United States Patent 9,328,346 (POLYCOMB-ASSOCIATED NON-CODING RNAS) - sequence listing, part 5

SEQ ID NO: 509 - RNA, 5232 nt, Mus musculus
agguaggaaagaaauguuuauuggagucucggguuuccugucucuuuaggacacucuacaugucccugaauucuagacucuuccuuugagaucucuuaaucuuacaacuucucacccucagauuugaccuccugguccguacccagaauucuuggacacaagauggaaugaacucacuaacguaccgacugcuggcaagagagcuggguccucucuauaccaacaucaccgcagacaucgggacugacccucgggguccccggucucccucugguccccgauacccaccugguuccucccaggccuuccgucaagagaugcugcaacgccggcccccagcuaggccuggcccucugcccacugccaaccacacagcuccccguggcucacacugauucucugcccacuguaaucaugagacugaauuggagggguugugucccucacaccucugcuccucacugcucucagagggaugugagggaauuaacccuagugcugugcuagggggcagggaccucuucucacugcuagauuggagcugggcuccucuagaccuggagguuccucuuucuaggggucaccugucagggcuuaugacugugaaucuuugaugucauuuuaugugacgaauccugggaguccucugccccugggguaggagcagggcuggaccccaagucccuuccucguccauggacauuacucuuuuccaagagugaccuggcuucuccugggaccucugugaauauuuauucuauuuaugguuccuaagaagcugucugguggaggaaaccccuagccgggcauuuccugcgagugcuggaauggcugcuccuccucuggucuuggccccggaggggcgggggcugggauuuugauaucuuuucuaauaaaggacuuugucucaccuuugcuugugauuucugcaucucaggccacuuaauccucucccaccacccucaccccugacaagucuauagggugaugaauaguaaagagcaaaccaagcucuaccaacuuuuacuuucaugaguaggaaaguggggguggggacgggacagggggcuugucagcuguuagauucugugcccaggacagcaacugcugccuggcgcccacucucuauacagucauugacagcaacccccucauaggaggcuccagccaaagucaggggcaaccucugggccgucaggaauugcauagcugagucugaaagguaagggugaaagcguuuuagcugaggucugacacccucagcacagccgcucguccguccagcagcucgcccagcuuaccuaguuuuugccaguggccuauuguauacugagggauacaguucuaaggagagagaagaugcaagggaaaguuuaugagugacuuccgagcccuuggcuugauuaacaugccugucgucacuuccagggcuuucagcggagaaugaguaaguuugacucaccuuguguagauggaccaggcagugacucggugguucuuucaguccuaacuguguggcggcugccuccugggcuuguugcuggaacagcucuggagacaguugguggcccgcagcuuuuagcuucuguagccaguaaccucccaacaucaccuacgaggagacgcagcacugaccagcccgcccuugccuauucugcagcacagagaagccccauggacaccccaccccaagccaugcuuccucucacagucacucugaggcuugggggguucccauccuguucaggaaaagccaccgagucguacacaauucccaggacagucgggucuucugacgauggcaccaaauguccaaaucccuggagaagaagaugucugugggucacagggaauggcugucaccgagcccgugucuccacucuucuuccucuuauaccuggacaggcagacaagcuccucgguacugcagauucaccacagcaacagacacugccuugaugguacucaggauucgagcuagaggugcagccucggcagggagcagcuugcugagcucuggagagcaggcguucauucuaggcuagcucugucuuacuagcccagcccaggagccuguguggcccugcuggcauaugaaggcacacuauuguccccuuaauggcuaggaaagggaagggcugucccauuaccugaagcuggaauggcacuuauaauguggucagccuccagacugcuguccccuagagacaccugagugagaagaaaacuugaaagacgguguuaugaggacuuuguggggaaggugagauuugcugccucgguuucagagguacucaagagguaggaaagacugggugcugacccaggaugaaggauaugagugacaagaucacuucaaaaaccaagaaacccucuguguaauccagaaagugggccaguucgccugcucuggaauguucagugaagguggguggcucugucccugucacgucgaaagcacuacuuccgcucacaggcuuuaccuaaggacauucugaggaagguucacaaauagagccuagcaaccugagguagccaguaucuacagagcuucccuaaggcaggaaaacaguacguccaaugcuaaggguuuaaccugaccuggucagccacucugacaaagauggugccauagucuguggaugugugcgcgugaguggugagugugagcaccuguggaggucaggcccucugcaaaggcaguacgugcucgcaacugcugagcucuuccuucagcuuucucucuucccagaggaagacauuuauggacaaaaagguaucauugaccuaggaggcagacccaucugaggaauaccgcagggcuuagcaaagacuuuaugagucuugugacugaugugugugcagccauggcagcucgcaggcgacagaguauuagaacgguggcugucugaggaaaugguaucaugauguuuuaaaagcuuggacgaaacuuaaagaaauggauguugagcaaagaagccccccuccuccccccgaaggccuauuuugcuauaaaaucaggucguguacauuugcauaugaaacuuuuugccaggugaaauuuugcaauccccgauauaacaacaauaaaagcaguaacacugacguagguucgcuacacuccagagguucuccuaccuuccagcgcccuucuggcugaaggcugagcccacagacuggcugcccacugaggacagugaccccuuuacuugcuaggugauugugaagagccuggggcaacaccuccagcccuccacggagugaccacuggcuccaucgcucagcccgggccugacgaauuagugaggaauccggcuggggacucuguccuaaaaggagggguggguggguaaaagauuaaacuaguaccccuuguacacaguaccucaguuuguccucaggcuuuuuuuuuucacccucugaaccaaucaaugcugccccucaccugcgcccagcagcagccccagcaauauggaccgguggguuuguucagcuuggaagagacugggaaagcaggaccggaugcugagcucccggcuguugccagcaaauacuccucggcaaagacuguccauggcuaaagaugccaccuuaagaguaagacugggacugagggaccaaggaauaagccacccugacugauuuccauuggcccugcuugugagagacuaagggaaggagagaguuuggguuggagauguucccacuguaacaaaaggaugggaaggaaaggaaggcauuuauucccaacacuggguuuuggagauuccagcaauagauaguggacauuccuaaaugauucaagaguccccgggguuaagucugaguuagagacucagcaacaggaggggaagagguuugagaccaccucugagcaaugucaccucagguccaaggcggcgcugggcaaaacugugcacaguuucaucaggcucuuugccccugggcuucagcaacucccucagcccagcccaaaacagagguuuugagaaggggggugaaggacggaguagcccccugcauggaggaaggcaugguugaaaagaaaacucccagauucaccuuucagaggguucuuuucagccauuagacccccuguggcuggaaggccugacagggagcgaaagggggguguguguaauagugagguguuaccugaggccggaggguagagggugcaggguaccgccuacauacaggaaccuguucugggcagcugggugauccccucggacaggcaagacuucagacuccaagccaaguucagaaaccuguucuccacaagcccucaggaagaggagaaacuaaggaaaaacugacccaacguuuuuccucucugcaacuccgucccuuuggagaacucuccuccacuaccuguccuacacauuccacaagacgcucaccaggagcaggguccgggcucccagggcuccagccggccuaaucccucgagguccaaguucaaagaucgcaccaucugauccucggauugagcggauccauccucccaaacgcuugcugcccuccacuaagaucaccuggcgccaaaagugaagcacugucgccacagggcaaagggacugggggucgggggaagugcauauuucacggaacaaaaaucuaugcagcuuuugcuagaaauaucaagaguauuaaaugagucuuucucugguacuaguggggacucaccuuaggaggacuggggccucggaucagaugauaacuugcggccaauccacugauaccuccgccaaguacuaucacaguccggcccaucguaaggccugggaaaaggucgagauaccccaggagaacggggcaggggagcacucuguuuuacaacugcagaaacccccacuggucccauaccccacuucuggacacuuacugauuuaugagcaacuaaugcagggcgcgcguguacgugcugguggaagaguaaggucuucguucugaagccagaacuuacccacgagauagggggaacccgagaaagugagugacugauagaggcccuaggagcaguccauccuguccgugugcagauaagggccacgcccacgcuaucuccccagcacaaacccuucggaggccagaauucuacagcacucgguuuuuccagccucaggggugagcagguucaagucugguauccccgccccuaacuuuuagggucccuccgacucuccgucgauuccuuucuggcggccugcgugacugcguuucacuuuc

SEQ ID NO: 510 - RNA, 5232 nt, Mus musculus
gaaagugaaacgcagucacgcaggccgccagaaaggaaucgacggagagucggagggacccuaaaaguuaggggcggggauaccagacuugaaccugcucaccccugaggcuggaaaaaccgagugcuguagaauucuggccuccgaaggguuugugcuggggagauagcgugggcguggcccuuaucugcacacggacaggauggacugcuccuagggccucuaucagucacucacuuucucggguucccccuaucucguggguaaguucuggcuucagaacgaagaccuuacucuuccaccagcacguacacgcgcgcccugcauuaguugcucauaaaucaguaaguguccagaagugggguaugggaccaguggggguuucugcaguuguaaaacagagugcuccccugccccguucuccugggguaucucgaccuuuucccaggccuuacgaugggccggacugugauaguacuuggcggagguaucaguggauuggccgcaaguuaucaucugauccgaggccccaguccuccuaaggugaguccccacuaguaccagagaaagacucauuuaauacucuugauauuucuagcaaaagcugcauagauuuuuguuccgugaaauaugcacuucccccgacccccagucccuuugcccuguggcgacagugcuucacuuuuggcgccaggugaucuuaguggagggcagcaagcguuugggaggauggauccgcucaauccgaggaucagauggugcgaucuuugaacuuggaccucgagggauuaggccggcuggagcccugggagcccggacccugcuccuggugagcgucuuguggaauguguaggacagguaguggaggagaguucuccaaagggacggaguugcagagaggaaaaacguugggucaguuuuuccuuaguuucuccucuuccugagggcuuguggagaacagguuucugaacuuggcuuggagucugaagucuugccuguccgaggggaucacccagcugcccagaacagguuccuguauguaggcgguacccugcacccucuacccuccggccucagguaacaccucacuauuacacacaccccccuuucgcucccugucaggccuuccagccacagggggucuaauggcugaaaagaacccucugaaaggugaaucugggaguuuucuuuucaaccaugccuuccuccaugcagggggcuacuccguccuucaccccccuucucaaaaccucuguuuugggcugggcugagggaguugcugaagcccaggggcaaagagccugaugaaacugugcacaguuuugcccagcgccgccuuggaccugaggugacauugcucagagguggucucaaaccucuuccccuccuguugcugagucucuaacucagacuuaaccccggggacucuugaaucauuuaggaauguccacuaucuauugcuggaaucuccaaaacccaguguugggaauaaaugccuuccuuuccuucccauccuuuuguuacagugggaacaucuccaacccaaacucucuccuucccuuagucucucacaagcagggccaauggaaaucagucaggguggcuuauuccuuggucccucagucccagucuuacucuuaagguggcaucuuuagccauggacagucuuugccgaggaguauuugcuggcaacagccgggagcucagcauccgguccugcuuucccagucucuuccaagcugaacaaacccaccgguccauauugcuggggcugcugcugggcgcaggugaggggcagcauugauugguucagagggugaaaaaaaaaagccugaggacaaacugagguacuguguacaagggguacuaguuuaaucuuuuacccacccaccccuccuuuuaggacagaguccccagccggauuccucacuaauucgucaggcccgggcugagcgauggagccaguggucacuccguggagggcuggagguguugccccaggcucuucacaaucaccuagcaaguaaaggggucacuguccucagugggcagccagucugugggcucagccuucagccagaagggcgcuggaagguaggagaaccucuggaguguagcgaaccuacgucaguguuacugcuuuuauuguuguuauaucggggauugcaaaauuucaccuggcaaaaaguuucauaugcaaauguacacgaccugauuuuauagcaaaauaggccuucggggggaggaggggggcuucuuugcucaacauccauuucuuuaaguuucguccaagcuuuuaaaacaucaugauaccauuuccucagacagccaccguucuaauacucugucgccugcgagcugccauggcugcacacacaucagucacaagacucauaaagucuuugcuaagcccugcgguauuccucagaugggucugccuccuaggucaaugauaccuuuuuguccauaaaugucuuccucugggaagagagaaagcugaaggaagagcucagcaguugcgagcacguacugccuuugcagagggccugaccuccacaggugcucacacucaccacucacgcgcacacauccacagacuauggcaccaucuuugucagaguggcugaccaggucagguuaaacccuuagcauuggacguacuguuuuccugccuuagggaagcucuguagauacuggcuaccucagguugcuaggcucuauuugugaaccuuccucagaauguccuuagguaaagccugugagcggaaguagugcuuucgacgugacagggacagagccacccaccuucacugaacauuccagagcaggcgaacuggcccacuuucuggauuacacagaggguuucuugguuuuugaagugaucuugucacucauauccuucauccugggucagcacccagucuuuccuaccucuugaguaccucugaaaccgaggcagcaaaucucaccuuccccacaaaguccucauaacaccgucuuucaaguuuucuucucacucaggugucucuaggggacagcagucuggaggcugaccacauuauaagugccauuccagcuucagguaaugggacagcccuucccuuuccuagccauuaaggggacaauagugugccuucauaugccagcagggccacacaggcuccugggcugggcuaguaagacagagcuagccuagaaugaacgccugcucuccagagcucagcaagcugcucccugccgaggcugcaccucuagcucgaauccugaguaccaucaaggcagugucuguugcuguggugaaucugcaguaccgaggagcuugucugccuguccagguauaagaggaagaagaguggagacacgggcucggugacagccauucccugugacccacagacaucuucuucuccagggauuuggacauuuggugccaucgucagaagacccgacuguccugggaauuguguacgacucgguggcuuuuccugaacaggaugggaaccccccaagccucagagugacugugagaggaagcauggcuuggggugggguguccauggggcuucucugugcugcagaauaggcaagggcgggcuggucagugcugcgucuccucguaggugauguugggagguuacuggcuacagaagcuaaaagcugcgggccaccaacugucuccagagcuguuccagcaacaagcccaggaggcagccgccacacaguuaggacugaaagaaccaccgagucacugccugguccaucuacacaaggugagucaaacuuacucauucuccgcugaaagcccuggaagugacgacaggcauguuaaucaagccaagggcucggaagucacucauaaacuuucccuugcaucuucucucuccuuagaacuguaucccucaguauacaauaggccacuggcaaaaacuagguaagcugggcgagcugcuggacggacgagcggcugugcugagggugucagaccucagcuaaaacgcuuucacccuuaccuuucagacucagcuaugcaauuccugacggcccagagguugccccugacuuuggcuggagccuccuaugaggggguugcugucaaugacuguauagagagugggcgccaggcagcaguugcuguccugggcacagaaucuaacagcugacaagcccccugucccguccccacccccacuuuccuacucaugaaaguaaaaguugguagagcuugguuugcucuuuacuauucaucacccuauagacuugucaggggugaggguggugggagaggauuaaguggccugagaugcagaaaucacaagcaaaggugagacaaaguccuuuauuagaaaagauaucaaaaucccagcccccgccccuccggggccaagaccagaggaggagcagccauuccagcacucgcaggaaaugcccggcuagggguuuccuccaccagacagcuucuuaggaaccauaaauagaauaaauauucacagaggucccaggagaagccaggucacucuuggaaaagaguaauguccauggacgaggaagggacuugggguccagcccugcuccuaccccaggggcagaggacucccaggauucgucacauaaaaugacaucaaagauucacagucauaagcccugacaggugaccccuagaaagaggaaccuccaggucuagaggagcccagcuccaaucuagcagugagaagaggucccugcccccuagcacagcacuaggguuaauucccucacaucccucugagagcagugaggagcagaggugugagggacacaaccccuccaauucagucucaugauuacagugggcagagaaucagugugagccacggggagcugugugguuggcagugggcagagggccaggccuagcugggggccggcguugcagcaucucuugacggaaggccugggaggaaccagguggguaucggggaccagagggagaccggggaccccgagggucagucccgaugucugcggugauguugguauagagaggacccagcucucuugccagcagucgguacguuagugaguucauuccaucuuguguccaagaauucuggguacggaccaggaggucaaaucugagggugagaaguuguaagauuaagagaucucaaaggaagagucuagaauucagggacauguagaguguccuaaagagacaggaaacccgagacuccaauaaacauuucuuuccuaccu

SEQ ID NO: 511 - RNA, 6670 nt, Mus musculus
  misc_feature (1828)..(1828): n is a, c, g, or u
acagccgcuuucggagucaguuccguggagcggguuaaccuguucguguccuaaucggaguuaguugcaguaaccggcacugccuuccccagggacaggacagcgaaauccuugagcauuccccagcucaagcuucccaggucuguggugaaaacccuggaggugggagagccccacgagcuuuaguuagggagaaagagagagacacuuggaggccaguccguggggagaaggcuccauaaacagcuccuugauguuagcaacagacagggccuacgggagcaagggccgcccggcaacgguaccaguguuugucaacagggguucuuggaugccuugcccucgaggggcaguaccccucucaggaaaaaccggcgugccaaugccugcacucuaguuucaggcuuucccgcaacuucacaggucucaggguuugucugccuaguuccacuaaacucaguguuuggguccaaggcuggggccagcucaaucccuguucuuuuccuucuguugugagagcgcccccaccuguccagagacagaauuggggcccagaaaggcuccaauugaaccaaaauucuagauauccauucccucuuauccacaaauacaaacaugaacaucacuuuuuucuuaauaaauuuauucacaaaaaagugagauugcagagguucugggggcuguacauggucaagggucuggugguuucuguacaugggacaggaaaacaaggcggaaggguacuucuuaauaaaaaaaauaacgggagcuacaaccaacccuccuccccuccccgauuaaaaagacacaaaaauagacgucugugagguaacugggggcuuaaggguguugggaagguuuucacaggugccagggcuucaagauggugucacaggcaccgaagugguuccugcaucaauugguagaacagcacguagcccucacuggaugccaccugauuuucacugacaggggaaacgcugagaagagaaacgggacacggcuguggucaguggucauucuuguagauucccccuccaucccacaagacucagaguagccagguggagaucaggagagacucuccaccuauccuuugucaggaacuuaucuuuucggagcuggggggggggcggugggagggggcaggaguugaacaagaggcuauucucaccgggagucauuguagacaugccaaccagucuggcaccggcacagggcuguguaguggccauaguggacacuacccgagugguugcaaagggcauacagcugguagacagggcuuccugcggguuaaauaacaucaguuuccacacccaguugugucucccuccugaagauucuuuaggagguucccugccagacucacccgcuuugucgcuggcaaaguccccuaggcuuagucucugcagugggaagucuacaccuacugaacuuuucuugauggagccucgggagguggaaaaucgguucagaucuaagcccugguuaaggagcacuggggaggcuaagggucucuaggggggacugcaguaauaaauucaguacccuccauucccccaacacauccugaaagguggcaaagaaagucaggguggcagguuuucccuaagggaaacucaaacgaaggcgaggagacacuguaugggagauacccuaagagaaauaagaacgugaagauuaggauauggagcacgaggauucgggggaaucuuuguacugucaacuuuuugguacuucggguuuucugccgacaucggucacacaccuaaauaaacagcaaauaguguuaggucagggugcccucaccuaaguugcuuuuucnugacacccccaacuuacacauaaauuuaguuauguuucucauugcuuugccccucccccccccauaaccuagguauacgaggacauaccggagaccccuaacacacacccagacaaguaacuguuauucccaaaucaaggagacaugcauuucccuuuauccagacagacccucccaggucucccccauuaaagucccacauacuggggcauucuccgacucuagcucuuccuccuuggugaaaaggcugaagcaaucccgcaaagacacuuugcccccagcaaauccuuucuagggggaaaggggaagugagggucagcauguucugaguuuccuuuuuuuaaaaaaauccuuuuuuuuuuuuuuuaaauccaggcuuuaauucugcuuuagagacccacacaguucccacccacacuuaggagugcggaggggugggucacagaaccccuguuccauccaccccuggaaucuacuggaaucccaccuuggggaugggcagggacaggucacaaaaaaccucgaaggucguggagcgauacccacaggccuggcacuugaggcaacuuuucaacuggcccacaaacaggucuagguagaagcaaaaggcagaagaaguuaccgucagaugccuaaagugcucacucuccuagaacaguugguguucuccccgugccucugaccugccuuucuaauacagcacugccacucagcgccacacagcauuuuacauccuuggcaucuggccuugcccccaugcuuccuucucccgagccccagcucccacuguguugccccacugcauacccacccacaaucuugcugucuucucgcuccagguagcgcuuccacauuaaguuggcucggucaucaucacugccacagagcaagggaagggagcaaccugugagacagcuauaguacugggcggccccaaccacggaaauuauccacggaacccuggucccuguccacauaccagcuccuucccuaaauuccuagucaaaggaguaagcaaugccccugggaacuuucuggggaaauccaagaugaaaggacacacauacauauacauuuauauauguauguguauauauacacaugcauauauauguauguauauauauaaacacacacacauauacacagggccaucuuccucuacaagcucuuugauauauuugauuguagacguucucuccuuccccagcucagugcaucucugacucuauuuucugccucuauauguacuuucccaucuuccucccuuccuuccuuccuucuuuuuuuuuuuuuuuuuuuuuuuuuuuuccugugcuaaagggucucuccuaggcccuacauuucaguuucgguuagcucaguuccgugauaacugaaagcugauagaaguacugcggagaggagcaagggggaacaacccuuaccucaacucagguucuucaugcagagccccuccuccucggcaagguggagagggaacugguccgcuggccaagauuggcggugcccggcgcccucgucgguugaucucaaggugcaaccgcuccaugaggagcuucaggaacucuugggcauccugcuggcuacagccagacagaauaugggcaucugauccauccccucgugguccacacaguacccccugcccaaauguggguucccguuuccucaguguaggaaaucucaaggcuuacaacacugcugccagagccucagcuuguccccgcccccaaccggagccagagagaaaucccauucucucaguuuccccaccuguauccagagaaggaagggacguauuucuggaagacagcccggaaucgggugggauucacagcuucacaggagucagggugccagagggcaccaaucacaucugcaaaggcuguugguuugacaguggggaagggauucaaugcuaaugucuaggagagcaggcaggcgggaggagcuucuguggcuagaaaaucucuaggaaggaacaaacuggggaaaacggauguaacugccagcuugaagggcugggagccaugggaauugggaggauagaacugaagggguugggggagagagaacagaaggaucgggaguuguugcccaccuucugugaguuccugggcucggccuccuccgggcaccucuugccggaagucccuucgcagacagaagucucgaagaggccuugugcugcucaaacacuguagcacggcauucaggaagcacuggggaagcgguggggacacugcuguuaccuuugcagaccggugcccagcaggacugagagcgcuuccugcucuccggcaugccucuccugggucugugccugucuccacccccaacaccaucucacaucccuuuuacagagaaggacaggaaaguggcucuuacuguauuuccuagauuucggaggccaacaugaccagagcccagaagcaguguguggugagccuagaaagucagaggacagucauauucuaccuggcgcuuucaauagcaugcugcugaaugucuccccaacccaacucgugccccaguucuacccuguuccccucacuggucauccuaccucacuggucaugaguaguaagcccaucacagcugaguguaccacagacucagccauggcugucacaccaaguccccauuuacuccgcugccaagcuagccggcgcugcagcuccugaggcaacuccccaagcacuggcaugguugcccagcugcuccccgcccccacuuuacugcccccaaaucccccuccugcccccguggccccuucuugcacccucuccugcuggcuccaacugcaagcagccuagcucaguuagcucgggaaauggggaaccacaccagcacaggugcucuugacuccgccccuccgcagcuccagggauuaauuaggucuaggcccaguccuaggagagauguugccuuaaaagagagugccuaaggacccaaggaagaauucuaaauagucgggcuaauucccuagggacuagaauggcacaccaaguuggagaaucacauacaacccaaaauaagaucuagaaggucucagaaaagacaagaauccacugguguaaugaggaguugacaaagggacucagagaagggaacacaggaaagccauaguaugacaaaguugaaggcaagaggaacaugagcaugggagagaccacgugugcugucaaguccucaccaucuugucaucagaguagaaaggcucagaaggccgggcagauaucauguggaaggagccaugggaaguagggggcucuguccguaugcugagcaggguaggggggccagggaagcccccaagacgccggagagaaguacuacgucucaaaguggguggcucaggccggagugccaagcggcucagugcagccccuagcucgccagcgccacggugcccucccaaggcaauccccauuggacgcaaguccccacugcucacagacuuggaacgggcuaaguugguccgggaugggagaggcagagccacagcugggggcggugagccaggcaggggaaccccaugaucugcucgaaggggaccucuaggacgagagccugagguccgaccccgacccagcuccaguuucuugagccuuucaucugggggaccuggccugggaggcaaaggucguaacauggaguuuggcccaggaacuggguuucggcgcuccuugcugcgugcccggggaggaaaugguaucuuggcucccacucggggcuguacauugacagguggcucucgaguccggcccaggcggugcucagaagccuggggcauugugggcaccacaggcuggaccugaggagaaaagagagucagcguuugaauuaggaagggagagaagauacaggcgaucaugcaagcugucuucuucauguaccgaggguacauauaacguuuauaaaaucaguucuugcaucuccaggaccuggcaauguuuggcauacgaaaaauacuuaguacuccuugaauaaacaaaugauugaauagcagaccaucauuuugaccuuuucaugccccacccccucucuauagaauacagauuuauuuaaaagccacugguacucucaaucucagcuguuuuuauaaucuacaaacuccccauauguggcuagucaagugggaugugccauagaccugggacuguggacgcaggaaucaguccaaaagacagcauuccaaucucaaccccagcuccucuggguugcaaaugaagcggauuaaacgggugaucugcaauccacucccuccuccaauucugggauccuacuugguaucugggcccaggggggcaaugguuugagauggaggacgaacuacuugaccccuaauuugugcaccucucccaccacagcaggguuuuacccggguccgccccccucgagggcagaaaggccgaggcugcugauuggcugcgggguccggcggcauauuccccgcgguccgagaaugccguucuuccagcccaguucucccaggccccgcugggcaccgcgagcaucccccuuuguggugaacguccucuggggucuggauccauccucccucggcucucccaccccaccccgccauaacgucccggcccauaccugucccccggugaggcggcgggggaggccagccgggguccagcuccagcucagggccacccccucuuauccccaaacagccuccccacaggccgggcugcagcuuuagccgcagcuguugcccagcuugcucccgccgcaagggccgccgccaucuuuguuggugccgcccggccaccggccaccggcuucacagucucuuaggcgccugcgcgcccacacucggaaucc

SEQ ID NO: 512 - RNA, 510 nt, Mus musculus
uucaaguuuuuuuuuuuuuuuuuuuuaacaaaaauauaccuaaaagcgaagcuucuggaaaaaccauuuguucuucccugucuuguaucgcuccucaaacuugaccuuggccucccgccuggccuugcgcuucaaagcugggucccugaacacauccuuguugacaacagucuuguccaaggggauauccacagaguaccuugugggcaugaggugguuguaguuauaaacuuucacaaagaacuugaucuuggaucgcuuggugaucuucuucuugcccauggcagcugucacuuuccggggauagcggucaauuccagccaccagggcauggcuguaagggcgguccaaggugccaucgucaauguucuucacgaugacggcuuugcgucuggaauagcguccggccaggaccagcaccacuuucccggguuucaugaacuugcccaucucgacagcaggcagccggcacccagcagaaaggaaaggagggcacuuccucgcuucaag

SEQ ID NO: 513 - RNA, 6092 nt, Mus musculus
uauuuuuaaaucuaaaagugaucuagcuaggucacuucugaucucugaaggaaucaaacauaguagggagaucccucugcauccauguucauuuguuguagcacuagucacaauauuuauguuuuggacuuugccuaaugcccaucaacaggugaagggcuaacaggaaugggauuuuauuccgucaaaaaaaaugcaauccucuuguuugcaggaagaugaguggcacuggagaguauuguguuuuguaaaagucagauucaaacaaauauuugaauauaauguagauuugaauauaaauacggcaugacgguagaacuuugguguacaagagaggaggaggagggaugaggagaaaacggccgugagcaaaguacacagugugcuugugugacgaugucuugguaaaacccaucuuuuuucuuuuucaaauguacucagaaacucuguaaccuuaacuguccuauaauccgcagccuggccuugaacuaaaaagaucagccugccuuugcuuauacagugcugggauuaaagcugugaggcaccacaaccagcagaaacccauuaguuuauaugaugaacguggcucacacacacuccagagccauagucacucauguaugcuucuagaacuaagugucucuauccuucucuccaacaguaaguguaccaguuuucaagaggguuuuuccucacugacacucuucuguccccauggggaagacuuugccuacucuaguuguuucaauuuuuuaaaauuauuuuugguucauguaucuagcaaauauaaaguguuugccugcauuuguguaugugugccccaugugugccuggagccugcagagacgagguguuagauuccccgacacuggaguugcagaaggucaugcugcuacaguagugaaaugaccuuuaacaccuuuaauccaagcacuccagaggcagaggcaggcugaagccagucagggacacugugagaccuugucucaaggaugcuagcagcugucaguaacaaagaucuaagggcuuuaaagaugacuguggacagaggugcuugcugccaagccuuaaugacaugagauuggucaccugagccaacagcuucagaaaauuguccucuaaucuccacauguaugccgugguacacacauacacauauacauguacauaggcauacaucgaaauauaauaaaaaaucaguaacauaguggcuuuuuaauaaguguuacaguuuuccucuuacccagcuagcuuccaaauaacugagacuggacuauuauauuuauuuaucaaguuuuaaugguacaacaacugagugguauugcucuauuuucauccucuaagcuaaucuugcugccucccagccaaaaucccagaaauacuuguauuuuauggcuuucucuacucaagcuguuuucuccugcuuucucuuugacucucucccugccccacccucugcccuggcuaggaggaaguccaguguggagagaaucucuuaaaagaaucaccugccaauaaaaaagccaguggccaaugagcugagacagaaaauaaaagguaggacaauggcaggaagagagaauauucuagaaaaauggagacuaaaaggagacacagagacauuaaagagauuugagagagacacugaggagacuggaagaaaagcaagccaggacugaagagguaacuaaccaaaggguagacacagaauaguuuaaauggauuacguuaguuacaagcuagucagggcaugagccaaagccuguagccaaggcauuuauuaauauaagucucugagucaucauccugggaguaggggcuaaggggacaacagauuuuuuuuuuuaauaguccaacccgagccgggugugguggcgcacaccuuuaaucccagcacucgggaggcagaggcagguggauuucugaguucgaggccagcuuggucuacagagugaguuccaggacagccagggcuauacagagaaacccugucucgaaaaaaaaccaaaaaaaaaaaaaaaaaaaaguccagcccuauccucuucucuguucaaucauuggcugaucagcuuuuuuauugaccagugagggaauaacuggggaguaauaguuacguuuacaacauugaaacaagagauucucagaauaaggauuguaaucagguacgggagcagcacagaaaucagcguuugaauaaugcagguauaaccucaaacacugcacaggagcauuaugccgaccacaggagaggacagagcucaguugcuggagcaucacccagugugagaaaagagagacucugaaacaaaccaaagaaaguuuuaauguuguuuauuuguaaguuuugagacaaggucuuucuaugugucccuggcugccuggaacucaauauguguaccagguugcccccaaauuccagagaguuccgccuggcucucuauuucugagauuaaagguuaugugucaccuugauacaccaaaagaaaauuaguauuagauauaguugacuugagucaaaaauaaaugaaacagaagaaauaaagaaaggcacauugucuuggcacuugggagguuggggaaagagaaucagaaguucagguuuuuuuguacauaguuuggggcaagcuaagguucaagacauacaccuugucucaauaaaauaguguacagguccugauggaacaggccaauaaucccccaugcucacgaagcugagaugggagaaucucaaggucugggcaacuuggugaggccuacucagaaauuacaacaagcaaggccuggggcuggagcacacagcauuggagcaauggcucuucuucaucagguucaguucccacacagcucaguggaaacaaaacaaugcuaacuaaagaccugggcuagguugccaagaaauggagccauaugguuuguagaguuucucuuuauaccuuuuaaauuuuaaucuggccuguguuccucaaaaguacuuuucccccuugagacagggucucaguauguaacccuggauggccuugaauuaacuauuuaaaccagccugaccuccugcgauagucaggcccagucuuguagcauaacauuuuauuuggcccuuuaguguugguugcaucuuggaauucugggaacaggaggcuuaaaaaaaaauaacaaaaaacagccugcagagacuggcagaaagggagugagauucagguguggggcugaggaaguuccaggagacaaaagaagagggucagagacuaggguuagaaaagaagacaguugaugauagcugagacagagaagauauuguuaggagacagaagaacccacaaaguaguaaauaaagaaaaaguaacaauaaaagcuacaguuggugaugaaaguggggcaauuuguaggaaaaagaaacauuaagagacaagugccaccaauguggcagggcggcaugggaggcuugguuucaaguacaguaaagcagaagccgggaaaggaggaacggauagaugcuuuguuucagaagccaacaggguuugcuggggcuguuucuggaacaugcuuccuucccaugguuuuuagcagcagguccuagucaucaucuccuucaccccucuccccauccucuuuuuauguugcugcugcuguuuuccucauuucgggauauuuuguuuauaaaauacuagcugagcaacuggggaaaaaauuaagguggaauuaaagaagcuugguauuaaaaaaaaaaaaaaguaaggaaaacaaauagauucauucccagugacugaaccagagagaggaaguuucccccagguagaaggaggggaaagaacuguaucaaaaggcagucaagucaaaaaaggaaaagaaaaacaggaggauggucagaguuaaacccacagcacucagucacaaaaaucaacagcauuuccaguaguaguugggauaaucuuuuuguacacugugugugggguccauccuuuccugucuaaggcaccuucucaucgauugauuuaauaaagaucugacuauggcugaggcaggagaggaaaggugggcagagagggggacagggaaagaauagggugggagguuuugccagccagacgugggggaucgaacaguugcccagaaugaaagagguaaugagccacguggcaaagguggguuacuacaaccuaacugggaacaagacuaagcuauaaggccuaaguuuucauaaauaaaaauaauucucugugucauuauuggaagcugguagugguucaagacagucuggugcauccaauguggggcuagaaauccaagcuuagggucugagaagaguucuggagggaagguggggaagaagcaguuuccuaagggaggggagggccgcaagucacuuuaccauggagcuaguggaggccugugagcaggaaguaagaaguggggaaccagagccucagugcaagaccucucaggcaagcaacugcucagagcugggucagagcacccagagcuggccugugccugcuggugaaccacagaacaguaccucuguuacccagagguggggcagguagguguggcucccaacuguuguccaggaaaacuggcaagggaagccugcuagaccaagcagagucaggcaaagccagcugccauccacaggcauuggccugaggagccugcaagugcacaaaaggucagaugggacauuucacagagccacagugggacugaaaagccccuaccuucugaacaauuaauguauaagucugaaaaucauaaagugauguuuaugaaggaaggagagaguuacagagauuuuuaaaaaauguauguucuguuuuaaaaaaugaagacuaccaugacaagauacuuggauuccauuuuauuuuauuuucaucaucaucguacaaauacuuaucuuuucaguaaugauugcaauuuuauauauucuuuuaagaaagaucauauuaaaacagacuuaaauaaagagaggacugaaaaaauugagcacuagggguagaacaaauuagacaauccuuuggaucagaauaaaaaaaaaaauugucaggaauccaaucuaaaaccuggggugccaccuugugaugagacugcagaauggcagcucauagagaugcaauauucuacauuaagacuacagaguauguuuaaugccauauuagagcaaugucauacaauaauuauguguuucauuuuguagaguuugaaguuuuaaaguauauacaugugguaacacagcauacaauugguuuguauucaggacuugaaggggcuuucuuaaauuguaaaaaggauuguuccaaaacugcacauuuauuagagguaauagcuaucuuggagaugccuugguagauugaaacuaaugauacuccauguguauccaguagaauaaaacaauuuuuuuagacauuuuggcauaaaacauguuacagauauaacuuacaaucaugcaggucaagugauuguaaaaagauauaacuacacuuuaaaggaaaugcucauagaacagaagggguaaaaaauuuaaauaccagucagguagcacagcugcuggggggaaaaaaaaaaaacccuggauuuuagaaaguccugcuaaguuaucaggcuaugaaugucguaaucuccgaauggaggucaggaaauguauugcacugggggagagguuaugucugugcuucauauguaugagaugaaaugcuguggauuccuucaaaguuaauaaagauuaaauuugaccagggaagaccuccugaaaaucuuggcuacagacaugaagaaccaaaccaagcacaacaauaaaacaugugagauguaugcagaucccucuacauagagacagcucugacaggcugagauaggaaugccuuuuuuuguuaucuauuuuuuuuaauuuuuuuauuagguauuuucuucauuuacauuuccauugcuaucccaaaagucccccaauucccccuccccaggaaugccuuuuuguagccaauaaucuuguuggguacuguuagugucaugauuuuauacacuguaaagauauggcucuguauuucuugcaugccuaaagcaccuucugauugauuaaaauaaaaacccuguggcuuuaaaag

SEQ ID NO: 514 - RNA, 14471 nt, Mus musculus
cagccguccuucacccgucagcugaggcgacuuuuccauaggaaaaugggagcucaaaaggaaaacacugaagggaugaauuccgagagagggugagaagcgcggcugcgagguucggguuucagaacgucagagugacaggaaguucaaggcaaaggugaacuccagaucgugaccuuucaccucaguucaccgggcaguccgacccccggccgauuccgcccuuacguaucauggcugccagccccucucucccgagggccuucgagcccgauaccagccagcucgggcgccaccaaggcuuccaccuucaaauacguucucucuccgcuucuuagaaccuccccgccgccgccguuaggagaacccugcguugccagcuugccccuaagcaagauggcugccagucuccagccucucuugccgacgugaagcuacccacuccccgcuuaaugccgcugccaggcugcccucaccuaguauggcuccuccgcucaugccucguuauggucucgaagccgacacuaaccggccagguuccgggaggcgcugugcaggaugcagccacccccgcccggcccuccccucccccacgcccgcggcggcggcggcggcggcggaggcggcggcggcuggagcccggaugcggcuccgugaggcgcaggccccggagagcggcgcggauggauccaacauggcggcgccgaggcugagccgagagugaggcggcggggcggccggccggcguggggagggggagucgagugggacggggcggggccgggcggggccgccaagggcuuggggaaggaaaguggaagggggaggcgguggcgacguccagcccggagaaccuccggagagggaggugacgggacgcugcgaggugggggaaggggagcggccgaggggggcgugcaggggagauggcaacugugggagagggcaggggucggggcgcaggagugcgagccuggggaggggcguaaacaagggcccaggcuggcccaggccaggggcaguaaagaggccgagguggggagcggggcugcgagccagcgcuggggaagggguaggagccggagggagagguugaggguguggaggggacgggggcugguggcauguggcugcagggagggcuggacucccgugagcgccguggugaggacgugggagguggcggggguuggggggggggguuggauuggacuugagacgugugccggagggagguuuuucaaaguguucaaauuggaagcggaagggccuaaggggagaauugggguggaagaggagaagagaagcggggcuuggcggauggagagaguggcgaugugccgggguaacguagaaagugagagacccggaggaaaguuugaaaggaaggggggaagauagggcaguggagcugcacgggugauagaggguuuggggguuucccuuuccccccuguggaagggcagcagaguuaagcaguaucaguugcagccaauuuuaauugccaggcgcuuagcuuuuaauagggugggaagggcagaaaggaauggucauguggguuuggagaauugggguugaaugaggguucaaccggauuugcuuuccaaaacacccgcuugcuuccuuguuuuuccugguuacaaauagggagauuaguaaagcucuuuccuagguuucuuuuuuucuuuucuugcaauuagcauuacaagaauagggaaagagacuuuucuggagccuuauauaccaagguggaggcucuggaagccugaggaggaaauagaagagacagacuggccucuagguaacaggcuaauuaaauaugcuuaccuuuacugacccucaaguuguaggagggggaggaggugucaauaugcguauuuaggaaaaaaaacaaaaacaaaacaaaacaaaaccaccguuuccuaccggaguguagacgugaguggauguugcuuuaguggucauuuuguuuucauugugugcugagggaagaggugaaguuugagucuggccucgugagugaccugaugggaaggaagagcugucuuuggcuguaacuuucccccuuccagucccccuaccacucauguuguaagaaacuagacggaauaagguauugaggaaggcgagacaguaucagggugaugguucauucccagaaguguugacuuggaaccuuucuugcuaugagccauugagacuagaaauuuugaggggcugauacgauauuguggauuuggucaguuugaguucucuguaauuuggaauaguucagccaaugaaaugacuuuaggcuuagaugacuuuuuuuuuuuuuuuuggcacugacacuugacuaacuguggaccuuugaaguuucaaaauaaagcuugaaauuuugcucuuuuacccccccccuuauuuguuuuuguuuuuguuuuugugcuggcuuugaaacuugugcuaggaagagcccuggggauuuaaguuucuugcaaagguaagucuggaacuuuuucuuguuugcacacaaugggauggaauggaaacgguaugaugcacugggguagaaccugcuuaaggagguagaugcuagggcaaaggaguucacgcucucugaguucguugcucagguaacuggagagauaggcagagggaaaggggguauuaaguguccugggacgaggucccagcuuugguuuguuuuugucuacccuucuggucagcucugagugaaacauuuaacauauggaaagcugugcucuuguacauuauguaugagauauuucuccaggaaggugacggaggcugagguacuucagugagaaggcucccccucccuaguucacugucucucccagcaguucagaguucuugguuucuuuuuuuuuugggugggagggggguucaagacaggguuucucuguguagcucuggcuguccuggaacucacucuguagaucaggcuggccucaaacucagaaaucugccugccucugccucccgagugcugggauuaaaggcgugcgccaccacugccccgcuucuugggauuuuuugaaaacauacuguguaauucugcccuccaaauauauuugguuacacuuuccuggucccgccagcaaggcagagcuucaugagcccuuagcucucuucaggauugcccagguaguuuuugcuucaaaguucaagcuguccguccuuucuguaagacaggaucucacuuuguaguccuggcuagccuauaguuugcuauguagaccaggcuggccucagacucagagauccaucugccucugcugcccaacuguggggaugaaagggaugccacuauaccuggcuguugucauuuuuuuuuuuuuuaaguucuuccacaugacuuucugguaagggcuucugagagagucaaguauuucuuuuuucuuguaaaaauauagauguaauuccucuuaaaagcuagacugccaguuucauuuaaagauaauucuuuuacacauccuuugcuuccguaagucaaaguacuuuaaaaaguuagaaacccugucuugaaaaaacaaaaaacaaaacaaaacaaguuaggauugucauuucuggaugggaggaucuagacugcguaggcacagaaacgcaguagagaguaaccuaucaggaggaaacugucuagguacauacagacucuuguuggcucuuacuacuucagaccucacuaaaggaaaaugaacuacaccuccaggaaauacaguaauugaucagaaucuagaauuuuucugugcuagggauguagcuccgugguggaacacuuacccacuuaaacccaaggccccuauguugggucccuaguacaaaaaaaaagugcacuuuaguauuugaacuacagcaaggacauccagugggucaguguauuuguuuauagcuguggaggguuugguuugguuuguagggucucacuguggagaccaggucggcuuugaacgcagagauccaccugccuaugccuaccaagugcugggauugaagagagugcaccacccuucccugccuacuguggcucuugcuucuugauauuuagcaguauuugagaugaccaacacauguguucuuguucaucugcuuggaggaggguguucugguaucuuucaucuaggagugugugucuaggcugggcucccuggccacugaaagcugaguauaaauucacuuuaagagaaaguuggugauguucuuuucauccugaagcuagauucuuagacacccuggcuggguugcugaguuagcucacaauccuggaugauaauuaaguggggagagcugccuaucagccugcgugcccgccucuugacauuauucugggagacgugccuugggaaaugcuugcuucuguguuuugcuucauuggcuaguguaagucugauuagagaccuaacaaggaagggccugcucucuagucuuguuuugggauuuuauaaauggcacugaagagcauuuguauuugucuugaaguuggcauuuuucuuauucccacaaaacuccagauugaacugggucaaaguagaccuccagggacggacaggaggggguaugucugccaccugcuauucaccugaauggcaacggcaggugauggaggaugcauugcuggggugaggugauugcgauagugggauucaugacuuaagugagccuaugucugacuggcccuccuuugcuucuagaauaagacugaauuguuucagggugaagacaccucacaguuuccuucuguagaucuaauaaggaaagugacaugcacccuuuugagccuucaucaugguucucuuaaaauccgauuccucaaccuuaacuacuguaggccuuuugguccugaugucuuuguuguuagugauuacccugugccuuauaugguguguagcagugccuuggccuugucauaugcuggugguguaacucccucuccacaaaucuggacaaucaaaacuguuugcagccguugccagauguccccuggcagagcagacugguggagaaccacugaccuaagaagcucugugauuucuagcgccuuggauggucuggccugggaccugggacuuaacagucacucucccccugucuagugagaggagugauuucucagaggauugagacccauugcaggaucacauugauuauauaauuaggacuauaguguuuuccuuuauuuugccucauuuucuagggacagaguauguguaugugggggugguuuuucuuaauugcuuggguuuuaaggacacuuugaauuagggaaaccaagcaacagucugcuccuccgauugguuggguaugaaaccugcccaucuguucucucugggauccuuauagucagcagcuggccagagggagcagugggguagggacgauggcagagucgcucgcaggggucugaagggagcucaguuuucccccacugccuacuugaguaagaaggcauuuuuccucagcaaccccauuugugcugagugacagcaggugaaaugaaaggaagagauaaggcuaaccagugucugaauaaugauuuucucagcuguuuccuauacuuuaggugaaguaccuaaggcuuucaaaacuacaugugggucauauuuauuuuuuacuugggauucuccucccuguccccaaaggagaaucugugcauuccugguugccuuacugugggcgaaaggaccaggcucuaucgugucucggcuaacucaccaucguggcccuucugaaggagcuuaccauuguguuguucuucucucuuugguacuagaaauggaauccaaggcccgucuucuagcguggccaguaucuuccacguguuaaguggucagaaccccaucuuguugaauagggugguuuggugugaguaguuuucugugguauggagacagcucugacuaggcagaauaugugcacgguuacugaauacuacgugucucugugcgcacuccccucucccccauucugagacgggugucacuguauaacuccgacuggccuuguguuuguagucugucccagccuuccucauucugggaugauagauaugcaggaacaccaccaugccuggcuuacauauuucuuucaugcucuugggcucugauagguuugguuuucgacugguguugcuuguauuaaccuccugcgaauuaagcucaguucucaacagcaggcugcggccacagcugccuacugcuaagugugaugaagaugaagaugacuuugacuuagcacuacuucauaaaccgugcgggaccaaaauaauuuuaguacacuaauguaaaagaaauguucaguuuucuguacgagcacagaagaccacuuaagucauccuuggagauagaaaguugacccccacccccaccccuuucuaagauagucuuagucauagcagcuggccucaaacuccuugagauaugcuugccucugcuuuugcauuagugggauaaaaagcaagaagcuuccaugcccagcuaaauuguuggguuuucuuuguuugcuugcuuuuuaaaaauuuuuuuuuuuuuuuuuuuuggaucaggguuucuuuguguaguccuggcucucuuagaacucucucugcagacuaggcuggccuugaacuuauagagcugggauuaaaggcauguacuaccaccaucauggcaaugacaguaaagugaaaggaagggcacauuuaagaaauagugugugugcuacaguaggaauuaagaucugacuggauggcuggaguuguggucagggcggaaugguaacucgguacacuacugucuugagagguaugaaugacuguaaaguggaggugaaaacuguuaguucuagaugauugguugaugacaugacacagggugaauucgugaaucaagcacagagcugugauugaucuuugacaaggguuuguuauaugccaucuauaagggacuguuagguuuuguuuuguguuuauauucuguuuuugagacccuaaagcccagacuggacucagacucccaaccuuccaguuuguuuguuuguuuguuuguuucuuccuuucuuucuuuuuucuuuucuuuuuuuuuuuuuuuuuuuuuuuucaugacagggcuucucuguguagcccugccuguccuggaacucacucuguagaccaggcuggccuugaacucagagaucugcuugccucugccucccauugacuuuaaaaagugugcaccaccacugccuggcucaaccuuucuguuucaugagcuaagauuauggcaugugccacuauaaucacuugccacugaaccuuugaaguuaaaggacaugcuuaaagucacauuaaacuaguucuaacuagugauuuauaucaucuaauucagcuucuguagcaaagauugaauugucuacuuuucaguuuugccuauauuuaagaaaugagccuggaaggugguagcacaugcuuuuuuaaucccagcucuaaggaggcagagacggguggaucucugggaguucauggccagccaggucuacagagagugaguuccaggacagccagggcuacacagagaaacccuguauugaaaagcaaaacaaaccaaagaaagaaaggaagaaagaaagucagccagccagucagccacguguggugguguaugccuuuaaucccagcacucagaaggcagaagcaaguagaucucuugaguuuaaggccauccuggacauaguuuuaggacagccagauuuacauagugaaaucaugucuuaaaaaauaagccggguggugguggcacaugccuuuaaucccagcauuugggaggcagaggaagguggauuucugaguucaaggccagccuggucuacaaagugaguuucaggacagccagggcuauauagagaaacccugucucgaaaaaccaaaaauaaaauaaaauaaaauaaauuaauaaaauaaaauaaaaaauaaauagaaaaagaaaacggaaauaaacgaauugcuuaggaguggggaaaaguaauuucuuuuuuuuuuuuuauauuuauuuuuuacguaaugucuaaaggcagaagggggcauuggaucccauuacagaugguuuuucagccaccaugugauuguugggaauugaacucagccccucuuuuguuaguuuuuuuaaaaaaagauuuaaaaugguuugagacaaggucucacuguguaguuuuggcuagccuggaaccucauagagaucuaccuuccucuauuuacugggauuaaagcuguauaccaccauucuaaaaaccagaaauuuaauuuuuauuuaguuauuugugugacugaaggugccucuugaggucucaggccagagcuggaguuacagguggauggagccuaucccugugggugcugggaauugaacuuaggucuucuggaggaacggcuggugcucuuaaccauuaacaccucuaaccccuuugagacaggguuauguuauuuaacccuggcuggccuaaaacucuguggaacacuagauugguuucccauucacagagauccuccugaauucuagguucaaagggguacacugcuacacuuagauauuguucuguuacuauguauauuuuguuguuguuucuguaagacuugagaauacagaccagguuuuccuggaauccgauccuccuaaccuuaaucuccugaaugcuagcuacaggcauguaccuccaugcccagcaaaucgguguuucaggggacuaaaagcaguguuuuggagacaagaggaacauuuggauaacauuuaaaaaccagccaaccaaccaacuaacuuugagacaguuucauauagcccaggcuggcuuugaucuugcccuguagcugaggauagccuuaaacucgugagccuccuuguguuuaccucucaagugcuggggcuuuaggcagcuuuaccagacuagcuuauuuugcuuuugagauagggucuaccuuauaucucugacaggacgaaacuugcugugcagaucagaauggcuucaaacuuaaggguaauucuccugccucuggcuccugagugcuguaauuauagguguauacucucauaccuagcugcaacagaaacgucugaccuaugcaguacuaaaaucacaaagcauucucacuccaggaucugacuguaucccuuguaggaucuugacucagggcaucgucuguugaguaugaaaagcauuuagcauuguuuuguuuugcuuuuuuguuguuguugguuuuugcuuuuuugagacagggucucuguagcccugaguguucugccacucugaucuacuugccccugccuccugagugcugagaugaaaggcguaugccaccacaccuagcauaaacacuuuaugauauuuaauaaacauauuaagcugagcuucauuaguagcacguuaagauaauaaagauaaauaaaauugguggcuaccaguggccccauggcucauggggucuugucuuaucuuacagaucacuggagauugcagcugcugagcagagauucuggaaagcacucuauuucugagccucuagcauggcgggccuaaagaggcgggcaagccagguguggcccgaagagcguggggagcaagaacaugggcucuacagccuccaccgcauguucgacaucgugggcacccaccuaacacacagagauguccgagugcuuuccuuccuuuuuguugauguuauugaugaccaugaacguggacucauccgaaauggacgugacuucuuauuggcacuggagcgccagggccgcugugacgagaguaacuuucgccaggugcugcagcugcugcgcaucaucacucgccaugacuugcugcccuacguuacucucaagaagagacgagcuggugaggccuuauggggucuggggacacacgacuaagagaagcucugugggaggccaggagugaguagugcagagucuacagggcggggcggucuugaccuggggaauaccuaggagaacagagauccuuugggagaagaaagauauguacuuuuucuugagugacuccuucuccuccugcagugugcccugaucuuguagacaaguaucuggaggaaacaucaauucgcuaugugacccccagagcccucagugacccagaaccgaggccuccccagcccucuaaaacaggugagaggauacuacuuguaauuuucauaagcaggagaacauuguucccaucacauguguggcugcgccaacaucagugacgggauacagucccucuccauccaccccauuaaagacauuaaagucccuguccauuaaagacaaucaggagcuggggaaauggcucacucggucaagugccagcugcauacucaugaagaccuguguucagguucccagcacccacacagaaaaagcuggguaauaaagugucugcaaucucaggguuggaggcagagacagguggaucccuggggcucauagaggcagccagccuuggcacacugcugaacucaaggcucaaugaaagcccuggucuaaagaaagauggugagaggauugaggaagacaccuaaugcugaccucugaccuuuacaugaggcacacucacauaggaacacaucuaugugaacauguacacacauaaagcaggugaaguauacuuugucuaggucuaguguuuauucuccuuuuagguuacuuuuuaaaaaucaauuuauguguaaaaguauacugucugcauguagguuaagccaucacuccagaccuuaggucaguuuuuaaaaaauuuuuucuguaugaauguuugccugcauauuugcuugugugccuuguguguaccuggugccuguggaggugaaucuggguccucugcaagaacuacacguccuccuaaccacugagccaucucugcagccccaacuuuuauuuuugggacuuccuauuuagcuuggguaaaugcagaacccuguguaggccaagauggccuuccuuccuuagccuuuuuuguuucucuguuuuuguuuuugucuuguuuuuugagacaggguuucuuugugaagccuuggcuguccuagaacuuacucuguagaucauacuggccuugaacucaagagauuccauuaccucugccucugccucccaaguguuggaauuaaaggugugcaccaccaccuggcuuccuuucuucacccuuaagugcucagaugauagauuucuuccaccauacuuagugcaugccaccugccaccccauugcuagggcugaguccagauauucaugaauguuugacagacauugauuauugggcuauaccccucagccuucagguuauaucaccaauacuuuuauucucaagucuagaugguuccuuugucuauuccaaaugaaagauuugaaguucuacuugucaaaccguguuuucccaccuacuuucugcucagugccuccccacuauccuguggugugcugccccacuucggguucucaaauguguaguaagcggccagcccgagggagaaccacacuugggagccagcgaaaacgccggaagucggugacaccagacccgaaggaaaagcagacaugugguaaggaaauucagggacuuuaacguuguagacuugagggaaaauauaaagaacuccugggaugaugggcagucuguaguucagugcaaggcaaucuuugcuguuuucaggucagguuuaguuuucaugagaacuguucuuuucagcaaugguauauuacaaaucuuuuuaguuacuauuaaagaaaugccaacgucauucuuauauaggaugaaccaagucaagacagaauuaaaguaaauuugugcaacuuuuuaauaagacaggucuucuaacaaggugcuguuugugaguggccugagcagagucauuguagggcauuguagggcagcuccagaauugaaaccagugacacagugaagaacuaguucuggggagagguaaagaagcugugagaagagggagggucucagccuugcuugcuugcuuuucuagcuuugguuguaaacacaauccauuauaaaccaugcuccuuaaaauucucccagauaucaggcuccgaguucgggcggaauacugccagcaugagacggcucugcaaggcaaugucuucuccaauaagcaggacccacuugagcgccaguuugagcgcuuuaaccaggccaacacuauccucaagucccgggaccugggcuccaucaucugugacaucaaguucucugagcucaccuaccucgacgcauucuggcgagacuacauuaauggcucauuauuagaggcacugaaaggugucuucaucacagacucucucaagcaagcugugggccaugaagccaucaagcugcuggugaacguggaugaggaggacuaugagcugggccgacagaaacuccugaggaacuugaugcugcaggcauuacccugaccuuuccccuucucaccuuucuggggacuguucgcuccgucaccucuggagcugacauacuguucugggguuuguucucuacccuuuccaaccaaucacaccgccuuuuuuuuuuuuuuuuuuuaaaaggaaaagacaaaggaagguggaaguggugucccugcccucccugcacccaugugccugggcuuccccguuuccuguugccacuuacccuauugugugucuacagccaccuuaccacugagccguaagacaaguguauagggacagggucucuggaacacagccuuuguaagggauugaacacugcuuucaggugcauugagggguaaucaauacuuauggcuuuaugagggcucuuaaauuuugucugaaaaaccaaagggcugugaguaaaggagcuauguggaaggugggacucugaaguguauuuuggaaauuaauuaccaccuucuuccaaauuauagaauuuuuuaaaaacagagaagcuguggcccuuugcagucucuccuggccuuggugcugcuccucucugccuuuccuucauuccacagcgggaacugcugucguauggaucccuccuugucccugucaaauguucagcaaacuuacagaggacugggccagccugaucgaucacccucccaacugcgauguguaugugaacaccaguacacaggacaguggaguagaggcugcuaguuggagcacacuuucucugaagaggaggagggggugggggguaugacauuuuccuucccuuuuccagugaaaauaacucuuaccccaccccaaggcccuuucccuuugcuuccuucuugcuugagagaaagugggguauuuaguaucagcuccuccuguuccucugcccucccuucucccauccuuuggagagcaggacuaguacaugcacugagcaccgcacuuucuuagguaaggaggcauguuugaggcaggaggcugaggagugaaguccagucaagcagguacaauuccaccuccccuucuagcccccaaaagacauguccagacauuaugauuauuauauuuuuuuuucaaugccagugcugcucagcccucagcauaacuucaguuuucaugaaauaaacagugacuauauaaaaucccacuuuucugaaacugaaaucugaggucaggucaaagucucuucuuucccauggacuugauuaagccuguguuccauuaagagagguuaaaguucugcaagugaagggaaccgugcuuguguccugccuacaagucacaguagcaucaccucccaguuggcugugucugugucuuaaccaacagaaguuaaaagcauuaagagaguggaugacccagacugccauagaggucaggucugcggugcuggaacacaggcagguguuggcgcaucuguuguagaaaguggagaucaauucgagcaaggcagaggccuggucccucggagcagcgggccaccacugugccccacgggucaaccaccaugcuauggccauaacuugcucuuguuucaugguggcguccacacugcgcugcugcuauuacauagcacugagauucaauggcgcgggcccgcagcagcaccugaggaugagacgugcguugacuccagaacauacagcguuuaauaggcaagugacaagaagcgggcacugugggcccaaucuucucacuaaccaacuagaguuaauaacuaacucuuuaacaugacucacaccuagcuaagaaaugaauuuccucaccagaugaaaaggaagaaaaucaaguagaaaggaggaguguuuguguuuuguacuuuugagauaaggucucccuguguaacccuggcuggcuuagacccacagagaucugccugccuuugccucacagugcugagaugaagagcaugcaccaccaugccccacucuuugaagguguggguugcuuuuuuguuuuugagacaggguuucucuguguagcccuggcuguccuggaacccacucuguagaccaggcuggccucaaacucagagauccaccugcuucugccuccugagugcugggauuaaaggugugcacccccacu

SEQ ID NO: 515 - RNA, 5075 nt, Mus musculus
cgcccacuugcuccugcgcuccuggcuccuggcagcucuugagauccgaccccgugaaugguuuuggcugugucuucauguaggaccuacucccaaacccugcccgcugcggugaauuccaccugcgaugcuuuaacuugugcaacagagauucuugcccgggggggagaggcggggaaggacgcgcuaaucagagggcgggggcucggguugggaucugguccuguacccaucuacccaccaugagaugguggagaucuagggagggugaacuuuccuucugagauucggguauaaggggaaagauacguguugagucuauaaagcugugcagguggcacagccgagaagagaauuggggaaacgaggaagguuccaugagaugacuugaacugcggaaacguuuggcaaaggaaaaagggcuucaguuuuaaugugagaucacuggaaguugagguauuaaggcaccgaucauagucgccucucccauuuucccauuuuauaucuuuuccuagcuacuaguaguaaaaaguauuuucgaagccuugggggaggggauuacuggccaggccuggaaauggcagagaauucuagaaacuuacggcuugaaagaggguuagguguccugauuucucaccuucuucaggcugggcuucaucaccaggccuccucaccaacuccuguguaccggauaccgauuacuucgaaccccaguacuuuguacucagcccagguaacauauuucguaauguucucucucuggcgcauagcugcuuaguucguguuuauuaacuucauagugggagacaaagauaucuccaaacauguaaugagugaacuccaguagcucuaggguuauuaugcucuguaagaaugaaaacaaguugcuggggucaccuguaaugccagcacucgaaaaaaaggaggaucaaccaggaguuuaaggucauccccaguuacauagaaaggccugucugggcuacaaaagaccgugucucaaaaaagaaaaaagucaaaagaaaauaaaguuucuggcuccacccccacuugagccucugaguuucuccuagauagaaaaucugaggauacugccugugucauucacaggcccagaaccauguccucaucaacuuccugggagcugccccugguggcugugugccagguaacaucaacaccaaacaagcaagagaacuuuaaaacaugugcugaguugguucaagaggcugccagacugggugcuugccuggccuuucugccugaggcauuugacuuuauugcacgaaacccugccgagacauuacuccuguccgaaccacugaauggggaucuuuugggccaauauagccagcuugccagguacaaggguaggguuuggggggggggggguuguguguguagaacucccuguugagcaguguuccuggauugccacagaggggguagaguugugugugucguguccccccccccccccagggaauguggaaucuggcuguccuugggcgguuuccacgagcguggccaagacugggagcagaaucagaaaaucuacaauugucaugugcuuuugaacagcaagggugagacgucauagcccuuaguuugccucuucccaggcuucucuaccuuuccucaacucagaucuucagcauuucuuucucaacugcuuggccuugggguuuuaugcuucuguucucagccuacaaguuacucuuugggagaagagcuaagcuggacuuguagagugucuguacugaguauuuucucucucucucucucucucucucucucucucucucucucucucucucucuaggaucaguaguggccaguuacaggaagacacaucugugcgauguagagaucccaggucaggggccgaugagagaaagcaacuauaccaagccuggaggcacucuugagccaccugucaagacaccggcuggcaaggugggaguuuggaaaggaaaugggacuauguugaaaagugguaacaccccccauuggugcaggcuaaugaaggcacucaguguucuguugaaugggacagggaagaugaguggguuguuucucauuucagguuggucuagcaaucuguuaugacaugcgguucccugaacuuucuuugaaauuggcucaagcuggggcagaaauacuuacuuauccuucagccuuuggaucuguuacagguccagcccacugggagguaagagaaugccucuucauaacauauaggccuccuuuaaccuuacuuuuaguagugggagcagagugguacaaaccuaaauccaagcacuucaguggauagccacagguucaaagccagcaugccuugacuaaaaaagaaaacaaaauagaagcugggcagugggggugcacaccuuuaaucccagcacucaggaggcagaagcagguggaucucugaguuugaggccagccuggucuacagaguggguuccaggacagccagggcuacacagagaaacccugucucaaaaacaaaaaagcaacccacaccuucaaagaguggggcaugguggugcaugcucuucaucucagcacugugaggcaaaggcaggcagaucucugugggucuaagccagccaggguuacacagggagaccuuaucucaaaaguacaaaacacaaacacuccuccuuucuacuugauuuucuuccuuuucaucuggugaggaaauucauuucuuagcuaggugugagucauguuaaagaguuaguuauuaacucuaguugguuagugagaagauugggcccacagugcccgcuucuugucacuugccuauuaaacgcuguauguucuggagucaacgcacgucucauccucaggugcugcugcgggcccgcgccauugaaucucagugcuauguaauagcagcagcgcaguguggacgccaccaugaaacaagagcaaguuauggccauagcauggugguugacccguggggcacagugguggcccgcugcuccgagggaccaggccucugccuugcucgaauugaucuccacuuucuacaacagaugcgccaacaccugccuguguuccagcaccgcagaccugaccucuauggcagucugggucauccacucucuuaaugcuuuuaacuucuguugguuaagacacagacacagccaacugggaggugaugcuacugugacuuguaggcaggacacaagcacgguucccuucacuugcagaacuuuaaccucucuuaauggaacacaggcuuaaucaaguccaugggaaagaagagacuuugaccugaccucagauuucaguuucagaaaagugggauuuuauauagucacuguuuauuucaugaaaacugaaguuaugcugagggcugagcagcacuggcauugaaaaaaaaauauaauaaucauaaugucuggacaugucuuuugggggcuagaaggggagguggaauuguaccugcuugacuggacuucacuccucagccuccugccucaaacaugccuccuuaccuaagaaagugcggugcucagugcauguacuaguccugcucuccaaaggaugggagaagggagggcagaggaacaggaggagcugauacuaaauaccccacuuucucucaagcaagaaggaagcaaagggaaagggccuuggggugggguaagaguuauuuucacuggaaaagggaaggaaaaugucauaccccccacccccuccuccucuucagagaaagugugcuccaacuagcagccucuacuccacuguccuguguacugguguucacauacacaucgcaguugggagggugaucgaucaggcuggcccaguccucuguaaguuugcugaacauuugacagggacaaggagggauccauacgacagcaguucccgcuguggaaugaaggaaaggcagagaggagcagcaccaaggccaggagagacugcaaagggccacagcuucucuguuuuuaaaaaauucuauaauuuggaagaaggugguaauuaauuuccaaaauacacuucagagucccaccuuccacauagcuccuuuacucacagcccuuugguuuuucagacaaaauuuaagagcccucauaaagccauaaguauugauuaccccucaaugcaccugaaagcaguguucaaucccuuacaaaggcuguguuccagagacccugucccuauacacuugucuuacggcucagugguaagguggcuguagacacacaauaggguaaguggcaacaggaaacggggaagcccaggcacaugggugcagggagggcagggacaccacuuccaccuuccuuugucuuuuccuuuuaaaaaaaaaaaaaaaaaaaggcggugugauugguuggaaaggguagagaacaaaccccagaacaguaugucagcuccagaggugacggagcgaacaguccccagaaaggugagaaggggaaaggucaggguaaugccugcagcaucaaguuccucaggaguuucugucggcccagcucauaguccuccucauccacguucaccagcagcuugauggcuucauggcccacagcuugcuugagagagucugugaugaagacaccuuucagugccucuaauaaugagccauuaauguagucucgccagaaugcgucgagguaggugagcucagagaacuugaugucacagaugauggagcccaggucccgggacuugaggauaguguuggccugguuaaagcgcucaaacuggcgcucaaguggguccugcuuauuggagaagacauugccuugcagagccgucucaugcuggcaguauuccgcccgaacucggagccugauaucugggagaauuuuaaggagcaugguuuauaauggauuguguuuacaaccaaagcuagaaaagcaagcaagcaaggcugagacccucccucuucucacagcuucuuuaccucuccccagaacuaguucuucacugugucacugguuucaauucuggagcugcccuacaaugcccuacaaugacucugcucaggccacucacaaacagcaccuuguuagaagaccugucuuauuaaaaaguugcacaaauuuacuuua

SEQ ID NO: 516 - RNA, 3366 nt, Mus musculus
uuaagugauguagcugcuggugagccacuagugcuccuguggguaucuccauccauucccacaagggugcuccagguuagacucaugggccacaaaacaaaacagagaaauacgauuaugagaugggauggguugguggcaaguggaugagagugggcuguuugaucauaugcuuuuauaacauuaucaaagaauaaugaaaauaaguagcucagaugguuccccuuuauaagccacuguguucuugucucacugccuccaacuguagcacaguccggggcagaggagggagaccugcacuccuucuccauccucucuuuugccucuuagauacagaagaucauugagacacugucacagcagcuucaggcaaagggcaaagaacugaacgaauuccgggaaaagcacaacauucgucucaugggggaagaugagaagccagcagccaaggaaaacucagaaggggcuggggcuaaggccagcucagcagggguguuggucucuuaggagcuaaggccucugcggguuuuuuuuuuuuuacccugauucccacuuguaauuucuuuuuauugucguuauuauuauuucucugcuauuguaauauuuuguuuuuguuguuguuguugauuaaauguuuuggucaaauacuuagcuauagccugaaccuuuaucucauuuagggcuacaccgaccucauagagcuggguguggugccacacaugccuuuaauaaucuuagugcuugggugacaacaagaggcagaucucggaguuccaggccagccuggucuacaaaucgaguucccaguaauccaaggcuauauauagacacagugagacccugucucaaacaaaacaaaaaaauaugauuugcauuguuucuaccagguuaauggcucacuaucagaaaggaaccucaguucggucuuuccuuugcaaauaaaguaaucuguuuauuugaugcucuucuaaaacggauucagagggcuggagagauggcucagauggcucaacagugaagagcucugucugcucuuccagggggcaucuguuuuauuauccccaacaaccacaugguggcucacaaccaucuauaauggggucugaugcccucuucuggcacaaagguguacaugcaaauagggcacuuauauaaguaaaauguauaaaucuucuaaaggauucagagacaaaacucucggauugaaauuuaauaaguauuugaaguagggcaauagcucugaugagaucgcuuuguagguuugccacaacacagagugccucccugcuguucuuuagaugaagaauuccaggaugcaaaccugugggcuagcuguccugccguccucaccaaaacccccaaccaaauaaagcuggucauuccaaaggcaaguccgauggcccacgcgcuucaguccacggucuguacuggggaaguggaaccacagaggcggagacuugccuguggguugagagcagaaggugguuacuguggcauucugcuccggccuuacccaguacgcaugccugucaucguucccguuugauuugucagccuuuucagauguucaguauuuauauugucuauuguauuuuguuuuugaaacagggucucacucugucacccuggcuaguuucacacucuagaucaaguuggcuggccucaaaaacuaccagagaucugccugccucugccucugccucccaagugcuggaauuaaaagugugaaucacuaugccuggcucuauuuuuuguuuguuuguuuuucagcaguccacacacuuuugccuccugaguagcauacaucaccacaaccggacugcauuccuuuaacucaucaacugauuucuccuccuuucuaucccaccaccccuguuuuguaauuuuuagcugugucuuuuucuccucccuuucaaaugauagcuuggcgcucacggguaucguagauguagagaucauugcagaucguaucucuagcucuggucagaguuucuccgccaaauaguacagcgaagggucccaccacugaacaggaaugauggcgcaggcucugggguccuugcugcagucccugcccacugcucacaagccuugcaagcuguucccucaaaugaggggcaacugguuguuccuccuugggcgagaaaaacaagaagggguugucugaaggguuugcuuauugaaguuuuaguccuuuucuacuuuaugugaguagcuaauaccuugauuuucccagggcuccauugcccugcuaccuccgguccaacugaguugcagcccccaaagagcaaaagcugaugacccgggugcggcccagcaguuggcagcagggcagcacaguggccugaucgugagguuguguggcagccuucuucuuuguagcuguugguacacagaaaaucgggccugaguuugguuuucugaaaagauucaaguguucuuugccagagagcucuagugaaaaagaaaaucaggcuuggggcagauagaguuaagcaaucuuggauuccaagacagaaggugcuauggauagacuaccaauaaguuuauuuagguuuuguuuuuucuagaauauagagaaaacaaacgaacguuugggggcaaaguugcaguaccaauaaguucggguccugugguccaacuuuaacguguagaugcuuccguagcgucgcugaguguggguaccacccucucugccagacacucgcagcuccccgucugagaggcgagugcagguguggcugcugaggccagcaggagggcaguugccaggguucgcagcccaugcuucccacaccucucucuccguguccagcgcggccaccguggauaagcgacgugacccgucccagccacccaccacgcagagccaacgaccucccaccagugccgcgucgugguggcugcgaaggggacuaccucgggcuaccagucgcaccgcuuggccuacagcugggucaaagaucacagugucguugcugggcacucuugcaccaccuucuaggagacccccuaccagauagaaccguccuuccaguuccgugcaugaauggaaggcacgagccagaagcacgucucgcgccacuggccuccagguccagguugagccucuugcucgaccgagggucugcaccccagccaugggccaagggaaggggagagcagcucggucacuucgggucgcacuccuucacgaagggcccagcacuuccaagcauagacuagcuuccccuccaauaacagcacaggucuucacccaaaccaccccuucucuccaccgccgucgcccagcaaccacugcagggacuacagugcgaccgcugcaaacugaaggucgcaaagcgccuguuaccuuggaaacaagag

SEQ ID NO: 517 - RNA, 981 nt, Mus musculus
ggcugcaaaagagugagucuccuguaaaccaucuguguggccuuaggcaagccacuuccccucucuggaucucaguuuccuccucuguuaaauggcgauaauaacgccuaccucuugggaaugcaguguggaucuaaugagguaauggacugaaugcgcuuugcaagcacaaaucgcuccagaaguuccggccgccuuugcugucauuagcauucuggaugcguuccauugguucugacugucccccucagccugacugcuucugucugcccccugcaggccaauauuccgcgggugagcuggagaccucugacguagugacaguggugcugggucaggaugcaaaacugcccugcuucuaccgaggggauccggaugagcagguggggcagguggcaugggcucgaguggacccaaacgaggguauccgggagcuggcccuacugcacuccaaauacgggcuucaugugaacccugcuuaugaggaccgcguggagcaaccaccgcccccacgagacccucuagacggcucgguccuccugcgcaacgcugugcaagcugaugagggcgaguacgaaugcagagucagcaccuucccagccggcagcuuucaggcacggaugcgucuucguguucugggugaguggggccagcugggcaugauccguauugcugaguggguggaagagggagacagaacgggauugcagagauggcugaaacagaagcaguacaggcagacauaaaagauaagguccuauaggggugagagaggauuacccagccccucccacccaauccagaaauucucuccaaaagccgccgaagcuguggaauaauccauauauuaagaaguuuauccuuccccgauggcccgcauuucccuccguacccuuguccggcuggagcagcauagcuccagcguauucugucuucuguacagcuuuucauagagcugaggaccucugccagacuccacuu

SEQ ID NO: 518 - RNA, 5299 nt, Mus musculus
uguuuuuucucuauuucacgaauuaccauacacaacaggaaagcagaccacuaccaucacaccacauggaaugagauuucaaauucuccuacccacuagagaucaacaagaaaaauagcuuggcuuaaaagaauggauuuuucagcagugcacuuugagcacugaggccgaaucugcuguugccuguggggaguaaggagaggcugugacugggcagagaccaccagcgucgcagaggggaguugacuaucuccagccaccuccagcaacgcccaucuguccguucacauggcccucugcccuguuccgcaugcagccugcuucuacaggaggagacaccaagucaacucacuaccugacauugggaaucaugucuuaugcuccugaucacacgagaggucuaugagauagcuacagcagguaucaauucuuguaccuuauugaaacucagagucagguuugccuaagucaugugucaguuauggugaacuuucccauuuauucuccacaugcagaaagauguuaagauuaugagucucaccagaaucuucuagaaaucaggucuggccagccuccggcccuuuucuuaugccuuucugcacugugccugcuguuuucucugcccagcauggcagacagcaaagcuuugaacuagaagagaagauacggcaggagcaaaugagcaagguuuuaugguggauuuaggcagagacaguuuuagauuacacauuaaaaaggaacugagaagaggagguagggcaaaaugagaggaccagcaggaugcggaaauaggcgugguccagccccauaguaucucaaaaaccaacuccccacccaucuuagcagagucuuccuagaagcaggagaaagaggacaggguugcaaaaauacgcaaagagcagguguggagaaccagcugcagcacuuccaaacauacagcacggugcucaggcuguagacgugucuugguaguuaacaacacuuguucuuggaggucacccagguuugauugauucccaguaucuauauggaggcucagaaccauguguaacuguaguuccaggggaucugccacccucuucuuaccucuucucacggagaguaggaaugcacaugacauacauauguacaugcauacaaaacagccauacacauaaaaauaaauaaaccuaaaaaaaaaauacaguucucaacaugggcguggugguggugcaccccuuucaugccagcacuugaggcagaggcagaaaggcaaaggcagagauggucucugauccaaugugucucacacccuagaguugauucucaaguucccugagaagaucugucguuuuuuggcuagccuaagaaucuaaggcagaauggaagagcauagcuaaugaagguuugaaaucguccccuuucuccuauguaugguuugcaagagaucccaauggagguagacaaugaaguaggaggcuaaugaacuaauagguuacuuggcauuuguugucauuuggcccacucguuccaucagcacaugccagguccaucauguguacauauucuaccguccacgaggaauccaagacuagaagucuggacagaguucuaacugaguccugccugggcugcaaucauuuuuuuucucucuugccuccuugcuuugcucucugccuggagugccuuuguccucuucgcuacuccucaacuagauacccucgcgguuugcccccucuagagauucagagucaccuccccugcaucucuuucuucuggcuuccuugaacucucguucacaucacuucauagaaagcucagcucucaaggaagcaguacaagcuccauccuggcauugugaaaagauuuuuaauuaaaaugauuauguggcugugguggcuugaauacaaaugacccacacagacucgggugugagaauuuuuggccuauaaggcuuggcacuauuagaaggaguggccuugcuggcugccugguggggaaaacgcugcgccagcauagaaccggcggaagggagcagagccagucagcggaacccuccucacacggcacgaugggcucgcugagcccccuccauccucagggugcgaagcccuggccuagaccccgcggagauguccaguugcggcgcuuguaccugcagcgcuguggccgcccggcuucucaccaccucgcucaccuccgcgcagagagguauuucgugugggcgcauucaugugccaauguuaggaagccuggggaccuuggacgcucagguucugcgcagagcuucucuuaggaccuuuucagaaacaccagcauacuuugccucaaaagacggugcaaacaaggauggcuccuguggugguuccuuugcacagccuagaugagaagacacuuguacaaauacugaccgagccacggaaugcuguuaucccucagcaucaggccuuguucagcauggauaagugugagcugaauguuacugagagugcucugaaagccauagcgagaauggcccuggaaagaaaaacaggugcacgaggucuucggucuauaauggaaaagcuguuacuagaaccaauguucgaaguuccuaauucugacauuguguguguggaaguugacaaagaaguaguagaaggcaaaaaggagccaggauacauucgguaaagcauguucucaggccagaauagcgccagaguuagggucccuacugcuugaguuuauugggcugucauugaaauucgguuuuguaaggaaagaaauaaucuccugaguuuucuacaagauaaaaguaauaugguuuuagaaaaaaaaaagaaggaguggccuuauuggaguagguguggccuuguuggaggaagugugucacuguggaagcaggcuuugaggucucauccucucaaacuaugcccaguguguacacagucuccuucugcugccuguggaucaagacguagaacucucagcuucuucgccagcaccaugccugcuugugugcugccuugcuucaucccaugacaauaauggacugaaccucugaaacuguaauccaguccugauuaaauguuuccuuuauaagaguuauaguugucaugguguaucuucacagcaauagaaacccuaacuaugacaauaacuauuauagaaaaguuaucccccacagaugaaaaauacgaauuuaaaaguaaauuaugcauaaucuccuuacccaguggggaaaauaguacuauuaacuuuccaguacucaauauuuccuccuaauaucuucaaugcuuauguacauucagcuagauaacuggaauuccacuagauauugauauagaugauauugauauagagauagagauagaugugugugaugugucauauacuuuguauaugacuuuuugucacuugcuguaaacauugucccuggauauuaggcuuucuucaaaaagaagaacaacaacaaaagaugucgaacagagcucaauacuugcugguguggacacacagcacuucaagcauuucuucucuacugcauuucuuucuuaugucuaacuuguauuuucuuagugauucuucagagaguagugggaauugacucucugggugggaugcagaguaggaauucuauauucuuuacuaucuuacuuugagaagggaauaauucuaguaagaauuucacauuuuuauauuuguaauuuuguacuaauaaggugugccaacuuaaggaaauuauauccuugcuuuuguugcuggugcauuuagaggggaaaccuguccucugacucccaaacaauuagguagcugcccauccucaauacuucaauuaauaauauaaucaauaaugaaaaccaaauagaggaaaaaucuucaaugugccugucuuagaguuuuauugcugugaugauucauuaugaccacagcaacucaaauaaggaaaaauauuuaacuggggcuggcuaacaguucagagguuuaguccauugucaucauagagagaagaauggcuuugcacaggcaacauggugcuagagauggaacugagaguucuacaucccaucugcaggcagcaggcaauaagauuaaaccacugggcguggcuugagcaacugaaaccucaaagcccacaccagugacacaccuaguccaacaagaccacauccccuaauagugccacucccuaugagucuauggggggcauuuuuauucaaaccaccacaguggccucacugagaagaaaaauuaaagguguccaaugauucucaaagucugucuuuaggaagacuauuauaagguuuauguuuaaauaaagggcgagaaguacuaagcaauugcacaauccaggacaaagugugucccugcccaccacuggcccaucgucgucuuagcuucaccaucuugcaaagcaguucaauuagaugucagcucaguguaaaaaacucuuccugugaagaaggauccuuuggcugacaccaggauuucauaucccccucccccaauagaauugcuagggaaauuuaacuggguuccauuguuucaauuguccaauagaauaaggaaaggauggaaauguuucuuacuaaaagguccuuguuccuuccaggguaguuauacucugagucuaccuuuacccaacagggaaguguggaagaucaggccucacugaaaacagcucucaaaggucaacuagggugugauaacugacucucauuuuuuguuuuuguuuuguuguugguuuggcuugguuugauuuuucaagacaguguuucucuguguguaacccuggcugcccuggaacucucucuguagacaaggcuggccucaaacucacagagaugugcugagugcuaacuuguuugauaugaccuggugcggcagacccucuuggaucccuugucuguguaggacgggucucugggugcagaugagcaaagagucggcgaaaaugacagacagaugcacacaggagauuguguagaaucugaauguacuuugucaaguugagcaucgaacuuuuuguacagaagaauaacaagaaaccaggcaagauacauccacugaauuacagugacacaauacaaaaggaauguauacaucaaaagaaggcggggaccaggccuuugccacaaggaagggagcuagguguaaagcuaguguauuguuaagcccaccaccagggguucugcucuagcagaccuucucaugaauaaugcaauaccacaaccccccuauuuccugggcccugauaaauucuuauaugaguuucucaggcuacaaagcaaacuucacuggagggugcauagcaaccugguguuuaaaaaaagaaaaaaua

SEQ ID NO: 519 - RNA, 499 nt, Mus musculus
ccaguaguauuuggguuuuuuuuuuuuucauugcauuauuuacuuuauucauuuuuuuuuuuacaaaaguuuauuacaauguacaacaggcuucaggauaacauuucauucuagcuauuacauggcaaagauguuaugacagggaauccagauguuugacugggcacaggauaacacuucauucuagcuguagguggcaaagaugcuauggcagggaauccagauguuuaaauaggaauggaagaggagggucacuaucaccccagaugugaggaacagcuuacuuuuugccagauuucuuaauuccaccuguggccagggggcccuucccggcagccuuggcuuuuagcuccucgaguuucuucuguuccuccuuuuguuucugcuugaaagccuuaucuuccucguccaucuccuuggccugcuucuugggcuguuucaggggcuucuuuuugccaccuucccggcccgacauggcgccuccagccccucaguauuu

SEQ ID NO: 520 - RNA, 5307 nt, Mus musculus
aucugguacuagaucgaggucacuuuaauuuuucuuuuuguaggaaauuaggaaugcaaccagacaaagacacacaggacaccagacacagaucccagggucugcucuuggugguuuggggaaaagcagggcugguaagaggaauggaguacacaggacuggagggggauugucggggugggggcagcagggagagauugagaaaggacccccuagaagcugggaggcugagaagggacacuauuccagaggaaaggggauagggacagauggagcugaagaagggguaccaguauggugggugaagggauccccacacauacuugcacuagagaaagaagaagagaagugacccgggagagagcaagaggaccucagcuaaagcaagcugcaaggagccccccucacccuaccccaaagugcauaacucgguaauaaauaguaauauuuauaaauaaauaaauacauaaauaaauaagugaauaaauaaauacauaaauaaauauccuuguagagcuaggaguuuggugugaggauggauggagcagagaaaagcagugaguucuucuacagggaauuuaaggcccauagacucugggucgcaaggcuacaaugggcagguggguggggcucagcagcaugggcgggucaccuuccuucccacggcgguuuaagaaaggaaggggaaaaauguaauaagaaggcccuagagcauucguagagggcaguagcaggcaugcccuugcaucugagggaggagcugaugggguuugcauguuuucaaggguccccugggauggaaggagcugcuguggagcggccccacccagggccugagccuucugcaaggugcccugggcuguuugggggugucauccuuaucccaggacuaagguuuuccuuuuucuagccggcacagggaaagggagaauucuggguggcaggggugggaggggaccgggagcggccggacagcuccaagaaggcaaggcacucacuaccaaguuagaucugaggucuguauauccuaagccucaggacugagagagacaaaagaaaggcagaauuuuccuauaaucccuggcuacccaggauucaccuccgucaucucucugccaucccaagagcccauuccuccccccccccacccccgccacugccccccccccaauggaccgaaaagucugggaguuggggacccgcuccuucaaccucugccgcuagucaguucccauuccgauuuugagucccaccauugccagaaagagaguuagggucuggggucucugaaaacuugggcauaggauagaugaggcagcagcugugcagagaggcuaggcuuaguaaacccagcacggacuccauucugaccacucuggcaagcaacucugaccaagcuaggccggaacaacucucugaaggaacccauaagaacauccuucacauuccugggccaaugaaaagaaaccgccuucaggacuagcgaugugagccugguccucugggaugggagggggccggccauucuaaguaauguauggugacagggggcucuggagaggcccagggaaauggggagaauccagggugggaugcgggcugaguucagacguccagcacaugguucagguaggagauauagcagauggccaggcguaggaucucaaucuuagagagcuucuuguccgggggcagagugggcagcagcuugcgcagcucggcgaaggcuagguugaaggcuuccacgcggaugcgcucccgcguggcgugugccgugcgguacuuggccguggcgcggcgccggcgccugcgcuccucacgacucaagugcugcaggucuuugcggccggacucuccaagcucugagcuccggaccuggaccacuccuggauccccggauccagcaccaucggggcccgguccgcccccacagucgcuaaagcccgacucggucuccgagugggugggaggcagguccagcuccaugguaucggaguugagcaucaugguggaaaaccccccaccuagggaaaugcggauccucuccccaccccucccuuuaggagcuucaaagaggguuaggaggaaagcagcaagggccuggagugccggggucugccacugagcucugggaagcaguuacuucaaaguuccauggucaagauuccagccuggagccugaaauagagaaagacgaauugagaauuggccgcuaaagguguggcuggggagggggucgggggaagcugaggugugaguugggaguugugguaaaggagagccgaacuuggcuucauaguuguccaacgcuagagagaccagcagguuggaaaggagcaggaagaauaacagaggaaagagaaaagucgagggaaggacaaagcaagcaagcaaaugucaaacgagaggaccgaggaccgaaagcuaaaacugcugaguuccuagaaguaaacagaggugaaguccuucgagacacucgagacacuggacugggcugucauuuccugaauaugagaacagaagcauaagaaaaaagaaaaaagaaaaaaagaagucgacgccaaacuuaacuguagaacgcuagacaauugccacagugaaaauucaaccuauggaaucagggaacggucccaaaccaggagucuggucauagguuaauaugcaaagcauaugaaugaagcaguuccuacguaggcguggcagcucacuccuguguaaccccagcacucagaaggcuggagcaggaggauugugaauuugagacuauuccggauagucagucucaaaaaaggaaaagucuggaguaaccaaaauaucgaaaaaccuaauuuuaaaaugagaaaaggacucgcacagacauuucuccaaagauaaugcacaaauggccaacauacauaugcgaauacauggcacaucacugaccacuaaaaaugugaaguaaaccagcguaaaagcucaccucagauccaccagagacagagaauguauuuaaaaaacaaaaacagaaacaaacaaacaaacaaaaaacccuuaaaacuauaccuaauaaaaauauuuaaaaaaaaaacccuuaaaacuaaaccaguguuggcaagaguaugaagaaaugaaaacccuugucugaaaguguuucaccugcuacgggccaucgccuggaugcuccucagaaagcacucgggagagguugguaccugaaugcucucacucagagcaguggcagaagcaacucaaaccguccacuacuagaggacugcacaaauacaauguagaaacgauguauucauaauaaacugugagccuugaaugcagauuccugucacacugcaaaggagacuaacccucgaggacauuauaccaugcgacgucaacagucagacaaauacugugacuccacucuuuugcguugcuaaaguaguccaauucacagaaaccaaguggcccaacaguggucagggacuggagguugaggcagaggggagcuagccauucuuuagacaguauagaauuucacauugccaagaugaaaaaguucuggagaugaguuucacguaaugagaauaugcuuaauauugcuccggcucugucuacacucacuuguugugauagcaaauuguguuaaguggggguuuuuacauaauacuaaagugaaagguagagcaacaacugggggggggggcggggagggggcuuuggaaccuucugcacccuuguuucucgcugagggagggaagggccaaacucagagauggcuguuguggggaggacugggauauaaggcagaccuuggcacaggcaccugguucaguccuucacaaucccucagccuccuuuacaucaccacuguaguagacaggcccucccauucugcccauuagaaccaaagaaaagguauuucuucucagcacgugcaccuaccugcucaggacuaccagaucccccagcucuguccuuagcacauuuagcccuugccauccccugacccucuuggcgauucuguaaggaagacuucagaaacucacccacagccugugcuguggccugcagaggagggcauaggcagcuccuuggagccacccuuaaggagcucagcuaaguuugcuuauaucagaaccacugggccuuucccagugacuucagccuugacagagacagaaagaguagaaacacuugggauccuucccagucaccaccgcccccagcccuggcuugacagcuggcagcugacaggcucucaggagccacccuuucuccuaggcuugccccacccuacugucacagaagacagguucaagaccagagcgguuacuaagggcuuaaggggacguacacaagaccaccagcaucugacaccuacaccuacacaccgacugcgacauaaaacaaccuaauuaaugcugaaauuaugaacauccuccauauuguaggauccaaaggaagagaagagaacaccaagaguguaggaaggugggggagcauuucccauccauguucagugucccugaugucccacucucaaaguggacugaaaccaagaguucaaccuugggguucccaggacaucuaucacaaccagagaucccaccucugcccaguccccauguccccgaguccuccaucacucucucguguccucccuuucucucuccugcuccccaucugucacgacccaucuccaccugccccucccuucuccccaccucacucccggcaggcagcagcuuccauauuccucucaagucuuuccucccucagcucucaaagugucuggcucugagaagcaggaagcaaggauuccaaggauccaauaggaggaauucccacccugcuuccuccaacugccccucacagaugcugcccaaagaauccaagauaaguagguaggaaagaggcagagauggagagagagacccuuccuggagaaagguucugggaagggacuccagucagagauuaggaggggugcaccacccuuccccagcccaugguucccccuuaccuagaaggacucugccaagggauccaagcuggcaagugagagggacagcguagagagccccagucucuucucgcugcucaagggucaucugucugcaaaguuagugagcaguuucuagagcucuuaggggcagcuuguggcugaacaggauccaggacagaugagaaggguacacaugaugaggauuuguaaggccuaggcaaaagggaugcucuuacuuaguccagaacuggagucacccacacucacacauacauacacacaccuacacauucacacacucacagacacauauacacacaccugagcug

SEQ ID NO: 521 - RNA, 39806 nt, Mus musculus
ugccugcacuagcgaugggccguuccggacggcuccucuuaaagaccagagcuccgggguggggugaccucaccugccaguaccacggaaaaagacagaagaagaagaccccgacuuccugggucaggcccagagccgccccuagucguagccaucuugccucuccgcugggcggaagccucaggucccuuccagacucguagcggccucucuaggcuuccgcuagcaucgucucuguggcccagcgcuccagagaccggaaguccuuguccgaggagcuuccgggagccgcgacccgggaguagcugacguggaagccuugggagugccaccgggagcggcgggacccgcuaaccugaccuaggagcccgaggccugaaggaugcuaaccaaauucgagacgaagagcgcgcgggucaaagguaguggagaagaaacgggaacagcggagguuggguguuggggguaguggugcugucacuaaggcaggacucgcugaccgcgucgggccuccuggaagaacccggaggaauaaccgagggagcggcuuaggguuaguggaguagucugcaguccgugcugcuucguauguccuggaacuuaucgugucguggcucguuaaccuuaggccggcucccuacuccuuccagccaccucuucugggggggugugccagcccuuucuguucuuaaggccuuaugacuuggaugcuuucugauaaccagguuguauggaguguuucugggguuugagucucagcuucugucacuggcuacuccaguagcccgucugcuccauuuccauguccagugcuuccgcuggacuauuuauuuauuuauuuauuuuuggccuauuuggagugagagaauggaggccuacugccccaccaggucccgagccuggguaagauuguccggugaaauacagaugcuuuguguuagauuugaauaccagguaaacagcuaaauuuuuggugauaagucuugaaagacaaaggccugagaucacacucuuugaaaaugucgauauuagaaaaauuaagucuauggaaaucugauaaaaaauauaucuggacuauuucaugauaugcauuauagugaagugguucagaauuuguuuauuggagucagucagacuugcuuaggaauucugaaacgucuacuaacaagccgccuuaaggugucuccuuacuaucucuaaaucucuauauucuuaucuuuaaaaauaaggauaguuaacacuuucuuauaaagagaauuaaaaugagaaaguacauuaacuguguuuauaauagugccuggcaagacuuaguaauucagaaacuggagguucuuuaauggaggcuauauucugggcaguuucuaagugucaugggaaauuugauuauaaagggugccaguaagaauucuuaguaccaccaggguuacauagagagaccuuaucucgaaauggcaaaaaaagaagaagagaaaagaauuaucauguguggugccagucaugguggcuuuaauugcagcacucaggagccagaugcagguggaucucugugaguuggaggcuagccuggucaacguaucgagcggcaggccaaucaaagcuacacugagacacacugagauccuauucuaaaaaaaaagguucuagggcugaagaguuggcccaauuaagauuuacugucuguucagaggacaugaguuugguuccccauucagcagcucacauccaccuguaauuccagcuccaggugaccugaccccucuucugggcucugugggcaccugaacucaccugugcauguacuuaauaaaaagaacaaacacaaacgagucucugguauuugaguaguugaaaugagucuucauuuucuaugagcucuuuucagauuucuucuugugcacuagaaaggcauuagggaaaucaguauuugagaguucauuaagaucgcugaaucaguuaagagggcauacuguccgcacaguaugucguucccaucacucaugacaugugguucacaacugcccgcuccacgggacgguguuaaagagucuaccguaaaaauaaaagaaacaucaugcaaaauagugccuucauuaacuugcuaugagaguauauucauauaauauuuuuacaacuaaggacuagcuaccagaguuggauguggugacucacuccuguaaucccagcacaugggagacuaaggcaagaugguugcugcaaguuugagaccaaccuagacaacaaugugaggccauguugugaaaagcccaagcauuccuggugugguggcacagaggcaggcagauaucugaguuugagaccagccuacacuaaacagcuaggacuacaaugagaaaccuuagcccugaaaaaacuugaaaaaaauuuaccaaaacauuaaauguacauguucuaagccaguaagggcucaguggguaaaggugccugucaccaauuggccaagauuaucuauagaaguaucuucuguagaccuuuuuguuuguagguuugguuugguuugguuuggugguuugguuuggugguuuuguuuguuuguuuguuuuccgagacaggauuucucuauguagcccuggcuugcccagaauuuacuguguagauuaagcuggccuuguacucagagaucugccugccuuuaccucccaaagaaauaaagguguguguuaccaccaccugccuucaguagaucuuuuuuauagucagaaacuaaaagugaaauuuuaauguuuucuaagaguaaggguuuuguuguucuuggugguggugguuguauuguuuuguuuuuuaaagacaaugccucacuaaauagcccaccugggccucaaacucaguguuucuguuucaaccucccagauguagcauuacaggugugugugugugugugugugugugugugcgcguguuuuagugaucauacgcagagcuagacaagccagucuucuuccacugaaguaaauguccaucuccaaaacagccuaaaaugugauagacuaguggggugacucagugguuagugcuuaccaccaagccuaaugccccgagcucagucucuagggcccauaucuuaugguaggaggaggaaauugacaccugcaaguuguccucagaccugcacauaugcacuguggcucguguguguccaugugaaaacucaccgugcacagauaguaaauaagugucauuaaaauuuuuaaguguagugccguuguuccuuacagcuauaaaaaagaaugaguuucugguaaaugaagugugaaaagguuuaugucauauauuuaagugagaaagggguauaauuccauguucacaaaaugauaaggcauguguguguauguaucugcacuaaaaaccugaagggcacacuucagacuguuaacaguccuuucuuguaguauuuccuuuugucauccugauggaguaacaaggacuaaauuuguuuuccugccuuaaauugcuaaacauguaaacaaaauuacaaugguuucagacauuggucgguaaagaguacugggaauuauuucuugagggaaggaauauaaacaggacggaucuuauguuaguuuagguuagugcuuagagagagacaccaggcugcagugaaggacaagggagggaggaacccuguggucuagccgaggagcagagcucagcauuuggggcaacaaagauguuaaaguaugcuuagaaaagcccagaaaagggagcgcgccggaggucuguauggauucccucgagccuuugucagaguauugauagguacaugcaugcaugaaaaauauccaaaauuuaggaagaaaaaaaacaucaaaagguaguugugggccuggagagauggcucagugguuaagaacacuugcuguucuugcagagggcccagguucaguucucagcauccacgugguagcucacaaccguugguaacuccacuuccaaaggaucugacccucucuucugucuccugcagacaccaggcaugcauguggcacacauggacacaugcaggcaaaagaccauacacauaaaaauuacauuuaaaaacuuaagagguaguuaugguaauugaauauaccuaaaauccuaggacugggagacuaaggugggaagauugugauucugaggccagccuagacagaagagugaggucugucuuuucuuagaaagaaaaauuaauaauugaggacuagagagauggcuuagugguuaagagcacuuguggcucuucaagaggacccaaauugagguuccagaagucaugccacgugguucucaaccaccuguaacuccaauuccaggguacucaacaccucuggccuucauaaauaacugcacucauauguacaugccuguacauaggcacaaaccugcacauaguuaaaacauaauuuuaaaaaaucuuaauaguaauuuuuaaauaaaaagagaaagcaacuuuccuuggaguucacauaaggcuagaaauagucucugcuucaauaagaaaagcagauuucuugauaguauugagcauccuauagacccuccacugggucuucccuuagcagugguuccaaguuagaccuaaacuguacugguagcuguagacccacaguuacaaagccaaguuauaucuguugauaucaacugaguugcaccucagaacaaagccuaacaauauuuaacaaaauaccuaacaaaaaaaauacuguauuugguauccaauaaaaaggcaguuaucagccggguggugacgcugugcaccuuuaaucucaguacucagggaggcagaggcagguggaucucugugaguucaaggccgguauggucuacagagcaaauuccaagacagccagggcuacacagagaugcaucuuuaaaaaucagggaaaaaguuaucaggaauguugaagggauagauagauagccucugguuaaaucuaguuguuccuuuuuuuuuuuuucauacaugacaaaagaagauaucagggaucuuaccucaucguauaccuuucugcuuuuuuucccuuccccaggccuuaguuuucauccuaaaagacccuggauccugaccaguuuacacaauggggucauccaguuaugggacuaucggaugugcacccuaauugacaaauuugaugaacaugaugguaaguuaauuucuagggaaaaauuaaaagagaugguucaguaguaaaaagugcuagcuguucuuuccaaaagacuugagugcacuucccugaacucaaauaucucuaucaacccagagcucauaaucacuuggaacuauagcucaaggcaugugauacucucuuugggccuccacugacacuuaaacacaugugcacauguacauauacaaaauaaaagugaauuuuuuuuauuuuuuuuauuuuuuuuuaaagauuuauuuauugauuauaaauauuauauauuauucagacacuccagaagucagaucuuguuauggaugguugugagccaccaugugguugcugggauuugaacucuggaccuuccgaagagcagucgggugcucuuacgcacugagccaucucaccagcccgugaauuuuuuuuaaagggcaaauauuuaucauccccccccauaagaauccuaguuugauaaggauuuccccuaaaaguaaagaauguggaaguaaaaggggauagaaacagacaaaaacuacaaauaagaguuuuaguagggccagguguuggugacacaaaccuuuaauuccagcacucagaaggcagagacaggcacaccucuugaguuugaggccagccuggucuacaggguaaguuccaggacagccaggaaucuugucucaaaaaaaaaaaaaaaaaaaaaggaggaggaggaggaaaaaggaggacgaagagggagaaaaauaauaauauuagugcgucuauggaggccugcugggaacaggacuucuaaaaagcaaaaauauuuggaaggcuguggugcaaggccauuuuugcuaacuaggagugaggucucugaagccaaagagagcacacagcucuucuugaaauugaagguguuuaugccugagaugaaacugaauucuacuugggcaagaggugugcguauguguauaaagcaaaaacaguacagagacuccuggaggcgaaccaaacacgaccagagugacccagggaaaguaacuccggccagagaaacagaggcaugauuugugccgaauucugaagcaccuuccugcgaaggccauuggacagagaauuuguccaaugggugaugcuguacccaucccagguuuaaacuaaagaaaauuaaauauaugaaguggauuugugcuuuuguuuaaaagagaaagaaccguaguaggaacuggugagguggcucagaguaaagcagugcugccaagccugaacaccuuaguuccauccccaggacccacaugguagauggagagaacugacugcagcuugucuccugaccugcacaugggcacccaaucacguacacacaaauaaaucauuuuuuaaaacaccuuugacaaagacguuagaggauagcuuuccuuacuggucuuugccugucuccuucccuagguccagugcguggcauugacuuccauaagcagcagccacuguucgucucuggaggcgaugauuauaagauuaagguacaggggaucugucauggcugggaguaauaacuacgagaaugugguggucagguuugagaauuauggaaagaagugagagacagaauucauguguacaaacuuugacuucuaacauuauccagagcacuuccccagcaagugcuuacugaacacuuauuguaugccagaagcuuacuguguggggauugaaagauagauacaaagugacuucugcucucaaagagacuuuaacacagggauaaauguacacucacauaauauguguaguuuggugaaugauauaauaauaaauacucaaagaacaguccagguacagagauggacguggcauagcuggauguguuugagaaucuccaguugguauuggaugaguugggaaggucuagagagauagauacccauaagaauauuaucuuauaaaugcguuggcaagugagcagagccugaacuugggcaacaccaucugaguagagaggaaagcuuaaggguacuugugaugacugcuggagggauagggagaaaaguggaugagacaccauugcuguauuuuccccucggugcugggaguugaucuuagggccucguguguucggcgaguacuuuacuacugaguuacauccucagcccuaagaggaugucauuaacuugcaaagacaaagcuggaguagguacaguuuucuggaguuugggggaaugcauaguucuacauuggcucugaugugcuugcgcuaccuaagagacucacugaauauuugugauuugucaaagagggagcuaaaguccuaguguggaagacgcugcacagggaacaguuugaauaacgggcaaaugaucaucuuaaaagacagaggcaacuuucccuugaggagcccaugcccacaugugggugugucuuacauucugugacuucucuuugaaaaguucuugggagugucuuccuuucuucuggguaccucucuuucucucaacccuugugcuuaagucugcauuaagauaucuuuauugcugggcugugguggcgcacgccuuuaaucccagcacucgggaggcagaggcaggcggauuucugaguucaaggccagccuggucuacagagugaguuccaggacagccagggcuacacagagaaacccuggggguggggggagaaaaagaaaaagggauaucuuuaucaaacaccaacccuaaaggggaaagaagcauugauauaggacagaguaauuuuauaguuuggagauaaaccaagcuucgaagagcaaaccuucuaagaugccaaggaggaaggaaaucggggaaagauaaaguggucagaacgagauccaggcuaagaagaagccuuuagauugccaagcuaggagcucgugaauaauccuagcgccuuacucucaggugugauauuaacuaggacggaggcaguucugugaagacucacuguaauaaaagcaaaaggcaggacagcaacaucagacuucuaaacagaugacgggccugaggguaugguucauuuacguggaauacuuaucuaguguucaugaaguugggcagcauauaaaacuggguauguacaccuguaauucuuagcgcucaggacguggaggcgggagaauuagcaauucaaggucauuguuggcuauguagcaagugcaaagaccaccugggcuaugugaaacuccugucucaaacaagcaaacaaaaagaaaccugguaaaccuuucaggagcccaagacaucuacaucggcuuuuguugaaucucugucuuugcagguuuggaauuacaaacuucggcgcugccuguucacauugcucgggcacuuggauuauauccguacaacguuuuuccaucauguaaguagcuguuggccuaaacuacauagugagacccugucugaaaaaccaaggucuggggaugauggaacacuuguaagcauguacaaggcucuggccugacagcacaagauuguucagagucuugucugaaaugucuuucaggaauauccuuggauucugagcgccucagaugaucagaccauucggguguggaacuggcagucuagaaccugugucugguaaaccaagaggcaguagccucaaaagagguuuaauucuuucuagauuuuuauagucagcugcuuuucagaucacucaucuuccuuccuuugugggccaugucugccgauugauugcugaucaucuuuuaggauccuuuucaguauaauaucaucaauuuggauuuguaauaucuuagcaggaagaaaggcauguaaguaggcuuuuagaauagaauguuaagcugcuuuucaguucuaguccuauaaaacuugaauugggaucugggcaguaggucuucauguuugaacugguccuccagaauucacauaagagguagggacuguguagagccacagccuuuagagguauccuacuaaagucuauaaaguauauuucuuauaagaauuacuaagauugcauuuauuuucauauuuuuaugucuuuaaucugagagaauuguauaaucucuguuccaugaaauuugaauuuuaaacauuuaaugucaggaagagacuuccuggagcaggcaaagauggcucaguggagaaaggugccaugcaagccuggcacccugcgucugacccaugcaaagguggaaggagagaacugacugcaugguacccacugcugcugcuccccuaaugagaaaauaauacuaaaaauaccucuuguuuguuuuauuuuuuaagacaggguuucucuguguggccguagcuguccuggaggucugucuguagacuaggcuggccuugaacucagagauccuccugcucugcuuccuggguucugagauuaaaggcaugcaccagcacagccuggacaaaaaagaaauacguguuuuaaagaagcuguuagcacagguggcauugcuuauuacuaguucagaguuguuagaugacuuaccuugccuccacaaaauacaauuagacaagcauuuguugacuaugaagaaagguauuuauuuaacuuagggaggcuauugauuucugccuuuaauuucauauguuuuuuuucuuugcaguguguuaacggggcacaaccauuauguaaugugugcucaguuccaccccucugaagaccuggugguaucagcuagccuggaccagacuguccgcguuugggauauuucuggugagcuacccaaguucaggggacagucuggucaugucuggcgcaaaacugcaauugcuuaaaauagcaagcauauuuggcuuagaacaacaaaaauuagaauauuccauuccuauuuuugaaggugucagaucugcuuugaaaguucuucauguuaguauuuucugugaaaguggcuuacucuaggaagcuaauuugauuuaaauaacuuuuaacuucuuuuguuaccucagauuuucauuaaaauauguacaucugaguuauuugguuaagaaccaagcuuuccauucaaauauuuuacaaauuuuauuccauucacguauuuuacaaaaauaaaaaaaaaaaauugagacuuugcagguaaacaggauucaugaacuuuguugccuuauuuauaaauggaaaagucuaccaauuagauuuuuuucuauaguaagaaacauagagugggaagaaguuacaacuguuuuuauccagaaaacuuuuaauaagcuuucuaagacuuuauagacuuuggauaacuaggcuaauucuuccugucauaguuuacaaauagugauuuugauauaaggguugaaauuugagugucauacagagaucuaaaauguagcuacacagagaacuuaaauacugagagauaucuguggcguauggaggggguuugugcugggaucgggacuaugcugagacucuaaaugcugugcuucucuacccaauuacauuauuuuaaaaaaaucacucacugaguuauuuuuauuugccacuucagaaagccuuagagauugaguucucuggaugucaguggugauauacaaaucaguguuucuuuccaaagcaggaaggcccuucuagucccuuaccugcuucuuuguggaaauaaaggaguuauuuccaccauuguacugcuaugguggugacuacccaacuucccuguaacacuguugggcuacggcaguuuaguguuugcuauuuuuauaaaccauuagcgaacagcaaguaaaacaauugaauuccugaauacacuauuugggaugugaugauauuauauauuguagaaauaaaccaaggggauaggcauggucuuacaugcuaucaucuuagcacuugggagguagaagcaggagaaucaggaauucacagucaugcuugacuacccaaugaguucaaggccagcuugggcuacacgagacucugacucaaagaaccaaacaaaacaaaaccaaagaaagaggagggcaguuagagaguggaagcacugucccaugcaguuuccaaaaguuucaagucacaagacagugcuguaaacaagauuguuuuggagauagguuguucauucucuagggcuuugccauugcaguuuuccgucagaccgacuaggcuauuugcaguacacccagaugugaccagccaugccaacaggaggagcuugguacaggcaucaugagcuugugcccucuccucucugccaguacuggagagguuagcauucacucucuccauaaccuagcuguggcuuucugugggguuucaccaugcacacauucaagacacccucucaggagggucucaggagacgcaccccuaaugagguugguucccagcuccugcugucccagcuaaucaggggcaguucuguagaauagucugaguucugugaaaaaguugcaauaggaagcaccuugagugacuuuucucaguuuucccaggaaugguguacaucuaauuccuuggguuaauuuugugccuaaacugcugauuuuagguuccagggguucauccccagaacauuggacugagaagacccuuguccugccccacguuaaagugguggugguuugugcuaccugcugccagcacagcauguuccuuguggucuagcuaaagugauuggagaaauaacauuuuuuuuuuuuugaaaucuguuaauuaaaauaagaaagcaauuugggcaaguaaggugcccagguucucaucugugaccaugaaaaugcucaaggcaagaaguacccuucaucaucauuugcaggaaggaaacauguuuacaucaaaauuaauggucuuagauuagaggugugaaggagaguaugaccuuaugggguuugugcugcucuugaaugugugaauugcauggacugcuaugugguacugcaacugcuauaaauaguagaugcuccagugggaauguugugcuaacuugcuacacuaaugugaauguccuuuauuguuucucugcugacucuguugacuuuaaauccuuuaaccagaguggaaggggggugcuuugguauuuaaguggaagugcuuuuggguuaaacuuuuacacuuuuauugcccuuuccucaaaauuagcauaugcuucaggauuucauuuuguuguauuuccaauacgucugaacacaggaagagaaaccaacucuccuggucucuuagggagugacauuaacauuuucaagaaaguauauuuaaaauaaggggaugaauacucccaaauuuaggggacuggugaaguucugauaauuuuggcucucucuuuugaaaagaacacucugagcuaguggguaacaccaagagaaaguagagagaccucuuuaaggcagagcagucccuuaacagcucucccauguggauuuggccucuggagcucacuguaaccugaauauucuguuagccugccuaaaaucaucuguuuaaaggggaagaguuuuaaaaucuaacuguggaagauggguuacuguuucagcuugugcuucuaaguaaacugucaguuaaauuauuuuaauaugcuuacaucuuugcaugucaagcccauguaauucaggcucacucuuuuaaauauccacuaaaauauauuaauaugcugccaaauccuuuccucaucccucucuuucuucugcaucccugguccccacugggaggcaaacguaacugguccauucugagagugugcucuucucccucuggauuuggguagcugcuguagaaauuuuccaucugucgcucaguccuagugagugccuugucgaaggcucaaacacuuuaucucuaaguaucuuuucacugccugucacuguucaucugucucgcccuuccccuuuccuggaucacugcaggcaagcgcaacaaaggcccaguucugccccacagcuucccuuuaaugugucuguugacgcuuacuggaggugaagguccucacagcugucugcuuuuguaucuuuuugaaccuguuuuauacacuucacucaauagauaaaguugacagauccuauuaaagggacaaaugaaauaaguguaaggcauccuugugaucauguauuuaggaagugugaggaaaacacuuccuguuuuucauccgguuuaugucucuaugccuauggcuaaggcaucucuuaaauugggcauaaaauaauuaaaacuguuuaugcagugcuggcauuaggcacuacccuagcagaaauacaaaauaguuuacaacacuggcaagaugagucauuugaacuucuuuccuuucucuacacauuuuaguguggagcuucuuaggguuuguuuucuuucuuucuuucuuucuuuaaagauuuauuuauuuauuuuauguaugugaguguacuguaguuguacagaugauagugagccaucaugugguugcugggaauuaaacucaggaccucugcuccagcccgcuugcucuaguccaaagauuuauuuauuauuauaaguauucaguagccaucuucagacacaccagaagagggcaucagaucucauuauggaugguugugagccacgaugugguugcugggauuugaacucaggaccuuuggaagagcagucagugcuccuaacugcugagccaucucuucagcccaggguuuauuuucaaugauauguuuuauuuagucuuugcuuuaaaauacugucuuuuuaaaaaguuucaacaaauguuagguauuuucuuucccaaauauuuuaaaagguaggaauuuagucuuaauuuuguuuuauguaauuugguauaauuauauaugauuauuaccugucuuuaaagguuguuaucagaaacaaaucugaugaaacugguauuuguacuauaauuuugguucugguuuuaauacaguuagucagcuuuccccuaccucucccugcuuuuuggaauaggacuuuucucuguaggccaggcucaacuuaaaacaguacuccuguuucugccuccugauuguagaaauugcauguaugacccgccacaccuuaaugcaagcacucaggcuuuaaagguguguagaugggucauaagcgugggucgccacagaucagacacuuauccugaugucuuuguuuccuaucauuaaaaauuaugggcuaauaauuccucccagugaaaaauagcuucuguagguuuuaauggaaaaaauacguauguucauaucuauaaucagcauuuuaugcaagaacaugaagaauucugacggcuuuaauuauuugauguccuuuucaggagguaaguaggaagugugaggacucuuugccauaucuucucauaguauuuguaauaguucuuccaagcuagacagcuguuuuguuuauuaugucuacuucagcagugcaucuggaacuuuccuguaaauugcuuccagcuuggaaaacacuaaagugagaucuuccccaggagcauuucuuuaaauuuuuuauuaugaggauuagagguauggcucagcaguuaagagcacugaccacucuucugaaggaccuggcuucaauucccagcaccuuuuuggcagcuuucaaccaccuguaaauccagggacauuguagcucucuucuggguucuacaggcaccaggcguacauguguuauacagaugugcaugcagacaaacauccauacauaucuauuaauaaaauacauuuuuaaaaaaauuaagguaaaaauaaaauaaauaaauaaaauuuuaaggugauagaaaaagguauagauuuuaugaaccugaauguggacauugaaugauuaccauuugaggccacauuuugggaagauuaaagaauggguaguguuacuaaucuaaaauagacagcucuuggaggugagauuuaaugaacuuaguugugucagaauuuggauuggcucccacuaagggaucguugaguguuagggaagagcuagugagggguaaguaggcuugugagugugguucuuccuucccucuaguuguaguuucccauuucauuuuaucuuagucuuucgcuguaccuuucgugauucugcuacugugcucuuacugauaacauuauauuugcaucuuucaucccacuccuuaacccuccaaaggucuaaggaagaaaaacuugucuccuggugcgguggagucggaugugagaggaauaacuggcguugaucuguuuggaaccacggaugccguggugaagcaugugcuagagguacuuaucucugucgcucacugugggugaggguaugcuacucucuagagacaaucucgguaugcuguugauuuaauuuucaucuggaaaugagugugugaugugugugggcaugugugcugcagcacccgugaggaguccacagugacaguucugugcacucaguucucucugugggucccaggauuugaacugugccuugaguagcaagcaguuuaucacugagccaucucacuggcccacguuuauuuuucaauucuuucagcaaauauuuaagugucagagaccgucugagauuugaggaauagaauuuaaguaagccaacagagaaaggaagauuacaugucaccucagagagaguuauagcaucuuguaaauccaguaggaagaaagcuggacaugugucccauuacugucaugaagcaaagccauucuuagaccuuguagaaggagagaucccaaagaaaaucagugagaaguaccaagagccaguuauguguaagauguaagaaacuuguucauggugggaaauagaaaagccuaagaaaagaaacuagguuuucuaaaauuaaagucuuacuauaaaacuacucgcugaaaugugaacuguuuaaucccacagaugaaaaaaaaagagauuuagaaaaauuacaguuccccaaaguccagcuguaugcauugaauccugggcuccaacuucaaaacccacauguuuuuacaaauacaaaauacccuaacacuucucacucaacacugccaugugcaucguucugccaaagaaaugaaguacggucguguaaauagcauagagacugucaugaaguuagcguccuuaacuuuaugcccuuuagacucuuaaagcuucauaagaauuuaauuuaacuaguuuauuuuuauguagaggaguauuuuacuugcauguguaucuguguaccauguuacugucugucugcugccuucagaggccauaagaggguaccauaucccuuggaacugaaguuagaaacaguaucugggugcuuggaacccaaccugggucauuuguaagagcaaucaaugcuccuaaucgauuagccaucucuguagccccuuguuuuuguuuuuuugugcacaugcccuucuacuggaugacaccuccagccuaaaccugagaaccuuuaaaauguggauuuugucagcauacauuuuauuagcugucagaacaacgaugucaucacuuauaaugcauccuguggaaaacaccacuauguagucauggagaauaacaauaaaggcaaauaaaaucuuaguaggauuugaaaaauagcuuugaacuuguagauuuuccagugggaucuuaggacucuuucaagguauuugagaauuuaggcguuaacuuauaaaucuuuauccuuaugauguugcaauuacuuguagaaauaaaacauauauagacaaguaaaaaguaaggaaaaccuaacuauaaacaaagcugaauuuccuuguggaaauguuugcaacaucccaugagaauuugaauuaauauuggacauguugauaugguuauucuaauguucaaagcuuuauaguaagccaaaacaaacaaacaaacaaaaaaacccaaauguuuguuacaaaaaaaaaaaaagucaaaugaaaauaaaauaucaacaaaugaucucuacaguggcacaaucucuuaagucuuuugccuugaguauuucagaggcugaggaaauagaucagugauagaguacugacuucagcaccuguaaggcccugacuuugauugcccguaucacagaaaaagaaacagacacauuuuguuauaaacacuagcaugguuuucuuugaauuguguuuuuacagcuguuguagaagacccacuuuuucucuuuuuaacagggucaugaccguggagucaacugggcugccuuccacccgacuaugccccuuauuguaucuggggcagaugaccggcaagugaagaucuggcguaugaauggugaguaagguacuggcgauguugccauagccaagaaaguggcagccagccagcaaggggaaguagccagguuuucuggacuuuggccuauuuuucugccuuaggccuuaguugauuauuuacugcuauuccuaagugcaugaucauugucucuuccuccccuccacaccccucauggcaguaucuugauuuugagagauaugagcauagucaagaguaaaaguucaugugacaaauugugaguagcugcuuuguuuuagacuguguuuagggccauauuuauauuauugugacucaaaauuuccaugauauagaguuuauauuuguucucagaaucagcaaguaauacauauacuauguggauaaaauaagaguagaagcauaaagaauuauuuaauauagcuguuacagucaguagagguacauaauaaaagaacagagauguacagaaaaacaggaauuuuggagcugagguagcuguggcuacucaagaggcugagguaggggcuggugagauggcucaguggguaagagcacccgacugcucuuccgaaggucggaaguucaaaucccagcaaccacaugguggcucacaaccacccguaaugagauccgaugcccucuucuggugcugucugaagacagcuacaguguacuuuacauauaauaaauaaauuaauuaauuuaaaaaaaaaagauuuccuaaaaaaaaaaaagaggcugagguaguacaauuccuaggaggucaaagguagccugagcaacagcaaaaccuugucuugacacccccccccccccgcaaaaaaagguucaaguaacuaaaaaaaauaaacauaaaauaaagaggaagaaacuuacaugaaaaacauugucccauuuggggaaaauugauuuagcauuuugcaauaguacuuagcacuugcauuuaaagagcaucaucacagcuguccaugacaguauagcuuugcaaugucuaucagcaugacgauauagccuugcagagucagcaugcauguacaugacaguacagccuugcaguaucagcaugacgguauagccuugcagugucagcaugcauguacaugacaguauagccuugcagugucagcaugcauauacaugacaguauagccuugcagugucaacaugacgguauagccuuguagugucagcaugcauguacaugaugguauagccuugcaguaucagcaugcauguacaugaugguauagucuugcaguaucagcaugcauggcugaggcaggaggaucacaagcacaaggccguccugagccauauagcaaaaccuugucuccucaaaaagcuggggcuagagauggcucaguggacccacagagggcugaguuugguuccuagcaccuaugucaggcagcucacagacaucuguuacuucagcuccaggggcccaagggcugccuucuggccuccacagauacuacacucagaugcaaaaaaccacauacagauaaauacacacaaaacuaaaaacacaacuaaaaucuuuuuuuuuuuuuuaaagaauggguguuggauuuauagaucccagaguuauuacagagaauugugauaacaauuccuuuuguucuucagaaucaaaggcaugggagguugacaccugccggggccauuacaacaaugugucuugugcuguuuuucacccucgccaagaguugauccucagcaauucugaagacaagaguauucgagucugggauaugucuaagcgguaagggaauuauuuaugucaugugaccaaacccaagagaaggacccuuucuuugucuuauccuuugucuucgcgcgugcgugcgcgcacacacacauacacacacacacacacuccuuaugcaauauuaauaucuguaaaaggaaaggaaaaaauuagaauacuucuuuuucucuucagcaugaugaaaaaccaaguccuguguucugaaguucuaaggcuguauugcuuagugguuaaagugcuugccugucaugcaugaggccauaaauguaauccacacugcuguaaagcaguaaauaaauaaauaagcaagcaacagcaaaaacccuuagagacuaaaauagcaacaauauuuuuuagguacaaaucucccuguauucuuuuucuccucuaaauuugaguauauuuuuuucuucccuucauuguucagcuaaagagguagaaaugugaacuaaaaguacauuaggagagacaagggagaaacuggccugccuaggccuggguuagugugaagccuucccucccacuguguuccuugugggugugguccugauccuuagcugagugcacagcauucccugucuccagugcacuuguaaagucaucuuccaggccugcuacucacuuuccuugugcaugcuguacugaagagccuugauuaacgguuucuucuguaccuuuugguuuucuaggacugggguucagacuuuccguagggaucaugaucgcuucuggguccuggcugcccaucccaaccuuaaccucuuugcagcagguaaggaccauuucuucuucucgcuccugggauuuaguugaaaguuuguagauuucaaagugauucuuccuuagcuuugucucuuauaagugguaauaggaaaacaaagagaagcagaguuuucagagccaccuaccggaagcuuuucucauucucaucucuuacuuuugggagauggagcucuuuagugaucuucaccaugaagcucuguuugaccuuaagcucauucucugugaugugcuuuuaggagcucauaggagacuaauagugaacauuuagaguucucagagugagaacguagaagccaagucuacuucauucauuugucaaauacauaauaaaauaucagcccaugcucuuuaugcuggugucagagcagugcauaaauacugccugccuuaguggagcuuuaagggagauggucuguaaacucuaaguauagaaagugauguguguuugaagaugccuugaauaaaaagucaagggaagggaggacgaugacagugguggccuacaggcuuauaguggguauucaagaacgugaacaugagugagaaaagggagacugugcugucacaggcugcuuuccuaguuuguaugagguccuggguucaagaaagagaaggaagaccagggagaugagugacagaaaacuauuuggaaaagguuuuuaaaaacugugaguuuaggaauguauuuagggggggggguauggcggacuuuugggauagcauugaaaauguaaacgaggaaaauaccuaauaaaaaaaauuuuuuuaauggaauguauuuagcuauuguaucuguuuucuauagcuacagcaaaaaugcuucacacuguguacuuuuuuuuuuuuuuuuuuuugguuuuuuucaagacaggguuucucuguauagcccuggcuguccugggaccagacuggccucaaacucagaaauccaccugccucugccucccgagugcugggauuaaaggcguaugccaccaccgcccagccacuguguacuuuuuaaaaagggauuugagccaugcgguagugucugguugaggacagccuggucuauagagcaacuuccaggacagucagggcuacacagagaaacaaccgucuugaaaaaccaaaagggaguaggagguagggggcuagagagauggcucaguggucaagagcacuaacagaggacuaaagguguuuccaguacccacgugguaucuuauagcuauaacucuaguuucaggcgaucugaugcccucuuuuggcuuucccaggcaccaagcauagacaguaugcuccaacgugaaugcaggcacucacauguagauauaaaauaaaaauaaaugaaucugaaaagggggguauuuuauucacuauuuuggauguugaaaauccaagguggagcagccccaacguuuguccuuugguaaagguucuuuuggcucagucacagugugacacagagcaucaugaaaggaguggucaagagagagaucacaugaccaggcaggaauccagagagaauucaggauauucuuuguauaucaacauucuccccagguuuccgaugacgcauauccuaagaggacauuaaucccagagugcuccucuaauggccuacugacauuucaucucuuaaagaugcugucaccucaguaucacacagcaagcuucuccacgugaaccuaggcacaguccaucuccaagcuguaguagaugccccuuacccuuuugacaugugaauauaaucauccucgugcaucucuucuauuucuagcaauccuuuuugccaacagcugauuguuuccucuuuucucuaggccaugauggugggaugauuguauuuaagcuggaacgugagcguccugccuaugcuguucaugguaacaugcugcauuauguaaaggaccgauuccuccgucagcuggauuucaacagcuccaaagauguagcugugaugcaguugcggaggcaagucugacuucuccuuuccaaacccucucaucuuugucauaaugcacuguccucaagcagggcucuuuaaaccaaccuugugaaucucagcugucagauauggacugcccauugaauaaaccuccuuaauuuaaauuccuuuaugauagauucagaggugucuaugaggagaauugagaagucuccucuugagacugccagugacccuguggugaagauauccuacuacagaugccugcaaagucucuugcagauuacagaaaguucuugguagagaguagcccgauuugguaauauaacuuuuugccuuugccauuuaugccuugaggaaccuuguggcagagaggggugauagaccuaaaugacuacaguacagaauaauaaaaaaauaaugagaauuuuuaggaguugcaguuuaucuuaauucuaccuuuacaaaagacuacaagccuaaacagcagaacugugucucugaacuguuaacucaagcuaugauagccuggccaaaggagcuuuggaaugccagcugcagcacucugaaacauucaugguaguaagcacuggcauucgggguugguaaccacccgcuagcuucacugcaacagaaagauggguuaugcaaacagucccagggauagaaagcaggcagagagaucguauuaugcuacucugugguguccacugcaguuaugugcagcaguuuguaccaggccgaaccaucacugcuugccaccucugacgaugguguaacuucugcugugcuuugaacuauugaguagucaaguuuuaauggaaagagaaaaaauacaggaucuaucuccucaguacggaaguagugcaugcgcguccugaggguauaaacguugaagcgauagauucuccugucuguucuuacccgauucuguuuccuccucuuuauguagcgguucuaaguuuccaguauucaacaugucauacaauccagcagaaaacgcagugcugcucugcaccguaaguaauuacgagucucugugggcucuccuuaguguuuguuacuauuuuacugcccuuacugcccucuaauggccucguaaaauauuuuuuuccucaguacugaaaguuaaacauguggguaccugcuaagcaaguugucuccuuuccugauagagcuuuuacuggauagcucuauuuccugauagagcuauuauaagagcuaacacaguagacacucguaggcucaaacuagaugguuucaguugucguaaccuauuaaggguugugaggugaucaggauuguuggcacuuguuuguuguuuagaagagugccuuuucuguccuucugcuuaggggaacgugagagaccugugcugggaagcugguucuuucagugacguuaucagacuuaucagaacucucccuuuucccugccacacaaguugcaaaaaaaugaagcaaugucauucuagcuuuaggacccagguggcuagaugaaaaguguccccuggguaacuuugcauauggaaucuccuuuaauaucuaacaccaccauauucuugaaagucuccuucgaucuguuuuguuuucuuucuuuaaugugacaaguguaaucaaaugagaccucagguucaucaucuuuuaauuuguggaauagagaaaccuuggguuuccgucagguaacauugcacauuuagagaguaaagagagcagagccaucagugcuuagcuguuuggcuaagaggagacugcaguucuuacauaggaaaaggacacccucuggugcagguaacacaagcaggagaaaugucuuuucugucaggaaaagccagggucugcagugccucccucacuaaacauguuuccccuuuuccccuccagagagcaagcaaucuagagaacaguaccuacgaccuauacaccauccccaaagacgcagacucccagaacccugacgguaggugccgcuugcuuccagcucuccgcgguagcaucacuucuuuucaaguuuugcacaucccauccccaggccauggcuacaucauucuugucuguuggcaggugcugcugacaguugcaccagaggcaauuguggugugaaauauucauguucugccuccauuuuauuaccccagcuagauauauauauuuuauaauuugguuauuagaaacucuccauuuucccuuucagcacagcauguuacccuagauuauugucagcugauaugacuuucacccugguaguuucauuuauuuaaaaauguggcuccagucuugcaaugucucauccugggaguggggauuuauacucuccuaucuauauccagauccgauuugcuuccuuuugcuugucaaaaagaugaggcugcucacagccccaugacccaccugggaucccaggauccagcugagaccccugccugccucuuuuaucaccaccaucucuuguugacauccuuacuauuagaacuugcuuacagaacauucuguggauggaugggaaucucauuuauguucuguucuuuucucuuuuuuugguuaguuuuucgagacaggguuucucaguguagcccuggcuguccuggaacucacucuguagaccaggcuagccucaaauucagaaauccaccugccucugccucccaagugcugggauuaaaggcguucgccaccacgccuggcauuuauguucuuuucaaugcaguucuucuaguggguuugcaggccuuacccagucugaaguuuauuccacaagcccuccuuuuuucuaguacauuuugauauuuauacccuccaaaguucugugaaauauuuugcuaguucuguuccuuuugugagugccaacaggucauuauuacuauaauacucuuuggcuuacuuuguuuuuuuggagaggcuauggcuauguauauguauauguauauguauauguauauguauauguauauguauauguauauguaugagacaaggucucacuguaugaccagguuagccuagaacucaugguuccccuugguaauggaguuacacauuaugccaacucguuucagccuuuuaaguguuuuuggagugagauaaggacagaagcaggaaaccuguguauauuggggauccauaaagcaaagucucccccacaaagccuuccuagucaguuugaugccacccaccuccagcuuggguuuuguuguuguuuuuccauaucuguuaacaauuacuagaccuucuguucuccauccuuugggagaaauaauaauuauaaagguauggucuagugauggacuucagagaggagaaagcagacgcuggaguaguauggguugugguaaaauuuuguuuuguaauuucuuuggcacuccagguaccagagaaguacaaaaccgggcuggccagcauguuuucugauuuguuuuccacugcuaaaacagauaagacuauuugaauuuauacuuucaagcuucucagagaguagaguauccauuucaaaauucuaaucagcugcaaacugaggaacauuuuauagcucuccucagugcgauaauagugaauugacauucaccgagcaacagcuugaugcuguguugcccagcacgagccugucaagauuuagcuggaagugcuguguccuacccugccugagcuggaggccuacauuagcauguuaaaagcagcagcacagcugaguccugggguugggcucugucacuucuccagcacguggauaggaggucuuagacuuugacaggcugcuugcugugccucugcuuggcuaggaaaccucugcucguuagcuugauggaguaugcugucucccaagaugggcagcaucucugccagucuguagugcuggcugaaaugcagccacuuggccuagagauaagaggcuuggcaggggugggggcuggaguuuggagggaaaggaggggaaagucacugacaauagcccgagguuauggcugaauuaguuaggaagcagcugaacuggcaaagccaaaauggcagcuccauggcaccugacucugucaccugcuaguggcucaccacaugcucccacacucugguuuuguucuccucagccccugaagggaaacgauccucaggccugacagcgguuuggguugcucggaaucgguuugcuguccuagaucgcaugcauucaguaaguggaaacuaauuuagggaguacaguaaugguggcccauacuucccuggucucccaucagcccuagucauagacuaaccccuuggggagggaaagucgauuugauuagguugguguuacuagaccucuggcuucugaaucuggaaaagcuaaaaccaucagauuuuaaguacacgaauuagaugagagggauauucuccuccuugucccacuccccuaauugguacuuaaaauguaauagauuagagagccagaugaugauagacaucuuuagucccaguaccugggaagagaaaugcguacauauggacagacagacagacauucauaaaaugugauaggcucaaugcaagauaagauaagcaagggucuucuaauaaaauacucaaugaaaguuuaaaccuuggcucuuuucuuucuaguagauugagaaacucagauuuacaugaauaucuuuuauuugauuuuuuuuguuuguuuauuuuuaaguacagggcauugaauuuagggccuuguucauuugaguacucuaccacugagcuauauccccagcuuucauuuuaacguguucauuuguguaauuuuguguuuguugugugauuuugagggucucaaugagacuggugaagaucugccuagacuaggaauggacuuacucuacagccaagacagagauugaguuuauaauccucccaaguggcugagauuacaggccugcacucugaggccucuuaggauauccuccccuccccuccacuucucuucucuucuccucuuucuuucuuaaagauuuauuuauuuuauaugaguacacuguugcugucuucagacacagcagaagaaggcaucugaccccauuacagaugguugugacccaccacgugguugcugggaauugaacucagaccucuggaagagcagccagagcucuuaaccccugaaccauuucuccagcguucucucucucuuucucucucucucuuuuuuuuagggaaagagguuagaggccagugagaugucuuaguggguaagaacgcuuaucaccaaaguagaugaccuaaauucaaucccugggacccauguguaggaggagagaacugaguucuucaauuuguccucugacacccccacacacacacacuuggacaccaugaaguauauguaccacacguucuugcaagcauacuugugcgcacugaaugcacacacacaaacaaacaaauaaauaaauauugauaggcccuggagagagucuuaguaaucaaccugauguauaaaugacuuggacaggggaaaaacuucuuuauuaaaggagcaauugcugaggggcaucuuaagcucuugccuuauuuauucacuucucguaacuccacccauucucguuucagcuucugauuaaaaaccugaaaaaugagaucaccaagaaaauccaggugccaaacugugaugaaaucuucuaugcugguacaggcaaccuccugcuucgggaugcagauuccaucacacucuuugacguccagcagaagcgguaacaugacugaugcuccugacagacagacuuguaaugaaggagaguggggaucuuuaauaagggcuuuguucuaagcuugccacauggccuugcugcuucuuguacacucaccuacaagacuguuuguaauccuuuuucccuuuccauggcuauuccaccacugugugcaugcauuccagcaguguagccagggcuguguguucaggugucuuuauaguacacaccugaacaaggaaugaguacagcucuugggaugagaagaacacaaaguugaauagcacagauccuguucuuaaagaacuuaauaagucuagugguaaaaauugauagagauaaaggccuaguaagaggaggggauucgaagacagagaaugaggaaggggcagugcagagugugagccaaaacacuuuagcucacugacuacaguguaggcaguguuuccuugguguuacauugagaaguugaauucugcauugauuaaagauggaaaaggcauaggucauaguuugagacaagggaauuaggcccauucaugauuaccuuucucuugcuaucccagaacucuggcaucagugaagauuuccaaggugaaauauguuaucuggucggcagacaugucucauguagcguuacuggccaagcaugguaaggcuucaucauauccaccgucuuagaggccaccuccuccugccaguuuacuacacucacccuguccaacagagcacucaugcccuuugccucuuacagccauugugaucuguaaccgcaagcuggaugcucuguguaacauucaugagaacauucgugucaagaguggggccugggaugaaagugggguguuuaucuauaccacaagcaaccacaucaaauaugcugucaccacuggguaaguuaauuaucugagaaaaaguuugggagaagguggcuucuugcaaucacuguacuaacucaagagacauaacagcaguucucugcuaacuuucuucaugaaaaagcuaacugggcauauauauauaugcuaaaggggugugugugugugugugugugugugugugugugugugugugugugugugugugugugugugugugugugugugugauugucucuaccugucugucugccugucugucugugucuguguugacucaguggguagaggcaguuucucaaaggucagacaacccagguucaaucccuagacuccucagagugugugugugugugugugugugugugugugauugucucuaccugucugucugccugucucucugugucuguguugacucaguggguagaggcaguuucucaaaggucagacaacccagguucaaucccuagauugcucagaguggcaggagagaaucagguccugagaguuuuccuccagcucacacacauaccugcauugugugcaaacacacacauaaaauaaaaaauuucaaaauuuagggaaaaaauuauaaagaacuggggagggaccagugagauagcucagcagguuuaaaaaaaaaaaagugugagccugacaagccgaguuugaccccagaacccuuguauagguggaaggagagaauugacugcacagcgcuguccucugaccuccaccaaugcacuacagcaugcaugucuacacuacguaauccaugcaugcauauaucauagugauuuuuauuucugaaggaagacugcucauugguaguuugcuuuccuagagugcccauggcucaauuccucaaacugcaaaaguuuguagcaccuguucugucauagaaaagaguaaaauccuucugaaacacuuccuguuuguaccaguguuuagguagcauuugaugaaaggauaacaaggaaaggcugucuuaacucuguuccguuuuuacaagguggauuuucucccuucugaaaauugugccuuuuguccccugcuccuagggaccaugggauuauccgaacucuggauuuacccaucuaugucaccagagugaagggcaauaauguauacugccuagacagagagugucguccucgggugcuaaccauugaucccacugaguucaaguucaaacuggcccugaucaacagaaaguaugaugagguaggaagcaaagcgaccuaacgagguguugaaggaggcagugcugcuuuuuccucaugagugaucuguuuucugccuaucacaccgaaugucuagguacuccacauggugaggaacgcuaagcugguaggccagucaaucaucgcuuaucuccagaagaagggcuauccugaaguggcgcugcauuuuguaaaggaugagaaaacucguuucagccuggcccuggaguguggaaacauugaggugagaggacugugucgucagucccagauagcuguagagaaaggaaggcucgggaccagcguaaccuaaugugccagaggcuggacccagaagcgcuauccuugcuuacauucuagccagaguagaguuuuggauguuuuuacuuaaauugagcuauuuuucuguugcuauuucuguuucacaucuuccugucuccucuucugcacaguaguuccgcucuuguuaccauucauacugaauuuaagaguuucuaggauagaagcuagauagcaagaaauuugaagaaucugcucauuuuccuugacacuugguuuugcuggaugaaguacuuaugaaauguugaggcccagacauuguuucaaggauaaaggagcuuaugaaagcugcuuuuccaguccuguauuucauuccuucuuuuauuauuuccucugcccuaaaguaccuaaagcuacuguggagcuucuaagcuaaggcacuaggcuaggagagcacuggcucuguggaguacacaguagauaggugauuguacuguacuagugaacuuuggagggugagugagaacacuauggugugacuccucaucuugugaauucagaucacacuugcagauagaauucuccagaaaaauagcaugaaaguagugauugcaaguauagagaauuccuugggaaauuuuagagacaaauauuuuguuagacuccgcuaguuuugagucauagugccuacacuaaacacugaccuugggaacucuuuagauugcucuagaggcagccaaagcccuggacgacaagaacugcugggagaagcuaggagaaguggcccugcuacagggcaaucaccaaauuguagagaugugcuaucagcgcaccaaaaacuuugacaaacuuuccuuccuguaccuuauuacuggcaaccuggagaaacuucgaaagaugaugaagaucggugaguucucuaaacuaugguuuggaagugugggacuuguagggaaggaggaagauaaauagaggagagagaucuuuagagagaaggcuuaaauugguuucucauugacuugcugcagcugagauccgaaaggacaugaguggccauuaucagaaugcccuauaccuaggugaugugucagagagaguacggauccugaagaacugugggcagaguaaguauuuguccaggacuuccugauccuuugagaccuuugcaaggauuuuuucugggaguugcucuggauuguacagugugugucuguccgugugcauaaguuaaaggacaacuugugggagcugguuuucuuuuccuuuacuguauuucugggagaaaagucagacugccaggcuugguggcaagucuuuaucuauugagccuucuugaggguccagauuuccuauuucuagaugaggauacucagacuguaauuucuaugcaaguguuacaaaaucugaaaaucucuaaaaccugaaacgugacauaguuuccaaagaauauuuaaauuauaguuccuuuuaaaauuauuuuuaacaaacauuuaauguguaauagacuauaacauaacacuucuagugauaaguggcaaaagaacugagaucuuuucagauuauugugacagugaacucagauguuacauagugcggaaugaaggaucacugucaucaggcacagcgaacaaacaggguucuuuuuacagacagggucccauuauacagccaagguucccuuggccaggaaccuacugcauagaccagguuugcuuacuucccccuuuagcuuuuucuuuuagcuccucaaguuucuucuccuuucccuuuuaucugucuugcuggcauacuucuugggcuguuucagaggauugccacacuuguggugucuauugcuccuuuccaaguuaaaacaacuaagggagccaacucccaacagauuguccucuggccuccacaugcugugagacucauacagacauacacaccauaaauaugcaaagauuguaacagauaaaauauacaucccucacagguagagugcuuuagcuuuuguuuaguguguguaaaccugcagucaaaguuuguuaggccuacagacacagagacccaacgggaaaagaauucauuuccauucucacgugcaugggugugggcauuucuuggaucuuuguuccccuuugucugagaaacaguaucuaucaucuugccguguuaccuucuccaucacaaaguucacaacguggcacuugguuucuuucagaacagguuaacaagaugacacccaaaacaguccacaguuauuguaagccaaucuugggugugacauugcaucacuucugacauauucuguccauuagaagcugcucaacaacuucagccuacacuuauguuuggguauuaugcaagcauuugaauacuaggagauagcggucaucccuacgaaacuagcguucuuuuggaaauguaccuauaccacaagcccuguuuuuccuguagaaucccuagccuaucucucagcugcuacccauggcuuagaugaagaagcugagagccugaaggaaaccuuugacccugagaaggagacagugaguauuuacacagacaucucugauaacaggauucauucccaucuugggauaauuuaaaaucauaaauuuuacucuaccaggguggggguaugaaggggagauaagucgagaggaagcauuuuaacccuuugugugugauuccugagagcuauuugcauuuaacgucuuucuuacuccaccucucagaucccagacauugauccuaaugccaagcugcuccagccaccugcaccuaucaugccauuggauacaaacuggcccuuacugaccguguccaaaggguucuuugaaggcuccauugcaagcaaggguaagugcccauuccucuuagcacuuuuuauaaaaaaauacuguuuuuauagagaacgauccuaagugggucugaguuguacucaguuagcagagugcuuacccagcauguucaaaacuccggauucagaccccagcgucacgcacaugacugaucagugccugugauuccagaaagagcugguggucagccuuggauucauaggcaguuucugggcagccuggacuacauaggaccauuucuuaaaaacaaacagggggacuggagagauggcucagcaguuaagagaacuggcugcucuuccaaaggaccagggcuuagcucccagcagccacauagcaacucaucagcaacucucuguaguuccagcuccaggggucugauaccgccauaccuggggacugaacaacaauugaauauuuaaaaauaaaaaaacuguuuagaaagucccucuaccagcuuugccuguucuucuuucugugugaaguuucacagagcacugugaugcuaggaugucuccaaacugagguaaacuuuuugagaucuuuuuaaagggaacuugagccuaguauagcacauaccuguauucuuagcaauuagaaaauugaagcaagaggaacaagaauucaaagccagccaucacagaagcuaguuuaaggucaggcuggccaaugugaaacccuuccucagcucucuagccccugccaaaaaaaaaaaaaaaagaaaaagaaauaaaagaaaggaagaaacguagaaaaugaugguaaguggcugccugcacugccacugacauccggagcacgcacuggaguguuucucuaguuccaccacacauguccgcaucuccacuuaguguuuuccuguccaucgaugcuucuccccagcauccaagccgagcccuacugucugcuuacacacuuauccuaguucacuucugagcgagagccaacgcagaggucaggcauucugagccuaagcagaggucaggcauucugagccuaagcagaggucaggcauucugugucuaagcagaggucaggcauucugagucuaagucuggcccauucuuugcucaccuccugcacccaccaugucucuuucucugcagacuguaauaauagucacuuaggaaagauuucagagagaaauucuaagaguaggcagccagaugcagcuggguuuugguggcagggaguuuguucucuccaacuucaauagggauugaagccagagccuugugcauacucgacaagcuuucugccacugcccccccccacccacccccacuaccaccaccaaaacaaaacaccaaaaaaaccucuggcuaucuuucuucuauuuccucucuuuguggaaacuguaucaaguuagcauaacuuauauaugacaaaaccaauaacucauagucuauggaugggaacuuuggagauggcucagucaguauaaugacuuccaugcaagccugagggucugaguuuggauccccagcauugcgaguagaguugcucacauccacacaugcacacagauacacagugcagaacaagacagaaccuuggcaauuauuuuugucuuuuguuugggguucguuuugagauuuaacaauacaaucaaacauauuuacugacauucacaguuaccaguuucuaaauggacacauauuucugaggacacaguucugagcaaguuuugaaagcacgcaccuugccuguagaggagaucaauugcacuugagacuugcuagguucuaaccuguucccucugcccuugccaugguagggaagggaggagcauuggcugcugacauugacaucgacacuguaggcacugaaggcuggggagaggacgcagagcugcagcuggaugaagguaagaacgcugccuuaggacugacugcugagcuguugggcuccaugagcagaaaggauuuguggagcagucuacaagcuucugguucauggagccaauaggauccugauacuuugccuuuggggcgggauucccaugcaagucuauuuugaucaugaauuauccuuacagauggguuuguggaggcuccagaagguuugggagaggauguucuuggaaagggacaagaagaaggagguggcugggauguagaagaagauuuggagcucccaccugagcugguaugugagguuccugcucugcaguuucucucgauuucacccuauaaaaaguuggugcgugucucucucugucucucucuccacacauacacacacucacacacacacacacacaccacacacaccuuguagugugcccauccugaagucugaaguauccacaaaggagagguuccagaaaguccuccuauucugauacauagcuccacuugagaugggguagccagcguuuguugccuuguuguuucaguucauguguagcaaaggagaaggagaugugcagccucccucuaauccaaugcuuaucuuucauuugaaagagggaaguguuuaaugucugaacugcagcuuaugauaggucauuuuggucuuggugagguggcucccauucugucuuuccauuaaccaucaccucuuuucucaagcaaagguuagcaucuaaauguaguguguugauuucaccagaacacaguacuuggauggcuaaaaucgccugggaacguagcucaauugguauuacgcuuuccgagcaugcacaaagcccuugauuggauccccacucuauguaaaucaggcauggcaacauaagacuacaguccuagcacucuagguagaggcaggaggauucaauccuugcuacagagugaguuugagguucugucauauucuguuuaaacaaauaaauaaagccuuaauauuuuuucuuuuuuccuucuaggauguacccucuggggugucugguagugcugaagauggguucuuugugcccccaaccaagggaacaagcccaacgcaaguaagcaggaaaacacaauucuauagagauaagugcuucugggcugcuuaauauuugauuacugugaaaaauauugacugcuuuuaacagauauggaggagaagaauuggaaagaaaaaggagauuuuucauuuggcuuauguuuuauauuuuuuacuagaucuggugcaauaacucccagcuuccaguagaucacaucuuggcagguucuuuugaaacagccaugcggguaagucuuccuaaaagccuuggcccuuccucuugaguguguauuccagaguccugaggagaaugguugacucaucuuuucaaccacauggggaugaugugacccacagggccaagguguguauucguggcagugguuggccuuguuaaagagacuuguuucauaaaggccuuuuaucugcucuccacuuggucuauggucauauuugccagucagccauuucugcugcuuacauuaguaaaaucagcaccucuuccugaguggguguuuauuauggacauuguaccaaguguuauggugacauaacaaccgcaacagccaugaucacuugcugucacucgcucuguugguuacucugaaguacucucuauagguguuuaaauggaguagauccuguaguugacuauauuuuaguacugagaaagcaauacagagaaguaaaauaccuugcccaaguuugauuuaauuuuuacuugguagaaaacaaaucccuauguuucuuuuuuucuuguguucuagcuucuccaugaucaggugggaguaauccaguuuggccccuauaagcaacuguuccuacagacauaugcccgaggccgcaccaccuaucaagcgcugcccugcuugcccuccauguauaguuacccuaaucgcaauugguaaguccccuugcucucugcuguguguuucaguagaguggauauuucagaugauagccacagugacaugggguuugguuuauaccagcugccauccuauuuccaguuauucccacaguaguggguuggugacuguguuugauaagaacagaacggaauccuaguuugcuauugacuauucuucuuucuucauaauuuucccuuuccaggaaggaugcagggcuaaagaauggaguaccagcuguaggccuaaagcuuaaugaccugauccaacguuugcaacuguguuaucagcucaccacaguuggcaaguuugaggaagcuguggaaaaauuccguuccauccuacucagugugccucuucuuguuguggacaauaaacaggagauugcagagguaggaggagucuagccacuuacucgauccuggccaccuccauagucuugucuaugucgugacuguccucugcaaccucuucaggcccagcagcucaucaccauuugccgugaauacauuguggguuugugcauggagauagaaaggaagaagcuaccuaaggagacccuagaccagcagaagcgcaucugugagguaagauggggagaccagcaccacgugggcacauccucauaaccuucaguuccggcuaaaauuguuugguuuggaaguuucuuggcuuuggggaggaagagaaauuggaggucaucuccgugacgagguguuccauuucuccgcugucguccucacucaugaguucuuguaguuuaagaggaagagcuaaucugucuuauagauaguuguguuggcuuuguauuguuuugguuuuuuuuauaauuguguggcuguuaauaaacaacagcugaacuucagccugcuuuguguuccuuucuguccacuagauggcagccuacuucacacacucaaaucugcagccugugcauaugaucuuggugcugcggacagcccucaaccuuuucuucaagcucaagaacuucaagacagcugccaccuuugcccgacgccugcuggaacuugggcccaagccugaaguagcucagcagguacaggggaauuccaucagugacuugaggggaaccagaucuuaaauggaagaugcagaagccaauaucuuucucccugaaacaauguacauacagcacugaacccaagaaagcuaauagaguguucugcccucugguuacuuacugaccuuggggcaucuuuuuucccuugaaaccaaaguaauaauuuauucagauauggcauucuaaaauacucuauauagauguuuaaauggaguagauccuauaguugaccugacuguauuuuaguacugagagagcaauacagagaagaaaaauacauuguccaaguuaugauuucauuuuuucccccccuguggcccuggcuguccuggaacucacuguguagacuaggcuauccuugaacucacagaaauuugccugccucugucugucucccaagugcugggauuaacagugugcaccaccacagccagcuugauuuaauuuuuaacuugacauuuguguugggcuugcuggcccuucuacuguggcgcuacaacccagaguagcuccagugcccuugcaggugaugcaccuauccuuaagcuucaggugacccaucuuguccucugauacuuuucacucauauuccaguaucuauuccacccaaaaacauucuccuugggcacuagaaaccugucucaacucuuucuggggcccaauccugauaaucuaauccccagauguggacagaauuguggcuuuagagcaguggaaccauguuggagaaagagaaagauuucacuguguagcccaaacuggcccucaaacuccugaaccuccugcgucugccuucugagcucugggguguagcaguacaaccagcacaguggccuugucauuuuuuucacauauguccugugcagaggauggaaccuguauucucacagcauaguuacuugcguugucauguccugguuuuugagacugucucaguauaaacucaggcuguccuagaacuugagauccuccuguuccugugugcugggauuauagaaauaggccaucaugcccagcauauacuuacaccuuguaucggagauuguguugcuuucuguacucuuaaauaaaaucuuccuuccuuccuuccuuccuuccuuccucccucccucccucccucccucccucccuuccuuccuuccuuccuuccuuccuuccuuccuuuagacaagaaaaaucuuaucugccugugagaaaaaccccacagaugccugccagcucaauuaugacaugcacaaccccuuugacauuugugcugcaucuuaccggcccaucuaccguggaaaaccaguggagaaguguccacucaguggggccugcuauuccccugaguucaaggggcaaaucugcagggucacuacaguaaguacuguccucaagaaugugucuagcaggguugggauccaauaaaaaaaggacgugugugggauguugagggaagggacaggagaaggaagcgcggugcugguucucucacucugcauuugccccgcucccugaggcagggacacugggaaagccagcacuuuccccacuguucgcuucccagcaccaagcguccaucugacugcucaucggcggucuagggaguaagccgucuggaguucucuaaccugaugcuguuuccacuuccacaggugacagagauuggcaaagaugugauugggcugaggaucaguccucuucaguuucgcuaaggcccuuccuucgcgugcaugguuaaccccauacuguucuucagagucuccccuuacagccacauucagcuuguugauguugguucucccuaaaacgucauguccucucucugcuauugcaaaucagaaguuucaagcuugacuuucugguucuugcagaccucugccuugacgguuacugugcuugugaucauagaugacuuugccuuucagcuuaggccuuccaaggaacaaugaaaacuaugugcuggccauuuguuuaucagauucuuaguauauacuccucccuucccaccaccuuccugucaauuccaguacgagacagaaggauucaauaaacgccacuuuccccagccacgcgaguuguuaacuaucccaucuuuuucuugggcauuuaaugucauaaauagguuccuccuuuauguggcccccacacuucaggcugagaagaagccauuugguuuugcaaaauguguaccauuuuucauugauuuguuucuauccuuuauaacauaccaucgucguuauguucuguugcccucacuaaauaaaguaaauuucugagagccuccug

SEQ ID NO: 522 - RNA, 9958 nt, Mus musculus
ccuacggcaagucggaggcaguaagauggcggcugcugaggaagguugcgguguuggggucgaagacgaccgggaacuggaggagcuucuggaaaguaagagugcacgaugggaaagaccagaaguaucggggagaggauccaucguggggguuagaggaacuugagguuucugagcggggcgggagaaucucuucaguggucagcgggggagguggucugaguucgaccccggcccucuuuauuagcuggcuguguccaaaccgcacaucucccugcgaaggggaacacuaaccguaaagagcuguuucacgagccccuuacaaacuucucuugcuuucgauugucggauuguuguugaggcaaggcucucucacucgguaucccaggcugaucuggaacucgcggcagucuuucagccuccgccacugggaguacagagaucacaggcuggacccaccaggaucgccuucuguaaauuauuaaaaucgccucuccuuucaguagcaggauucacagaacaaaauaaucuuuaagcuccaaagguccauauguccaugauaguaucuuucuuaacccgaaacgccuuuuuaccgcacagucuuuccucauucuuuuaccagacccuuaguucuuucgugcgaguagucaaagaagucuccuuuuaaaauuagugugauguugagagacugucucguguaguuuuaggcugaccucacacucauugaguacuguagaguggcccugaacuugugauuuuuccagucccuuccuccgcauucucgcauggcaccacaaugccugacaucccuuauuuauccuuuggagaaaacaaagugagccagccccaggggaaaaggucuccucuuccugaaaagaugguggaccuucaucucuuucuuggccuugcacuccacucccguuuccugcgccagugaggccagugcccuuucccuaguccuggcaggcagagugauggugacaacacaggcuuuucagggcagaggugaaccuuuuaucucuugcucagucacagcgauauaagcagguagaaaaugaacagaugaagugaggagugcccagugacuggccuggcccaggcuuacugcauaugaggccaaggaggcuauaggugccuguuaagggcgaucuaaauuggagcauuauuuaagaguuaauaccuucuugucgaauguauccuaguagucagaacgguggaaagccgggugguauauucugugcuuccucaacagacgauauuagcuaaggccucagagugaauuccaagaaauaaggcucucucuccccucuucuucauguuagaugaaauguguagguuuuuguuuguuugguugguugguuugguuuuucaaggcaggguuucucuguguagccuuggcuguccuggaacucacucuguagaccaggcuggccucgaacucagaaaucugccugccucugccuccugagugcugggauuaaaggcgugcgccaccacgacccagcaggguuuuuuuuuuuuuuuaagggaauuuuauagugugcauauagagauuucuuugcacagcuuuuauuuaauucucuccuccuaauucugagaugaacacugguucuguguaaaaggguuuccuucccaacuggucacaacaaacuagaugguucucaaggaaggugggaagccuauuggccaguaguccaggcagaagagacaccagaaaaagagagagaaguccaggaaagccagcacuuuguaucauuauuuuccuaagaguuuguuucaaaucacacggcugucuagcccuuuccacccucaacaucgccaccacguccgucucuugucuccgaaggugcucuugaugauuucucuugucuccgaaggugcucuugaugauuucgacaaagccaaacccuccccagaacaugcuccgaccaucucggcucccgacgcuucaggaccccagaagagagcgccaggagauacugccaaaguaucaauucccccacuuaagggagagggaggauggccaugcagcucagagcagggauggggggcccucugggccagagggguggcugagagggugccuuugccucacacugcugaguguucuuccaggccucaguuccuaugaaacgaggaccugugguuuuacggagggcuaacgaggaaagaggaaagagcgguuuuaagugguuggcuuuguaugcuaccucauauuagaccuucaguggccagucuuugcugcccuccggagaagagguagauggaauguucaguggaggugcucgugggaggggagauguuucauuucccaauaugagcucguuuaagcggcuagccccagggugaugcuauaggaggcaaauguugucucccuccccaccccaccccacccuugcaggaugcucucuucgccucccaagagaaauuuuuccaggaacuguuugacagugagcuggcuucccaagcuacugcggaguuugagaaggcaaugaaggagcuggcugaggaagagccccaucugguggagcaguuccagaagcucucagaggcagcugggagagugggugaggaaaccccaaacauaauacuggacaggccucuuaacugauugagaguaccaggauuguaaaauugaugaccaucaugaugucacagccauggcuggggguggggggguguaaggcaagagaaagagcugugggaaucuagcuuacuaaaaggaaaaagguaagauauuuuggaaaguaaugaaaaaagauuauuccagccagguguaguggcuuauucaaucccagcacaucagaagcagagguagacgaaucucuaugaguuugaggccaacaugaucugcauggugaguuuuacaacagcuggaacuacagagugagaccguaccucacaaauccucacaaaucaauacgauucucccaaagcaacccuuuuaaaggaguguuacuguggagaacagcuaacacaguaccaauauagauucauggcaugcccgugaagguaacuacagaacaacuaagauuuggaagugguaguagcuugcuaguaaaugcucuccauccaggcugguaacuagauggguguagacaagcugacagugaggauccuagcuaacccugggucuuuugucucccaggcagcgaugcaaguucucagcaagaguuuacuucuugccuaaaggagacguuaaguggccuggccaaaaacgccacugagcugcagguaagggggaaggagugaggggaggccgcucucagugcuuccuaagcagucucacaaaacagaugcuggguggggagggggccuggagccauggcucagcaguuaagaacacuggcugaucuuccagaggacuaggguucaauucccagcacccacauggcagcucacgccugucuuaucacuccaguuccagggcuucugacauuuucacacauuuucugacaaauuuacacacagucaaaaaagaaaaaaaaaacauaaauaagauaaaacuuuaaaaaguuuacuuuuuaaaguuuuuaaaaaagcucugccgggggguggugguggugguggcgguggcgcacgccuuuaaucccagcacuugggaggcagaggcaggcagauuucuggguucaaggccagccuggucuacagagugagguccaggacagccagggcuacacagagaaacccugucuugaaaacaacaacaacaacaacaaaaagcuuucugauaucucucccaaaucuggcccccuuugguuuuuguuacaggcaaauuuagauaguucuuuccaccggaaaaagugguaagcauucagggaggcagggugccuguucaccucucuuucucuugucuagaacucgggcaugucugaagaggagcugaugaaagccauggaagggcugggcauggaugagggggauggggaagcgagcauucuccccaucaugcagagcaucaugcagaaccuccugucuaaggaugugcuguacccaucccugaaggagaucacagaaaagguucgugaguuuccauugcuggcuugaauccucacuucaguguaucagcucgugggccacuuugcugagacgaugcauaguaaagggguaauuugaauggacaaguacgguuuuuuaaaacgccuuguuugucacaguuguuauugagaguauuaagcugaccaucuguccacgcugggaauguuugagcuaaaaggggaaauuugcacucuaguuuucuauaaauuaguucaagacuuugaguuugacugauucauucuuucuuauauauuuuuaagcuuuauauauuuauuauauguaaguacacuguagcugucuucagacacaccagaagagggcaucugaucucauuacagaugguugugagccaucaugugguugcugggauuugaacucuggaagaaaagucaguguucuuaaccgcugagccaucucucuagcccuccuucuuauauucuuaacuuuacuaauuucuccaguagggacucacaggauuuuguggugguguuaugaaccguuggagagugcuuuaagcggugguucaugcuuaaaagagcuauagcuugaccagagaaaugaaguugagaaauacaaguucuucagccucacgggcaacaugugacugaagagcaagaccaggagucugcagcccaguguuugugcagccucagucugacucucaagcuaagaguaguuuuuacuuuguuuuuuuuuuuuuuuuaaagauuuauuuauuuauuuauuuauuuauuuauuauauguaaguacacuguagcugucuucagaugcaccagaagagggcaucagaucucauuacagaugguugugagccaccaugugguugcugggauccgaacuucagaccuucggaagagcagucgggugcucccacccacugagccaucucaccagcccuuuacuuuguuuuuaaaagauuuauuuuuauuacuauuuuuaaauuagguguacacacacaaacacgcacacgaguuaaggugccuauggaggccacagacaucaaaccacguuugagcuggaguuacagcugccagugagccaccugauaaggguguugggaauggaacuugaacuaauucggguccuccgcaagagcaguaugcacucuugaccacucaagccaucucuccagcccuccucgguuuuauauuuuuagguuuaaaaacaccagggcuagggaagagauaauucagcaguuaagaacacuggcugcucuuccagaggaccuagguucaauuccaagcacccacauaggagcucacagugguccauggccccaguuccagaagauuugaagccuucuuccaucuucugagagcaccugagacacacguggcacacagacauacguacagacaaacauuuguacaaauaaauagaguuuuuucaaaauuacaaauaaugacaacagagggggcuuguuaaagagcacuugcuguucuugccgagggucaccuagacucacuucccaggcucaacacaguggcuuauagccauccacagcucccguucuagggaaucugacacucucuccaaguacaccagcugugcacaugguacaaauacauacaugcgggcaaaacacuaaugaauacaguaaauaaaucuuaacuacaacaacagaccuacaguguuucaacagaaaccauaugugacccuuguccuaguuagcugcagcugucaacuuuacaaagcccagagucgagggaaccucaguuggggaauugcccagauuagauuggaccauggccaugugugugaggaauuaucuugauugaugguuggugugggagggcauagcccaccguggguggcaccaacccuaggcagaugacccuaggcuauauaagaaagcuaaaaaucaagccgggcugguggcgcacgccuuuaauccuagcacuugggaggcagaggcaggcggauuucugaguucaaggccagccuggucuacagagugaguuccaggacagccagggcuacacagagaaacccugucucgaaaacccaaaaaaaaaaaaaaaaaaaaaaaaaaaaaaaaucaacugcccucagugauggacuguuaccuggaaugucagaugaaauaaacccuuuggucucgcaaguuguuuuugauguuuuaucauagcaucaggaaugaaacuagaacagcccuuuacacucuugcuuuaguuuacuaauccgcaguuaccgcguaccccaguguauccugaugaccugucggagucaacagugcucugugcucuucaugucgggcuugcucauguagccuuguuuucuucuuggucccuucccuccugcuuugcgucacucucucccgcccaucuccucucuuuaguauccagaauggcuccagagucaccaggacuccacuccucccgagcaguuugagaaguaccagcagcagcacagcgucauggucaaaaucugugagcaguuugaggccgagacgcccacagacagcgaggcuacucagagggcucgcuuugaggccaugcuagaucucaugcagcagguaaggcuuucucuccucacacugccuucccuggugcacuccucagggagaugucugcacaggcugcugcgccuaaccugaguggaggacagaguacaagaagacuuguaacuggucuuugcuacuuuguggguucucuucuuuuuuccauccuucacaccccccaaccccuggauucacccacuaacacuagauaggagggaaacaaggagagaggggaaagaaaccccugaaucuaguuucuuuucuaugugucuucuuugaucguggcugcuaacaaacagcaaccaacaucccuaaacggccaacaaccccucacuccccuuggggcccuugaguuauguacccucaggaaaguuccuggaauucuaaaccucacacagucacagacacaaucugcagcuggcaaagccacgccucugcuagaacaugcggcagacuguggucagcugcugcagucagucugaagcagcccacguucccacuccugggauuaaagcgaaagcacauuccuacaaucuuucugaguuuuuuuaaacaaaaauuccagaauucucaaaaaugucacuacaaagacugcauaccguggccagcaggaaucagauugcuagccugauuuuuuuuguugcuuuuguguuuucugggacuuuuccuuuuuuuuuuuuuuaaucucuuauucuuuccguuuucuaguuacaggccuugggccauccuccaaaagagcuggcuggggagauggugaguuugucuucuguauuuuaacccaguuuucaguuugcagacgccaguaauccuuagguaauccauauagggugaucacuguggcugcuagggacagaccuucagaagcucugacuugaaauaugagugauugucucagucccuuugucucuucuccagccuccuggccucaacuuugaccuggaugcucucaaucugucgggccccccaggugcuaauggcgaacagugucugaucaugugaaacacagcacaguuuccucccugagccccagccguggggaacaucuggagucaacagagucacugggaacugaggcaggaguaucaucugugggagcuggcugccccacccacacucuccaucccauucaagacugugccauaccagcugaucuguaggccuuuucuaugaguccuacuccaucaggguuucugcuguuagaaacaggccaauuaucugccaggugaaggaaggcaucccuuguggggcauuucacuucuucccacuccccaaauaauguuacacauggcaguacucauguuccccuugauucccagggacgucgcgccuuguuucuccucccucucugugucuggggaggaggagcugaguccugacucugugcuccuguuaggcagggccucugggaagaggagaaauguagccugagcuggggcuggaggcuggucaccgcauauccuugccuuccuuuggaauucucuuaagggaaaggaauuuugcacuuagccauggucggguuggaagcaaagccuugggcuuuuccugucccuaggugcugagccccaaucccccuuuccuccugagaacucauguugcugcccugguucuuucuacagcucugggauuuagggggagccaacucuuggccuuccuuugcucccugacuguccuuacguccucucuguuuagagucuuauuuauucugcccuuuuaaccagugcugugauggaugaaggccaaucuuguuuccuuucaucuaguaccuggaccauucucccuagacccuugccuuccucccuggccaacacauacuugcagugucagaucugguacaugaauggccauucuacccagauagguuuuagcuuauauauaggacaucagauucccuggaauccuugguucaggaaggugcuugggaaagggguguagccagaauauuuuuucccugcaagcccuaugggguaguaucuaauaaauauucugagcaaguguguggguuauuuuucauccaggucuauuucuaaucuucccuaguuucuauaaacugcagagugagauguguuaggagauggauaguucuguauaguguuguuaggcucuaccauggcccagcccuccagcucagcaaaagaauacugucuucgucuccuuggcacuuauuucagucuuaacguuuuacgauauagcugauguuagugauugauauauuaucaacauguuuucuaaauuaucuaacuuugaaucaaccugcuuuuucacagugguucuaagcaccaugguugccauauauuuuauggauauucuuuuaggccaccuagcuaguucacuuggaaaauaacguuuuaaaaauauauuuuuuauuuauucuuuggaauuuuauacauguauacaauguauccugaucauauccacccucccaccccaccccaccccaccugcuggaaaauaacuuuggcaagaagaaauucacauuuaucauuugagucacuucgaguucguaacaucauuuccccugggcuaaaaccacauuuaaggaugcaacauauucuauggaaaugugcuugcggccucggucugggaacuucccagccagcacagcuuaucaaacggaagacucggggucugaauuugagacuccuccaugcgcugaggaagggaaaaugaauguaccagcugaucuguggugaugaguggggucugaauugccaauauuuuauugaugcuccugacaaaagcuugacaaggacaggugaggagacaggaacaggaaugaucggcccuuggaacuguucucauugccaugcuggccaaacuuuauucucauuucugcuggugaugcugugguccaccaugguuuuauuuucaagacuuuuuuuuuuuuuuuuuuuuucauuuuaauuugguugaacaugagcaaguugaccuuggguuggacuuuuuuccuaaauaccauuugaauuacucugggacuuagagcugaauaaaaccugguacccuagggcaguccuccucaagguaugugugguaaaggaccagaguuuagucccucugcaucaguauguggaucuguugcccgugacagauauguaauugagacuauauacaacuuguauacaaauuugaaaacaccuaaacugucuagacucuguuacagguuaagcccacugaucacauaauuaaauuucacagcuauaucaaauacuaaaguuuuuagacaguauauuucugauuccuaaugucacaaguugauacagugguuaaaaccaaacaccuucaugggauaaugccgcucuggguuuuccuuagucucuacacagggccuaggcaaauguguacuuaggcccuugaaguccucuccuguguguuaccuguggagaacauggucuuuagcaaaaaaaaaaaacaaacaaacguguc

SEQ ID NO: 523 - RNA, 10078 nt, Mus musculus
uacgguagagucagucaccuuuauuccaggguuagaacaaggcugugcacgcugcagacagaggagcacaggcuaggagcaaccucacagcagcacgagggggugaguauauuagggcagguuagucuguuuaaaguuugguuuuugccuuacagagaagcuucugagaagcacccugucuccucccucuuccauaagggaagcgccgucucacuccugcucccauggaacaccccagaaggaaggauguuacccagaguuccuuucucccacccaguuguacaaggauuucuugucuuaaaggagaugccaggcaagacuagggagauuuaggaaggaccuuuaaggcaaagcuggagucuucgaggugugagaguuaaggcaggugucugcagcaguggccagaggagaugggcaaucugggcucagcuaggaacugagggugcucuagucagucuggcuucaagaacccucuucugacagccauuccuccccucccugugaaguuuugcucccacauccuaaaagcaccuaccuucaucuuucucuaaauugucucuuagcucacauguaaauguaacauuuguugugguuaguugaaauguguucuuuucuguuuggacucuguaacaauuuggcucugccacuuccuuucuguggcauccccucccacucccgcucuggccuagacaauaaguuaaugcuaaaaaccacaaaaaagggcagacauggcagugcggguuuaauauacauauauguagaauauauauguacacacaguuagcacggucaagauggggaagggcaucuugggacagggaggaggcuggguucacucacugcacucuagugacuugacuguguggcauccacaaacccaaaugagaaagguuaccagucccuuccuggauugaaucagggugguggucagugcaaaggaaacacuguaauuaacuacuugcuuggagaauucuaaacuggagaguggaaagguugccuacaauacucuguagguugugggcagguugggguuaaaaccuaaggaucucaucccccaaucucccuaggcuccaggucaguuuauccaacagucuguauuuagaaacugaggagcagaaagugggccugucucugccugcgucccuagcucaggcucaguagugcauggucccggcaucgucucuccagagcagaagguugggggacaguaaaugcuggcuucuccauugggguuugaucuuugggaccaggaaaggaucgaguggucuucucauuaagauuucuggcucauccgcaucccaggcccauaacaagggcauaaggagggcccauuggcacucaggaccucagccuaagggaacagcaggaagcuggcuucuaaccaguccagcauagagauacaaacacugaguccuggcuuuucuuugucccuuaccagguggagguugaguggccucuuuaccuuccuuccccacugguuuucuuuagauacaaccaucucucccauaccucaucuucaccauagcuccucaguguaggaaaaugcagguccuuucugcuuccauaaagaugugggggaagaguggaggaaaggggagaaggaggaggaaugugccaauuucuguuuacauagaaaaagcguccaccucccccuauaguggggggauuuaagcccccccucccuugccuccaauccccucaugaggaggaggaacuagaugagcuagacagacagacagccagagcgugcgcacacgcacacacacgcgcauaguaaggguuaggaccaaguuaguaaauggguacggagcaggggguugcccuagccccucccauugaggauggggaagggaguggucugaugaagauccaaccuuccuccucuuccucccccuuguucaggccuucuuuggugggggagccaauuugaugauuucuucuucagagggcugccggauaaugucugaaaaaaaaaagggggguguucccagggauggaggucgccaggcaggcaggcaggcccauuaagcaucaaccucuccccaaauucagaaugacuuucuacucuuaaaaauacagucaggcugggcggugguggcgcacgccuuuaaucccagcacuugggaggcagaggcaagcagauuucugaguucgaggccagccuggucuacaaggugaguuccaggacagccagggcuauacagagaaacccugucucaaaaaaccaaaauaaauaaauaaaauaaauaaauaguauauguaguauacauauacuauacaauauauaguauauacauauauacacacacauacaugcaugcauauauauauagucagacagggaagggagaccuagagcuaugccaaagguauggcuucuuaccuuuguacuucuuggcacugggaauacggguuagcuugguguccagcuccuccuccucagagaucuucagcacacggguucuguagucaaccaccauagugaggaggucaggacggcgagauaucucaaagaugugcucaauguaggagagguugucuggaggaaggcagcuugugucagagcuaggcuauagaggucaacuucugcccugucaaaacugguauucuugaaccacaacuaaguugcugacauugguuaugggaagggacagcagugaaagaaguggcuaccaagccaggaaaagaaaguuggaggcagccaaauacaauucaaagcauuacuccuuagcgggacagguauuuagccuagaucuucuaggguauaaauggaaaauacagacguugggcuagauaccaaguccauccuggggaaugguacaauagaaaggcugccuucaaaacuacccacacccacccugucuuuccacuuuccuuccagaugaguauggggagaaaucccagacacuacacagaacaggaaggugagauuuauggucaaucaaagagauauucugagccaguaaggaaaguuacauaacugacagaaagcauugacaccaucaggcuggcuuaagauugccauuauuucaucuggcuccuguccucugauuguugcaauagucuuaacuguaagaggucguccuucggcuuuccucccugcugucagaccccagccagacucguucauaggaaggacucuggggugacuucaguuucacacaccuguaacuaacucggcugccuuagacccaauauuuuuuagcccagcuaacguagacuguguucuuuugcuuaacauguucucuggguucuaccuuagacauaccauuugcuuuuggaggcagucuauuaucagcaacuugggggggggggcucucuccuuccaaggugagcccugggcccucuuguuaggcauacauggcaaauccuuuuaccugcuauccugccagcacuuggggccaucuuaaaugccauuugacccuucgagccccagcugcauggcauugcucuaauccagugucucccucccaccccuaaaaggcagcagucucuagacauagguaagagaacauuagaacaguggucuuaaguucuaccacacauuguacugcucaggcccguaggagaaccugucugacaacuccugucgagggccgaucacuuuacccccgccuugucaugggguuuccccuuguguuccuugcaguuuacugaaugagcagcgcccccuccacaaccuuuguccagcuuguuguggcucuccaggaagcuaaaccaggcacugccuguggugaucuccucacucuucucacuggggauguccuccuugcaggcugacuugagcuguuccagaucuucaagggugauguuguuggucagguccugaaggagaguuccguacucugccaugacuggaggagaaagggagagagcaagcagagcuuacccuaugggguaagggucacuuacuucaaguacuuaccugagacuuaacucccacccccagcaacaugcgcccacacgcccacacuuuguccugcccgggagagugagcaggucuggagggagaaaaggaaagcccugcauaacagaagaaacuuagaaaagcuaggagccgagagugauaagucauaacacacacacacacacacacacacacacacacacacacacacacacacacacacaccccaauacaccaucuuuuucuucuuuuucccucccuuaacgguaacccuggcaacagcuccccugacugaggaggcgguuaccauggcaacauucuccagacuuucuuacagucucccaaguacccccuccccaauugccccaccuaccuacaacuccucccccugucacaggcuugccuagcagugagacgcuaaaaaggaucuggaaggguugguucaagcccaugugucccaccauucuugcccagaagcacaggggucccucguuacaucuucccagcacucuacugaugccuuugcaugugugccugguuacuuggccugaaggaucccuggccccuccaugcuuacucaugcauuagauuacuaggucucaggggagcauggagcagugggcuacccccaccuuguggagcccauuuucucccuugauaguuuacugggcccagcucagccuuugcuccuagccuuugugcugugccugcagcccccgcgcccaagaauaccaagcggcuggcucuggcccccugcccaguucccaggcaggcugggugguggggggaggggaguugagauguagcuuucagaauauggcagcaaggagggcugccuuugaugcuaccuugagucuggucuccagaggcauggcuagaucugaccuaggccucugcaccaugucuuucgugauccuuaguugagagaagaaacacccaacaacacccuucaccaagauaggaacuauggcaaaaauaaaaaaggucagaccugggacuggagagauggcucagagguuagcacuggcuacucuuccagaggaccuggguucaauucccagcacccacauggcaguucacaccugucaguuucagaggauucgacaccuucacacagacauauauaugcaggcaaaacaccaauguuguuuuuuuuuuuuuuaagccuuuagaacguggauuguuaaaauguaaaacuccagugguaagcuaaaaucagggaucugagcauaguagcguagccuacaauuucaguacucaggagucugaggcaggaagauugcugcaaguuuaaggucagucuggacuaccaggcaaaaccuuguuucacauaagggccaguuuucugcaaugaguauguauuuuuuuuauagucugaaaauuaaaacaccaaaacaguaugcaucauaaacguucugugacuaggcaaaaaggugggcaagaagugacuggccuuucuaccugaccacccugcccaugcaccacccaaccugagcugaagcuggcagaucaaaggagccagcuugucaaaccuguuugccuugauucuagccucuguuggagaggaacugaggcagagccaugggcauugcacaguaagcguggacccagacguccuuauuccuagcccccuacuuugaccagaauaaacaaaccauccuuguuggcaggcaccgugacacacgcaaacaauaagccagacagcggggccagcacgacccccagaagaaucggcaggaagcauuucuacuugcacacccaggugccaccagacagaagggcccagcggugguccugccaggcagggccagggacaaugcucucugacugucagcaccaggaaccaucucugccuggaaaucuaggucacagcagcaggcuccggagcccagccccgccuccacugauaauccuagggcagaaaaggggacuugggggaggggcuggagggggcuggaaaaguagcauaggauggagacaggaagacccugccucaaaugaagcacuugggccaaacccucauuggaaagggggucacacugccuugaugucacagggaagaagaguuuguaaauaccagagcugcugugggaggaaaguguguagcgccgugugugaaucucuggggaggaguuaagauuuagggcucuggaucuaaaacacagaucuacuggggugguaggcgggaagggauuaauguguguaacacacacacccacaaagguugggggcaguagguaggagcuuuccaagaguaaaacauacaagcaggcccuaaagagaaaugugggcagagguguacaagguggcucaggaagagaugguguuugcacucggggaugcacaaacuugaauguugcugagugagaagggguguguggaagauacuguagguguguuuggauguucugguaguggagaucagugcagcacuagcugccaacuuaugugaguuguauguuuguauuugagccaguuaagaguaugcaagaccacuuacauagacucacauccagaggggugaggggagccuccaguaugacaaaagagaguuggccuugggaaaggcugcacaugaggaauucaguguguguguguguguguguguguguguauguggggggggguggaccaagggaccaagcacagauuccacaaggcugaaggcuccacucagcuguuaccauagcaaccucaguucagggugccccaccccccagucaucagaacaaugacccugccaugggaagugugagaagugcuaagggccagaaagaauggggauggggggaggaggggguccuugagggaacagugaaggagucggagcuaccauuugccuacagccagcugugaaagaggcaagggcagaaaaguuagggaauacuuuuuagggcacagaaucucuucugcaugacuuucagguuucacucaucagcugcuauggucccuggccggucagucugguuauaguggggcuuggcagagcuugccuuucucacccuccccaaagauuuaggauuuguaagggccuaaggagaagucuccucuccuggcucugaaaacuucccaucucuggagcacugggcugaggccauucuugggacaggauaucagggcaggaacugagagccugagcugaggcugccaggaaguuaguccccuucccucccaucucacucuguguuguguucacugcuuccucacaccucccucccucccugccugcccuccuaagccggcucuaggcauagccuugaccaccgagaaugcuuuaggugagggucaggaagcagaugcuagcuagcccugcgugugcucagagcagccuagcaaaagagaaccaccugugguggagguggcggcagcagcagaauaauuucugagcauuuugacacuaaugguagugucaaacucugguagauuauccccuuuuccagagcacuugguuccagauaggaaauguaaaagggaagcccaaggauuagaugucaccccuuccuccacaucuucuacagcugccaaaggcugcggggaggagcgauccuauuacagaugcagagacuagagggucccucuaaggagcaggaggccaauuccuaggcacucacuucagucagccuugucucaagucgggaacuggaggaaguaaucaaggaaacaggugggaagggcaggccgggagcaggcuggagcuauuggaauuucagugcuaucagggccucaaauccaaagccccagcaguguauuucuuucaguaucuuaaccgacuucuucccccaaccuuuuaaucuagcuuuggguagcucagcagacacucuccuuucuuccuguaacaaugaagaaaguuuuacgguuuccaaggucagccuaggagcagggcuccaaaauguacaucuaaaaaaacggaaaaacagguugccucugagaagggggagggccaugcccaagauggaggcagccagagcuaacuggccugggauuaggcagggcagagcggggcuugcugguuaugagcggggaugagcccugugugacuagcuagcuuucccagcuuuccccuuccugguuuaguuucucucucccuagucaucuuuaguuuauuuuucugccucuuucaguuacucuuuuuuuggggggguuucuuuuuuguaauuuugucucccaccccucucccaccugggaggaccaaaacccagggccuugggcuugacaggcaagcacucuaccauugagcuaauucccaccccccuuuuauucuuuuacugggcacugaggccucccagcucuuccugcucacuccauuuggcgguagccauggauacauuugaacuugguaagacucuguguucccaccuaaguacccagagcuaccauaaggaagggaugagccuuccggauggaaagagagagcagcggcuugggagggacugaugcauacuggguggcuacugaccagccggcggagauggccaucuugacaguguacaugaaggugugugugugugugugugugugugugugugugugugugugugugugugugugugugugugugugugugugugugguguguuacaguguggcucugugcccuuauguaugacagcguauguacaccugccgagcacaggugucacacaaguaguaggcggccagggaagcuggcagccuagagcuugcuggcggucuccccacgagaguguuuaaccgcaaagggaagagcaauuaacgcuaaucgcuccuacagccugggggggccagacgcacaaccuagagaaacaauauacagccuggggggccaaacacaggaaccuagagaaacaaggcucccuaacuugagauucucguccucuccagcacccuuccugugccucuggccaccucuuuccuuuucucuguggcucucuggucagcucucccugucuucucacacauuccucucauucucucucccccugacuuggguuccauccuuggcugacucauucuuuucacccucucccuggcuucuacuccuuccuccauccuuuggccauauugauguccaggcucuagccacucccagguacccuaugcucuaaacuggcagucagcaacaaaggucacaagaagccccucacccagguaagagcacaggcucaccaguccuugagguauugcccacuaaaacuguaaaaucuggguguguuuguggacagugguccuuuccacccacuacugaacauucguguuaagacugaugcuggucaaggagacuccacaugggagguaacaaacggguugugguggguggguggaugccuagugcagggguguugugauuugguuuguaugagaggauguguguaagucacaugggugugugucacugugugguuggcugucuuuuuuuuuuucuuaaagguguguuucugucccugucgguuuugacaaggauuguuuuaaaaauuagugucuuuauauuggcuacaucauuccuauguauccccagccccuuuccucugggcaagcuuccaccaaucccacucuccucagaugcaguaaacugggugugagaguacccagaccaguugccugcugccggaggaacugaagcagggcugagcugagccuggacgccugcagaggcgaguccgaagcuaaagcgaggagggaggggcgggagcuggccuggcucggccggcugggcgggaagcaggcuacauccuaauccccaggccccgucggacucccaaacugcuguucagcacggaaugggcggaugaagccacgcugccugugacacucuccagucucuggaugcauggacagagaaggaccccauggagccugacaccguggaccugucugaauccucaagcuccccuauuuguccccugcguccgggaucgugacccuccaaacccagauccccaaucuaccuccuccccacgacacaucuucccucugccccucucaccgccuccggagcugagagcucagggugcgggcacucccggguccccgguuccuaagcagcgucuggagccugcuccuuggcuccugccaccgcugccgccgauccugccgccgccgccucuuccgcccguggagcagagcuugagcccagcaccgccucaccccacccgacuggccggugaugucagagccggggaggggcggggggcg

SEQ ID NO: 524 - RNA, 10078 nt, Mus musculus
cgccccccgccccuccccggcucugacaucaccggccagucggguggggugaggcggugcugggcucaagcucugcuccacgggcggaagaggcggcggcggcaggaucggcggcagcgguggcaggagccaaggagcaggcuccagacgcugcuuaggaaccggggacccgggagugcccgcacccugagcucucagcuccggaggcggugagaggggcagagggaagaugugucguggggaggagguagauuggggaucuggguuuggagggucacgaucccggacgcaggggacaaauaggggagcuugaggauucagacagguccacggugucaggcuccaugggguccuucucuguccaugcauccagagacuggagagugucacaggcagcguggcuucauccgcccauuccgugcugaacagcaguuugggaguccgacggggccuggggauuaggauguagccugcuucccgcccagccggccgagccaggccagcucccgccccucccuccucgcuuuagcuucggacucgccucugcaggcguccaggcucagcucagcccugcuucaguuccuccggcagcaggcaacuggucuggguacucucacacccaguuuacugcaucugaggagagugggauugguggaagcuugcccagaggaaaggggcuggggauacauaggaaugauguagccaauauaaagacacuaauuuuuaaaacaauccuugucaaaaccgacagggacagaaacacaccuuuaagaaaaaaaaaaagacagccaaccacacagugacacacacccaugugacuuacacacauccucucauacaaaccaaaucacaacaccccugcacuaggcauccacccacccaccacaacccguuuguuaccucccauguggagucuccuugaccagcaucagucuuaacacgaauguucaguaguggguggaaaggaccacuguccacaaacacacccagauuuuacaguuuuagugggcaauaccucaaggacuggugagccugugcucuuaccugggugaggggcuucuugugaccuuuguugcugacugccaguuuagagcauaggguaccugggaguggcuagagccuggacaucaauauggccaaaggauggaggaaggaguagaagccagggagagggugaaaagaaugagucagccaaggauggaacccaagucagggggagagagaaugagaggaaugugugagaagacagggagagcugaccagagagccacagagaaaaggaaagagguggccagaggcacaggaagggugcuggagaggacgagaaucucaaguuagggagccuuguuucucuagguuccuguguuuggccccccaggcuguauauuguuucucuagguugugcgucuggcccccccaggcuguaggagcgauuagcguuaauugcucuucccuuugcgguuaaacacucucguggggagaccgccagcaagcucuaggcugccagcuucccuggccgccuacuacuugugugacaccugugcucggcagguguacauacgcugucauacauaagggcacagagccacacuguaacacaccacacacacacacacacacacacacacacacacacacacacacacacacacacacacacacacacacacacacaccuucauguacacugucaagauggccaucuccgccggcuggucaguagccacccaguaugcaucagucccucccaagccgcugcucucucuuuccauccggaaggcucaucccuuccuuaugguagcucuggguacuuaggugggaacacagagucuuaccaaguucaaauguauccauggcuaccgccaaauggagugagcaggaagagcugggaggccucagugcccaguaaaagaauaaaaggggggugggaauuagcucaaugguagagugcuugccugucaagcccaaggcccuggguuuugguccucccaggugggagaggggugggagacaaaauuacaaaaaagaaacccccccaaaaaaagaguaacugaaagaggcagaaaaauaaacuaaagaugacuagggagagagaaacuaaaccaggaaggggaaagcugggaaagcuagcuagucacacagggcucauccccgcucauaaccagcaagccccgcucugcccugccuaaucccaggccaguuagcucuggcugccuccaucuugggcauggcccucccccuucucagaggcaaccuguuuuuccguuuuuuuagauguacauuuuggagcccugcuccuaggcugaccuuggaaaccguaaaacuuucuucauuguuacaggaagaaaggagagugucugcugagcuacccaaagcuagauuaaaagguugggggaagaagucgguuaagauacugaaagaaauacacugcuggggcuuuggauuugaggcccugauagcacugaaauuccaauagcuccagccugcucccggccugcccuucccaccuguuuccuugauuacuuccuccaguucccgacuugagacaaggcugacugaagugagugccuaggaauuggccuccugcuccuuagagggacccucuagucucugcaucuguaauaggaucgcuccuccccgcagccuuuggcagcuguagaagauguggaggaaggggugacaucuaauccuugggcuucccuuuuacauuuccuaucuggaaccaagugcucuggaaaaggggauaaucuaccagaguuugacacuaccauuagugucaaaaugcucagaaauuauucugcugcugccgccaccuccaccacaggugguucucuuuugcuaggcugcucugagcacacgcagggcuagcuagcaucugcuuccugacccucaccuaaagcauucucgguggucaaggcuaugccuagagccggcuuaggagggcaggcagggagggagggaggugugaggaagcagugaacacaacacagagugagaugggagggaaggggacuaacuuccuggcagccucagcucaggcucucaguuccugcccugauauccugucccaagaauggccucagcccagugcuccagagaugggaaguuuucagagccaggagaggagacuucuccuuaggcccuuacaaauccuaaaucuuuggggagggugagaaaggcaagcucugccaagccccacuauaaccagacugaccggccagggaccauagcagcugaugagugaaaccugaaagucaugcagaagagauucugugcccuaaaaaguauucccuaacuuuucugcccuugccucuuucacagcuggcuguaggcaaaugguagcuccgacuccuucacuguucccucaaggacccccuccuccccccauccccauucuuucuggcccuuagcacuucucacacuucccauggcagggucauuguucugaugacugggggguggggcacccugaacugagguugcuaugguaacagcugaguggagccuucagccuuguggaaucugugcuuggucccuugguccacccccccccacauacacacacacacacacacacacacacacugaauuccucaugugcagccuuucccaaggccaacucucuuuugucauacuggaggcuccccucaccccucuggaugugagucuauguaaguggucuugcauacucuuaacuggcucaaauacaaacauacaacucacauaaguuggcagcuagugcugcacugaucuccacuaccagaacauccaaacacaccuacaguaucuuccacacaccccuucucacucagcaacauucaaguuugugcauccccgagugcaaacaccaucucuuccugagccaccuuguacaccucugcccacauuucucuuuagggccugcuuguauguuuuacucuuggaaagcuccuaccuacugcccccaaccuuuguggguguguguguuacacacauuaaucccuucccgccuaccaccccaguagaucuguguuuuagauccagagcccuaaaucuuaacuccuccccagagauucacacacggcgcuacacacuuuccucccacagcagcucugguauuuacaaacucuucuucccugugacaucaaggcagugugacccccuuuccaaugaggguuuggcccaagugcuucauuugaggcagggucuuccugucuccauccuaugcuacuuuuccagcccccuccagccccucccccaaguccccuuuucugcccuaggauuaucaguggaggcggggcugggcuccggagccugcugcugugaccuagauuuccaggcagagaugguuccuggugcugacagucagagagcauugucccuggcccugccuggcaggaccaccgcugggcccuucugucugguggcaccugggugugcaaguagaaaugcuuccugccgauucuucugggggucgugcuggccccgcugucuggcuuauuguuugcgugugucacggugccugccaacaaggaugguuuguuuauucuggucaaaguagggggcuaggaauaaggacgucuggguccacgcuuacugugcaaugcccauggcucugccucaguuccucuccaacagaggcuagaaucaaggcaaacagguuugacaagcuggcuccuuugaucugccagcuucagcucagguuggguggugcaugggcaggguggucagguagaaaggccagucacuucuugcccaccuuuuugccuagucacagaacguuuaugaugcauacuguuuugguguuuuaauuuucagacuauaaaaaaaauacauacucauugcagaaaacuggcccuuaugugaaacaagguuuugccugguaguccagacugaccuuaaacuugcagcaaucuuccugccucagacuccugaguacugaaauuguaggcuacgcuacuaugcucagaucccugauuuuagcuuaccacuggaguuuuacauuuuaacaauccacguucuaaaggcuuaaaaaaaaaaaaaacaacauugguguuuugccugcauauauaugucugugugaaggugucgaauccucugaaacugacaggugugaacugccaugugggugcugggaauugaacccagguccucuggaagaguagccagugcuaaccucugagccaucucuccagucccaggucugaccuuuuuuauuuuugccauaguuccuaucuuggugaaggguguuguuggguguuucuucucucaacuaaggaucacgaaagacauggugcagaggccuaggucagaucuagccaugccucuggagaccagacucaagguagcaucaaaggcagcccuccuugcugccauauucugaaagcuacaucucaacuccccuccccccaccacccagccugccugggaacugggcagggggccagagccagccgcuugguauucuugggcgcgggggcugcaggcacagcacaaaggcuaggagcaaaggcugagcugggcccaguaaacuaucaagggagaaaaugggcuccacaagguggggguagcccacugcuccaugcuccccugagaccuaguaaucuaaugcaugaguaagcauggaggggccagggauccuucaggccaaguaaccaggcacacaugcaaaggcaucaguagagugcugggaagauguaacgagggaccccugugcuucugggcaagaauggugggacacaugggcuugaaccaacccuuccagauccuuuuuagcgucucacugcuaggcaagccugugacagggggaggaguuguagguagguggggcaauuggggaggggguacuugggagacuguaagaaagucuggagaauguugccaugguaaccgccuccucagucaggggagcuguugccaggguuaccguuaagggagggaaaaagaagaaaaagaugguguauugggguguguguguguguguguguguguguguguguguguguguguguguguguguguguuaugacuuaucacucucggcuccuagcuuuucuaaguuucuucuguuaugcagggcuuuccuuuucucccuccagaccugcucacucucccgggcaggacaaagugugggcgugugggcgcauguugcugggggugggaguuaagucucagguaaguacuugaaguaagugacccuuaccccauaggguaagcucugcuugcucucucccuuucuccuccagucauggcagaguacggaacucuccuucaggaccugaccaacaacaucacccuugaagaucuggaacagcucaagucagccugcaaggaggacauccccagugagaagagugaggagaucaccacaggcagugccugguuuagcuuccuggagagccacaacaagcuggacaaagguuguggagggggcgcugcucauucaguaaacugcaaggaacacaaggggaaaccccaugacaaggcggggguaaagugaucggcccucgacaggaguugucagacagguucuccuacgggccugagcaguacaaugugugguagaacuuaagaccacuguucuaauguucucuuaccuaugucuagagacugcugccuuuuaggggugggagggagacacuggauuagagcaaugccaugcagcuggggcucgaagggucaaauggcauuuaagauggccccaagugcuggcaggauagcagguaaaaggauuugccauguaugccuaacaagagggcccagggcucaccuuggaaggagagagcccccccccccaaguugcugauaauagacugccuccaaaagcaaaugguaugucuaagguagaacccagagaacauguuaagcaaaagaacacagucuacguuagcugggcuaaaaaauauugggucuaaggcagccgaguuaguuacaggugugugaaacugaagucaccccagaguccuuccuaugaacgagucuggcuggggucugacagcagggaggaaagccgaaggacgaccucuuacaguuaagacuauugcaacaaucagaggacaggagccagaugaaauaauggcaaucuuaagccagccugauggugucaaugcuuucugucaguuauguaacuuuccuuacuggcucagaauaucucuuugauugaccauaaaucucaccuuccuguucuguguagugucugggauuucuccccauacucaucuggaaggaaaguggaaagacaggguggguguggguaguuuugaaggcagccuuucuauuguaccauuccccaggauggacuugguaucuagcccaacgucuguauuuuccauuuauacccuagaagaucuaggcuaaauaccugucccgcuaaggaguaaugcuuugaauuguauuuggcugccuccaacuuucuuuuccuggcuugguagccacuucuuucacugcugucccuucccauaaccaaugucagcaacuuaguugugguucaagaauaccaguuuugacagggcagaaguugaccucuauagccuagcucugacacaagcugccuuccuccagacaaccucuccuacauugagcacaucuuugagauaucucgccguccugaccuccucacuauggugguugacuacagaacccgugugcugaagaucucugaggaggaggagcuggacaccaagcuaacccguauucccagugccaagaaguacaaagguaagaagccauaccuuuggcauagcucuaggucucccuucccugucugacuauauauauaugcaugcauguauguguguguauauauguauauacuauauauuguauaguauauguauacuacauauacuauuuauuuauuuuauuuauuuauuuugguuuuuugagacaggguuucucuguauagcccuggcuguccuggaacucaccuuguagaccaggcuggccucgaacucagaaaucugcuugccucugccucccaagugcugggauuaaaggcgugcgccaccaccgcccagccugacuguauuuuuaagaguagaaagucauucugaauuuggggagagguugaugcuuaaugggccugccugccugccuggcgaccuccaucccugggaacaccccccuuuuuuuuuucagacauuauccggcagcccucugaagaagaaaucaucaaauuggcucccccaccaaagaaggccugaacaagggggaggaagaggaggaagguuggaucuucaucagaccacucccuuccccauccucaaugggaggggcuagggcaacccccugcuccguacccauuuacuaacuugguccuaacccuuacuaugcgcgugugugugcgugugcgcacgcucuggcugucugucugucuagcucaucuaguuccuccuccucaugaggggauuggaggcaagggagggggggcuuaaauccccccacuauagggggagguggacgcuuuuucuauguaaacagaaauuggcacauuccuccuccuucuccccuuuccuccacucuucccccacaucuuuauggaagcagaaaggaccugcauuuuccuacacugaggagcuauggugaagaugagguaugggagagaugguuguaucuaaagaaaaccaguggggaaggaagguaaagaggccacucaaccuccaccugguaagggacaaagaaaagccaggacucaguguuuguaucucuaugcuggacugguuagaagccagcuuccugcuguucccuuaggcugagguccugagugccaaugggcccuccuuaugcccuuguuaugggccugggaugcggaugagccagaaaucuuaaugagaagaccacucgauccuuuccuggucccaaagaucaaaccccaauggagaagccagcauuuacugucccccaaccuucugcucuggagagacgaugccgggaccaugcacuacugagccugagcuagggacgcaggcagagacaggcccacuuucugcuccucaguuucuaaauacagacuguuggauaaacugaccuggagccuagggagauugggggaugagauccuuagguuuuaaccccaaccugcccacaaccuacagaguauuguaggcaaccuuuccacucuccaguuuagaauucuccaagcaaguaguuaauuacaguguuuccuuugcacugaccaccacccugauucaauccaggaagggacugguaaccuuucucauuuggguuuguggaugccacacagucaagucacuagagugcagugagugaacccagccuccucccugucccaagaugcccuuccccaucuugaccgugcuaacuguguguacauauauauucuacauauauguauauuaaacccgcacugccaugucugcccuuuuuugugguuuuuagcauuaacuuauugucuaggccagagcgggagugggaggggaugccacagaaaggaaguggcagagccaaauuguuacagaguccaaacagaaaagaacacauuucaacuaaccacaacaaauguuacauuuacaugugagcuaagagacaauuuagagaaagaugaagguaggugcuuuuaggaugugggagcaaaacuucacagggaggggaggaauggcugucagaagaggguucuugaagccagacugacuagagcacccucaguuccuagcugagcccagauugcccaucuccucuggccacugcugcagacaccugccuuaacucucacaccucgaagacuccagcuuugccuuaaagguccuuccuaaaucucccuagucuugccuggcaucuccuuuaagacaagaaauccuuguacaacugggugggagaaaggaacucuggguaacauccuuccuucugggguguuccaugggagcaggagugagacggcgcuucccuuauggaagagggaggagacagggugcuucucagaagcuucucuguaaggcaaaaaccaaacuuuaaacagacuaaccugcccuaauauacucacccccucgugcugcugugagguugcuccuagccugugcuccucugucugcagcgugcacagccuuguucuaacccuggaauaaaggugacugacucuaccgua

SEQ ID NO: 525 - RNA, 10004 nt, Mus musculus
cucauucugccccagauuucuuuauuaaggccuugcauuugacccaaauacauuaacaggagauggcuaagauuauagccccuaacacaguaccucccuuccuccuggccagggucaggacagugagagagguuuaagauuugagaaaugggauagagaagaguuugcaaaccguuaaguauggggaguggcgggaagagaaacagauaagguaugggggaagaagcaagucagaugagagaacugggcugggaucuaagaaaaagcagcuccuuuucuccucggagagggagaccaggaccucaagcacccuguaugcagaccacaguuggcccuguaguagagaaugaccuagugucccaaggagcccagggaagggcacagauggcagaaagguacaacaaguaaggagcaaguggggcugguacucggcugccacggccacucgucaucuagucgucgucaucaucaucgucaucgucaucgucgucaucgucgucgucauccucuguguugaucucgcccuccagcacguccuccagccaguccuccagcucaucagcagaaggcagguccuccucguuauccaucuccauccauaugcugucggccuaggucacggcacagggaggggauggaagcgaacauaacacagagcuggaccugccacacacacacaccccguagcccccccuuacuguacauucccuuccuugcauccuucaguggugagaaaaacuaucccggugaagaucggcguuagaauggugauagaugugagugggaagaaaaggcauuggcuagagcccccucccugcuuccugucugucuuccuuacuguugcugcacugagcuccuggaaccagccaucccucucucccacauccacgauggaaaagcagugguaccuccuuauggccaacacagccaagcagaaacucuuaacauucacagauuuucaagcaaaugaguuucuaguaccagcuuuagugauuucuaaacucugaaaguguauuuuuuuuuaaauaccugucuguucccaagccugauuucacuuuuuugcugucuuuguucuuauuuauuuauuuauuuauuuuuagggugugcucuugauggcucacaccuuuaaucccaguacucuggagacagagguaaagguagggagaucuuuugaguucaaggccagcaugugcucuugcuuuauagccuuggcuggcugaccucucauauuugcuauguagcucaggcuggcuuugaacucacagugguagucuagccucugccuuuccagugugugugccaccgugccuggcuuugccucugaccuuugaugaucacccuucccccucaguuuggagauuuguauuugucccuuauugaaaucucauacacuccauggucuccaucguuaacgcuacucccagucccucaagcagaaagcgcuacuuugcugccguuuuauuuacuauaaaauuuaccaaagcccgccuuauaauuaaugaaauacuugccuacuccauuagccugcgaauacuaugaaaucaaaagcugcacuacucaguucaacucaacaaauaagcaccuacuaugugcucaccagaagauuucugccuucaaaauguucaaaaucuacuagaagagauaggaugcuccaaggcaaguucucuaugccagugagcucucaggggcgggggugggggugggggugggcauaggggaaauacuugaaagaaaacacaguggaggaccauaagguuggacuggacucugaagaaugggcagguggauccugugaguggaugaugcacgugcucagaucaugcauucccaccccacaggucuagccuuggaccgaugucuccugcuucuggacagugcucguuuccuugacagucagagaacuaacuauacugagagaacuaacaguacagagaagcacuggugcucagcucgaggucacagcacccuaaccucacccaguccuguccaaucugguuaguacuuggguuggagaugaccugauacuuaggugugaaugaagaacaggaaacucacgucuguaacauugacaacuccuauuuguggagcugacaggucaaugucaaaggucuucucccaguacgggaccagcuguagagagaaccaaacacaugaguuuaauagagguuaggagcacacgaguccauaagaggaugagagccagcccagggaugagaggaggcaagaggagcuggcagugcauggagggacagccagcaaccagacacuggguuguagguaaagaugaucagugaaagagaaaccccaguggaaaagaaugaggaaggcagccucucccuucugaggagaagcacagagccccuccuuuguucccgagucugauuaugacuggccuuguaccuuugagcuauucacaucucuaaaaaguccucaguuccugcauaucuauaucugucugucugucugucugucugucugucugucuaucuaucuauaagauuauuuuuauuauuuuuacuuauguauguaugaauguuuaccauguguaugcauaccuucagaggccagaagagggugauggcuccccuguagcugaaacagccaccagacgugggugccaagaacugagcucaaguccucuggaagagcagcuaaucucugagccauuucuccagcucaguuccuacaucucuuaacauaaguauuuauaccuggcacucaucaguguuugccacauuccuguuugcucauucaacaguaaaccugagaaauuggggauucagcugaaaacagagccaucucuuggaacguggaaucugcugauucucugaguauacguuugugugcaguguugugcucagccucucaccagagcacugcuuuucagcuuugguacauugccugucugccucugcuccgggaaucacaucucauaucccaugcaguucacuucccauccccuuccccccuuugcucaggaugcccaugcucugugucugcggugcucgugagcaugcagcaggcauacuuccuggauccccagcuaggaaguggggagaggaauucugaaacaaagaaggagccccagcccaaguccccaccuuaggaccacacaguuugagcagagccucuuaccagcgggaagucaucaggaucaauccagaugauacugaggucgggguucucaguguugucuugggccacagccuugagagucucuaagaacucauagccaucuuggagggagcagaaguaaaagugaggaggaacagacaggaaagggacacaggaaaugaguccagaccuauuucccuaccuccuacgacaccaacaccuuucaagcccuaggcugcuugcaaacucccaggaaugccuuccaugugaggccuacgauccaacaaauacacccccuucccccaggccgcuccaguguccucuccucaccgggaucugcuuccucugcaaaggcgacaauguggauuccauccaggucauccuccuguuggagggugaggaggggagcaggguuagagcuggggauggggguggugggggagaccuuacuguccucccguccaaccccuugcccguugcuugaaucugacuccuggaauggcagcuuauguuuucacgguggugacuuuucuaauggcauccuuucugcucuagggauccugucagcuccagaguuugagucagccuugucauguucauugucaugccugucacuugagaccugacauggucuucgguacagaaacaaaacaaauaaaaaccaacccacgugccccuuggcugagacacggcuuucuuccuagcuaagggcacagggaggagcagggacagccguuucuaagauccgggucuuuacccacuccugcuccccaagggccugguccuggucaucacucacccaagucucguacauacucucaggcuucaguuuccucaggguugaucuaggagagacagagggucccuauucaguggguggggacaccucccuccagaagguccccacagcugaagccaccucugggucaggccuagggcauaaacagcuuguagcccagaacaaagccaguuagcaaaucuaagcucugggcaucaggcccagaacauggcacggcugcaaaacaaugguuagugggaaggggauggcuggaagagagacgcugggggcaaagguaagaacuggauaucagcagagucauuuacuuuuucauucacucauuuaguaaagcugacagccugggcucgaaauaaaauuccaugccuccuguaugccaggcccuggguucccuucccaguacaggaaaggguugggggcggguauagguuaugaggacugaguuagguauugauuaaaccauguugguauguugugccccagugaaagaggccaaaaucuagugggcgagaguaaguaguauuuagacugaugaguggguauuucuaguuguggagucacaugaaggaagagacuugugugaguauagggcaggguuucuucgcaucagcacugcagacgucgagggagggggcgucgugcgcacuggaggaugguuaauaguaucucuggccucuaauuacugaauaccagcagcacuccucacagccaaaaauguccuggaaaccuugccuaacagccacuggaaggcaaaaacccuugccccgcaggccgcucccugugccuccguugacaacugcuagugucaagaaugacaaaggagaagggacugaguucaagcuugaaucccaguucugauucuucccccuggagccacuuucacugaggaugcuaaagaaauuaacuucaguaauagagagaagguaccucccaguuccugguccgaacacagguacucuacucauuggcugacacucccuaagaagccccucaguccacacacauuuacagaggacuuucucuguguagggcucagagcuuagugcugggguaugaaauacaacacagaaccuacugguauaucagugaacaccaacgucugcaagcauauucaucuccagggcaguguagcuuccagguuggcuugcuucccagcccacuucacaaacugaugugcuagcccugggaggaaccuuggccaauccccaccuccugugcuccuccacgaagcugacaaucuccucuucacuguugggcuugucugggauggucauaggcucuuccaugaaggccucguagaaaucaaucucauucaacuucagagucagcuucuuugccaccuuugaggaaguagacaagaguuauggagcaggagaagcgggagcugagugagaaacaguguaaaggaacuaguugcagaaaaggagucagaaaauguggcucugggucacuggguaagugucuucacuccucugggcaucguuuaacacaauaaagguggguuagacagucuaauguccaccuucccuucaauucuauaggagaaggaacaugagucugggguggggaauaccagcaugaaaaauggugccaagaucccaucaauuuugguaggguaggcugagggaagcuuaagaguguagggagagccaguguagccacagggaagagaaccuugcugucgaagguagcgaagaaagggauguagggauggaacucuucagcugcguccucguaggcuuuguaaucugagggggaggaagggacagucacagucauguucagggucugccaaagaaucacucccccccaccaccaaggggaaucuucucugcaggucuuccuugacaugugggucccaggaagagacccauccccuuuagcucucuaacucuagcucucugagaauaaaauacaauagaauuguagaggaagcagcggaaugcuggggguguuugggaaugccccagagugcagggacagaugauggagcugaccgugcagaaggaagaagggggccuaggaggucagaaccagagaugcuuggccacuggccaaaguagggaggcaaggaggauaggugggucagaaagagcuguuacccacgcucugagucuuugcucuugaaguagccaaugaguuugauuucaucuucaauauucucaaaugccugcagcucucguucaccuucaaucaacucuacagggucuucuaggaccugggagaaaaagaauauugagaccaccauuccuuuugucccugacaggccccagagaaagauacaggggaaagacagggaacuagaauaggagaugcuuguauaggguggauauguggccuguuaaugguguauguguguagucugaguguugugcagugugugugauacgcauguucuguaucuucugcuuggcaugggguauauguuugugauauguuguuguaugugugauuuauuugugguucugauguguaugguguauauauauauauauauauauauauauacacacacauauauauacacacauauauauauaauauaaauuguauauuacauguuuuauugcuauauguaugcuguaugucaugugugugcaugagaaugcauuguauguauguuuuauaucugguauauguggcacauauauaugaugugcuuuauacacacacacacacauauauauauguauauauauguguauauacacacacacacacacacauauaggggccuauauaugugauaugcauauguuuuguguacauugugucugaucuauaugauauauguaugugauaucuguuacauguugcacgugguaugugggaaacugguauaguguauguaugccuggugugugaguguguguguguguguguguguguguguguguguguguguguguguguuuaggaguguaggguugauuaguaaggaccgaggggcauuggaaacuucaaggcuaugaggcucaggggaacccucacaucaagcagaaacuccaccagagugucugcagaaaacucgccgucauauucaaugacuucaucuccuuugaacacauaaacgcugucuucuucaguuaguccuaggaaacgcauggugggaaggugagugaggaagacaaccuucccagaaacccgagucuaaucuggucacagcccacuuguuaaucccugcagacucauccuccaccucuccaucccuucccccuacuccugccccgccccaucuaccuucaacaaacccuuaaacccuucauucccaaauuaguucaggagcuaaagcuaggcagaagcuggggccugcccggguggggaucgguaggguuugaggggaggaaacugggaagauucagauucuagcaacacagcucccuugcucugccuacacagccagggacaaauauuccugccagcgacucugaaguaucuaguggcugaaucuuugcuauugcuguccagaugacuuguugcuaacuacccuucccccauccacauccgguguccagccucugcugccgccugguggccgggugguguaauaucugggcucugcuaagagaaagggaggaagccgagggggaagggagaagggaggggggaggggaggagccaaaaaagcacuuugcagaagggcucucuggcuaugccuguauuucuugguuucaccuuccuuuccaacaccuagcuguguucuuuuuuuuuuuuuuuuuuuuaacuacauuuuuuuuuuuagguuagcauacaugcuuuuguuuuguuuuguuuuagaauuucacuauguagcccaggaagcuuugaauccacaauccuccugccucauccucucaaauacaaguaucacaaguaugagccaccaugcccaugucccuacccagucuuauuuucuagaugagcagaaagguuaccaccccaccguuccaccucauccagggaguggggcgcaggacucuauacagaauagccccuaaucucaaaugccccggcccacucuaaauagaugugcagcucucaaaucucccccaaacccccaccugggccucuccagucuuccauaaccugcuuccuugcccucccuuaccuaguuucuuggccacagcugcauccuucucugaguccaccaggccaaagccaacacccuugucuucuaagacuugggcugcuaacuggaagaaggagucagaauuaaauuagcccccagaauucuuaucaaccucuuccuugugagauacguuccuaucauucaucgggucaucugaggugcaagaaagccaagcauugaccuucaccaucuguuagaagcagacucugccugggcaccucauaacccuagccugucuuugguucagccuuugaaaagaugguguguauuuauugcucacugcaacguuccugaaggacgcugagucucaccuuccaugaaagacugggcccuaccuuucauccugaucaaaggccaaacucagcagaggggaaugugggacccugggauccugaaguaacucccaaagugagagcuguggaggaugggguguggggugagggguaggaaaggccagaggucaagagguugccaucaucccuggagggacagucacucuucuuccaggccccaccuccuucuucuuuaggcuggucgccccacaagccuccccagccagccaccugcggauucuuucugcugugggcauacugugugcagcuguaucccacccagcacugcagugauccuuaggagaaugggagggcggguggcagguggauggcagaggccacugaacauggaggauaaaaauacuuggcucauuaaucagauagcaguuugcagagcccgauggggcacacggaaaugcaagccagggggccgggugucuuacacugaaacauuccaagcucggacaagguggagccucucuguaucaccaagccggggaagugcagacaaaggcaaacguauccuagcuccauuagggaugcguguggccacguaauccaaucggaaggcugccuccccucauuucuuuuuuguauuaaccgucucugccuuggaccuaaaguagauucucuggcugaaaugauggggaaggcaugcugaagccuucgugagaguuuucuaguaaggacuuccccuaggggacaaaacgcggcggguuggccuggggaggucugugggaagccucuagaagucauuuaacuguacagucacuaagucaguugaaggcaaauaaaagaacaaucguguucacgguucugcuguuugcgucuuggagcacggcccuacguguguaaagagagggggaucuuuuggccacaagaguaguaugaagcacagugcaggguacugugcaagcuccccccacccagcuucuccccccccccagccaaaccuagugccccugccuccugcagcacaacuuaccaacagaaggguaggaccuuggucccugagucuuuuucuuuuugccaaggccacauuccagucauguacuugguggagacagaggcccagcagccaugcugcucuuaagcuagcccccacccucagacucagggcucaccgaggggacugagcaugcucuccaggccugcuauucuccacucaccuccaggauuagcuccuccaucucaaauugucucugcgaggccuugucguccucggggggcucaugguagaggagggccagcaccucauacuucuuaaacacguucuuguaguucuuggcguucacauugaucacacgguccacaccgucguacucagggaaguccaacccaucuucccccuggaccccuaaccugggcgucccuagcaccaguacaaacagcagugccagccgcagcucggacacugcucuggcccccauccugucgguagcucucauggagguaguacaaucugggccugcucuccugguccagaggagguuagcugaaauagggagaggugccccucggauacagaauccugaguuaggggcuccaggugggggugggguagagagugggccagagcaguggacagaggacacugcuggguccuggagaaacugccgacagagccaagagaaaaagggucaggaggaggaau

SEQ ID NO: 526 - RNA, 670 nt, Mus musculus
caccacgccugacuacugaccugaguugaauuaccaggucucacauuggggagucaacugucuccccaaguuguccucugaccuccacauacauacauaugcacgcauauagacacauaaauguaaaacacauuuguaaagacgauuggcacguugcacaaaggacuggacuuuuaaugagauggugagcuuucaauccugggguguaaucaguucagcccauugucugggaaugcuuggggguggguagaggcggcucugugggaaacaggaagguuaggcuuaagguuaagcuucucaauggagaguaggggaaaacauaggcuggcagauagagaagagggcuaacuaaaaagagaggugggacucucagagagagaagaggguugugggaugacagacaggagaaggaauccucuggcaggggccccuuugacugaugccgcuucuccuccccccaccccccaggaaugacgugccaagcucgaagcucguaccugguggaugaaguguuguggggccaccgguucacaucggugcucacccuggaggaugguuucuaugagguggacuacgccagcuuccacgaaaccuuugaggugcccacacccucgugcagugcucgggaacuggcagaagccgcggcccgccucgaugcccaucucuacug

SEQ ID NO: 527 - RNA, 3004 nt, Mus musculus
auuagaauuccauaucagcguuuuauuugaacguuugucgcacaaucauuguuauccugggcuagacaggccuacuuucaauuccaguucugcuacuaguuggcuauguuuuauuuauucuccauaaauccugauuuugcucauugauacagauagggauaucuacuuuacauuaaaaaguaguuaguaugucugacaacugggaauaaguccuuaacaaauaacaauuaugauaauuuaggccacguauacugugauaacacaguaucauucaaauaacucuugacaggcucgacuucuaagaucaagccagacagucugugucaguuaccaugugccugcaacuguaaugcaaggaaguacaaagaaauacauacuuucuacucucaagaacccuacaauuuaguuauaagguuauuugaaugguaauguguuaucacaguauauuaugggcaaugcauaguaaaaaaccaauagagguaguuauuaaucuacaccauguaauuacaucaaagcacagacauaccagacuaugacuagagguuaauacggcucacucaaaggauaaaugugaaguguaggaugagagaugucuaggccgaauggagccacuucuaugguaaucuagaagacauucccuaggggcaggcucaguuuguaagaucaaggcagucugcgucaguuaccaugcgucugagacuguaauacauuacaagaaaguacaaagaaauaaagaaauacuuucuacucucacgaacaauuuacuugaaacugaaaacauuguaaaauaaaguaugaaguucuuggcccggcgugguggcgcacgccuuuaaucccaccacuugggaggcagaggcaggcgaauuucugaguucgaggccagccuggucuacagagugaguuccaagacagccaggacuauacagagaaauccugucucgaaaaaccagaaaaaaaaaaaaaaaagaguaugaaguuuuaaaaagucaauuauaagugcaguaagaaaucaggaaaagaaugaaagaguuggagucuuuggcaagaaacuaauagugguagggugaacggaguggguugacggccgauuuugaccuaguugaagaguucuugaaaagaacggaguugacaguacuccaggggagacaaucuagacguauuucgguaggaggaaccuucuuaucaggguaaaaagacuauuuuauuuuaggcuuauucuuuccaucuguauuucccacucucaguccuccaagccaguugggcgggauguaaguagcagcagguagcagcucacuguguucagcguccuccuccguagaucugagcugggaacgcggaagcucugguuacuaaaaacaaaguucacccaggucccagguccacgacaucucagccacuccgggauuuccggacagcggaagcgucgccaauaagggaccggaaaucccgccuucgccggaggaagcugcggacgcuagacagccaaucccgaggaaggcaaucguuccgcggagacagcugagagcccgcgcggggcuggaggccggaaguaccgugggggcgggacuuggggugccggaagugaucauuccucgguucuuccugucggugcuguagcagaggagaugcucccggcggcugagaggcgucagcccgaggacgguuagcgagaggggcgcaguguggacccggggccgggccgggccgggcggguggcccgcacucggaccaugagcuaccccaugcacuggggggaauggauccugaacuuucgggugccgcccgccgggguguucggcguggccuuccuggcccgggucgcccugguuuucuacggugucuuccaggaccggacucugcuggugagguacaccgacauagacuaccacguguucacggacgccgcgcgcuucgucacggaagggcgcuccccguaccugcgggcgaccuaccgcuacaccccgcuccugagcuggcuccucacccccaacgucuaccucagcgaacucuucggcaaguuucucuucaucagcugcgaucuccucaccgccuuccuccuguaccgccugcugcugcucaaggggcuggggcgccgccaagccuguggcuacugcgucuucuggcuucucaacccuuugcccauggcgguguccagccggggcaacgcggacuccaucgucgccucccugguucucucgacccuguacuucauagagaaacggcucaucgcgugcgccgcgguguucuauggcuucgcggugcacaugaagauguacccggugaccuacauccuccccauagcgcuccaucugcggcccgagcgcgacgaugacgagcgucuccggcaagcccgguucucuuuccaggcucguuuguacgacuuccugaggaggcuguguagcugggcagugcugcuuuucguagcaguugcagggcucacguuuguugcccugagcuucgguuuuuacuauaaguacgguugggaguuuuuggagcacaccuacuuuuaucaccuaacuaggagggauauccgccauaauuucucuccguacuucuauaugcuguauuugacugccgagagcaaguggaguuuuacucuggggauugcggcguuccugccacaguucaucuugcugucagccgcaucuuucgccuacuacagagaccuugucuucugcuguuuccuucauacguccauuuuugugacuuuuaacaaagucugcaccucucaguacuuucuuugguaucucugccuucugccucuggugaugccacuggugaggaugccuuggaaaagagccguaguccucuuacuguucugguucauaggacaggccuuauggcuggcuccugcauauguucuagaguuucaaggaaagaacaccuuccuguuuauuugguuagccgguuuguucuuccuucugaucaacuguuccauacugauucagauuauuucccauuacaaggaggaccgccuaacggagagaaucaaauacgacuaaug

SEQ ID NO: 528 - RNA, 7569 nt, Mus musculus
ggacuuggggugccggaagugaucauuccucgguucuuccugucggugcuguagcagaggagaugcucccggcggcugagaggcgucagcccgaggacgguuagcgagaggggcgcaguguggacccggggccgggccgggccgggcggguggcccgcacucggaccaugagcuaccccaugcacuggggggaauggauccugaacuuucgggugccgcccgccgggguguucggcguggccuuccuggcccgggucgcccugguuuucuacggugucuuccaggaccggacucugcuggugagguacaccgacauagacuaccacguguucacggacgccgcgcgcuucgucacggaagggcgcuccccguaccugcgggcgaccuaccgcuacaccccgcuccugagcuggcuccucacccccaacgucuaccucagcgaacucuucggcaaguuucucuucaucagcugcgaucuccucaccgccuuccuccuguaccgccugcugcugcucaaggggcuggggcgccgccaagccuguggcuacugcgucuucuggcuucucaacccuuugcccauggcgguguccagccggggcaacgcggacuccaucgucgccucccugguucucucgacccuguacuucauagagaaacggcucaucgcgugcgccgcgguguucuauggcuucgcggugcacaugaagauguacccggugaccuacauccuccccauagcgcuccaucugcggcccgagcgcgacgaugacgagcgucuccggcaagcccgguucucuuuccaggcucguuuguacgacuuccugaggaggcuguguagcugggcagugcugcuuuucguagcaguugcagggcucacguuuguugcccugagcuucgguuuuuacuauaaguacgguugggaguuuuuggagcacaccuacuuuuaucaccuaacuaggagggauauccgccauaauuucucuccguacuucuauaugcuguauuugacugccgagagcaaguggaguuuuacucuggggauugcggcguuccugccacaguucaucuugcugucagccgcaucuuucgccuacuacagagaccuugucuucugcuguuuccuucauacguccauuuuugugacuuuuaacaaagucugcaccucucaguacuuucuuugguaucucugccuucugccucuggugaugccacuggugaggaugccuuggaaaagagccguaguccucuuacuguucugguucauaggacaggccuuauggcuggcuccugcauauguucuagaguuucaaggaaagaacaccuuccuguuuauuugguuagccgguuuguucuuccuucugaucaacuguuccauacugauucagauuauuucccauuacaaggaggaccgccuaacggagagaaucaaauacgacuaauguguucuggaucuucugcaacauucugauuuugccguauggacuaggaggcuuuggaauuuuucuccucccugaacauucuaagcacucuagugaaaguuccuuuguuccaauagaaauuaaaaccaguguuggccuuauauauaaagggggcccaagaacugagguccaugguccauccuuuagaagucuuagggcucauuugcuugaugagaagaaagccauuccuguuucacaguugagaagccggugaagcuagaagaugcugaaauauuuuugaacaguagaggaauaaggucucuagcagcguuuguuccugucacauggugcuacuguuguaccuucagccccugccuuuuuuuuuuuuuccugcaguucugacagcgguggaaguugacaaaaucccuaaagcacaacauuuuuacguauuaaguauuaacaguuccaugcucgguugggaaagucugaaauuuuuguaguaagugugggggcuuagaagagaacuaauccaaagaaucuaaauugugaucauguauuuguuuuguaauugaguuuuucaguauuaguaccagugguauucauuuuauauaaaaagauuaaauuuaaacucauccacuguagaccugaguuuaagaaaacgaaauggagcauuauuaacauguauaugcuuauccuuuuucuaacugcuaggaagacuuuuccucuagaguuuccucugagagcgguguguuguaaaagugguaaaauuuagaugcuaaagccuaaguuuugaguauaacuucacuugcucucuucugguuuuaucaucuaaauuguuacaaaggagaacauuguuuauaaggcauaaauccuacacucugaaaauuccaggauagaaaggaagacugcuugcuguaaagcaugagugcugcgugcugucauuggacaaucaagaggugguaagggauuugaggaauuacagaaaugaggcugugaggagcaggucuuucuacuuaucacuugaaguaaacacagugaaacuguaugaauaaacuuucucaacuguaugaauaaacauucuaaaauauuuuuagaaaacauagagccugucuguguugaggguuuucuaacauucaaagaugcaguagcaauagaugaguauaauuuuuuuuuuaaagaauaaaauuaucaucuuuaaaugcaaguucaagagaagauaggauuuuuguuuguuuguuuguuuuuuuuuugguuugguagggguugguuuuuccuuugucugguuuuuuuuguuuuuuuguuuuuuuuuuuugacccaggguuucucugugcagcccuggcuuuccuggaacucacucuguaggcaagguugacucaaagaucugccugccucugucuccugagugcugggacuaaaggaguguguaaccacacucagcaagaagaaaguuuuaacaggcuuuaauuuauuuuuacuuuuaauaagaauguugauuuugaauguuuaucagcuaguucugauuguuuuauuuuucuuugagauagcacuccauucuacagcacaggcuggccucaagcucacugcacucuucuugccucugaagugcuaggucuacaugucugagccacuauaacuggcuuucugauuguuacuucuaaagcaagauuuuagggcuaagagaacaacugcugaaaguuguccucugacuuccacgagcaugcagugacgugugcuugugcacguacaugggugcacacacacaaacuaaugaguguauucucucaagaaagcuauuuaaaacaugaaaaggucuagauguuuucagauauaaaauaaguugucucaaugcugaugucuaacgacuuuuagcaaaugugguaguaaacaaucacauaaauauguuuuuggcuuuaggaaaaggacuuuguuuuuuggagccaaagucucacugugguagccucggaugccucagacucagugugcaaucccgaccaaccuccaacucauccuccugcucuagccucuuggguccugggauuaaaaaugugccaggccaguuuuuacuuugacugccauaugcauauccuuaccauguuuuucucuuucuuuguaaaguuccagcuuccaugcauguaccugggugacaugagaauucuaaaaaaaaacaagcuagaaaauaguucugucuccagccugcauaagcguagauggcgauaauacagacucucucaguagguccucuagccgcuucuguuauuccaccuuugacuucgauuccucuuccagcugcuuacccagccuuucacucugcuccgccuucugcuggacggcauccaacucagccagggcgagcuuuagcuuuuccuuaaagacauucuuuucggaagucauuuccucuuagagcagagcaucagaguguccuuuccuaaggcgcuccugaaaagauucaaugacccuucggguugugcuccaucuccaggugcuuaugaugguaaaacuugagaagcaaacucuccaugaauauaauuuuugugaucaugauguuuuuguuuuuaaauuggauucuuuuccagggucagcaacaacaaaaaacuccugaaaaauaagcacuacuccagaaaaguaguauucuuucccccugucacggcaagccuagaaagccuuugaggauaaaaucuuuauaggcuggucauaauuaaaaauucucuuaggggcagcauuucuuugcuggauuccuuuugggauuggccuuaggaagaagaauagguggcuuuucuguugcuuacuguaugugagaaaaguggucaauuguagaaaacagugaccuuuccuaaaauggcaagauccauauuucuauuuagcuccuaacagcacacugcuuaagacaguuuaagaaguggcuuuccaauuaugguacaugaaccuuuuaaaauuauuauggugauugaaaccccuauucuaggcaagcagucugccacugaguaauguacccagccccaagugaauauuugaaauugaaaauuugagcaaggaaaguauauauucauguguuuuuauaggccugacuuuuguuguucuuuuagacagucuuaguccaggcuggccuuaaacuuuguuugcccaagauaaacuugaacugaucuucaugccucuaccuccuaaagagcugagauuacaguccugugacacugugcuuggcucagaaauucuuuaucaaagaaaugcaaguguuucuuaagggaugcagaagauauuugcaguuagucugcugcaaaccuuuauuuuuuuaauuugcuuuauauguauagguguuuugcauauaugucugugcaccaugugcauuccuagugcccaagguggccagaagagggcauuggauuucuagaauagaugguucugagccaccauguggguggguacuaggaauccaaccugaaaaucuccgggaagagcagcuagcacucuucaccacugagccaacucuucagccccaugcugcagagacauuuaguaaguuaagcggagaaaagaccugauuugaucuuuuggcuuuuacuucuguuuugcagcuuuuaaaguuuuauuuggggaagaggcacacauaccuuguccuguguaugcaggucagaugcacuuguggacggcagaggacuugugguaguccauuucccucuuuccauuaugcuggcccuaggaucaaacuuggguugucagucuuggcagcuguaccuuuuuacacugcacugucuggucgcuuugucuuuuuuccguuuaugauaucuuuuguuuccuuauaaguccuuaaauaauaccuuaaaauugugucgcucuuugacguauuuucuguguaauucucuuguucuuauacuaccugcauuaucuuuaugucacuguagcaaaugccuaucauaagucaacucucaggagccauaaugggacaagcuaauaacuagcaggugaucauccugaaguggccugccucggauuauuauauaaucugcgacaggugcgcccuuauuaagaaaggcuguaagggacucauuuuaggaaagaugccugcuauuaaugugcuuuuccuguuacuauuaaacauauauaacaaucacuaaguaguagcacaccccuguggagcagaucucugcagauccacaaagagcuugucguguugcuauauagacaaauagaugacuuaagucuucaugaugauccuauaagaauuccuaaaauuauaucuguguuuauuaagcucuuuuauaacaggacugcuauuagguccuuuuuugauagucaaagcugcaaugagaacucugcccaaguguccccaguuaauugcucuuagauaguaaccagacuuuauccuauucagaguacacuccaagaaguuguaaaacaauuaaccaaaggucauaaaaagggaacuaaugauuuauuauagguguuaggacagaagauaaaauaucuauugggcuuaucuauacaaaacuucacugauaacuuaguuaugguuuuaaaccuucagggacccuguagagcugagacaagugauggauguuuagccagauaauuacuccuaacuguuaggagcgugcauguaaacauucacuguuguaaacuucuauuucaguuuaugauuugauuuuaugugugaacuugugaugaacuuguaacaugugaucauguauucuggaagauauauaaguacugaggacagagagaugaggggagagaaaggagaauuuuuucccuuuccccacuuagagaacuuuuucccuuuccccacucaggaucuuuuugcuuagauagcuuucauaggaaacuuuuuuacaacuuaguaauaaacucuauaaccacuuuucuaaguguccuuuuuucucccugcaacuuccaacuagcaggcugaaaguuagagcccagcagcaauuccugcugcgauagaacaaaggcuauuaacuuaauccuuugugguuugaggaagaggugcuaagugccagaaacugcagucucugccucagaggaucacagaaggcaggucagcuacaauagcauaguaacuuagaauuagacaaguaacuuuuuaguauauagcaacccuaaauauaagaaccaagaacccuccgccuacgcgcucccccucugcugucucaagaagaaccaagaagaaagaacaaaacccccaccagagcugccccccccaacagucaauuuauagagagaaaagauuuauuuggggccauggauuaaaaguuuaacuuugagauugguuggccuuguggccacaggccuguagugagguagcacacuguagcaugaggacacgauaaaacaaacuguugacguuauugugggugcagaagacagagucugagacaugggucucugagauccuuuugagggcacaccccuaaugcccuaaaaccucacacugggcuggccuaaaguuuccacaguuuccaguagugccgcagucaaggaaacaagcuuuuaacaccugggccuuggggagaguucagauccauacuauagcauuaacuguguaggacagacugacugacaggcaagcagucaugauuagauuaagaagaauguuucuccacacagguugugauuuuuuuuuuuuucuguaacugcuuuucugauguccccaaaaugucauuaaaggucucaaguucccuggauugggaucauuaucgucuguuuuguuuuuuaguuguaggagauagggucuuauauagcucaggcuggucucaaacuuguuauguaacagaggcuggccuugaacucagccucuugagucuaccucccaaguacuagaauuaacaggugugcuggaccaugccuaguguggauuagguucuuuggaaaagcugugagaaauauguacacuacugggcaacucagcaaaaggauucuuaaaacuguagaucucagucacugacaucucgccaucuggauuuuauaagcuguauaaugauguuucauaaguuguauaaaacuugaacuuuaauuuauggcugaauauauuguucuuuuuuucucuuaacauccguuauuuuauauuccuaccuacacucucuugccaucugugauguaaguuaucaguagaaaagaaaaaccugaaaaauucuaccugugguggucuuuauauccaau

SEQ ID NO: 529 - RNA, 7562 nt, Mus musculus
ugcccgggcuugaaguuaaauggcaagcagaaccacgugggggugcugucccagccuguaagcaccagaccuauuacuccuuacucuauccuguaggaaggcgcuuccuggaccugaauuuacaaaaggccggccuuuuuguaauaguaggcuucucauagaaacaggccugcgauccugagcuagcuagucuaggcagaaaguuuccuauuaggauacaagucuauggcuggugaaugcagguugaggauccccugggcggagaccuuuugcagcggcgccaaggacuccgcagguccuuuacggcucauuccugccuacugaccaccuaucuuaagcgcuccagcauuccacgcggcggcgccuuuaaacccucuuggcccuugccccgccccugguccgccccgucugaggcgggaccccccagaaaacuccaagcccggccgggucuugagcuccacucgccgcugcagccccugucgugcgugcgcucucauccagcccucuuggacggugagcaggacugagggaccaaggcagcggggugggaguuggggauuauguguguggucuguagaaagcaagaagccaacacuugagacuugcuucugggagcguggggguugaagacuggcggacgcuggggucccaacugggugccccgccccgugcugucagguccgguucccaagccuucucugcauuguucagcaguuaagcaaggcaaguuuuacgggugcacaagacggggcguccgucccgacccaagaggucuggucccaagccccagccguuugcuccagcguugaguucucuuuggggggagaaggaaggagggcgucggacguccgcaggcugcugaguggccgcaagaacuagguucuggcgcgcgcuccgguccaugaauuuaccgcgcgccccuuucacuuccugguccaggagcacguguggguacugccugccuucugugaccccgagaccgcccuuuugccccccuccugcuaguucguuuguccggguacucggggucacaggucuccgggaguuauuugcacaguagccuggucuucugugaaacccccuucuucuccuggagcgccuuugaccucggacaucuccgggcugcagcccugacugcacucggaugugcccugucuguagggguuggcugcuauccaaacucucuuacccuagccugagacccgcugcccccucccgugcccccugcugcugggaaagccggugguggccgcgggcgggcgggcgggcugcccagaccugcgucaccccaguggcgggagggcggugggugacucauccacauuaacggcccaggcaggguguggccgugggggugggggggacggccgaaggggcuggaccggaaguagauuaccuccuuuuugggcucugcaggccuaccuguguuccuauccgagagguucugggauacgugguaucuguggagcaaaagcagcggugauggcaaguggaggugcgguguaggagaccaguggcuggacgggucuccuuguucccuagagcaguagucagggauagcucaucucuaagcuucucccauuuucucuucccuguagcucaggguacaccucaggcuuugggccaagguaaggaggggugagcaagguguuaacguuccaaagccgcaaauaaucuuuguccuugcgauccccuugcacacccuuggugucuaugcugguccccaggggauuggccccuagucaguguucaccccauggcuuuguccuucgagauugccaggugugggcuuuuuaagcaaaaaaaaaaaaaaaaaaaaaaaaaaaaaagucuuuccuacccaggguaugucuucuuugauucucuacccacaaacugcauaugcccuccagguccuccagagcugccccuuccccguucccugcuuccccagucuggcuauacccugagaauugcugggaucgcuuuugccccuucgccuagagccuccacccaagucuguguggaguggguguuccugccccgggggggcccccacccugccuccauucccauguuugguacacagacgccauggcaacggccuccacccccuccucuucuccugagcagcccuuguggcuuccuguuuguggagcuuagcuuucucuucugcucuggacucuaucuaggugguuaggggacuggccccuggugggggagggucuucccuaaggcguccccuuaccacagugccccccacuggccuucugccuacccacguggcguuucuguuucagaaguugggaaguucccuacauuccacaugcccagggagaggagagucccauugucuucccaacacguagucaugaaaccuagaguccaacccuccagcuugucucccuugccuucagcguugacagugaauggggugagguaaacugccauccauccaugguuuggguggagcacuggguuggaagaccuuuuaugacuccuccuuucccaguuauuguuguaaccuugugggccugguugaggaugguuccuagggcuacagucagcaguagaguucgucacuggcaccccccaggcaagcuauccaguugucuucacuugggauacccaguucuaagcaucucccacaccuguguuccagcugaacacaucucuuuagcccaccccagaaggagacuugccauuuucucuuucacugagggagggcuggggcgggucuccuggguguaaccagggguaggucucuccagcugcagcagccacaagccaucagucgccugccugccugccugagggguggguagggagagagacagcugcuguccaggcaggguugguugggagagcuuagucugagaaucccgucccguggcucugccacuuugggauucuagggucauggccucugaguggaauggagacacugcagcuggaaaugaacagcccugccagcuguguccagucuccagagcugggagauacuggaaagguccgucucuggacucucuucuuccucucaacccuggucucugguuaaucauuuucuugcccuuucuuuaccugugccugagcgcuccaggcacaccagcuccuuggaaacagccccaggcagcaagaggaaagcuguuuccagaagagaggucuagaaauugcgcaggcuugcgugugauaguggccucuagcccccuccuuuucuuuuccuguuuucuggccauuccuuuguagucagagguuacaacacgccccccccccccacacacacacacacagccugagagcugaguagcugcggcuggucuauugagggcgagcgugcuggcuccccuuucugcccaggucucagccacuccacuaccugcauucaucaagcugagugcguguguggccugcggugcggugugggucgggaccgagccugacauuuaucuggucuggcugggggggacgucuccuaaugaacuuaaaaauaacuaauuuauggggaaagauccugccggaaauaugcagcuggauaaacccagaguuagaaaggagcagccauguuggagggugggggaagggagugacccaccacacaaccucugcccagacguaugacauuauuagcaauggacuuauuagccuggcuucuuuggcggagcaccagagcccauugaggggguggugggagcguuuaaccuggggugcaugagagagggagccagaaugacuucaucccuuaagacugaccuggccugaugccagaugugggcucccuuccucucucugaauggaggcgcuuguccuguggauaccauuuuaugagcagucggagacagcuggcucuauuucugacuagagaaaaggaccccuaaacaguagcagggauuagcuaaugaaggacaaugucccuccucugucccugguuccucuggacagcagaagcuacuccugcacucccucucuggauuccuggguguggcaccugucaguaaaacaguggguggggcaggcugcccacagugaaaugccugcaaacucaggccuguggucagaagccagcagcccuuccuaaccaggguccuuaaggaaccuagcuaugcacuuugccacacuucuuucccuucccagguuuccuugaauaucacauccaaggcucuggguuaauuuccccuuucugcuguaacaaacuauaaacuuagccacacacuggaugcucugauaguuuagaaacucagcgggagaugcuggcgggggugggguggggggguggggaugggguggggggggcggggggauggggggugggguggggcauacucacugggacugaggagcuaggggaggguccauuuccuuuucuuuucuggccucaucuccauugcuugguuugugacccugcuugacacccacccugucuucacuucucccaugcugccuuccccuuucacuuacugagaaugagaacucucgugacaguacugggcccaccuggcugagacagcuaaucacgccgucugcaaaugcaugcacacccugccuuuucaacuguguaagaugauguaucucccauguuugggaaucacuauaugggcaccuucggugggagaguaggcaagggggagggggggcuagucugccgaucacgauuccuagaagggaaaggaaggaauucauuuugucugcuaggcuuuucucaggaagucccccuugcccgcugagacgcgggccuaccuuucccagcaagcccacccagacugccuuugucccucugcuucuauuaauuccuguaagaugaucugaacugugcagcuuaauauucguuguguacaguucccacugccagcgcuccucccuguauucccuugauaacacuauagauaguguagagccggagacuucacucucuucuacagaugcuccguuacaaccuaaggguugacggaggguaguuuacucgcucccgcucuuggcauagguuucccauaugcucuguacucucauuuccugaaucauuuuuaaggcuucaaagaggaggguugggggcuagaccucgccucugucaagcuucaucacuccaaaugagaagcugaacuaaaauccuuuaccucauccugcauuccagugggucccaggcgucauucuagacacaggaccauucauucagacgaaauguaguaucuguguggcuuccuacuggccagaguccagagcccugcugcgcuagcuccuggccacgagucccuccccugucuucauagggacccuaugcauuggauuguagaauguugagcgugggccugguuauguccucuccacagcucuuugccaucaccacagcugcucagaauggccaacaggggaccuuccuacggccugagccgagaggugcagcagaagauugagaagcaguacgacgcggaucuggagcagauccucauccaguggaucaccacucagugccgugaggacgugggccagccccagccuggccgugagaacuuccagaaguggcucaaggacggcacggugagugcuggaugggugagcggggcaagcagggcgagcagggcugaugcugggggaccagggagcguuuuacacagugaagaggagaaagcgagcaugcaaacccaagcuugccagccugagcaucuuccugggggcccuuagagcuuccaugcuuuucugucuccacggaggaaaggacaaggcggaugugccuguugcagcaggagcugauaggugcuggugauguuugcaaagagggugagaagguaagcgccaggccgugguucuggaguagugaggaaagacuaaacucuggcccuuuaucuggguucaaaggcaggaggcaccuugaggcucaccacaggaaaggcaccucucuggcucacugucuuugguucucugaccuucaguagucccauccucaccucugccugccugcugccucuuccagguucugugcaagcuuauuaauucacuguauccugaggggcaggccccaguaaagaagauccaggccucuucgauggccuucaagcagauggagcagaucucccaguuccugcaggcagccgagcgcuauggcauuaacaccacggacaucuuccagacuguggaucucugggaaggugggccagggcccagggcuauuaccuggcagagcaggaguuggacugggccaacuuuaccaaagaaaaaggauagcuggugguuuuccugagggugugugugugugagaucaaggaugggccauacugcagguugagguugaaacaaugaauuaaaguuuggaugccaggcuugcagaccuagcgacagauagaaugcuagcaucuuguaacuuacuucugcugagaugauaucaccguuuucuuccaggaaagaacauggcuugugugcagcggacacuaaugaaccugggugggcuggcaguagccagggacgaugggcucuucucuggggaucccaacugguuuccuaaguaagugucugugggaaagccagagggccuugcugguacaguauucuugccuauuccuaucuguagauaauagagucagucauuacaaagcaucuuuaaaauuccagaagguggugguggugguggugguggcagcaauggcuguccuuuuggagagacaaagaggugcuuuggagucucagaagcagagugggugucagcuuauacaccucagggaagaauuuaacuggauagcuagccccugaccacccccuaacuaguacucccuuucuacccaggaaauccaaggagaacccucggaacuucucggacaaccaguugcaagagggcaagaacgugauuggguugcagaugggcaccaaccguggagcaucucaggccggcaugaccggcuaugggaugccacggcagauccucugaucauacucucucuccuuccccugcccuccaugaaugguuaauauauauguauauauauguuuuagcagacauucccugagagccccuggauugcugaacuccccucugccaggguccaggccagccuaucuugucaccacuggcagggccugauaauugccucucucucucucucucuuucucucucucucucucucucucucucucucucucucucucugggcuuacuaaugcauuccuucccccacaaccaucaaaacuggaccaacaaaaacccugggaccaaaguugccuccccacagcaucuuuccugcuuuccugaucucuucuuuuaguccaucccuuggcuaggagucagagauucugccccauggccugaugcugcaccgacccuuccuucuacaaggaggccucuccuacagcuguggcugcagggacuuaauuuauagggaggggccuguggcugucacuccagccacagcugggcuguacuuaccacacgucugggcagcuuucccuagcagaggcucuuuggcuucuuucuuuccauuccucucucacuguggcuaagggguggagcagagguaggacggcugcccaccaugcucuggggcuugacgaacacgaguuugcugauuuuaaauaaaaagaucucauuuuguuuugcauggau

SEQ ID NO: 530 - RNA, 1561 nt, Mus musculus
ugacagagagccggaggcauugcuccuggauccugcuucuguggguuucugugcucaaagcagucugaccuucucagaccucucucagauagccccagcaacagaagccacuacgaccaccaagacaauacccaagaggugugcuuucaagacacuuggauauguauugaucccagagaggcuuguaaccuccugguaaggcuuuaguacuucauauccuuuggagagagcagaaaggcagaagcuuauggaguacgagugauuugccuggaguccuaggguuucugggaacagaaaagcuaugcguuacauacagaucuccuguucgcuucugguucucagaaccaaaaguguugcaaccagaaggagcucagagcucaggaguuugaacuggcucugugugaacuaaaauccagaugccuagacucuggucaccaaucaguugauauugaaagucaagugcccucagggaugggacuggcuuuagaccucaaggaacacaggauggcguguucuccuaaccaccaggaguuccaaguggcuaaacacgucuguugucaaaaugauauccuccagcacggggugaggaaugcagaucccagaaggcuuauuagaucuguagacccggauccuggcuggggauugaaccgcaucucaaacggacucuucaaucuuuaggcaacaugucccagaagacuggaaaacguuucucuaacaagaaaacugaggucuugaaagggccccggccugagccagaaacaguugucccuacccccucaacccuagcucuguuuggugacuguggugggguugccaggggaaccaggcugugcaacuuccuggcuuuggcguuuuuccccgauguuggccuuaucucggcauccgccacccaguccagggcugcgugcuggucacguaggaggggaagugggugccaggcguauugaggacaccaagagaacacuggcccaaguaucagaugggcaggaggguggugaaugggaaguucgagagguccaggagggugggcacggguucauuaaugucuuucucuauggcuugggagguuccuggcaaaugaggaugugaagaauugugacuagucaggggcuuuuucugcccuaacucucagcucucagcucucucacagccggaucccagcaucaccugcaugucugcuccacuccagaccuacagucuccagccccaagcacacccaguggucccuaccccaacaccaucaacccugcuucugaaguucuaugcacuucggcucuuucugccugguucaagauuacuuucuguguuuuguguuucuccuuucuccccauugcaguucagucucuugggcagucaugaagaacaggaaagagaaaagggggguuuuugaagacagauggaacgcagcuagcaguuuaagugaaguaauucgugcauuuaagcauuuauuuauguuuugagccuuauuuugauuugaaaagaauuuagggugguuuggagaauuuaaguguuccaggaaaggcggcgagugaugcaacuuucaagcuucauacaguuuaga

SEQ ID NO: 531 - RNA, 7782 nt, Mus musculus
gucagucuuuaaguuucuuuauugugcuaacacuguugccuuggagcucagaucucacacacagagcaauucagcccugacauccaccuacccagggcuggggggcccucgccuuggcuggggacaucuggguuguaccucugcgguucugggauaccgacagcucuccucucccuuccucucccuggaaaccaggggugagggagagcucugaacuguuuucugucucccccgccucuccucccacuacaggggaggagggucugcccggcuuggcuucucagagggaaauuuccuuaccaccgcuagguggccaaugagagagccaggucugcuggcccgaaccuguccccagcugcgggcagagagcccccgaaccaccucccagccggggcgcagcccggugcugugcgcucacacuaagaggccguccuugcacgagcgcugcucgaccugggcacagucggcgcagucggccggcuccgcgcucuugaccuugauguagacgggggagggacccgcuucgcaggaggcggaggcggugcggggcacuagggccacguccucggggccgccgcagggcggaggcgcguacuugcggcgcagggagcggcugacguucugcgucggguaccccaggaggugggugacgcggcugccgcgcccgcuggccuuacacccgggcgccucggcguccacucuggaaaacaacaggcgggcgcgugagcuggcuccuccacggcgcggcguuggcacggccugggcagagcugggggcucuuggacacuucucaucucccgcgcuccccuccgccugccccaucaccucucgcucucuggaccucaacuuacucucccuuauucacaucccagagccagcgacccugcagcgcccccauggcaccauccccguccuucacacccuguuuguccucaagugucccaguucacggcgggcagcuccagucagguugcccuuugucccuuucuaguguuugucuagaagggagacuuagugauccgggaacugugucccuccuuuccuugacuaacucucugaacuccggcaagcucuccuugccucaggucccucgcucuccuuuuccucuguccccaaggcauugcaaucauuagcacugcuauucuuguucuauuuuuauuucuagauugcuucuaauguaaguuauuagcacuauugguguuaacgcuucuuaaauaggcauguugagguucuggccggcgcaguacaagggaaaggugacaacacacggucccugcccuccaggagcuuacagucuaggccagacagacugggggaugcauagacgacaggaaggaaaggggaaagcaaggagcagaggugaagacuggagcgggaagggcaaagagagaaaagccaugcggcgagugggcaggucgacaugcugaagucccagcacuccauggcgauggcgggcagguuuggaaugggguucccagccggccgauggcaggcaggggugaagaggacagggcgccggucccccgccgugcagcagcaugcagcaugcaucagguuuuaccugaucucacuagccaagucgccgcaggccccuccgccgaccccgccgccgaccccguagccgaaggcaccucgggcaccaccggccccgccgccuccgcagcagcagcagaugagcccccagaugccuagugccaggcaggccagcaugagcaaagagcccagcacugcuccaacgaucaugccuacucgcugggagucuguggagagagagaaguggaaggagucaggcuccugacagccuggcacaugccaggacagaugucugugggauagaacccaggcccugggaggcuccguaaggaagcuggggguucuggggaggggggagagaagguuaaaugaaucuguagguggcuuccagcugcucuaaacggggggcggggggugggggugggaagggugcugccugacagcgguggagaggcuaccagcugaagcuccaaaauagaguuuaucugcuauccaaucccggaccaccaccacccccgccccaccccacccauccccaagccagggaauucuuagagcugcuguaccuaccugagacuuucaccucuaccacacagacgcuguagcccacaugguuggccacugugcacugauacagcccaucgucgucugcguugaugcccuucaacagcaggucuccguugcccaggccugagauggaaagagcaucagagggguacugagacagagaaaagugucucugagaacuccuacccugccuagccccugugggguggaggcgccacccuaaaaaaaaacaaggaauguguauacaagcacacucuaaugcugacccauacuccccuugcugaaacagaaaaaaaaaaaaaggaaaagaccccucucucagaaagaagacaccauuaauucccugugaccucagagaaauacauucugacucagcaccggcuugaaaagugaagacaggguuagaccugaggagcucugggguacccucuagcuuuguuauucuuugauuguggugauuuauuccgauucucuaagcacuaggcgccucagacaccuuauccucucuaauccucucaugccagugauggcagucaccgguaaguauuccccuuuucaucugccacggagguguugagcuacuugccugagauuuacuaccaaucagcauccuagccaggacucaaggccaacucuuccuuggaccuuauucuccccaaaugagccacacugcuuuugacugacauucuauucgcaccuucucuccuucccucaacagcagcugccuggaugugcucaaaugagcagccucucaccgggguaccaggucugacuugguaccacuuggaagucccaaucccauaacuguuuuucacucucccucggcugggcccccucaccuugguugauggugcuguggaaugacucuugguaagaaagcucagaguggaagcugugcugugagugguaagccccagcucgguaggggugacugugcccacugaucuuggcccacuuguaggagaggggcugagagccuccguuggcaaagcacuucagcaccacaucguugcccuuugacauguggccuuccguccaacacaugggcaccgcaggacgugcuguaacaagacaggaauuauaagcccgggugcagccaaaagccugagccaggcucacagcagccaaucugcacuugacucugaagccuggaaaaaggcgagcccagaagcaucugguauaccuuggacagugacaaugaccuuccugguggccaugguggucuucuucacccggcacucauagguugcugugucagauaccugcagguucaugagguugauggaggcaucguacuggcuggggucugaggcugcaaagcggacccucugcugcagaugggggagguugccaugaccuauccucuugucuugauaaguaagaaacugugaagcaaagaggaaaacagagcuguugagacaaucugagccagggaagguugugugaguugcuccggcaauucacugaccuucucuaagacuccaguuuucucaacugaaaaugggcauaugacugugucaggcacucugaccucuuacagaaugagugagagcagaugggauuagauauucuagagaaauguaaggucagacuggguucuaaaggcagggcccacauucagucuccuacccccaccuugauaugggguagaaggagguagagagacuggcuggcuugacuuccaguuggauggcucuuaucccuguugccucauuuucccugagauauuuuggaggaaguucaaggcccugguuugccuuccuucucccucaggauguuggcuucccaucaaguugacgucauagaguacagagaacccucagccaggcacuuacaacauucucccugugugagggcucugaguugacuugcauccacucaauguccagacuguugguacccaaauccucaggauccaggagguagggacagccuagccucacauugucaccuucugccagguacaugaccuccuggccauccccguugauccuuacagcagacaacagugcugguaaaggguaaagcagguggaaagagagaacagaaacagcgcuuaguagucagucuccaccugccagcuggcgcucaguggcgcuuccacaggaaugaggggcugugugcaugugugugugugugugugugugugugugugucugugucuguguguguguaugucugugugucugugcaucuguacuggcaugagcaauacuuauguuguuuauuuguuuauccauauggcagucucugggcuuccuugugaacuuguguauauauuuuagacuuguguaaaggagcacuugaguaguauuguuuacauauacagagcucguguguuguacuuguauauuugcauuaugaauaugcauauaugcauauauauguauagagagagagagagagagagagagagagacucaaaugugcauuauaugucuaugagucuuuguagcugaaagauguucauguguaugaccauguaggauaucuaccuucauauuuacaugacaguguguguguguguguguguguguguguggguggguggguguggguguggguguggguguguguguggguguguguguggguguguaugugugugaaacacccagagucguuagauguuuuauuggaagaaacaggcuauuuaaaagccaccugcaugggcuggguuuaagcccuaucugggucaagugaagugcucuagccagaagcaggagaguagauacagagacuccggucucuuuccaucccagaaagcaagaguauagcugugcaugcuggggugguggugguggugguguguggacuguguguccuccuccuugugugauugugugguuccaguauaaauguucccacuugcuugcucccauuggggccccuccugccacugagucagagcaggagcccaagguuuggagccaggaucaggaagcuuaggacugaacuccucucccucccuccccuagagccucaggcaagcucugggcccaaccgguuagaccuaaagaaggauaagggggggagugagcccagggcuccacccuagacacucaacuccuuccuuaccuccagucuccgaagcauuccuucuacaaagaccucaccaagcuugucuauggauggccuuuuuuaguaaacaucucucuggggaucccaggcccaagucucagggagucucuccccacuccccccccucaaacacacacacacacacacacacacacacacagguaugcaccgaccguccugggcaaaacaaauagacacaagcauguucuuucaagcccucaaaaugugaauauauacccaugcaaucuccuccuucuucuugcacacaaaaacuauuggaucuauauacagacacauauuuacagacaaagagaguccacauuagucuaggacacacccacugcacgcucugguggcuuccugcgcguccauucaagaccagacacaucugcagaagcccugaguuccagguguagccuagcacuggagaagcuagcaagggccuuacaugucccccaacaucuuaaacggcacuggaccugccccucuaagccaaagcuagccccccauacauucuacaaccuaaaaagauuccaacuugaccucgaacaggcagccuagcuucugggacucuaacgggaccuggagaugccuccuucagccuuaggccaagagaaugccggcucauuccuaagauaaggauccugaugccaucugccagaucccggggcauugagaagcaagccagggaugagccagaguucugcugagagcagagacuccacccuggggaugaaccacuggaaacagcugacagcagggaggauucccuuguccugcuucacggaggucaaccaggcagaggguaaguauucaaagaaaggggcugggguagaagggaugaacuggaacagaaugccucuacccugcacuaggcuguauuacuucaauugucucaggccaaagagccucaccccaguuccucagucuccuuagauguuuccucagcuccucccaaggguuccagccguuuuguaccuccucccacccuuuggcauaucacucugguuuaucuugcugugacacuggggaaggauuuccagggaauguaagagaaaagggaggcuuguguagagggaagaaucagggugaaagccggcguaggggagagugcuggguaagaggacuugaggggagaggaacaugaggaggccauccaaggaacugaugauugucccuuaggaaaucuccagggcugaccauccucuguggggaaagucaccucagcaggugucugaucucagcuaagaaaccuauucuaaauucaaacugaaaggagaaaagagaagacaagggcagcucagagaaaguuuuggcaucugacuccacgcagcaagaaucuagcccacaugcccucacacauggagaugcccuggcucuccuggcacagccagggcuccuaaugugggcacugccuggggggcuuucagcagacaaaaagagcagcagucacauugccagaaauucagucaucacacauaugcaagcacacacacacacacacacacacacacacacacgcauauugccacacagagaaacaagaugaaacaguccccccuucccucucaccuucuccauaccugucauccuacaucuagacacccaccccaggaggggcuccaugcuacuuucugcaauacucaauagaaugucccuugccggaacuugcccagucccgggcaggccgccauaggauccaaagcugagcccugccuuccacgagugccaccagagaggcgaaggggcucugggagccuaccauccauccuuguccacaaccucucagccucauccuggaggaggcaucaccugugggcucuuguagcacauggggcccagagcagaggucccaggucuggguucuuacuagcuaggauggaggcaacccagaauguagagccuuuucaaggcagacuguuuuccugcccaaugcucuggcuugggagggccggcccuuccacugggaaaagcacacagacugucuaaaggaaacagaucauuggcaggcuccuccucagcccccacccagagcugaugcucaccugacuccuaccccaccugcaauucccagaacuaaauccauaucuccaagcaagcccaggucuccagcucccagcgugggaacagcacaaagggcaccuugcacacaauauaugaguuacacaggcugccaaugaccaugaagaucaguuccaaagccccugcacacagacacugccccaagccuucagguacuggcucuccuggggagaagcccccucggcagugucgaaaucagcaucagcaaagugaagguagauggucccuaccagugccucucggaucauccauccgugaggcuccucugugagcucacaagcaucccugaccuuuggcaucaugcuggguaucccugccccugcccagccccauaccugggcucaggcacacaaguagaagauggagugcuccucgaacucccaugucucuaggcuuggucuuuccuccgccugagcugggcuccagugggcugguggugguggguggaaggggcagguggagggagggggagcggagggcccagacacugcccgggguggcaggaagaugcaaugagug

SEQ ID NO: 532 - RNA, 2088 nt, Mus musculus
uccaguucuugaaaagagggcaacauguuuuauuuucaagguggagaugaaggucccagagauaaccugucagaaagauucuaaauucgaucuagucugggauacauaaagacagcuccugcuguccccacccccaauuaugaaguacuagagauagacggguuuuccuacuugguugcaggaggagccaaagggggcacugaaggggcggcggcggugggcggggagccaggccaaggcugaguccugugcagccauugguggggagugcgcgcugaacugagcauguucgcgcccgccagccagggccgcagccacagccgcagggacggcagccgggagagccaccgcgcauuaugcaaagcggcagcagaugugagcggggccagcugggcgcuccucggccuccgcucccaacggccggcccagcugccugaauugucccggacacuccccuggcccucuccagggccgagauggccugaggaccccaaggcgcggcggcgcagcagugggguugaaacauggggaaccaggaugggaagcugaagagaagcgcaggugaugccucccacgaaggcggcggagccgaggaugccgcggggcccagggaugcggaaaucacaaagaaggcgagcgggagcaaaaaggcgcuuggcaagcacggcaaggggggagggggcagcggggagaccagcaagaagaagagcaaguccgauucuagagccucgguguuuuccaaccugcggaucagaaagaaccugaccaaggggaaaggugccugcgacucgcgagaggaugugcuggacucacaggcccugccgauuggggagcuggacagcgcucacucuauagucaccaagaccccggaccucagccucuccgcugaggagacaggccuaucggauaccgagugugcugacccuuucgaggugauccaucccggugcuucuaggccugcugaggcugggguagggauccaggcgaccgcggaggauuuggaaacugcggcuggagcgcaagauggacaaaggaccaguucugguucagacacggacaucuacagcuuccacuccgcuacggagcaggaggauuugcucucagacauccagcaggcaauucgucugcaacagcagcagcagcagaagcugcugcuccaggacuccgaggagccugcagcgccccccacugccaucuccccucagccuggggccuuucugggccuggaccaguucuugcugggaccuagaagcgaggcugaaaaggacacaguacaggcacuaccggugagaccugacuugccugagaccaccaagucucuggugccugagcauccuccguccuccggaagccacuugaccuccgagacaccagguuaugcgaccgcccccuccgcagucacagacucucucucaucaccagccuucaccuuuccggaggcugggccaggggagggagccgccggaguucccguggcuggaacuggggacacagaugaggagugcgaggaggaugcuuuugaggaugccccccgcggcucuccaggggaggaaugggucccagagguggaagaagccucacagaggcuggagaaagagccggaggagggcaugcgagaauccauuaccuccgcagucguuucuuugccuggaagcccugcgcccagcccacgcugcuucaaaccuuacccacucaucacccccugcuacaucaagaccaccacucggcagcucagcucuccuaaucacuccccgucccagucccccaaccagaguccuaggaucaaaaagcggccggacccuuccgugagccggagcuccagaaccgccuuggccucugcugcagccccggcaaaaaagcaccgguuggaggguggccucacgggcggccucagccgcucagccgacuggaccgaggagcugggcguccguacgccaggggcaggaggcuccgugcaccugcuggggcgcggggcuacugcggaugacagugguggcggguccccuguacuggccgccaaggcaccuggggcuccagcgacagcugauggcuuucagaacguguucacaggugagcgcgccugccacg

SEQ ID NO: 533 - RNA, 88058 nt, Mus musculus
ugcaguuuugucaagguuuuuauuucuuuuauugaucauugcaugucuuaaauggcagauaacucaguuugcaggaagaugacaacacugugaggcugagauguguuuaaauuaagaaauguugaaacccguggaaaguaaacauaaaauagaacaaaacaauacaaucucuggcuucuguaagacacaaguguggugcacuggcuacaggagagaagaagagacuuacaguggacuucucuuugcaucugucucucaaagcuuccucauucaauauuucuuauuccaagaacacucugaguacauucuguauucagcugguggguguuucaauaaaggcuugaaguucccauagacuggaggugagagccaucccaccaauucuucuuguuugaugccuguuucuaauucuccuagaagaucccaagccccccgaaggaacguuuaugauacggaccgugggugaagucucagaggcuggauaaaugcacucugaguacacaaggacacaagugcagaauucagcuuuuauggcacaugaugccaggaucacauagaauccuagaguaucuuuauuuguucuauaacuuaauaguauaccuauaaaauaauuacauuauacuuauagcuuuucuucauuuauaaacaagacacaauuuaaauacaauuugagccauucgaagguaaacuuuauacauacaauaagccaagaaguagccucagacuacagcauaucauauagccuucauggguacacccaccauuaggaucaaaaagaaugcucacauacauacauugugggucccuagcuuaaccuuuccuggugaugugugggucccauuaauagaaugacaugggcuggcuucgcagcugggugugagacucuucuccucacccuccgguuacaugucaccauccuccauuaaggacacucauaucucuuucacagcuuuucuacugcauguucugcuuuggcucuaccucgagauuuucugcuaaaagugaaaauuguaucucugaccuuuggcacccucuucccuuuuugccuuuaucccugggguuuccagcccucugugauuuuuccauuucccccuuguuucucucugcugauuccaggcugugcacucucauuucugaagcuaauauccccuucaaaaccacauagucucuacucaugguugcuguguagcagaagugaugaaacuagaaaacuuacauugcaauacaggcaaaagaguccaaggcauacccuccccagcucaucccaacccuccuccagguggcagacuggagagccagcaucacugcugggcauccacaagccugagucucagagcagcuuauggauagucucccucacauacuaggacacccaucuuggcaagagcauggacugggaaauuaucaaccaaaggauuucagcacauucggauucccaccaagguuucucauucacauuugucagauugcauacgugccauucucagggaggccucccuagaacaauugcacaaagagauugaacuugaguguaauuuugaaggaaaaauaaauuauuucaaaguccucgcaucaaaagaccacacaacagagacuccaacaacucaucagcagaacugaagaugacugaaauguuucuugguauuuuaggagucuauucuuuguacaggaagcuauccucugagugacaguuuaccuacauuacuacccucuauauuggcucuauauuucugccugugucacaaaaugucucaauaccauauauucuuacauaucuuuuaauagaaaauauuuuuuuacuuaguguaauggcagugaaaacaguaccaggucuccucucacacgugccuuuuaaucuuuacagcuuccuagugacuccucuguacacaccucugucccaauccgguuuguacacuaugccacaaugcuuuagucucuccugugaugucauauuaaaaguaaaaucaugaugugucccaucucccugcucaaucuggaaagagagagugugugugagcaagcgggggugggggggugggggguggguuggggagugaauugcugaccuggcaguuuuuccucuguaaaauacuuuuccacagaucacucgaugcucuacucccuauucagaacagugaugcuaagcuagaguccaaacacgugacuugauauaugaauauguugauaauacuuuuaacuguuuuuaacaugauaggucaauuauaagacugacacuaauacagagaccuugugaguguuaacacagcagcaggaauagcaugcacaccagaguuuaucuugagcuacagauaggggcuaugagaaggaaauaaagagguggugguguccagagguguggagagucuugccugcucaguacaguuccuagggaaguccauuuccugauccacuugguuuggcuuguccucguggguaccagauuuguucuggaaccccuugcgggugagcaucuccuuuauagaugcugcccacaucagcaucacagcagcggcagagcugggcaacucccaggucagaagaaagaauguucacaccacagagguccggugaccaacaaaaguuugcgacagaagagucgugcauccuucaccagaggaaggcucaagcuggaguguaggauguggccagggaaagacuggcuuuuccacaugguggagucgucaaucccagaugacagugcaucuccugaaaaaucuugucgaguuucugggaguggaguuuuccaacaucuucugugucccauccacaaaguggauuuagagacacaaguguagccugggguggaucugggacaguugacaaagcuucacuugugguccucauuugugacagggacacuguuggcccuaagagacacauuugcugcugacugggacaccgggcagagugugagugagcucaacagaaguggcgguggcgcaacccagggguaggagugcucaaggcugagcugcauccugccccaugaguucacugcuugucggagucacucagguucacugacaugcaccggcaaugcuucaccuucuggauuuucuugauucggaaaggugggucgagacccgggcauucgagcucuacgaugacagaggugacacgcuggggcuugcagaaagcgcaggauuggaaggaguccuccuccuucuucacgugucgcgggauguagaaggaguugcacuggccguagcagaagcgguugaggauggugcggcugcggcaacccuccucgcucacugucugccgcagaggcugcgucuugcaccagucacucuugagguacuugcgcucggugacuaccagggccuccuggcuggaggccagcaccuccuugaucuggugaugccaccucucugaguuguugcugcuaccauccuuguaaggcgaggggauggcgcccgcaggccgguucuuccguguuucagcuaccuuuaccagcacagccaccaggagcaaggucagcgagagcuuccagaacauccugcaacgaaagaagagcugaucagggaggguuaucuggugacuauccaucguuuucacuuaguguuuauggcuggauacccagaaauuaaagaguauaacagaaggcagccgugaccacacugcacagugcccuauaaccagaauguuuuacaguaauacgagaaagccgugcuguguuuugaaugggcagugucccucauagcucaugcuguuuaaauauuuaggucucagcuggugagucacugggguagauggugcuacuuccggucuguugaagagccccaccuguauuccugccaccauaccuuucuugaagagucagacuguaucccuuuacacuguaagccaaaauaaacccucucuuaagacauagcuaagucaaguauuuugucaacaacaacaacaacaacaacaacaacaacaacaacaaaaaggaucguuguuacagcaguaaguugaacaauuucagagaaaaaaaaagccaguaguguugauguagcccaaagccaagauagcuuaguaacaacaauagcaugcaggauguagccagcaggugugcacuguguagguuaauaauggcuuaauugcuugacauuucagucuugccauagcuuaucugagucucaaaguccuucaucucagauuuccuucuccaaacucuaaucucaugcugccauuuaguauuagaauagcuucaauuuauugguucuuaagauauaucaaaagguuuuccauuuccuuucauacguaaauguaauuaauaguuggaguugcauagaccggguauaacugucuucccaacuucacagacaaggacacaggcuuggaaaggcuaugccacuugccagaaaucacaaagccuguauaugaaguauuugaauccuggcguaccggcucuguuauacugauuuccaugaauguagcuagcucuuucuuaaaaaguuauguugacaugccuaugguaaaucacaauguaugucacucuuaguagucuaggucuaagugacaauuggcaauguaccucaucucaaagaugaugaucuccuguccucaacuacauguggagaacuggagcuagagucaacacuaucagagguuuugcuaacaccagcauuuucauguuacaguugagcugucaaacauccuccagacuccaugugagucccccaaaccccgcugaguuugcauguggaggacacauucagagguagaaccugguaggaagacuguggguuugugcuugaaagagacugaagggugagcaucccuacucuuuuuuggggggugaggugggggagggcugacaugcagugggcagcuuucucugcugcacaguccuaccuuaauccgacacuucuccauggacccguuuugaaggacuaaaaccuucaaaacugugagccaaaauaaaccauucauacuuuucaguuucucagcuuugcuucaguaaaagaaaacugcuaccaguggguguuaggguaugaggaaaaugcacggauuaugcuugggaaaggaacagaaauaguccggguaauuucaagucuagggcagacgaguccccaguaggcuaaggagauggcucaaggguuaaggugcuucaugagaaagcuugaagaucuguguuuccauccccagcaaccauguaaagaaaugccuggcaugaaggcacacaccugugauuccaggcuggucaggagcaagaagaggauucagggcucacuucacgggccagccaaucuagccaaccccagagcccuggguucaucgagauccauucucaaaaaauaaggaaggggagaaaaauccaaaaagaauuugucucaggcuacuuuuagacaauguagacacuacugaccaacaggaagaaccacuagagagcugagaaagaaaggacuugauuuuuccugucacuauaaaaacauuuguccaccacaauuauuaaauuuuacguccaaguuucuugggcuuuucucacgcuuccucgguuccacacaugaagugucauaugauaauggccacacauccaccagacccauggcaagagcugagacuuggacucguucggcuuauugagucuguggagugauuugggaucucagucgccucuugaaaggagagucuuuugguucuacuuuaauaauuuccaaaaauuauuaacacucuaaguaaacaaaaccaagcguuuucaagucucagccagcaaagauuuauggucagccuaguccucagcucugagcuccaacaacagccugucaugaacucuugguucagcucaaacuucaggcuucuccuucagcagcuccucacugcugucagggagaagggagcuaaaacaugcucagaucgauuuuggggccgaaacucuucgugugaacaguauucgaaguggugauuaguaacaggcguucuuugaacgguuuaaaauggcaugugaacaucuggcauccaugccuggaagcguggucucccaggaacugaggaaguagaacaaacuuccaacuuuuaggaaagggaaagauacugaugaaaucuacauaacuggggacaagucuggcucuccuccccagcccaacucucuuacacacauaacuuauucccaugugguaauaggaaacuggcugaggacauggcaucucaguuccacaacagguaagccaguuacucaccuguuuugcuacaaugacuguuggggagguguucuuauaacuuuggggacaguuaagcuagcuacugcuauuggcaccuacucuacuggcccuugcucuuauaagggucauaagaggauagaaggugcauaccuguucuucaguuugucauccaucccacauaccccagugggcugacugggaccugaguuuagcauuucagugcuguccugaaccucuuagcuauucagagaaguggcuggcauauaaccaccucucaggaaugcuguuccgacugccagcaacgacagcacggggauacuucauuuuauccucacaucuuguguuuggcuuguaucagaagaaacucauaaauaacuccuguugguuuuauuaaccauccuucuggcccgacaacauugucaaugugcaaagugugccaggacuauaaaugcugauggccuaagcagacuagguuggccagaguugauuguauaaagagagaguugguuguggaaguauuuccccuaagugaacgcccuugggccugaccucugaagccagaguggccuaccaccuaggcagccaaauaauaaguugcuaucacuucuucacagaacagucaagacuaaagagaagcuucuaucacagcacacuucugauuucuagaaaaggcauggaagugcugagugcuuaggcaucugcagaugugcaaaagccaaagaugcagugaagcuggggaccucacccucagagugaccuuaauggauuuuagacaucagggcaaggcuguacuggacucuguugguaggaguagagaauagaauggggacagagcagauucgauaaccuaagaauuccagaccaccagaggauggaagaaagcaaaugagauaaacuucucaucuauccaaugaggcagaaucuaagcaacaacaacaacaaaaaaaaugcaaaugcaaccccccagccuuuuuaauguucagggauuauuguuggugggucuucuccagccacagcuaagggcccuucaucucucguuuugaaucuuauaccaagaagguaauguuaugcuccuuaucuaacucucuagagacacaggaauuccuugaucucacagaucacagaugggguagcuugcuauugaaacgaggccccccuggcagccuuaaacugaggcaaacuguggcccaugggggccacaccaaaucugagguucuguuuuguaaauaagcuugugccacacucucuuuuaccuguugccuggggcugccuuugugcuguaagggcagaaugcguagugaagucagugacuaugaugcacacaaagucaaaaaauauauuuuuggggcuggagagauggcucagcgaguuaagagcacugacugcucuuccggagguuuugaguucaagucccagcaaucacaugguggcucacaaccaucuguaaugaaaucggaugcccucuucuggagugucugaagacagcuacaguguacuuacauauaauaaauaaauaaauaaauaaauaaauaaauaaauaaauaaauaaauagauagauaaauaaauaaaugaaugaaugaaugaaugaaugaaugaaugaaugaaugaaugaauauuuucuuguggccuuuuacagaaaagcucagacaagucuugccccaaagcccgccugucuaacuuaguuguugcuuuuuuuaggguucaguucuucagccuucaaaauuucuaacuguucaauguuucaaacagggaggcacagaaaacagaauaaauccuaugugccugucaccaagauguaaacaauauugacacuucucaucuuuauuuuacaagucucaauuuugaaaaacauaauaugaguauguagagaggcuauaugacaguucccuccccaacucuuucuggauguccuuauugggacuaccagcauucugucucuggucugcaucauaccauccacugcuuauguuucugcucauguucuaugcaugagcauuguuugaggguguguaauaauuuuuuacauaaauaauaccccccucuacuuucuguuucagaaauauaugcuugagacuuuacacccuuggguaccugcagacaucaguucauccuucugcugacuauuaaaaugacugaucuccuccauucaucuuacugagggugcuucugcuugucuacugcagucaagguugcuacacugaacacuuuuaauaucuguuuaucuaugccugccaguugcagguuuuuauuauuuauuuguuuguuuguuuguuuguuuguuuauuauuguuguuauuacaggagauauggagaagugcaaaacgcugggucacaggcugugcucagauucagcugggcuagguuuggcggguugcuuuccaaaugcugacaccagcauucuuuccccagaguaggaugugggucccugcagcugcucauacuugccagcacuugauauuagcacacauuauuuuugccuaucugaaaaaaaaacccacgugaaaggacaucuuaugauuaauuugcaugucucugauuagaaggucacaucgaguucaggcccaguuguccucugacuacaaagugaagucugguugcagcucacuggaagacagagaaguuaguuggaauauugggugaggugaacucagaaguccugacugcaagucucugaagugucacgaauagacucugaaguggcuagcaaccucaaaucagaaauaucaaggccucccaugugauuuaggagcuugaaaucuaaacggauuaauuuacauuuccacuuuacugaccugucugagucaaacuguucaucauuucaucauuugggcugauguccaaggaggcugaccacagcagauacuguacagcccagugucguccccacauugccagaaugguacuauuuuuucguagaugaaaaaacacccgccaugagaaauuacuacugcagauuguguguguguuucuguguaucuguguaccugugugucuaucugucugucuuucugucugucuuugucuguguguguguuguuaugcaaagaucugauaccuguuccaauagcauaaacugucaacuugacgaagcauagaaucuuuugaaaagagagucuucacugacuaaucuuuaucagguuaccucacgagccugccagauuugguuacugucugcucugugcuugauacuugcaagugcaagagcaauuugauguuguugauguuuguuuuccuaaacagguuuucucuauguaaucccaacaguccuagaacucacuauguagaccaggcuggccuuaaacccagaguuccaucuaccucugccucccgagaguaaucuucaguuuugaaaucagauuaguuuaugggaauuugagcuuaucuucucacacauuuaauacacugacgucacucuuccacaccucacuuacacauaauccuuagagccagguccuugauaaugguccugaugcuagucgcuucacuggccugccugcuuccaguuccagauugagcucucauacacaaaauuucuaaucagacacugacuagaauguuccuuuaaaauucacccuuuaaaaguuuuccaucacaaauucaaccucuuuggcaguuagcaaagaccuucaaggaucuuugucccuuucuugucugaccccauggcaucuauucaccaucuacucuauaugugaaacuuguaaaacuacauguucaacccuaugugagggugcuugcaacuucuauaugucaagaaagccauuuuucuuuauuauuauuuauuauuauuuauaugccuuauguaguuucuagggucacuguuagucacugguuauuauuugaauaugaguuucauugugaaaucauucauguuuucuacagcaucuuuauuuccuguguucuucauauuuuaaauaauugcucaguuacagccaaccgacacaauauaaccacuguaugcacauuuucuccccuauuugaauguaaauaauuggaagacaaggguuuuuaaucuuuguuuccacagucauuuaugauagcuauggagaaugauguagaauauuuauuuaugugugaugaaagagugggugagagaauggauuuuaccgguauucuauaaauguaguuuccuauuggcuuuuagagacagguucuccugcagcucaggcugaccgcagaucagcaguauucauucacaaagcauacauacuaaacacaucucacaggagauaacucugcagagguaugucacugaaagguauaagucucuguuuaauaacuaauugcuaaauucauaccauggucauacuauuugaucaaaaauacuguuagucacaaaaaugcuugacucacaggaaauuuuaaauauuucauguuuuguggccacugacuaaaaaguaaaucuuagaugcuuaguuucuuucauugaaaagacaaagagaaugaaagcaaaggauuuacaaguauaaaaccuaccaggaccgcuagcgugaaaaauguacuuaaggagaaaaagacauuauauaaaauuuucauuaaaggaauauuuuauuuguacuucaaauacauguaauaauaugcaugagauauguaugauauuuagagcccucuaggaagguuaugaggggggauuuugguuugaaacacacaaccuuugauauucuuuaaaugauacucacugcaaauuuuagaugaccacugaaaaaagccacagguuauauuuagaaauaaccauguuggagaggcagacauuagugcaggcagagaagucuauuauuaccuugcauaaauaugacuaguguggcuauaaugcugggcaaggagaguaagucacccuccaucucuuuggcucauaaaaauuuuaugugcguauaugaagguuaggaaagcgcucaagcuccgcuccucucugauucauucacucguguccucaagcugugcaaccucucuuuuccugacagucuuucaaaaauacuuaguuggcuaaucggccugaagagacuggaaaacccuguauuaaguaaucuaauugaaacaagaagucugguuugguugguguugcuucucaggcacucggccuccuucaaguuagcugcuauugacaacugaugcugaauucagacaaauuggagggcaaauccaaggcucuggaccaaagaaaacaaacauaaucagagacaaccaggagacuugaaacaugccaauggagauggagcuauggaaaaacugaagaaaaaaaguguugaaaacauauuaaaaaugaauaccaagaggaaaaucacucuccacuuacaggcccucaauagggggcacuucuguuaaagcugugugcuaacucauccacugguucgucauucguacccuguguaccucuauaaggcuugauacaugaaggggguuauugguauccuagagcaagaaaaggguuccuguaaccaugagaguaggagaauauauaauuaugugauugaguuuuugaagagagccaugaaaucaagcuuucuagacugaaucaagggccuaugggaagagaaaggaaggauuuuuuuuuuaauguaguuguguuuuaauagacccaagaauaaggacaauggaaaaaaaaaacuagguuauuugggucagucaauuggauguugugagaggagcugacuaaccucggagaucagaaaagagcaguugcauggggacaggaugucuauaugcacuaggaaagaaaaugccaacagagauggauuguaggacgccaagcuauaguugugucuggcugugugagagcaggaagauggcuugucuguaaagcacaguagagcugguaucuuacccagagccugugggugcaacucugggacaaacaagcuuuccagcacaguacagaaaggaaacccaugagggugaccuugcaaaaucauaaagaacaaaggcugccagaaguuagcggagacaacaucuggaaagccuucccucaauggcgagcccaggaagcuccaguggacaguucugaacccauggccccagagaaggcucugguuaaauccaguggguccuaaaacagaucagaggcaugaaggugaaaaagagguguuuagggaaguguggcagggggugacaugaguaaggaggagcugagcaauggggucagagucguauagaaugcauuauaugagugcaugaaauugucaacgagcaaaucuaauuaaugagaacuaaauucuuccugguuggauggauuuagguccagguugauggauggguuccagagaaggcagauguggucaggagcaagauugcaacagggguggaacaaaccaagggggaaaugcauagcuuuccaauacuccugauaucccuucagacauuuaagagacugagucaguagguuguugggaaggcuaaaagguggucuucuuucuuuugaugcuauggauucaguccagggccaugggcaugcuacauuccaucacuuagccacacucccagcccucuuuccugaagccaaguuacugaguuauaguucacacagcauacuccucacccauuuauaggacaccaccuccagccccaggcaaccaguuguccacuuucugucucuauauacuugccaauucuagacauauaaaacuacuuauaaaacucccauuguucagcuccaggaagauaucuuagugaauccaaugugugcugcauuacauggaaaauacggcucccaucgcuagcacccauauuaaaggcugugcaucgugacacacgcuuucauagaaauuccugcacugggaaggaagagacagucagaucccuagggcuuuccgaccagcagacaaagccuaguuggugagcuccaauaauagacucaugucucaaaaaccaaaguggagggcuccugagaaaugacacuccaaacugacuucugccuuccacaugcacacacaucuacucacaccuguggaaauguauaugcucacacauaagaacaugcacacauuccugcauauaaaauacauacacguucuuuuaccuuucccuuuucuuucauuuuauaggcucuaagccauaaugaaagaaauuaggcugagucacauugaagcaauggacaaaaugaaucaaaucugaagcuggucuaugccuuucacugaugcucauucuacuuuuucugagaauucuuugguuucccuaguggucaaccuucucccaguaaaccugacuuacuauuuucucuaguagaaaaacuucaucagaguagaaaccaugucuaccauaucccuagaauguagcacaugucucaccacauaaaagaugaacaaugaauacuuguugagcaaaugaauggagaucaauauuucugagaaauuacagauguugcauuugcuaguauucauacauccagacuauaagugauauccgagaagggaaaagucugggagauuaaagccaucauucuuuugcuuuuuauuugggaaauaaagcaaauuuaaguguaccauucaugcagcaaauauuuacugaaugcacaugugcucaugaggcuugguguccauucugcauuuuauaacucuguuuagaucuuugcuuagaucagccuaauuauaaauaauguaaauaaaauggacuuccacugaacuuuugaaguauucgcagagaauguuucuuguuaacaucaaacagacccacuucuaccuuaagccaagcuuaucaaauuauuuucuaacauacuguuuccaagcaauauuggcacgucuuucucaagaacaaaugucacaauauuuguuauugguaugcaaugcaaauucaauaaagagucuuguguugauuacaugucgcuaugaaccaguuauaccugaggacuugcuagaaaugcagcucaugugugcauacagugggaugggaggaauggugacaaccaugaccugaaucagaaccugagaacugggauuuuuaauaugcacccuuacgucaaaucccagucaagaguauuuaccuaaacaguaauuaucuugguucugguccacuggcaaguguaaacuucauuaauuaugucuucauuaauaaagaucaaaaacaaaagagcagacaugcagagcaagcaggggcaacauuaguggaaacugagaucuaaccgcucuucaaacaguuugccuguguuuaaagcaacgaacaucuguagugaauggugguggagggaugugagagagaccagcgcucucacauaggaucccuuuccugugaagccugagugccaugauguccaggagaguuccaagaaaagcagucacaacccaagaaucugguuuacugucugccauuuucccuuacgcaaagccuuuuccaggaaccagcucauuugaugcugaaugcccccaacugccucuccuuuucuccacuuuuucuugauguuuaggucuuuuucagacuagauacacucugaaaauaugaaagccaaagaagaaagaggcagauggcucuguggccaaaguuuggaucugcagcauccuaaugaaaugucaauagguauaauggcuugucuguaauccuaguacuugggaagcagagacaggaacaugagacaaguuggcuugcuugaauagccuaauauccaagauaugguaucaagaaauguugccucagcgaauauaguagaauggccaaagaagagaccaaauaucagucucuagcuggaacacaagcaaacucacaugcaugcacaucugaauagucaugaguccacacauaugcuauuauguauucaaacacacaucacacacacacacacacacacagacacacacacaccucucaccucauacaauuugaguacaaagaucuaccaccaugaucucugaaaucacaguuaagguacuccagagaaaaguaauagccagugaccagauaggucauaggaaaguauuccuacccaauacguauucaacaaacacaaagaagcaacaacucuacagcuauuuaaacugcuaauggaaugcagaaaacagggagacaaaaggcagugacaguugucagggucuagaggugacagaaugaaaaacaaguauucaguucaggcuuucccucugagguaauauuaauuuuaauuagauagggcucaugacuucaaaacauugcaaaggugcuaaaggccauggaguagugaacuugaaggucaaugguuucucuauauuauauguauuuaucuagagauggcucucccugugcugcucaagcugccuugaguuccaggguucagggccucagccucccaagcagcugaagaugaauaugcaaaagcacacaacuagggagaguggcuaauguuauguuauaugaauuucauuucaauuuaaaagcauaauuaguagaggaaugaacuaaaugggaauuucaaacaagugcucuaaaaugaccugaguaaaaaacuucccuugugguuaaaagucaaaaucaauaauuaguauuaugucaaugagcaagacagugcaugguuugcuucagagcacuaagcuuuguaucucugagaagauguggaugugaaagguuuugggaggaaaguguuucuguacaugguccaaguucacuugcuuaauuauuuaaaaacuuauuuuuuacaucauuauauuuugguuacaagaccccaaauccaaacacaaguauggacagcuuuuaaggaauauaucuaugucuaugucuaugucuaugucuaugucuaugucuaugucuaugucuaugucuaugucuaugucuaugucuaugucuaugucuaugucuaugucuaugucuaugucuaugucuaugucuaugucuauauagagauguauaucaucucuaccauaaguacauucaaaguauuuaauuguuggucuaauuuggcuguuucuaacuucuagauaguaauacuauccugauacuggggcccuuucccaaauuuuacaauugcuuuuuaaucuugaugcagaguuucuuaaauuauggugaugaaaaaugcaaaucuuguacccucccuccuauccccaacaucccucaaauaugcagaauaagaaacuguagagauggggguuugaagccuagcacucuguauuggaacaagccuuccaaagcuuauaggaaaggacuugacuuauaaacaugcuaauaauuaaaugaaauuucuaaaaaaacuucuugauaauugcaguucauucagaugccacaaaauugugaacuuuuaaaaacacauaaugcagcacucuggaucucuauauuuuaaucacuguacauaaggggauaucuuaagaauaauuuuguauaagauuucaugaaaaacccaccuucauagcucaacuuucugauggagauuuguuauaucuuucccuuguuguccuaucaaaagccauuggugauauuauuggcuggaauaagaucuguuucuggggguccccuuuuaaaagaaacuuccaacuuucaucuacuccuuaucucaacagacauuuacuaugaaaugacugggugccaggcacugugguaggcacuguaaauaauguaaauauguuuaagauaguaaauaauguuccacuuuccuuagaaguuacacuuuagugaugacguacaauuaauaucuggaguuuaguggcuaagcagagugauagagaggcacagacaggccaggaauguagcuccgagguucacugcuuacucaacauucacaaagcccugcauugaccucuagcucugcaaagacaacuaaagaugaauuuuuagggcugaagacgauggccuaugcuuguuaucccaauguuggauugggguucaaagccagcuggcgcuucauaauagaauccaggccagucugggcuguacaaugagaaaggaagggagagagggaaggggaaagagagaugguauagacuaaagaauggauggcuuugcggacugugagaaaguggagaacaaguggaguuuuuuuguuuguguuuagugagaagcacaacaccggauuuaaagugacaaaguucccaguuccaauucaaugccuagagaaccaagaacucaaguacucuguagagauacaagagcacacaaggcaauugguauaaucuagaugacaaagcaguggcuuuggggacuugggugauagugauggagaagagaaggaaauggcuguaagauacauuucaaggacaggaaaacagggcagagcagcaugcuuauagauucuggagauaaaagaacugagaauuucccccucccccaggaucagcgagucauguugagaaggaaucagagaaaaaaagaccgcaaaggaauagccagagguaagucaugcaaaacuggagaaacugugccauguagaccaagacacgaggagggggauucagccauucacaaaucuauugaaaucaaacaggcagagaaacauaaaugccacuauugaucuggcaggagagggaucacagucaaccuucagaagagcagaagagcagcagcagaagaaagcugcauccagcagaucugauaagaagcuaucaagcaacacucaaagaaagcaguuuagaacugcuguuggauaugugcauggagcugaggcagugcuuggcacaaggagaggacguacuaugaggauaugaaagaucuauggguaauuucagcucugguuaggcaccuauaucucuucucaagcauaccacaaaugaucccugugggucccauaccuuacaauguucacgccuuuaaaugucuaaucaacugaggaauguccucuacucuuaccuuugguuaucuauuaaauguuucucaucacauggucauauuagcccaguuucuuuucacuagacaauccuucuagauaguacaaaauaguauuggcuugucaccuaccaugaguuggcucauaucucagaagcacuuugauuaucuuggagggucuaucaccaacccucuugauauuuucccucauuugcucauuuccuuucucucucugggagggcacuuuggagauuacaugagguugggauauaugaguuaaacaacacaaacucuuaacacaaguaccagcauuuaaaguaaaagggacuggggucauugcaaaagauuguaaacguugggacuaacaaauuugguuuuguggguuuucuuccugaggcuguguuccagagagggcaauaaaggguaaaacucauuagagcaucauuaucuuuugucuaaaggaaacaaugugugguuucuggguagcccacuugguguuugcauuggcccuggaagccuuucaaaccaacuauauuguuugaacaauucccgucuugaacaugaaaagaaccaccagcaaaccacagagcugaugcuaaauuacuaggugaugacuccuuuggcuccuaaagguuucuagaucucagucauugaaauuauggaucuuccuucuaaaaagaaugaucaucggugccucuggggagaccucccaugcagucuucucuccacuacuauguucugggacuucugagaaguuugguuuagaaucauagucacuggauucucuccaacaccuauuugugcuuguguguguguguguguguguguguguguguguguguguguguguguaugguguggacauguacacaugguccaguauggaggccacaggucaucacauggugucuuucucaaucccucucuaccauauuuuugacacaaggucucccacuaggccuggagcucacuauuuuggcuaagcugacacuuagaaagacaggugucacugcacauggcuuguugugugaacaauggggacuccaaguuuuauccuuaaguugcaagcauccuguaccaucugagcuaucuccccagucccucagacccugauugagaaauuucaguucuuuggaaacugcaaauaauuuucagauagaauuuacaaacuuaaauuugagcaguggugugacuuaacuuuuuuuucuccugagggaaacacacucaguuccuguugauccagaggauauaaaauggcuguugagggcauacuccuauguugcuuaccucuuuuggaagcuuuaucgaacuuuguaauaaugagaccuugggaggaaaucauagacuauaucuauggcuuuauggaaaaaaaaacuucauuuauaaggacuucuacuaaugaaacaaucaguaucuuucuagaaaaauuccaucuaaucuucugauucuugcaauguaaucucuuguugggauuuuagcaacaaaaauaagagcugucuuuugguugauauugucccuuaauuaugauaaauuuguaagauuuuaaaauuagaaaaguauagauaacaaaaagacaucauauauaaacugagcuucaauucugaggccaaagugugauauugauucauugcugguauuauaaaugguacaauaugcuccauccacauaacaaaucaaaagauggugguuggguagaguccaaggcuuugauguccuggguuccaacucuaucuaaaccaacacuuacuguaaaugaaaacuugauuagaauuuacauaucugcaccaugaauuucuguccuccaaacugugaaaaaaaugcagaaccugugaauacaguuguaaggaucacacauacacagaaacauauacauagaaugcacauaugcauacauauacauauauggacauacacacacuguagggguuugaauaauaauggcaccaauggguucauauauuuuaguguuuagucgucagcaaauggcacuauuugaaagaguuauagggauuugcaaguguggccuuuauagaagaagugugucacuugggguagcuuuuagacuucaaaagcucaggggacucagacucugucuuucucagucuaucucucucugucucugucugucugucugucugucugucugucucuaaacaugggaaaaaggauguagcucucagcuaccacucuagcuguauucaugacaccauggucccugccaugaugauaauggaauaugccucugaaacuguaaguaagcccccauuuuaauacuuucuuucacuauguucaccaugaauuuuuuucuuuucagcaauagaacaacgaguaaagcacaaauguacacaaacauacacacauauauacaaagaaacacauuuaaacauacacaaaaaacacacaugcauauacacagacaaagaaaccaacacacacacacacacacacacacacacacacacacacacacacacacacacacacacacacagaaucuagaaucagggaauuucucuucucaguaaguaguugucuaguuguuacaugaacuacuuuccauuucccagacauaaauacuaaggguuccaccauuaaauuuuagaguuaggauucaaacuacgauuuucucugacaaaaaauuuucuacuuuuucuagauuugucagugacuuuccugaaccugaacaguauaccuuuccaauagccucauucuaagugucaaaagaacaccauaacuucgcaucuaaaaaucaaauuaagccucacuucuuuuguacucucugggacccauaaagugcaugucugaugugcuugcaagcuuugugguacaaacagagaacaaacuggauuucucaccccucuguacagcuauugcaguggucacacagagaugaacauagcacagguuuuacuacagauaaaauuuaagagauuacauagcauagcuuuuuaaggaaacaagcaacauuaggugucuccccuaaucagcgcccccauauucuuuagugaaacaguaacucucagugaaccuagaccccuucaguaugguagagcucuuuggguagugagccccagacauucuugaacuuccacaaggcuugaacuccagguaagaguuucaguuucugacaauuguaccugagugcaagggacccaaaggccccacauugcuccucaaucuuguacauucauuuuuacaagugagccuuggcccuugguggccuucuaacucuucacaaugcagagucugagguucagcuacaaugagaccaauaaccaccuugaccuuggcuauguuugcacagcaggguuagagccgaaugacauguuagcacccugcaaggggaacucugcuuacugauauguugcuguaaggagcaggcaucacacgcaugugacucuguguguucuuucuuccauuaagguucuagaaggcaugauuuucagagcuguagcuuuuuaaugauauauguuuuuuauuucucugccucugucucucugucucugucucucugucucucugucucucugucucucugucucucugucucugucucugucucugucucugucucugucucucucucucucucucugguuuucuguuccucguuuaaaaauaauauuuuauuuuacugagcaaaagaaguucuuugguuggggagggaauuaguuuaaccgagcacucacaaucuggcucccuuugaauaucuggaaugacaggguaaguuucucugucagaacaagcucuaaggcugcagugcuuaaaaggauuuugcuuuugacccaaucugguccauucugauccucuuuuuucaucuccuugcugcuugaaacuacaaaagcuuugaccauuccuggaguuggcuugugagugaaaguggugacuuacaacugucuccccacgaagacaucgguauacucccucuaucaccugcuuuuugguuuuaauacaguuucacuaugaaccagaacagagcaaugcauaucccaaaggauaaugaagucagaugucaauuaccuuuguuagaauauugucuauuugcugaggagcaccgccagaagacagcuccugcuguguugaaaguggucaguucuuucuacucuugaggggacugauccuuaagaucaaagaauuuuugcaucaaaagauaacaucacagaauucugcaucaaaaauagcaacaaauaaaaaaauaaaauugaauagaaaugcuaaaauaaagaggaaaagauugagaaagggaaaguaaauuuggaucaaggguccuugccaugcuauuaccacguacaauucuccagguuccuaucuugacccaaguagacuuaguucuggcacaugaaaggccccauuggcggcuuaucuuggauaaauagcuuuggccuauuggcaauugagaggugggggugagcauaacuuuuaugguaaauagaauuuuacugucuucuucuggcugcuaucuuguggcgacacuaagaggaagccaguccugacaauuuacaacacauuuaugaaauaaauuuuagagaaaucuuuagaggucuuuauagaaagccacuacugucacucccuaucuaaaggcaccucuaugcuaucagugccuuuaauggaauguuugucuucacccaggagaaaacauugacguugacauuuucagacuuuaguguaauuuuucuaauauuuaccuuucuccaaagcuccuuugauccgacagaacccauuacaauugugugaccuacaacugucuccucucauuuggugaucauuuccaugagagaauaccucaccuaugguggagcaaucaguauagauauccuugagcuuuuccugggagcaagagccaggagcaaagaagcuaaagaaucaaaucaaagacuuuuuucuucacaaccuuugaagggcuuaagaaaaaaaaaaaaagcucaacaaaagcuaagagaaggagggggagaggggguggaagcagaaggaagggaggaggaaaaagagagagggaagaaaggagagagaagaggagaggaagaggcaauagugauguaguuugaaggaagcaaugcaugcaauuuaugauacagaauugaacaacuacaaaguggaaagcacagaaaggcuucuacccucuccuggcucauaagcccagccgcauagauaccauauaaucaguuucuggcaccauucgagaaucgcaauucucaccuuaagacucuagggauauuuuaggauuggauuacucuacgcuggagaugagauuucucuacuuauucuggguuguucagugguauccuugcuucuacucacucuaacaccaugucacauccaagaugugacaccaaaacuccuccuuugagggccacacugaaccauauacuaaaagaaaacuuuauaauagcacaaaugaaucauuuucugggcaugggcaacuaacuguacaaucaucuuuuauuaaguuuaugugaaaacuuacuuauccagaaacugacugauaguccuuuuuguuuguuuguuuguuguuugccgucaccuacaugguguaaugaaaaaaaucauacacauuucaggucauuucuauucauauagacuaguuucaccuuuaacauaaauuucuacaagagaaauggcuggaucaaagugugugagugcuugucauuuugauagguaguaauacuuggauuguugccaaacucaggugaaagacagcuuuucauuguucuuuugcuuuccauugcucuguggacagacuaagucgcuuuuuucuuuguuuaagaucuagcuuuauguuuccuuaugaaacaccccuuuauaauuaaguuuuuagaagucuuuggacauaccacguucuuuaaauauggcaugaauuucauuuuuuucuucuugucauugcaugugcacaugguguucauacacauguauauagguaggugcauguguguuuguagguagguauucauauuuaugugugugugcaugcaugccauggccacagacugaaacuauguauugucaucaccaaguccucucucacuuuaacuccgagcuugcuagguuggcuagcuucaguagccagcuuacccucgggauccuuguuucugucucuggaguacuaagauuacaggugggccauucuucaugccugacauuuauaugggcacuggggauauuaccucugguccucaugcuuacacagaaaacguuuaauccacugagucaucucuuuaaccuacacaucuuucugcuuguuuguuugcuauccuguaaauuauugaucuguugauuaacuuauguaacagaaggaauucagaaaaagaaaaaacauagguacauaugggaauguguaagaagaugggucuggcauuguauaucguaugaccaguaguagaaugcaucacaagucauuuguaaaauacagaguggcuaaaguaaugccaauauacuucacauagauccaaguuuuagcuaaaaauaaauagugucaaaagaaacauuacuuuaaucaccugcuuguggggaaaaggccuucccugcuaucacacacacacacacacacaaacacacacacacauaugcguuugcaccauacagaauugaaauuuguuuauuucuagaagauucuuccuuuguaccguugucccuccucacuaucucacuacucuuuguuguuuguuuguuuguucauuuguuguugagacagacuuucucuguauagccuuggcugucuuggaacucacuuuguagacuacgcuggccuugaacucccagagaucgaccugccccugccuccuacucacuacugaacuaauuucaaaccccaaauagaugugucagcaaagccucaggcaauucagcaggagucuccagugaccucaggauaugccauugaagcgaugggauucaccaacuagacuaagaauagcacagagggaugggccauaagcucugaggccagaagguccuuucuuacuucugugucaacugccagagacacucugaucucgauaccuucauaggauuaguccaagucccacuugccucugcuuucuugggaacuucacccacauugaaggcauaggcucggaaugacaggguucaucccuuacccucccuuuucccuuuaacauaauauucugguucaaacuucugcauacuucccaagcgcacaccugacaggaagugcugucaugauuauguacaucaaaauuguguucaaaucugucaauauugugaucuguggguucuggacauacuaggauauggagacccagcacaaaaucauaaacuugcuuaaaucuuuaugagauuuuuuuuuugcaguauuucuuguuacuugguuguacaguuccugagugugagcuuuguagggaacaaacaauauuguguuacaguuuuaaaaguuuagacauacuuggaauuuaacuguuacugauguuaacucuuuuuuuaaacaauguguuauaguuuugaucuuuaauguccaucaaagccuaugaguuaaagguuugauuuucaguguguagccuuguuggaauaugauagaacauucaggagcuggggcauagacugaggaaguuauggcauugggacuauguccuuaaaaagauauggggacccuaaccccuucucuuucucccuuccagucaccaugaaauacacagcuuucuucuaccacgcuuuucccgcuaugguggucugucucaucacaggcccaaagugauaggaucaagugaguguggacugagaaaucuggaacugugagccaaagcugaacccuuuuuucuuugaaguugcuuaugccaugcacuugcuauaguauugguaagcuaaugaaagguguguugugggggguuuauaguuuuuuuuuucucuuuggagucuuucuucuggagagagagcuacauaccccgaaaugguucuuaagauucaacugguucucagccugguaccagggaguaguuuuuucgaaagaagugauauggcaagggcuuugcuucuaaauccaauugcuuucacuuccuguuucuaccucagcuacuauccacugaauacaucacagauguguuagguuaggguuggauucucugagugagaagucucacugggcuaaauccaagguguucaacagagcugugucuucccaagggaacauauuuggucuugguccuuucacuccaaggcaagaacagugagaaaaccuucugcccaucaucucaucuuaauccucucucucucucucucucucucucucucucucucucucucucucucucucucucucucucucucucucucucucucccucucucucucucucuuccuuggauuugcucucacucuauaccuuagaccacccucaaauucuuaauccugcuauccugcuaccuuccaaaugcugagauuccagguaugcguuaccauauucagcucagaaugccuauuauuugauugccauacuuccuuuugaccacaaccccagaaauucccuuuccucaaaggacccaugaguucuuauuggacucaccuguauuaucuaaaacaaucuccaaacucaacgucuuuaagugagucauaccugcaaagucaauguggcuacuuuaggugacauaugcaggguauaggcaucuuuggaggggcacauuucaucuaccacacugcucuaacuugauucuggggccuaaaaggugaggcauuaauccugagauauuagaaguuguauuuuauaaaucaggucacaauagauauauuagaagcauaguuugggguucauuguuuugucaaaauuaaggccuuucuuacaaacagcacccgacuuuaaugugccaguuucugcagaaaucaaagcaacucaaucgccacucugccuuuaucucuaauccagcaggcauuuaaagccguguucucucuggcuugcuuggcugugcagucaagcgcuccaaagggcccucagcacagcugcugcuuuuggugccauggccaggaucugguuacaaccacuucuacucuaccuuggcccccucccaagaagaacuuugauuuaaauauucuguuacugcucuaccagguacucucugacuccugucugucuuugagacuccaaaucucugugcuuuguguggacuugccuucaguggcauugaauagaaagaugcacguuguucuuucaguacucaagaagaaaauugugcuccagggaagacucucaguguuugaacacaguaaggggaggagggaugaagaugcugccaguuaaaagugcauuucuaaacuacuucucugggcauauaaagggauggcuuagagugugcuggcuagagagaaaccugagccucugccauggggucagcuaucuuguuaccuuuuaacccgauuaguugauauuccgcuagcuaagcaauacuuacuaaaugcacucgacaggaugacacuagagcggugguugagaaauaaagagagauacgcagaaaaggaguuggugugcaggaaaaggacaagaaguccacuugagggagaggguacuucuuccauaucccucauggggacccacagccuguuggcuaguucuguucuaaauauguugcuuaauccuuacacuaaucuuagaaauacaaugugaaaugcccuccccaucgcauuuuaaaaucaauccguauguguguguguguguguguguguguguguguguguguguguguguguguaugagagagagagagaacagguguauacagauauguacagguaugauguuccaugguacaaauguggaaggccgagaacaaucuaacugacugccaugcuuuagcucccuccuuggugaggacaaaguaucuuguuuaccauuacauuaaccaagauagcuuucugggagcuucugggagaugcuacugucucugcuuuccaucucaccauuggaccaccagaauuacagauacgcucuacucuggccaguucuauguggguucuagggauccgcagaucuucuugucuguauaagcaagcacuuagagauccacuuccuuagcucaaaaugccacugcauguuauuagggucaaggaaguauaucuacaguaguucuaauaagaagcacaguuauuuuucuaucucaauauuuugaauuugaaagcauuuauaguacccucuauuagaaauaaugcuacaugaacacaacuagaacaauuguauaucauuaaaguagauuagucuuaauuuuagugucucugguuuugaaguacucuuaauguauacuccaguuaaacaccuuucccgcuccacacacgcuaaggauuaggauaaccaaaagagacguuuugauucucucuuucuauggaugguguaaaggguaucagagcuugauguauuucuaaaaggucugaggacaagaaggcacuggaagacacguauagcagcaggagugaagcauggaaggaauucaccgagacaaacuugcuuauuccacgucugugccagaaccagcaugggcuauccaugauccuuacuacccauacucucuagacaaacacuuugagucuuuaauugcaugguuacaagcauggccacuaggguauggagacaaaacucaaauucugaacugucaaaauucuacaucuuuaacuucaauauacacuauauaagauggaaggcauggcuguggcucagucauugggcuucuuaucuacccuccuacaggaauaugaaguuauagaaaguuauaagaauaagguagaugaucuuuugagugauguuuagagagaugaccccaaauugugguaaacugagcuuuuaagaaccauuucuaagugcuaagcaccuggcauuuaauguaucucuuacuagaaagcuuuucauucuuuuguuauauucaaggagacaaaaaauuuaugcaagauuggcuucuauugaaauguguacugaauaucagacuugacuaagaggaggagguuuuauuauuugcuucucaaauaaugagguuucucaugagaauuugaaauuccugggauugaguuuuacuaugugaacggcauaaacaagaggcucagcucuuuucuuuaaacuaguguauucuaauuuccaaaugagcaugguucucaccaaccagucacuuugugcuuaccugccuccaaucucuaauacuuuaggaacauuguugacuacaagaagaaagauuaauuggauagggacuggauauaugguuuuuuuuucccuauagaaaccugaaagccacacaccagcuauauucaauuaguuaauuaaaacaacuaaguaauuggcaccaaguguauaucgcggucuguuuagugaguggcugaaauaaaccuucacuugcaacuaugucucucuggccccugagcacagguucaaguguucuggcaagucacuucucacccuaccacagccuugccagagagaugaucaacaggcugccugcugagguuuuaugacugccuguagccuuagaacagcucuuucaauccaaguggagcuucagacucagcaccaagcuuugccaaagccacaucaaggagaaucauuuaaccugaauucuuuuccaucucuuucuccugcuucuucaugaaggggcucuugggauuuucauaaagggaguaguugaugaauuccuauguucagcagccaauguugcuauaagguaaaauacgacuagaacugcuagauucacuuuuccuuucgaucuagccauuucuaaggaugguaccccacuucauacccauggcuuucauucacuucauauguaaagguguuggagaggcagauuucuguaagacuuucaggugaggcugagaagauaaagaugggaauuuauggacaugagacuagugagucaagguaauucauccagagucuuaugcuggauucauuuaaaccacaggauagacgccaaaauacacacaaauaaacaaaauagucccuaugaugaagaagaugaugaugaugacgacgacaaugaugaugaugaugacgaccauuauuguuuugguaguagggauacaacucaggauuuugacauuuuaagcagguacuguagccauugaguucucuccucagcucgauuuauuucuuauaaaguuugcuaauuugaugauugccauuuccaucaacaguuuuuaugaaacuacagcgaaacacagacauuuggaaccacaaugaacacagaaaaauaaugaaucauuuaccaaaauaacaaauuuguucauuuuuccucuugugccucucacuccagaaccacucuauuagaaagcaacuuucagaggaguggccccuuugaucuguuaauaucucagauaaguagaaaaacaagcugauaaaauaaauauauaaauuacaugcuuauauaacagaaacggcacuuuuuuuggaaacacuacuagucccaaaauuccaggauuaucagaaaauuaugcaaauacaccucaagaaaacugcuagugguguguaugaguuauaugaacuugccuauacccucugacaugacgucauaggacuuuaaacugauuuccuuauuaugugggguggacccuugagcccucuuaaguaguuuuuucuagcuuucuuugcaucacugugggaugcucacaguuacugcugcugguguaagaacagucauuucauaagcagauccagagguggcccuaacagucaccauuucacuacuuuauaaaaaguuagcucaggacucaauaaauccuuaaaugcuaauuugcauuucuauguauuggaacaguacaccugguugguuauauauuaaaccaaguuucuaauuuuagaagccauugaucauugauaagcggaucaagcccaaagacuuuuaaggaaagaagauagaucaguacuccauauuacaugaauuccugauugcuggcucccaaaaagaugucugagaucaaauaaauuaagucaacccuuguuaaauagagcuauagagaguccuuuucuggaagacauaagugugacuaaugugauaugugagucucuaaaaaagaguuaugguguacaggauuuccuggauucucagacaauaggaaagaacaggauuuucaucaagggacuggcuagacaggaugauuuugaagacucuuuccugcucuaaauucugauauucuucaguucacaugaagaccaaguuauucugcagauauuuccuacacccuuagcuuucauaaaaagcuuuaaguuuucuuuaaauauauggcucuuuuuaaaagguggaauaaagggaucaaagggaucagauuuggcaccagggagaagaaaggaccuuaaaaccacuguacagaagggguauaugacucaaggagcacauugcucgauuccaaaugaucauucccaucauuaaccucccugacauagcacaaucucccaugaagugacucuuggaaaacaagaucagugguauaagagcaaugcaguggugauuaccaaaagguuuggagagucuuccuagaaucucuguguguagaaggcuccaggucaaauguuaugcuuuuguuuuuaagauuuaguguguggcuggguaguggugguacacgccuuuaauccuagaacuugggaagcagaggcaggcagauuucugaguucaaggccagcauggucuacagagugaguuccaggacagucaggaauacacagagaagcccuaucucaaaaaacaaaacaaaacaaaacaacaaaaaagauuuaguguguguguguguguguguguucaugcacaugugugcaccagugccuacaaaggcuagaagaugggaucagauucccuggagcuggaauuauaggcaguugugagccacuugguuugugugcuaagaaccgaacuuugguccucuauuaaaguaucaaaugcucucaucccucaaacacugagccagcucuccagcuccuaaaauuccagucuugcuguugcauucuuuucccuugcauacacagaacaaaaauuagcccuucuuccagucuggggaauuguucaccaucaaaugauccaauguuugagaacaauaguaaacaugaaugcacuaacucuugcuguuuuaagaaauuucagagcaaaaauagacaauucuaccaacucugaaauuaugacagacaucugggagcccaguuauuaagggcuuuguuguguuuuguuaagucuucaaucagauuuagugacaaauaacugggauaauugaacuucugaccaagaaacucauggaauuaaaaaaagagagagaaaucccucaaaccaagcaagauucauuuagaaacucuuuuuuggauucccauaagaggaagaaauauccucacucuuauaguguguuuucuuucucuuuuuggcacaaacugauaguuugaguuuguguucucauaacugucucuaccccguuuauggagauuucuuuucuuuauucuaacccugcugcuggacuuugaacaaauggauaauauaacuaaaaauugauuuucuuggaauaucacuuaguaggagaaagauaacauaguuaaaacuagacauaagaggugggauuagacaugaucagagcgacaugccagcccuagggaaugugucugccucaacuugggcuuuacggucacuguaauuuuaaucagauuugaauguaauaguauuucauaauuuuccacugagccuuuuucuccuuucuuuggaaaagaaaaaccucccaaacagacauuuaaaaaaagagaauaguauacuuggugugguuauguggcaaggauuagucugcacacacauggucucugcuuguuucccgacauagagucauaacuaugucuaugcuuuuccuuaaaauccacuugucacacucuuucuucaguacaagugacugaaaauggaagccauugggagguaguuuacucuggccuuagaucuuuaccaacuaacuuucaauaaacugugugacuguaucuugaacaauguagacgauacuuuccuaugaaaaugggaugggcuugaguuaaaugauuucaauugucauuucauuucuacagaucuguaagucugaaugaugauuuuacgaagugauccaaaguuauguaauuuauuuuuauuuuuauaauagaguaaugugacagaccaggggauggaggaagcagaauaugucuucacugaagacugcacuauaucaaaugcuauguauaauuugaucaauuggucuaugcaguaauugccccuggagucaucaucaucaucauaaucuuuaucacaaugguacauacuacauaguggaacuaagggagaaugcuaagggaagaucuauuguaggacagcuagugaaccgccaaggucagagacaaacccgggcucuuugucuucuuuaacuauguuuagaaccuguguaguuacugccuguaauauuucacucuaaagaccccuuuggguuccuuuauucucuucaagucauuuaacuuagaauuuguuuguauuuauguacuuaaucgguaacaauucauuacuguaguggauucuaucaucuauuaugguacagugaacauuaaaauauucauuauaucuagaaagaauuuugaguauuacagagaauuauacuauaaaacaauaaugauagugucacaucauuuucacugugaacuauuaagauaagaaugccuuggguguggagagggaauuugugaacagacauuaaguaaauaacaaucaguuuccaucagaacagcuagcugggcaaaggcuuggaaagggaaaaauucaucuacugcaauggaagaggccacuaauuuuaauguguauuuacaauacuauuauauauaauuacauauguacauauacauacacaauauacauaauuauauaugauuauauacauacauauucauauauauauauauauauauaauuauauguauacacacacuucgaggucagggcauuucauagucuaaaaauugagacaaagucuucauagcugaaggauaggguacaugacagacacaugaagaugaaaacagaaaacucaguguuuggaaagcccuugggggucucacucuaaagauacaacaccauccugaugaacuuaaggaguccuuuaaaacuuuuaaauauaaacuuuuuagcaguaaggagaugucacugaggcaggaaguagauggaguuuucuacaaauagaaaaaaaagaguccuauaguagaaucuauagaucuauacaaucaggucccucucaaaacuuauagaaaaagccaacaaggaaaaaugguuggauuugacagcuuugaggguacauaggaaggaaggaaaggaagugggcagaugaacagauacuggaaguaggagagaaggugaggaauugguuguguugugcccccaggcucucugauuguguaaugggacuacauuaguguauagacacauaagcuccaucaacuucaaugacuguaguuugcaugaaagugaacuuugaccuuauagaaguuguaaauaauaacaagaugaccaugcaacucauacauaauugaaugauaggaaagugaguguaagagcugggauuucaauucagccuuguuguguagacauucaaaacuagauguucuguuauuucugauauuuaaauauaacuuuucuuugaguuuuuaaagcaugaaaacauuguuucuuggccuuuuagcgaagaucaaguguuaguaaggcaugaaaauuuaaaaaaaagagugauuauaaaaugaagauauaaaaugagaaaagaaugucaccuuuggaaaaucacagaauaauaagcagcuaaagaauaaauacaacguuguccucagaggguuccacccagcagcugacucagacagauacagacacccacagccaaacagugaauggagcuuggggacucuuauggaagaauaggagaaaggauugugggccccaaggggauaggaacuccacagcaagaccaacaaagucaacuaaccuggacccauggaccucucagagucugaaccaccaaccagagaacauacacaggcuggaccuagaccuccccgaacauauguagcaggaguacagcuugaucuucauguggguccugaacaacuggaacaggggcugucucaaaagcuguugccuguaugugggauauguucuucuagcugggaugccuugucuggcuucagugggagaggaaacaccuagucucauagagacuugaaaugcugagauggagguggggauaccuagaggguccccacugacucaaaggagaaagggaggcagaaugggagaaggacugugggaggggguuaccaggagggggcagugaguaggguauaaaauaaauaaguaaagaauaagauacauuuuuuuauaauauaugcagaaggaagaaguauuuuuccaggggcuucuacauaaagagaacagagaaugcagcgggaacaaagaguaagaaaaugcugaagaaagugcucuccacaugcucacugucaccaagugaaucuggacacaguugaucugaaccuuuugccuuuuggaacaggcaagaagcaaggggucuuuuucagagcaaugucacuguagcaaaugucacaagagugaaaugaugacucaaaaagaugcaaggaauuagaaccucuuuguaggauguuuucagaaaauugacuagcaggggaagaaacaagauaaguuaucaacuucagugguuaccacgauggugacucauuggacauaauuuacuuuguucacauauuuccuugaacagagccuuauuugaguuuaguucuagagugaagggugaaaaacuuaccaagaaauggaagacuuaagagcauauaaucaguccucuagcaaggucuacugggaagcagaauagaugggaugagcaucuccugcauagauggaugugcucacauuggccaaagguuaauuugucuuugaccacagagagaauguucugggauggagguguguguuuauaaauugucaugacaacggguaaguagcugaugcucugagcaauuggacuucucagucugggcacauuggcuuauuguuuccuugggugaaagaauaugacaugucgaaaauaugggagacugagaaaauguugccuauggccucagaucuggaagccaucugugugucuguaccugaggacaagacuucucagauaucagaagagguuuagcaggaaagaacacugagcuugaacaaaaccgauaucuagacuaagcaaggauaagaaucuuucaaggagaugaagauauuuagaaggaaugccaaggggggagauggcuccuuggauaaagugcuugcugugcaggcaauaaccaaaaggaugaaccaauaaucaaaggauggagucagcagugucuauaauaccagcuaagauggcauuauaucaccacuacauguacauucaugaacuaguacacacccauacacucauauacacacaugccuaacacacacacacacacacacacacacacacacacacacacacacacacacacgagcauacacccaugcaagcacccaucuauggacacauagacacauucacucauaacagugaaagauaaacaacggacugaguucacagcagauugagaagucaaaucccacccaccagucaggagccaccaucacagcaguuuuaguuacaccacgggagaagugggagaggaaaaagacacggauauuuuuccugauaaaucagaucaggccucugagguuucagucuucuucauaagcucccucuuucauuccuuccauccuucugcuauuuacauuuuacaguguaaaucugaaacuaccugaauauauguaaauaacugauuuaaaggaaaguauaaaagaauuuuaaaaaggaagaaacagugaaaguuaggggagcgugaaacagaagaaauaaagagcaaguuggacaagacuagcuauguuuuuuuuuucccccugagauggaaaauaaggagaaaaugaugguaggaaacacuguggggcugagcgaguuugugucugggcagacacucugcccucuaaaggcaucucaugagaaagcacagagggaaaacgauccaccagugcaagggaugggacuauaagaugcuugguugacuuaggaaauaacccugguggaagaggggguaggaugaggaugaaauaaaugaauugaccuugaagcauccuacccugcuucaaggaaaugcccacggagccucagccuuuucugcagagccguugacuguucguuguugcugcagagucaaaugucauuuugaacacuguagcuacugggaaacuaguugggcagaagggguuccgagagaagggaagguagguaacagaagacaauaggggugaauauaaucacaacacaagcuauauauacaggaaacuaccaaaacacaaaacaaauacaagccaucagagggagugcaacagguccugcaggcacagaaggauuauuucuuccuuaugaaauggaaaguaaucacauaagucccacaagaugcccaucacucuugcaacguuuauggcgguuacaagguacuccugagauugaacucugaaauggcuuucuauaaaggacagaacuugcucuauuaaacccaaagaaucccuaagccucaauucuaugccuauuaagaucuagcauagauuaaaaagggaggguacuaacagaauuucagaaccagacauguuugaaggaggacaaauagccuugccucagaggccauguuagagcuaaaccaugugcacugagcccuuccccucucuaucaggcuccagcuauucugucuugauuuaccacugucugaugcauccuagcuugguuaaaaccaaacauguugggcugcggaaaugaaucaguugguaaaguguuuacugcacaguuauaauugcuuguguuugauccaccaaaaaccccaaaacauaaauaauaagugaaauaguuuuaaauggucauaucaacaaaugccuaucaucucagcauuggguaggcagagacaggaggaucccuaaggcuagcuggccagucaggcuaauguaaauggugaccucugggcucugugagaaagccaauuuuuaaaacagaaaauagugauguugagaaugacugaaaaauucacccaauaucuaccucuggccuccacauuuaccccauaaauacacuggcauacacacgaacagugcaugcuucugagcaaagcuguuugcuuuggcuuacuugaggacuuccccucuuucucucucucucucucucucucucucucucucucucucucucucucucucucucucucucucucucucucucucaacacuuuggauuuuguuauccuucuccuguucugcuuccugagcuuguaggaaagucuugucucaaaguauuuaauggagaggggaggggaggggaggggaggggaggggaggggaggggaggggaggggaggggaggggaggggaggggaggagaggagaggagaggagaggagaggagaggagaggagaggagaggagaggagaggagaggagaggagaggagaggagaggagaggagaggagaggagaggagaggagaggagagaagagaagagaagagaagagaagagaagagaagagaagagaagagaagagaagagaagagaagagaagagaagagaagagaagagaagagaagagaagagaagagaagaaagaccucuacuuugagagaaaauccccacucucucuucagacacacccugcugcacaguguuaacuucuaugaucagauuuuaagacagccucugaucauccuuauuggguuccuuaaugauaaacguguggguuuauauauagcuuuaaaaauauaccugauugcuuuucaggaccgcgaaucugucuucagaauacacagaccugugguaagaauggaagaaggaaaaggauuguuugguuuccacugguaacuccaugcaaggcaggcagcuagagacggagggggaaucuuaagcugcaauguugcuguaaauuuuccaguaaucuggcccucugaauggcaaauacuggaaacccauguugccuuccugcuucacacugacagcaacacuuugccuacccacaucugagaccuuguggcuuuugauucauucugcuguggaugccuccccucuuguuuucucaaaauguaaauauuuguucugucugcauccuaauuguuacucuuggugucuuauugacuaugugggcugugguaauucaggggccucaggaucucuuguuaugugcuaggauuucaugucuuaugacauuagcguggcauagcugacagccacccuguucuuaugccccugacuaacuugcaguuaugucuauaauugaaacccacuauuauuugauuccccacuacagaaaggaaaggcagaacuaucgucuuguacacacggaaaaccacaggagccugggugagggucuguaaugacagggccccacccacacaggacauuugcaagcuuucuacuaaugacuuuaauuuucuuugucuagacuaacuuauugcauuuaaagugcugcuuuucuaggggacaguggaaaucauuaguccuucaaugccagccaaacgaggaguggugagaaacacaaacaaccaagaaagucaguaaaaagggaccaggggggguucuccaugagugggcugcuuccugaagcacaugcuggcuucaagucacccuguugggaagcugcguuuuagagacuagugccuguagcaugaauggcaaauaaccccuuagauaauguggaaagugaggaaaaaauggagaccucuucaaagcagauagguagauaggcaggaaggaagugccacuggcuggcuaccaaguugaggauguucuauggugacuggguccuucucuaguguacaauuauuauaacaaaggcuauuugggcuuugcacaguaaaaacaaccaaaaaggacuugugugauguccuugucuugacacauauuugugaugagugcaccaagagaaauguaacccguuggccauaaauccuuuugaaaaucccuucaaugacaggacacugaagaagagcagggugcucauucacacuuucuaaaaaccugagugggaaagcaauggagacacuucaaauggcccggacuucagacgagggagaugaacuuaaggagccucuggaugaacacuacacacugaaaggccuccgggcaaggcuaggccucuucaguuggcaccaugucuugaguuccacaugccaaagccuugggaacauugggagugucuggagccccgaaagggcuuguccuggggguuauucucuuuagccaaguccuucuuucagcgccuggacuugcucacuucugccuccuccuccucuacuuguguccucuccaccacuuuugcacacucaaaauagguugguucccuaggcccugcuggcuccuuucgccauacuucugccugcuucaacuaugcuuuuccuaaaauaucuacuuuccaguuugguuggacuuucggugagucuaaauuccuaagucuuuuuauuggugguauggauuuguuuauuauucacagauuguauauaggaaggacuauugcuucuggaguaauguucaagcugggucugagguaaagaacugauauaguauauuucuguuuguuuguucugauggcuuuaaaaacuguuaguuaguuaguuaguuaguuaguuaguuaguuaguuaguuaguuaauuuugagggggccucuguguggcaauggaguacacaugaagucagaggucaacuuacaggaacugguucucuucuucaucuuguggguucuaggaaucaaacucaauuuuuaagguuugguagcagacacccugacuuacugagccaucucacaaaccuuguuuugguggugguggugguggugguggugguggugguggugguaguggugguggugcaugcauuuggauuuuguuuuuguuuuuauuuugaggcacauuuuucccucuguuacucgggugacuccugggcuaaacucguccuccugccacagcccacuugaggagagaggaugacagguuccugccaccguucauaacuguguauuuacuccagcaggaugagcagguaaaucuuccuaaaucggagggaacuguagagauaaagaguauagugggcucagggacuguucugugcccucaguccuaggcugggcagucacaccuuugacaguaacacuugacugccuuugugcuuucccuauuuuccacaauucuacuuucucugggagagaaaguauuuguauugacacccccauuggguuccuucucggugagccuuuaccaccugagcucuuuugaacuacaugacgcucgacuuuuuuacuucaucauuagucuauagccuaggagaacaagcagguuucauguaccaucauuagcuaaugagcccagcagccaacacggaaauguuauuuuuaagaacaaaauacauuuugugaaaacaaauacgugacccaaacacaaacuaugucaucaaggaaaacuugcuccgaggaacuuaauccaccuugccauuggucuuucucauuuccaaagagguugacagguuuaacacaauuucugaaacuuuauaccuaaaggaaauacuauacauaaugcgaaaguacuagacucucaaagcuguauuauuagcuuucuuuauggaagcaagacuagaggugacucauauauucaacauguuucaaccgugacuggaaauacuucugagcugucaggcauugugguuucuguuauuagggggaaguugaugcacccguguauuuucaccaauuucaaggccacucauaucccuccaguugauuuauuuguaauccucagagcuccauucuugcuucacaauacugaguucccugucaugugaucuauauacaugcgcagcacacaacucaagugucagaacucugguuuccuuccuauuucucucaagcuucugagaauuugcagaauuccccaaauucaaaacaaccaucacccacaccaaauaauguugucguaaaaagaaaaucagauuacaaacuacguauucacuauagcauaaccucuuugcauaaagcucaacagaaaaaaaaaguugucuaauuagccagggaaugcuuauuaacuaguuauuacuuucaaccacaagaaggaucacagaauacaaaaccagucaguaagcaaauguccauuuucucugcaauuccuucacagaugccuccaauuucucuaaauguaauuugcugccuauucauuugcguuaccaaguaaacuccacuugugccuagcagugcaggaugcccacgaacaugcagcaugccaaucucaucauuucucaaggagguucuguuauuguacucauuguugccucucgccugagaucuacggugggguuuuguacacgaucagcuaccugugaguaacuauuagauuuacuuaacuucaguacagagaugauugagccaggaacuuguggcauauacugcuuuuaucuauuuccaggugugcauuccuuuugcagauuuagacauagguugugauauauuuuugacacuguccaugguauuuuugaaaguaaaauacucaucugauuauaagaaaggauugucaacagauacauagauaccugccguauugcucauugcuuuagcauauccucucacauauuguauacagaggugacugguccuuuguggacuuucaacauggggaccaggaauaguacauggaaauugccaauagaagggaauaggcauggauagaaaacugaaggaauuugaaagccuaaaauaauuuuaauuccuauacuauauuaauuauuuuauauuuuuguuuauaaagggucagaaaauauuuuacaggaaagucuuauucuuggaugggagugagauggagaugaaaggagaaaggaagaggaagguccagcuuccuuuuacaggaagagcauggccaccugacgguaaccgcacaggacugacuuuggaaacaagauaacuaaugacuaagggggacaaaucaaagcaagaugaagccagauggauguacaaaugaauaaucugcaaagaaagccacagcacaacuuucuacacagcagcacucaagacggggugacuaaagagacaccuuaggacagggacuggugugacaagccagaguggugagaacucuccaggguggucuuagagaucacuggagagggaaagagaacaaaauguaccaucuacuaaaaggcaaggaaggauuguucuggaccuaaaaaguagaguuggaaacagacuuucugaaacgucaucagcaauugguuccugacucuucugcuccaggucagcguuaccuuuccaacauuuccacauugaucuuuugggucaauaugaaaggucuuaaugauacuuuuguuacaaguugcuaacuuccaugacacacuucagcuuccacuuacaccuugcaaugauguucuguuuguuuauuuuugcuguuugggguuuauuuauuuauuuauuuauuuugcuucucaucuuuugggauggaggcaaaggggcagauaugggaagcaggaagaugagugggauuagggaaauucacagggaaucaauaaaaaguuuuuaaaaacccaaauucacacugguuuucaucacauguuggcaaggaugugaaggguucaaagcagauacuaugucuacauacagaguaaguggucauuuucaaagagcuacacuuuauguugcuucuguuauauccuuaaugcauuugggcacauugcaauagauccaagagagccaugcugaucaacuagaauagcaauagaauucuaaagcaacaauaaauuuggaggaaaaaaaaucuccagagaacaaaagaacccaccgagaguguucggugaugggcugagccuuucuggaugcucuuuaauuugauuuauucugaugucugcugaaaucgggcuaguuucuugucguccgugugcuuucuguggaguucauccaagcacagagucuucuucaguuuuggaagaaacuuugcauuuggaugguuuccauaaggguugaaaguaagaagaaacacuggcucucgagagaugaaacgacuggagaaccuaacuuccugccaugcgaugaaaugaucugauguucgcucaacaucacaugaggugaaaaaauacauauuugaauauuguuuuucaauagauacugaaaauuaugaccaucgauaaaauuuaaaaccccacagguuuucaaacaaguguuccuuuccuuauuuccucuuuaaggaugacuucuagcauucuucuguugccuaggagguagccucuuauauaugagcuguguucagcuuucaaggacacaggaccaaugacacguucaauuggcucucugggaaucaaguuguauaaacuuguuuuacuagagucauuggugccugccuugaauuaauggagaaagaggaaaagcuucagaaggcaguuucuugcagcaaggaggguagguuacacaugguaccaucuuuucagaucucaucguugggagaagcugugacuucaagcaauucaagggaugcacagcaugagugaauaaucuaagccaguaaaccaguacucucucucuugaaaucuggcaucucacagaucucucucucucucucuuucuucauauuuuaacuagauaaaguucagaggugacaauagacucuuuuuuauguagccauagcguuaggaucuuaaggcagaagcaacugugaaauccuaugcaauuuaaucuucuguuuccuguaagcuacuaauguagaaaugagaacagccagaagcaucuggccauuccuuuccagcuucuaagagcuuucauuuaaaagcaagcauauauacagacugguuugggugccuacugucaugguagugggucuuaucauaaagcucuacuguuuagaggcaagaugacaaaagacucugcuuucugaucacagaugcagaauaaagacacagcccccagccacuguugaugugggggaugcaccucgugcuggucuuagaaaaguuuauguguauguggcagaacaugaaaccuucccuuuccauugcucaucucuucuccucuaugguuuuccauggcuauuaauaguagauggugaccacacucuaucuauuuacguauucuuaaacugauuuaagcguuccuucccugucuuuuucauuuccugccuuaagcaccaggaaaacaucuucucaggaagaaaggcaguaguauuucuggccgagaugguaugggaaaucauagauugcaaccugaccucagaaugcuuugaugccaaggggcaucagaauucuaucugcuuugcucugaagugucagauuuccuggcccugagccagagugacccuugaaaauccaaaggaaacaacugaucuuuucaggcaucuguuaaagcuacaccaauggguuugaccuaaguguagcaaaagcaaaagccaaggugcuagaaccuucuuuuguugccuaggagguagccucuuauauugaaagcugauccuguguucagcuuucaaggacacaggaucaaugauacguucaauuggcucucugggaaucaaguuguauaaacuuguuuuacaagagucauuggugccugccuuccucaugaccaacuucucagcugcauagaagucuucucaacucaacauaaaguguagcugcuguggcagggugaaaagcuuccacacucaaugagacaacuguccaguuagcaaucauagacaugcucauguacuguaagcauugguaagguagagugggaucucaggauugucagaggaaacacuuuuaagaccaaaugaccuucauuguauacaggaaaauaaaaaaaaucuaaagcugaacacacacacaauuccagcaacuuuuuauuuauuuauuuugguuuuucaagacaagguuucucuguauaguccuggcuguccugcaacucacucuguagaccaggcuguccucgaauccagaaauccaccugccucugccucccaagugcugggauuaaaagcaugugccaccaucgccuggcuuucuggccacauuuuaucauuuuaaaaucaacaaugugucaauccuggaaccauaaaagucaauacacauauauuucauggauucauggagcacaaaauauauauacagacaagagagagaggaagagagagagagagagagagagagagagagagagagagagagagagagagagagcaaacaauuuauauuccuugguuaacccagagaagcaagagcaaugauauaguucggucaugaaacaaaucuaucacaauguacaucucauaggaguugaacacugugggucuuuuauuguaacuacugauaaacauacauuaguccaucuucauuugauuuuuccucaagcuucauuuaggucugauucagagcaguaaguagcucugguugaacuuugucucuuacaaaggagcuaaauagcauauagaguguaaaaaaaaaaaaaaaacaaacuuaauuuccccccaagucucagaaaagcguucaaaucaaaucuaaguaagagaaucacaaaaaacagaggaagaaaagauauuuuaauuuuaaaucuuucagaagcuaaaacuaaaguucagauuuuuaaagacuaaguauguggcucugugguauagcaugagccaugggcucaucccaaagugggaagaggcagaagaaagagaaaugguagaaaggcagaaggagggaggguacuugagaagaagagaaauucagauaaaaagaacagcuuccuaguuguaaaaguaguaucauaagugauuaucaaauaaacuaaaugaacaccgaaaagaacguuuugucuuuagcuuucagacuacagagcuaugguuucuauauauuccauuauuagcaacaaguugguagauuccuucgcuuuauucagaccucucucugcccaggaauccuagagaguggacaacugcagagaugaaugucauauuaauagcauccuaaaauuaaauccuuagcaaugcuuucaagggcauagguauagugauaucugacaugugugccuguaugcauguauguauguauguauguauguauguauguauguauguauguauguaguugagccuacuugauuuuuugagaguucuggcagcucugaaaccaaguugaauuugucucuggaagcaaugguuuauuguuuucagcuuugaggcaggaugucacugcguagcccaggcuguccuuucauccaugguaacccuucuggcugagccuucugagugcugagguugcaggugugagucaucacacagacaucagcagugguuuugaugaggagaugccaacauggacaaacacacacaggcagagcacagcaauuauuaaauugucaaagaacacaagaagcauguuucagauuguugaaaaauaaacagaucagggcuuuaaaucccacaauuuguacgauguuugucauguauuccuaauaguuuuuaucuuguuccaauaauuauaaugcuguccuucuuugggaauuuggguuggcggauuccuucucccuuucccuccuucucuguauuaguuaugcuaauauuaagaacagauugucacuuuacacauauaauuguaucuuuggaggacuuauuuuguacuauuuuuuuuuuaaccugcagaauuugcgagcagccgaggcucaguucgaauccagguuuucucaauuauaugaucuugagcagguuuuuguuugccuaccuuuuggugccucaauuucuuuaucugugguaccagacuguuguaagaguugagaauguuuaagacaucuaaaacccuacacacacagcaugacacaaauuugaggccaaaagcauuuucuauguguaugacaaugaaaaugaguguauaugaugucuaaaauuauggcaaauaguccacacuucauaaaacaaaacuuuuuaggaccaagucaagucuaagcuaauuaggcaaaaauauagaucucugcguaguugaguguaguacccuguuacugucucuggggucauaacaagagcuggacauugacuaguauugaguauagaugucagguaauguuggcauuaaauuuuauuguguuuuguagucagacuugacucccuuguggguucucuuuucuuccaccauucucuaccuuuuuuccauccuuucaacuagaucccuaacacuagaucagagagaaaaugggauacagaggaaaggaaggagcucccugaauaaagucaggggucagaaagaggauggcauuauuguuagacuacuuccugcugauuagggucaucaaguuccuaggggcaaaguuaaucuuucccuuuucuucuucuugauguuucuucuuuccuuaugacuacuuaauaaaccaggaccaacagccacaaacaaccaaccaauaguuagccaaaaaccaaccaguaaccaccuaaugaccaaccaaaaccccaccagcagccucuuggggcucuagcauuuauauauguucugaaaaacucccagaauuccaaaugucacacaguugcagcaauuaucugucacuggcaaaaucacacuccugcuagaguacaaggcacaucagagucaacugcuguggagcaucugaaacagccccaugaacaaaaccauauucuaauauuucuguuuuuuaaagaaaccacaacuucaaaauucucaccacugaguaugaaaauuuuacuugauuaagagguggauguaggguuggagagauggcuauaugccuaagcaaaccgacuguucuucuagaggacacagguucaauucccagcccucacauggcggcucacaauuauuuacaacacccguuccagaagguccaacaccuuuucuggccuccaugaguaccaggcagacacauggugcacagacuuacaugcaagcagaacacccaugcacauaaaacaaaauuauaauuuaaaaauguuaaaaagagagguaaguauaaaaugggccuucaaugacuugagaguuuaaaauguuuguaguagaaagacacuggaaguaugcuaugcauuagucacccaccccgacuaucccuggagaagagcaggauugaaaacagaugcaagaacuacagucaacucaaaauucccacagaguaggcagauuuuaauugccaagauauuuuagucaccuuugauucaauggcauauggcucuuacuuucuguguugaauuaaugguuuaaagauauaucaaaaauuagcuuugcaacaccuucuaagcuaggagcuucuaguggagaauaucuuaauaauaaauaaaacccaacagauacugaaaaugaugagguagguaguaagccacaaguauuauuaaacaucagauaugaacccuccauuuguuuuucuguccuaagauucuaauacccucaagugguuccauguaauauauauuauuuuagguuguuugaucuuugaaaacuaaagguuauagucaaaguuauaaauaagaucagaaugaaauaaaauucuuuaaaguguuuuuauuucuuguaaauucuacacuaugagauuucugacaauuuuuggaacuuuugcugaagaagaauggaaauuaaagugagucuuuaaagucacaaugaauggggacaaugagguggcucaccaggaaaagguacuuguuagcaaaccuggugacucgaauuuggucacacacacacacacacacacacacacacacacacacacacacacacaguguaagaaacuacucaaaguacaaugaauagaaacauauaaaggcaucacugcauuuccaaaagauacuuaaaugacaauaaaucacuuacgaaaugggauuuuuaaaacgagagacaaaaugacaaggggagauggcuaagugagaaaaguguuggacaaccagguauuugaacaugagguugggucuucagaacccucuaaaacaucugacuuaauggugcaugcuuauuucuagagcauugaugguagaagguacagagacagaggaugccugcaucuugcuggcuaagcuaucaagcugaacugauauaguucaaguucacugagagaucuuguuuuaaaaaguaaggguggguggggcagucucuggaugguccauccuuucgucucagcuccaaacuuuaucucuguaacuccuuccauggguauuuuguucccaauucaucagccaccaagcgcagacacuauugcagacuccagcaagauuuugcugaaaggacccugauauagcugucucucgugaggcuaugccagugccuggcaaacacagaaguggauacucacagccagcuauuggauggaacacagggcccccaauggaggagcuggagagaguacccaaggagcugaggggaucuguaacccuauggguggaacaacaauaugaacuaaccagugcccccagaguucgugucuuuagcugcauauguaucagaagauggccuggucagccaucaaugggaggagaggccccuuagucuugcaaacuuuauaugccccaguacaggggaacgccagggucaagaagugagagugaguggguaggggagcaggguggggggaggguauaggggacuuugggauagcauuugaaauguaaaugaagaaaaugcccaauaaaaauuggaaaaaguuaaaaaaaaaaguaagggugggaagaaaccaaggaaaaacaucagacaugaaccucuggccuccacacauacccaucugcacauuuggguguaaggagcaugagugauauacauguauaugguggguagcaaugaucgccuuagacagugugaaacuaaagagucuggaugucaucuuugucaguuagaugugagcagaucaugugaccacccaaagaaugaacacagucuaauguauauucagggagauccagggaugcugcagcaaucauugggggaacauagagaguaacugucuuuuaggaacuuaacaagaaagaggguggcaaaugagggggaucugacuugaugagcuuuguaggcacaaaagccugccuguaaacuguacaaaaccuacuuugaggaaguaagaaaagaaucuugaaaauuaagauacaaacgaaaaacacccacaagaaacaaaaauaaacuauauauggcauucaaauuauaucaguaagaacaaccaauguaugaaaggaaauaugagggcuuaagagugcagaugggaagcauaagacauaucaaagcauaacuucgucaaggcucaucagcgaaaaacugauuccuauuuaucagacaagcauuggagcaaaugaaguggggaguccagcccugauauccuuuccuugacuagacccaacccuuaccaaaguugcaaugaucagaaccucauuuugcucuuuaaaaacucuuaaggaccucaaggagcuuuuguuucuauuacagcuaucauauuuauuguauuuuaaagucaaacaaccugaauuauuuaugacuuuguuuaaaauaaucuauggcauguuguguuaaauaaaacucuauuuucaaaaauagcaacuucaaaaauuagaaugauauacauucacacuuugguaagucuaucuuuauagauaccuuaauuguuuucaucagcuguuaauuaauuacuuuaauuagcuauuuuuagcugaucagccaggcaaaauggcuccugacuaugagucuaaaauucugggaggcugcugcagagaaaucaaauuugaagccagccugggcuauguaaugauuuugaggccagcuugagcuacaaaguaaauuaucauucacucuaggcuuccucagacauacuaaucagaaucuaucccuucuuauaauggcucuggguauuauuugguagagaaccaaaacuugagaugaaacaguuuguuguguuugaauugacaugagcaacugugaacucuugucugugaacuucuugcccgcggcuacauuaaagcccauugaccuacuacuggcaccagaaggccauaggacgaguuuauguuuaaacagcauggugcugauguagauaugcuguaagagucagcuaaaacaugacugacacaggacauucaggggccugagucagcacaaaaugucugacaccagaccagacauccugggaaccccuaaaguaagcaagcagugauguacuccauuuuuuaacuauuccugaaaggcugccaguuuuuguguggauucuguauaaauauggcauugaggccagagguuguagccuuugccuuugucagucugccuacauguguuucuaggucuaugugcuaugugucuaccacccaaguggucuguguguauacgaguaugccuggauguggucccucaguggccuaucuugcagcuggaguaaaaaacuauaucucaccucucuuugaauccacaaaauugcuucaucuucauggccuccugugacccuccuccuuuucugauaucagagaauggauaccacuauauucuucauacuggccugaauuccugauucucuuaccuuacucuuccaccuucugugauuaagggagugugccaucacacccaauuuagagaaaacucauaagcgaaacuggugaucuagcucaucuaugauuagcuguguguuagccaacacugcugugauuggcugugugcuagaugacauugcugugauuggcugugugcuagaugacucugcugugaauugcuauguauuagauaacucugcugugacuagccucagacaccagcaguuuugcuuauguacuaucugaguuaaaggugauguaguguaagacccacagucuuuggguauuauugugguucuuagaaaguuucuuuggauuucuggauuaaaaagaaaacucaagagggaggacugauuuauucucugugccgcucuugggacuauacuuaguaccugagauggucaaaagguacagugaacuaaauaaugagaaguauauggaaaccaaauaauuuuagcagcauaacaguagauaaauuaauaggaaacuaagacaauagauagauccucuaaaauugaagcuccuacaugauuguacccuguguaaaguuuuuaaaacucaucugucuaucccuccaccccaucacaaccaacuccugccauauuggcacauagaauaaccuagcuagaagugaaacucucauccaacucuaacucuccaaaagagacuccacccaccccuucuuccagauccacuguugacaccuuccacacauugguggucccaucuccacccacauccuuucauuaguccucagccuuucucuucugcucccuggccccacugggacacuuaucuaaacuauuuccauguuguauuuccuggugaccuaaugccuaaauguuauguacugucuuugaucaacuauugagcaucauuuugguuaggugccuuuugcuuccuccccccccccaucauuaauuaauucacaugugacaaauuaucuccagagauuucaaccuucugaaguguggaaauuaucuuucucaagguaacacucagccaggccucaaggcuaaccuuauuuaggaggcugaguuagaagaacuggaaauucaaggcauagcugggcuacaaggugaguucaagaccaaccuaugcaguagugaguggaaaaagaggaaaagaaaaaaaagaggaaaaagggaaaauuaaagaaaagcugcacaaaaugagcuuacuaacagacagauacauauggagggaaggguguaaagaauucuaucacucacuacuggacuauuugccacagauagauucagggaaagggaaucauugccuucaguaacauacccacuaacaucccuaucccaguacaguagacaguuccaauccagugguaacacaaauggcucuguuacacuaaaugaguuacauaauuaggcugaaaauggacuaguuggaaaggggagugggggagacuugagaaggauggagugaaggaagggaagauugguaagaaaauauuauauccagggagaaaauugucagauaacagcaauuuaucuauaaauauaacaaagcuaauaaaaaaaaagaaaagaaugaaggaggcugggcuaauaccuccauugugagguucucauguagcaugcaaguuucugaaguuuaauucccagaacaacaaagagaaagaaagaguagguagaagagaaggaggaaacagguauuaaugaggcuugucaagaguacucaguauauaaucugccaccauuuguuguccauacagaguuguguuuagauacagaaagcacgggaaucugagaggaugauuagcuacaagugaguaaagagacaggaaggacuguuauaugggaagucugaacacagacaaggcaaagagggcuucugagcaagucgcauuacauuauauuugcuuguuuuaauaggcucaggcaaaaaguggacauggugaagaguuaagaucuucaaacaccacaccuugguacuguucauaggcccauggcaucaaauauuuucaacauugguccuuucaguguucccaugagaggauuuccuggaaagaauuuuuugagacucuaaaggaauauuuacaaaauucugucaucacacucacauacacacucacacacacucacacuuaccauacacaccacacacacaccacacaucacaugcaccgcaccacacaaacacacucacacccaguacacacacacacacacacacacacacacacucauccaaaccacacacacacacacacacacacacacacacacacacacaccacauaucacaugcaccacaccacacaaacacacucacacccagcacacacacacacacacacacucauccaaaccacauacacacacaucacucacacauauauacacacaaaccaucuaguaacugcagauugaauauaauuaccaugauauggauuguaucacaucaugaauacaccuuucaaauccugcacauaaauauuagcaucucuuguuuauagaaaugaaacagguccuuuaaagggaaaaacugcuugucuacaaccagagccucuaagcuguacgcccuggacuggccucuguugaggucugaaucucaagcacacuguugauucuuugcacuucuucacugacuaaaauauuaaauacgugccuaauuaagcacaccgcuucugugugaagauucagcucaguauucagcaucuucuggcuaauccaaagcuucuuuaaacagggcgaggacacacuuucucuuuggaggaggcacauuuggccaaaguauauauagggaaggcagaugaugcaaccacugcuuugcugcugacucagaaauguugagcaugguaacgauaaacacauggcccaacaguuuauuccuuggugaacucuacccaucuacguguggugcuggaggcuuguccacuugcccacccuaaugaagugacuaaaauuaaaaagaaaacugacgggccacuugaaaacucaugagcagucuucccuccaagacuaagucauuuugugcuucugaggauuauggcuccuguaguaacagguggcgucaggacucuaaaccugauccuuucggagcugccugguguucaguuucccguuucacuguagguguaaucuacgccaugcguuuacuauuucucugugggaaagacaccaaggcagaauguccuggacagugucccaggauuuccgauggcucuagaggaaauuguuuguaccugauaagagcuuuccuuuggguacuucgaaugcaggcacgagaagacuguucuauuguaggcugucuauguaugugugugccuagaaacaucuuguuugggauuuaaugucucuucauaucagugugccuuuaaaauaugaaaacuccugacuagagaacacagugcuccccaggcuaaguuccauggugaauggacuucuguaaguuggcuauugcgcauuagaggguaggaaucgaguuagcagaaauugcugcaugaauacauucuguaacauaacagcauaacaaauggauuuaggcaaggacagaauagccgaggauggaaaaaaauguucugugcccagcuauuaauccaaguaugggauaggguugcuaccuuuugucugaguuucccaggauguuagucaaagggacuuagaagaaucuuaggcaauagcuuagguuccugaugacugacuguggacagggcuaggguagccagguggaccugggaaccucagguuguuuuguaaaucucugugcuagcaagauaaccugugagacaaaguuuuuuuuuaagacaccucuccaucuucuccaaauagauuuccuuuaacaauucuuacuaucaauguuccugguuaaauaaaacauauaggcagacauguacgaaguaguuuuugaauguuuggugcguagggcaauauuagaggcaagaucuccauaaguaacuaguauugaaauuucaaacaugauuuguuaaaagaaaggaggaaaugcaaggauuuuagugucauuucaugcaccugccaaguccccugcuucccuggacuaaaaagcagauccucagagacacacaggggacaagcuguaauucugcaauguugacugccuuuccacugucaucuuuucugccauguaagcacggacauauuuuggacuuuucuucugggcuuggagcuggacuucauuggauuugauagaagacauuuaucauuuaugugauucguaaggaauccuguucuugggugagaaugccuuucugugacaggaugcuuuucacgaccacuguguugacuuccucuccaccacuuguaugcugaucauuuuagauuuuguuuguuauauaagauuuuccccaauuaugcaacauauagauucugcuaagccucaguuggcuccugacuucccuuugucuuuuuauguuuaucuuauguuaauaauauucuacaugguaggaaauacccuauuguaugaaugugaaauuuaagauggcuuuguggacuuuucugucauuguuccaugucuuuacaugucaggacaugugaaacucaagagguuuucauggccuucacauauauguaauguucuucaaauuagcaaccuaaacuuuucuaauugaagccacuccuaauuuuuauauuuuuuaauuuggacauaauaaugcuuuauuauagauuuguuucguuagcauuguacaaaugcugagcaacacacagacucuggagaacacuggaaucuuuaaaaauguuaagcuuacaccuaccacacaacccaggcauuuagucaagagaggggaaaauauuuauuugaggaaacuuggauucauauguuggaagugacuguauaguauguauggcaauacagauacccagcauaaaauaagaggauaaagaaacugagauaaagccauacuauucaaugguacucagaaaaaaggaaaggggcuggagagauguuucaguuaguagaguguuugggugcuugugcauguauaagucgugaguuuggacccucagaagcuacauuaaagagauaaccugauaaagauggacauugcuacacaagccugcgaucccagcacuggguagcagaaacaguaaggucccuggagcuugccugccaucagggcaagccaaagugagcucuagcuagguucaguuagagguuuccucucagcagaaauaguagacagugacugaggaagacacuggcaucgagcucugacuuccaccagcauguauacacacuugcaaccauauacauguccacauacauacaagacagccaaagcagcacacaagugaaucucaaaacaacaacagcaaauaaauugaaaauaaacuaggcauauuacaugacgucauguguacaaacuucuagcgcugaguuguuacaggaagguacgaaguugcaagaagaaacuucuagagagauggcaagguuuaauaucuaaauuguacuaauguuuaucaaaacaguacacauaguuuaucaaaugccaacaggcacagcuaaggcuucuuucuuucucucuuucucuccucaccucccccucuccccucccucccucccucccuccaucccucccuuccuuucuuucuuuuuaagaaauucaauagaaauuucugucuguucccaacuggauauucauuuauugauugucucuugauagauuccuagaagguacauggauguuugaccaccauacucuuagcauucacugacaaucucuuccaugcuuugcuugccucuuaguaaaaaggcccaguucacuuaugcaugcauagcaagcacugacuuacagcugcucuauguugggagaggggguguugugggaugucuuuaagucaagaggagaccagcaugauauggacaauucugcugugggguuucacuuugucuaaaaagugacagugucaagugagcaugauuuaauaagauauuuauacagcauaucacaaaauccuuuuugaauaaggacauugguuaccuugauaaaauguacacagacauaaccaccugaauagaauauauuguuacuugcugcauuuuaauacaaaugccacacuucauuaggcuuagugcauuauuacaaauugaagcuaacuggguauggacaggaaauauuucauauguuaaaagacucccauagcuaugucaauaacuucccauuccaaauuucaauuauauaauauuucaggugaggcuagcaauauggcucaggaaauaaaggagcuuuuguucaaguauuauaacucaaguuaaaacaaaaguccuucaaaugggcagauuucugagacucugcuagagugaaauuuucugauuugacuuaacccauagaggaagauucaggugaguuucugguuuggcacauauauuucuugcuccuggauaaacuuuuacagaggugguaacuaggcgcuccuauggcaugaccaauugccucccuguuuguaaacggggaauuagaaauuacagauuuuauuugagcaccaaaggacgagagaagccaaauggcagugcugccugcucccaucaacccucucauuguggagacaugcugacugccaagaccggccaccuacgucagcaugaccacuuggaacuggcuggauccaaaggggagucugauuacagcugcagggccccaggaggauuuuggcaccuuuugauccaagaugaaccugacgcuggaccaauaacaaaucagcaucuucuuucuuuucucucauccuuuuccauuuuaauuguaguuggaaggaauacuucgauauauuagaaagaugaaaggaauccuggaggaggauugaauuuaaaagugguauugucugguuuuuugaagcaaacccaugaucuauagaguccugugaaaacuaugaugcacagaguugguagaagaacaguugaagaacguugaucaaacaacagcucaccagagaaccgagauuauuccaacacugugauucucucacugugagacucuaaccuauucuuugagucugaauucaaggacaacaaugaaaggagcuuacaucacuggauagguuagacuuucuacauucucugaaauaagacaacccuuugcuagcuaaguuuucucuaaagagcacaacaucugcucaucugcuugcuacugcagcaauggaagcauggccaacauccauuuuugucugcuagcuuugagccagugacuauagggaauugaagacaaaauuccagaugugagauaugcaugccccguaauucuuauucuuuauagauacuggcacucuccugggugaauugguuuaaugagaaccauccacauuuaaauauuuuuagggcauagccuaaaaccuuccagucaaucaguugcuuaauucugccucugaguaagguguaugcaaagggaugcucugagaagaauuaugugugagaauagagcccaacuggcucuccaccaguuuuauaaaauaaacagaacuacaacccccuuauccuaauaguagcucugugaccuuugugacccugaaaagaagccuaucaaaacagugauaaacagaaccaggacacugcaaugacuucguugcaguuaggacuacuaaagugaaaagagcaaguaaucaguagugaaaaauucgggaaugaagggcaacagggaagggggaguguuaagaguggggaaggagcugggccugguggcacacgccuuuaaucccagcacuugggaggcagaggcaggcggacuucugaguucgaggccagccuggucuacagagugaguuccaggauagccaggguugcacagagaaacccugucucgaaaaacaaacaaacaaacaaacaaacaaacaaacaaacaaacaaacaaacaagaguggggaaggagaggaugaagauaaguguaugcuuucggagugcauccucuguggucaauauaugcuauuacauagaugaccccuacccuagaacccuguguuaaauaauguuccucaacacauggggcuaucuggaggacagggcuugcaauagaaccuuaaggaagugaggcuuggcuggaagucuucuguaugcugcuuuuugcuugccacccaucaugaguugagaagcauccuccacuguauguuccuuccuugaugugcuuuguagccacagguaaggacaacagggccaaccauggacugacaucuuuaaaacugugaaacaagacacaucuuucauauuuuuaacuugauuuauuucaaguaucuccuguagucaacaaguucagacagaacuaguccaauaaaacacaagaccuauugagaaacaaguccaaaauuaaagucauauuucggucauuaugcuauuuuuuuucuucaaucuccuccucuuucuuucccuuuauggaauuguaacaacauccguccugcuguucuagcuaggaguuucagggucaguuugugaaaaagacagcaaucuuuuaaauaguuaaagaaguguggcacauaauuauauaauauaauacauauauaauaucuuuuaaucaaaaaucuuaucucauguauuuauaaaaugggaguuaaaaagucaaauauuaccaaaaaccauacaggcacagucaagcagacuagauaacuauauuaaaauggaaauuucuuacccuaauuaaagcuguuugucaccacugacuuacaaaaaguagaagcaaauggucuuuguauugucggaccugccucuggguaggguaucuuagugucaagcauauacuacuuaggacuuuuccauauuuuuuuagcuuuuuaauuuugcaugcacacacacauguucacacaugugugcucacguguacacacacacacacacacacauacauacauacacacacaccaaaaauaaaaguccauaaaaacaugcuauuaaugauaauacaucugagauugcauaguaguaguguacaaaaauuuaugaauuacuuaauaaaauuuguuuugauaauuuacuaaaaauugucuaaagggcaacuguuacacauaauggguuagcacacucauuugauuaaguuggucacucaaaaucauaacaauacuaauuauauauauaugucacuaauuauauaaauauauauguauauauuuaaaguacacagaaauaaaaucaagaauaacuuugaaaaaaguuauuuuuaagcuguaugaguucacuaaguucuaccugucccuuuugcauuaguuucaauauuucuacuuucaaauguaaaaaugugccuuguagacuguagugcagauugacguuaaauguguuuccuauauauccugccuaauggcauaucuugcucaauucuguauauccugcaugguauacuugcucauuuuuauugcauauuuugucugguguuguuuaugauacagugcuuaguuugacuucagacucucucuauaucccagacuggccaugaccaugugguccuugccccuugucucuggaaugcuguaauuguggacauacgccaugacauccagacccuaguacucuuuugcgagcaggucaaugagaugcauauuugaaaccuuuagccaauuuuccagauuacucuguaucucuauuuauaggcagugucggaaugaguccuuccuuuagaguggcucuccuuauguucuuuuccugagucuacaaagcaaagaucucuuuuucaauuuaauuguaaagcauucccagaagugucaagaaccaaauaaauugaggcuccugaaaacgaacauggaauugagucaacuguaaaauaaugucuccgagacuuauuucaacaguucuaaaauuaaaagcauguuucuucugucaugugucauacaagaaaagaagagaagaaaucauaauguguuccuaauuuagauuccucuucuuuaccacaaacauaacuuucucuaacagugacacacacaacuauguucugccacacuugaguccgcaagagauuucuuguuuuucuaauuugguucccacccuuuggacauugcaaagagacuagaagcugacuguggugacacccgaaaucccagcauuugggagacagagacaggaggaucaguuuguaaggcuagccuggucuacauagcaaauuccaggagagcuagcacuccaaauaagauccuaucucuaauuaaacgaaauuaaauuaauguaauugaguugucuaagcaucaacaaaccuaaagcaauaauaauaagaggcggagcuacaauaaaguguacacaguuugaagacaugcuguaaaccaaagcaucgugaagcauuuauccuugagaaacuggaguguauaacaucagucuucauggcaaguuugaaaauguuuugguaacucauaacucuagugaacaauccagugaguaauauuauugauauuuccauauuaaccauauaaauuauauauauauauauauguauauauguauauauguuaauuacauauacuauauaaaauauuuuguacuuuuauuuaguaagcuuauagaaauucacaaugaaaauuaauagagcaugggccuaaugcaugugagaaaggcuacaagucuaguuaacugaacuaaauaaguuuccuauuuacuaaagacaaaauaaccagaaacucagccaucauuucuugagaguaccucuuaacuuaguuuauguucugacuaaguuccuuccgguaucccauagacauagagaagcaggauccuggguacacugacgucagcaaaagcugggcauugccaugaagcacugggguuugccauccaccccuccuccauuaccuugagaaggcuuugccugcucaucuuaggaaguagguauaaagccccuugauaggacacuugguuggccccucaggggcuuucugaaugaugcuucucauuagucugucacauuucccagucaauuauuuuguuuugauuuguuuccaacuugccuccacccaggcuccaagacuucaauuuucacugcuggugaaauaaaugaaauuggaauuaguaacagcugcuaugccauaaaucuauaugcaccucugccaagagcacacaagcuuuaaggaugcauaagaaaguuaauaagguaaucgcguauaaaaagagauccugggguuaaacggcagggcucaagugaccacacagacagccacucaccugcccaagaggcacagugcaguaucuagcccuguuuuagaccacaaucuccuaaacacauacguccaguccuacaugaguuuaauugaaaugccgauauagagauuccucaguagaacuuaacgaaggagaggucuacagguagaauuuggggaucucauuguuuaaaaagcauuuuaaaauguauuuguacuauuuuuaauugugugaguaugagucuguauguggugaauacauaugugugagcauaugaaugcaggugcccacagagaccaaguacccugaagcugauuguaagccaccugcugugggugcuaagagucuagcucaggaccucuggaaaagcagugcacuuuccuaaccaauaucccucuccccaaggcccagggaucugcauuuuuaaccugguguuaugguacggcuaacuugaggauguuaguuaucuauccuuggaagccugaacaguucaugagcugggacauguggccacucucaaccacucuugcucucuucugcacucccuccuguaucugaacagcuaguacacaguuuucauugaaaggcacagcuauugugaucacagggagaaggguaguuuagaccauugcauugagcaccgaugcuguccaucacaugacuucuacccaaugagaaaaugucuuucacacucaaggacccaucugccuucugguguuuucugaucuagaagauuuucucucuuucucuguagacgccuuuuuagccuuccacaaggacucucagaaucacccuguccccuuucccacacagcacugacuggagaagcaagaaugacaauggcagaguaugucauuucugucacuuuuucuuuucaucuuguccuaucugugugugcacccgggacuacacaacugugugaaaaucacaugugaggaucagaugucagugcugaaguuuugugcucucgaccuccauuuagagacaagguguucaaugagcaggagcuuucugccuggcuagacaaauggaccagaaagauccacggacacuccuauguauggcuguauggauuacugguccauucugcugugcccaguguuuuacaugagugcuacgcauuugaacuuaggccuucauacuugcacagcagguacuuugccagcugaaccaccuccccaaccuccuccuauucuuucggucuccuuuuuuuaauucuugcuuaugaagugggggcagggaucguccaaacuggaacuuugagacuagggguguggcucagugguagaacuuauacugaguuccacccccaacccuccaucccuaucaaaaagaagccucuaggccucagccuacuuauuaagugccagaacuuuaucugagaaaccccuauucccuguaugcuuugaggaguagcaugugagaaucagauuagacaaggaaguuacauaaaagagaauuguacccguaacuuaguugccagacuaggaagacaguaaaauaagacaggcauguagggugacauguuuaagaaggcccaggacacggugauaacugucuuuccacagugacaaaaggaugaaacuccuuaguacaaacaaucaacauggaguggaugaaagagagacauaccagagacuucagucucaggacucaaacuaagguucuuagauaaugaaauauccuucccagauucugaguggaugcucugagugcucagagggagggggcuuaucacccgaauaaggugcuccccaaaauaguuucuccacuugagcucucaaagggagucugaaaagaauuaaaauacuuuuaaaaaucauauagcccacguuuaaaaguggagaaaugaagcaaaccaaauccaugcagaauucaaacagaaacaccuuucugagauaaaggucagugauggggacgugucugaaacagccuaaagucaaacucucucugccucaacauaacguggacacgaggacggcuguguaacgugguggcaucaucuccagagcauagaguuacucgaguacugaggaccaucgugugccaagaacauggaugcuauuaauacuugcaaagcugccuggaccagaaauccaucacuugcagaaacacaaguccuucacgaucuaggguaauuaauauaguuugacuuucuccugcucucugcuuagcagagauggaugacaacucccuuuucuacgaaggacaaagcgaucucuagagagauuucucagggagcaaccuuuucuucugugugccucuuaaauguuuagugaguugagugcagaagcauaccccggguggagcucugggaccugguguugggagguaagaaagguaguuccuaggaauagagaaaugaagccagcucccagccacacucccacaaacccaaaccacaaauaugcacauacugcagaaagcagaucaaucaagugucccuuuuguaccucuguuagcuccuucaaugagaguugaaagaccuucauuucuguuccuacaaauaaggucaaguucagaaguguuggguuuaguucuuuacccaucuccucuugaggauacuuugagcaaagaaauagaggacuccaaauucuuagccagacccugucaugagugccugugacuucagcuacucaauugucugaagcucauaagaguaaagucagcuaggguuacaggaugaauucaguuccauccugggugauguuauguaccccugucucaaaauaaagaguaaaaagagggcuagggagauccaguaggagaucacuugcauaguauaugugaggcuuuggguccaaugccaauagacacuauucccccacacacacauacacacacaaacaaaaucaauuguucuuucaagguucaagcccaccauccuuuuuuuacaaagguaaacuaaacuggauacauaggagaguacaauaaaauaaagaaagggagccucagacccuaaagcaaucaguggggacauuugaaaauauacagagcacauauuaccaauauuucugggucaaauuagcuguucccucuaccaggaugacuugacuuucucuacccuccgguauuaauucugcuuuuccuauuguggaucuaagucuuucuuagucauauaggccaauacauaaguuagagaacacagaucaaaagaaaacuaaaaucaccaagaaacuuaacucucaaagaaaaucuuuaaaaaauuuuacacuauauuuacaaagauuuuuuuuccaggcuucuaggaucuuacuaguguuccuugugcagcaaguucucuaaccacugagaaaucuuuaaaggccccaauacaguauagacuauauauauuucagauggacuggaaaauguucauuugucuauuuuguugguuguacuugauuuugaaccuacucuaacaguucaauuuccaggcuuucgucugacaagcagauugcuucgaaggagaacacucugcuguauucgcucaucacuaccauguuuuaugaauucuagcuugauacgcauggccuagcaccauccucuucaauggaagacugguguccaacugcucucugaaauguaccauaccuggaggagcccaggucuucccaggggcauuccuuaauucaaugauugacaggugaagaggaucaauaguaaagucucucaccuugaagcaguaaugagcaaugagauauauuuugcacuguuuuucagugcuaucacacuggauuaagaacuccuuuccaguuggaauugcuaaauucuaggauuaaugucugcuuucagggauccuuaaacucugguaccuacucaugauuacuuuggcaacagagguucuggcaggguggccuguaauugcuguggcaaaaaacacuguggaaaauuuaccuagucagcaaguagaugauuguguucagccaugagccauauaacaaugcuaccccaaaugaaagacuacagagguauaccacaggaguuccagagaugaugacauuaaauaacuccucugccuagucagugcacucugugagauuggcaacugcucauguccauccucccugugagaaugacagagcaaacaaaccuaaaauguccccaaauggugucuccaacauaccaaggcuaagagaaugacauggaaaaggagaugggaaugaccuaugaguuggaagguauggaagagaccuuugaagugcuguccuuuagacaugcuuauuucgagcaugaauuuauauaguuaauuguacuagaccaucaaaaguucaggucagcuaagauucuggcauagacaaagaggugcuccgcaggcccuucuccuuacugagaaacuacugacagguaauuucuacagagggaggaucauugcuucggggagaggaugccucaugcucuagugcauggcccuacauccaugcacauauaggcagcacuaauuggaccuacugggcuauuuuauuuuuaaagacaugaggguuuggagcgggugccuuguauuuuguggggaauagagaguagacucagucauauuucuuuguauaauuguaugaaauucucaagaaugaagagagcuuucuauacacuauaacauccacaauauggguagugaaaagcaccuugauaacaagagcgaguguccacauugcuggucuauguggcuaccacacucucccuuuagucauuauuuuagagagcacuccuaguuauuuuaauaaaaaccaguuauuguaaaaaacugauguggguguuauaugaacauuuuguuucuaguucccaucaaaacaccucauccaguggcuaaguagguacauucuaaugcugucacaguagcauaauugccuaacaaagcccuucucagaaacauuucuguccauauaugaagcaacaccauacuguucuuaauuucuaucacuucagcauuuugcauauuuauaagaauuuggagcugucauagccccaucuguuuaucuaucuaucuaucuaucuaucuaucuaucuaucuaucuaucuaucuaucuaucuaucuaugaaauauugcaaacaaucugaguuaaacacuuuucuuggguaaggugguacauguucauguaggguauuaaaaucaagccaguaucuaaaaccucuccuuucugacuacauaauuacacaucuacaaaaugauacuagugugucagaaauaaaggugaguugggauguaugaagggcugaaauaaauaaagcagucuuaacugcucuccuccucagcaagagagggaugguuuccuugccugaagccucagacauuuuagaauucugcauucauugugucuguccaaaugcucacacccuuauauuaaaacuuagcuuagaagccacuguaaaagauaagcaaguaugaaaaccuacaguaagaaaauguaugggaaugugauuucuuucacuugaaagagucaaaaccaaccagaaugguccuugaugguaguuaacagcuuaaugccuacaauuuauuucugauucuucucccaucuuccugcuucuuugggcuaguucccccaguaaauuugaguuagcuuggcaccugaggugagucucucuacagugcacugcccugagaucagagaguuguaauugaggaccagcugaccuccugcaggcucuacuggugcauguggugguaugcauaaauaggcaugauuccaggcagaguguaguaggcauccugggagaggugcaaaguccuuaggaaggauggaggaaggaaagagaaauucuggcagagggagaagcuggcuggaacagguggccuuuaagcugggccuggagagauggguaggauuucaacaggcggauauugggugggggagggggagagcagagcugggaacagaaggaacauagaagaaugcaaugcuggcucaaaugaaagggaugguggguuaucagggcucauacagagguagaagaaauggaucugcagugauauggagaaagauuuucauccucaguguccaguaauuucuauuuggagaguaguguucugugagcagggaagcagcaugcauagggauggaucugaacuuuaagaacacugaucugagaacuauauuuuauuacauuugauugauugauugauuuugugugcaagccuguaaguugacacaugcuguggcauucacggggaagucagaggacuaauuggauaacuucuuccuuugcccuguguguuucccaaagauuggacucaagucuucuucccccuuucccaccgagccaucuugcuggccuguauauuucuuuuauuggguguuuuucacuuugcugugcucagccauuuuauuuuuaacacuuugaaaugaagucucacuaugaaauccaggcugcccugggauuuccuaaauagcuuggguuggccuugaacuggugaaucuccuugcaauuauaggugugugccagccuuccacaauacugguuucuuaacugaaacuugcuugacgaaauuucucuggccgcucacugauccuauuuucuauagccuaucuaacauuauuuuuuaauauguacauguuuauuuuuuagcucugacacuaucauuggcugcugagagcaugaaucauacauugccuguccauuagcaucuucccagagcuuuucagacugacuaguacagaggaggacucagcaugcccuuguugaauaaaugaacucaauaaaauauaguuaauuggccaggaaagaaguuguguugcuuggagauauguuuaaauacacaauuaagugucuagcaauagauacugacuuguaggaaucaaucuuacugcccaguguguauaaagaaaucucacacuacuuuuagguggcuauuccucuugauuucuuuauucuuuuauuccuucaucuuccacuuccaacauuuccuggucauuauuucaacuaagggacaggucugguaaauuuccugaugaucugguaaagacuggucauaacuaguuuugucauaaccaugauuguuuuuuuuuaaauggguguguacauguauacgcaggccaucuagucaaguucugacacauuucuagcauccaaccuaguagguccaggaccaucccugaaaaccuggcuucuagauuuccugcaagguaugcugcuacuucuaaugcucgggauggaaaguaaauggcucagaacucugccacaggacgaaguucccuuuuaaaauguuugaauaggcuuuugguuuguuuguuuguuuguuuguuuguuuguguguuuguuuguuuuaaucaagagucuacaaauggcuauaaaaucauacaauuuuguucuaaagauauaaaauuagaugauaggagacuggacucccagcuacagugggaagaacugucaauuccgaggaagaugcugggagaugagccaucuuuacccuggcgugaaacauacaucugagcaauugucagugugucagggaagagugaugcaggaugauuuuguuuuugagacagcaucuuucuuuguagcucaagugggccucaaaauuauaauccucccucucaaaugauaauauggaugugugccaccacuuaagacgauuuuuuuaauugaauuucaucugcaauggacgauuacugaugagugcauucaugauuuuuaaagguaacacagcuagaauucugagcuccaauucaucucauaugccauucacaugaugagagauuauccuguaacuacuuuguuuguacccauggguagcaaaaagaauaauccuaaugccagcuuuucagacauuuugaagauaaacgauacuuuucaaagagaucgacauaauaauuuuaagcuuuaaaacuucuuaauggaaacgaugcuucucggcugucuuccgaguucacauagcuggggauggaguggagcucagugggcugcgugcuuaccuagcauacaagaugcaccagguucaguucucagcaccauuuaaaccaggcuuggugggaugagucuggaacugcagcacuucggauguggaggcaaaagauugucaggauaucccugaacacuuagccauucugagggucuaugagccugggaucgaugugauccugucuccaauaaagcucccguguuucauguugucugaugaauugaaccugcugauguuuuccuggauguguuccucagugauguggaggauucaaugguugugaaaaggaacagagccuuuccccaggaaugucuuugugagugaugcucuaugugugucuuugaugcuuuagacauugggcccuuccugcuguccauggcggagccaagccguacaguuucauuauucuccucuuaccaguacugucagggacaaauuuacucuccugaccaauaccccaaacugugaggcuugaaacugaguuucgugucuccacucagcccucugagaguccaaucaggcucaucucaacuguccccucuuuugaggagccuuccucccuucuguguucccagcagugaguaguggagaaugagacuggucuguggucuguggacucuaggguccuguacaauggcauggaucuuguguucucuguggagaaccauggaaggcaugguacuaugagcucagccuucagaaccacauacauugagaacuaacugucuccacuggcuauauauugggguacccuggaaaaauucaccuuaccgagucugggucuucuuccucaugggauuauguggggauuaaauaggugaugagcaaaaucaacagagcaggugucaugaguaaaguucuuaagagaauugguuaguacuguugcugcacaaauaucugcaagucacauuuucauggucucugaacugugaaucuuucuuggggaaucuagcagaucuucccccaguuaggaacaucaagaacacaguaggcccucaauauuuguaaaugagugggcaugauuguccucagagucuauuaaauaagauauggucugaccgagacuguguuacuggagggcugacaauauaguauugaccaguaugcacuuuuuuucauguccugauuugcccugcaacagcuccagcucugcuuguugucccgggcaguuuauuaauagcacccuccccuaugcucugaaagcaaucuaguuuggaugauaaauguuacaaucacccuaguuuucagaacagucucaucagcucgauucccagaaucagaguuccuuagccagcgaugcacacagcgcacuaagccagcagcuauaugugacaggaguccauucugcagaggaaaugcuuaaccuuuguagcuggcaggagaauggaaggguaagacucaguuuguucuuuagucuuuguuuuccugaaaaauaaacuugggaugaauauuugauggaaaucuaagaggaugagaaaagugaccuggaaaauccuuugcaauuuagaaugauuagaaggacagucccacauggguagaacuuuccagaaagcaacaaagaagucuaauaaauccaaaacuaaauuuucagagaagaccaaaguuggugugugcuguucagcacauccuugauugagggaacaccaccccaggauucuauguugaguuugcacacacagguuagcaugugccugacagcuuggcccacaccaaaggcaugagcaaagaggauguucacuuuaccagcucacagcuccuuucuuugauauuuuugccuucucagaagucugccccaucccuucuguguccccauuucccugguguccccucccuccugugaaaauguggacaauccagccacaguauuuuacuuuuagaucaaucacuaaaucgcccuauaguauuuuacuuuccaaaucauguucugacuuagacaacaaaagugucauuccuuauuaagagucuccagaaaucccagagagaaggcaaccugggccaaguugugcauccugggcauccuggagcugucugaagcaggucuagcaaauggacagagagcacaggcuuugaaaccuguucuggaugccagacccucacgauuggcggugcggcuuugaguggcuuugaaaaguaaaugugauuguaguuagcauuuaacauugaaccugggucagagcccagcauggaggcccagaacaaguguuuggugguucauggacaagauacagagcuaauuuuugaugaaggaccgucaacuugacacucuucuugcgaagaacacggauauucaccgucugcaaugcauuuggaagauuagacuugguuccuggcauaaugagugccaaaucagccguggcaguuguuaguuuugaaggggcuuacugaucaauagacacugacuuuguucuacuuguuacugggguaccagggacauuccucaauucagugaagagauggucuuucugccuucuagugaaaugccaaaucccaaauccaaugcauuauuucauacauucuuugccaugaaggaaaacuuguguuugaagggaccccuguguuucuccaggggccaauccuaaccuugacuaucccacucgcugcuuaccaaaggucacugcugggcaccaaccugcucuuaugaggugaauguucuuuguuaaccaugcuaccaaguacagccuaacgcacucagguaaaggcccuguuaugaaacaggcuuuccacucagcugcuguuagucacguagauguacccaaacucgugcucugauagaaaaacaaacauuugguuagcuccuugugcacuuguggaggagaagggggaaaaaaacggggagucugaccucugggcagucacuuucccaauccuguguucuggcugguguucaaguacacagaggcuggaaacaccucaccuguugggcccugcucucuucuacacuaaaaacccaggcaaugucagauaugaaacaagaaacaaagaacauggugacuuuucugugucauuguuccuuggaccauauuuuucuaaggaguuacaccugacugugauuugccuggauuccagugaucuuuggauuuuuaugauuggaguuacaggacaucaagcagguaaacaaaaccaaaaccaaaaccaaccaaccaaccaaacaaacaaacaaaaacaaccaaggccaaggccuuuggcucuggaauacagcaaaagacaauagccagagcuuagcguguggagagcacaggcugccaaaggugacucucgaggcucaagucugcaaaucauccagaugguguagccaccacuaacucuaagcauugaaacuucacaggacacugugggggaagaaacugcauuccaaaaugacacgugacaaccaauaagcuaaccugcugaagagagggugugugaaagcucuacacugcugaggacugggagcuggcaauauucuucagcacggugcaugcuuacgugaucacccuuguuaagaaaaaccagagaugcaaauucuuauggucacccuguuccaauuugcuuugcucacaggcuguuuagacuauuuugauggugaugguggugucccguucucccccccaccccgccccuauguguguguguguguguguguguguguguguguauaccucacacaugcaggugccugcagaagccagaugagggcaccauauuccccagagcugcuguuacaugugucuaugcugccuggcauggauguggggaacagaacugaaguacucuggaagagcagcaagcaaucuuagccacugagccaccucuccaaaagcccuugcuuuuuauuuuugagacagaggcuugagaguaccacuaauuagccuggaauguacaucgauccuugugcuucacauucugaauaugcugggauuacagguauguacucggcuuacuuuacauauuauacuucauuguuuaguagucucggggagcaaauguagggauuggcacacacuagguaacguacaaccacuggguuauaucuguagcucuugccugccuuacuuacuuguugauauuuuauuuacuuucuuauuuucauagguaagcagggagcuccuggaagguagggcaauauccuauccuuuuucuauuucuagugccuggcacaugcaaaagcucaauaaaaauugaugaaacaugcaaaaucagaacguugacaaaagggcuuacauucuaaaccacugaccaaacuguuggcaccgucugugacucugucacguuucaacagagaccuuuacuuccaaucuucaugcuguaaggucuuuaagcauccacccaauguggucugacugucugcucuaugccagcuacugaggcagcuaugcagauggaaaacaucuuucccuuuacuuuagcaagauuagucucugucaugaaucacacucuguauauucagaagccacccuaauaaauaucacuggguuuauuugauagcucuggcugucauuugaaacagaaaaucaguccaacaccacugcaguuaauaucaacucuagagcuccaggccucagcuggccagcauuucaucauauggagacaaucugaauuuuacugccaucaaacaacaagggcaauaucuaauggaagaauuaggaaugccuaucagcuuucacagugcugcucggugauuauaaaaguccacuuuuguguugcaacgaaaagcauuucuaguagccaaacuauugugcugguguguggugggugcagagagcuuaguggccucucugccuuugaucuuuugaauuucugaaguugugagauuuuugcaugcuacgaugauaauaugggaaagcauacaaccacuauaaaaggaaaauuuuucuauuaguccaggaauaaucucuuauauagcgaaaccaccugacagagccaugugggcacauaucaccaguaagaagaccagagauauuuuuacaacuguggauuauuuuccucccuuuguacaaauccauauggugccuauucacacaucagucaucugcaguggugucucauucgacuccaagaauagaauugaaaauguuugcucccaauuucuauaaaaauaaaacuugguauuaguuggucuauuuuuccacaggcacauuucucuuuggcaauggcauguuaccuugacuggaauuggacaagugugaauggagcuaccaugaaauauggguguucuucccuggauacauuugcugcuucuucaguggauaaaacuuggucuacuaggaagaguccauuugccugcugagucaccuggagacacuggacugcuauaccucauccaaccaaucugccuggacauccaucuuccuacccaaccguccauucucucaccaaccaauaaugguugguugaaaguuguguccacuauuuauugggaagccuuucccagggagaugucuggcugugguauauaugcuaugguguauauucuaucuauaugucugacuaaaaagugccaagugcuuccuuuuuucccauuuuuuauuagguauuuagcucauuuacauuuccaaugcuauagcaaaagucccccauacccacccccccacuccccuacccacccacucccccuuuuuggcccuggcguuccccuguacuggggcauauaaaguuugcaaguccaauggaucucucuuucaagugauggccuauuaggccaucuuuugauacauaugcagcuagagucaagagcuccgggguacuucuuaguucauauuguuguuccaccuauaggguugcaguucccuuuaguuccuugggugcuuucucuaguuccucuuguccaccaaugauugagaguagacucugacagacucauuucuuuccugaguccuguccagagguuucaucugcuacuuaaaggaauucuaaguaugaucaaauaagccaguccaaaugaggcauuuagguuacaggagacacugguuugggagugggagacaacuugagcacauggaucacagagauaauccauucuaaugcuauacaaauccuuuaguccaaacagaagggaggaggagagucauugcauucauuuagggaaucccaaacucacuccagugccugaaaauccaagagggaaaggcagugguugccauugcuacauuagcccccagcccagaugaagacauugcugguuuucuagaugagauugagauaguuucauuggaucuuagccuuggggagucuaagcucugagaugaguccuaagacaguacugaaaugaauaggagaaagcuaagauccuccauuuaaacaauaauaaaacuuccccugaaaucuauugucagcaaguauagugcuuuuccccagcuugggcaaccuucuggcaggcugcacauuggaccucugugaaaggcuguagcacuucaugugcuguugauuuugguuccuuaagaguagaguguugcaugggacgaugguguggaagaaaggaugggagaauggggaggcuggauucuaacacuaauuaguucuacagugcaccaacuuauuuugaaaaaccaggcaacuucugugcuaacgcugccguggcuauaaaaccaggagacuaaauaaguuuuaucucuaucuaaagcucugguauuuguagcacacaugccaugaagaggcaagagucaugacagcaacacaaagucagaucugcccagcucuccagagauauuccccaagucuuccuuggaaaugauguuuugcuucuccaaaacuggggagaccuuauuuguucaaguugguacugguguuucuugcuuuuccccuucuguacuuacuguuaacauacacauuuugcuuucuucaugaacgcuaagcuccuucaaaacaugguccaucuuuugaucucuugccacgucuagcccugguuccauaaauacuugcuaaaugaaucaaugauccucugaaaagugucugacuagcuuuccauccaaauaauuauucuuucuacuucaaagauaaaauugagacccaaacacuccagcuuauuuaucucaguuuacaaaauugaagucucaguuacaaaguccuuagaguaaugaacuguucuuucauaaaccuucacagacauccauucugaggacuauuccauuaauaucaaaacaaugagcaauaguaacaacaguaacaucaauaaugauaauaccaacuacaccaagaaaaauaauaauugaauguuuugacugggucaccuuucuagcucagaacaugcuuuuuagggaaauauuucagaucuaaacuaaguaaaaucagaaggguuauuucuuauauuauuucccuacaaaguauuauuuuuaaaauauggucacugguucuauaaccgugcugaccucuauaugugauuuuucauucauucacuugccaaacauuaaauaucgugacucagauguaaggcaacagaacacagauaugaaguugcgaauaauaugaucuuuucaagagcugacagugcagaagugggaagaaaccauagaaacagcaguuggauauaggaugagauuccgaaugcagacaaacucucacuuuucgggacacgagcucuaccugucaacuggcaccgcagucauuuaacuuaucuuacuggaaauuacugauguugaagaccaaccauuaaaaguacaaagacaugugcuaugaagucuuucuacaaggacucuucucuuguggcauagcagucuggcucaaggcagggaaauucaaacagaggagagacaguccgucuacauuccucuuucuuuugagcauggagggauuccuuggagguuggugcuaccgagaccuaauucugugugagaggcuuaacccugacaacuaggucuccuuugucccaaccuucagcacaaauguuuugccucacauuuccaauagugacaguugcaaguguuagaaaagcuggccccuaguaagccuaacuuacuaccugugagguaagguuuuuauauuuuguucucaaaauaccucuuuugggggagggucugauaaagucaauauaggacauuauaaagauauacacauauauuauguaaaugauaauaaaugaaagcaucugaauaaugcuaauacgaaacaauacuauucaaaaagaaguuuaauuacuacugugguuuugagguuguaaagaguaucagcaauauuuugggauguacaaaucaacaaaacuuucaaacagcuuuuuuauucuacacaauuguguuaagacuacuauuaucugauacauucauggcuaggaugggauauuuucacuacagacugguagaauucaagauguaauugugggaaccauucaaauucucagacucugcuaaauuuuugugagacuucuaauguaaaaaaacaucuagauguuuuaaacaugcccucuaaccuuggcauggugcugcaggucuaguauucaagaaucugaggcaagagagacagggcugugaguucuguucuagccugagcuacauaauaagaaccuguauagcaaaacgaaugaacaaacaaacaaacaaaaucaaagcaaacaaaaaccugcuaucugaaauuaauacugagcaaauucauguuccaguuucucuuaaauuaaguuuuucaucugaaagugaugacaauuccccccaauuuuucagugauguuacuuucuucuucaucaugaggaauuucuaaacuuucaaauuaaacaauauaaccagaaagugagcuuguguuccagacauaacaaggagccuucaucauggaagauaacacucuggcaucaucuaauacauuuuccugcacuuggaaaauaaucuaucagaauaguggacuucauauuuuuaaugcuuaaagagaaauauguuuguaaggagaacagauuuuuaauauuugcuugacuuucuuaccagaauaagcauuaagguguuagguacauuguggcacagaaagcaaaagaggaaggaaagagggaaugagggagagacuaaggaagggagacagggagggagggagggaaaaguaaggaagaaaggagagagagagaaagagaaagagagagaucacgacagaguuugucauuuauuuaacuucugguagauauguauguuugaaacauuuguagaccauaucuccuuggagauaaagaacagucuccuauccuagcucuaaauuagguauagcuggaucuuaguggacucagaccagauacaguuuguuaugcaccaguucuagucugggaaauaaaacauugaauaagaaucauucuucauccucagggaucauuuacaaguugaauggaagauguaagcaaaaacucacccaggaagucucaaccuccacuuaacuggauggagugguaugugggacaaauguagaaggaagugaagaaaggauuuaaauggcuuaagguacaauagaguuccuguugucaaccagcuuccuuaauuaagcaagauugacacuguauuuucagagugucguggauuaugacucgcaucaaauaucucuugucuuuccuauguaugauacuccacucucaagggcauucucuuuccuuuacuguaauaaccuauauccuugcagaguguucucuagaucacaacuucucaguaccuacuuaggaauacuugagggaaggguaaggaauguggguuugaaagagaagggcugcaacaguuugacuagugguacuguguguguguguguguguguguguguguguguguguuuuauggaggguguuggaagccacaauacuauuucaggugcuguuuaucagaugccaucuaccuugauuuuugagacagagacucucacuggccucaugcucaccaagcaggugagacugaacgaucagcaagagcguagaucuaccuuucucuaucuccucaguucuggaaauacaaacacacuuuggccuaucuaucuuucgaucuaucgaucuaucgaucuaucuaucuaucuaucuaucuaucuaucuaucuaucuaucuauauaucuauauaucaucuaucuauuuaucuucaucuaugugauaaucugaaagcucaaaguguugauuaacucaucugcaaaauggggaugcuucugaugcugauaauagcuccuguguuuguacaaaccacaugauagcuaugaaaugguuagcagagucacauuugugacagcuguuuuuacagaaagaagaacagagcugaagucuaagacuaguaugaagcacaaugauacacucuuguuuauuuaguacaaagaacgaacaugggggaagugguaguuuucccagggaaagaugugaacaugaaaaccaaguugccugacuuuccagguuuaaauaucuuucacaaugcauagauaaucuucuucuagaucaacaaaguacuaauaugauuuuacuuucugaaccaagcaacauuucuaguuugccuccuccaaagauuagggacaaaucgaacucaacgacguucauauuguuuguugagaggaauucucaaagaugcauacuugaauccacaugccuguguugugcaaacauuuucauaaaggauaguuuugaguagacucuuugaguagaggagguggucccaagacaugaaacaugaucuuauucaagagacuggcauagcuauagcacucaaacagacuucaguuugaguaugucuucauguguuuagucuaugaaaaacagcaugaacauguaacugaugcacucguuuguauaugcacuaaaauaaaucaauauuaacagcacauauauaauucucauguuauuacacaaagaggcucaguagcuaucugagaaauccuugcuuguaugauugaaugaacaguuauauuugcagcuauucaauguugugguuacauaaacacucacuaauaccugcauuuuuuuuugauggggaccaaauucacugaucugaguaaauaugccucuugcuaucuggcacauggcaugcauucaccaaauguuagaugaauuguaguuuuucaaaugaguaaaagggauggggaauuaaagaucuccugaaaagcuggagaaacuuagaugccuagcaaaggugauugguggagaaaucacguuuuuuuccauuuuuuauuagguauuuagcucauuuacauuuccaaugcuauaccaaaaguccccauacccccacccacucccccuuuuuggcccuggcauuccccuguacuggggcauauaaagucacauuuuuacaccuacuuaguucuacacauuuaucggcuuuucuccaaugcaacuaaaguaauuagaaaauaugacaacauucaugguauaauugcauaaaagagguuagaggcaaauacagguucacggaugaauaggcuggcuuccuuucagccuuaagucaugguuacagagccagguugaauuauauuuuuaaggcacacaauaucucaccuagacaaugucgggcuagaauuucacaugagagcgucaggugguccccugcccugugucuucucucccacuugcugagacacugaauauacaacaagagaggagaacgguaugcugagaaccuguacuagcccauaccaugaaagucacauucgagaacauuuguguuguuggugucacauucuucaagaccuucccuucuagagaacuuuccuaaagcuaugcauuuccucucuuuuugauucccuugcaaaaaaaaaaucauaaacagccuuuuaaugaacucuuugcccaaaugugucuuuuuauuaggguuauuauaccagccagaauucuccuaccauaguuuuuuuuuucuuuuuuuuuuaauuucaaaguagucuuuagaaaaaggggggaugugcggugguuuguuugacuaucugaaaggaguaggugugugggaugcugagccacagugaacuggaagcagcaaaggagcucuggaucuuagaccagagguuauaaauuaucccccagugucugggcuuagccuuuucucucuuccuugcuauccuccacucuugcagaaacguacuugguuccacaaggacccugaauaaaucuauccuuccacagagcuucagcauggaggcauugcacaguuccagagagcaaggaggacuaugccagaaacccauucagcuaaaaaacgggggagaacagagacacacaaugaccucacucuucucccagacacuaaagaauuuuaaucuuauccuugaaaccccuuuucuuugacucagggacaacccaccuugagcagaguacauggcccuggagaaaagaagauaugagugcuuucaagggcucauucacgcacacaugggcagcucccugagcucggagucaugcuuuccugacaaaaaauaccuuuucuuuccuuucucugaggcaucuauccuuaauccaggccaucucacucacagagaagcaaggcauucccagaaugagacuucucugugaucuccaguguggauucuaaaaccccacuuggugcuuucuucucagccuucauauacaauagugagcuguaugguggaugaccuaaagaaaacagacacaggauccccaagucuaacaucucuaaacugcuaaaugacacccgaggaggacaccuggcuacuuagcugucagcacugccagucacacccuauaacagugaugaacucuuucuuuuaugaacuuuuagaguaucuccaaagauagaaacagcacaagaaaggacuaagcucagaaacugaagaauaauguaagauuuaucaccucuggucuaagacccagagccucuacugcugcuaccaguucuaacuccaaucacuacgaauuagaugauaauuaggaaaggcuggguguuuaagcaucucugggccuagagguagauacuugauucuugguuuguuagcauaucuuagauucugccuaucacugaagcagcucauuccucaucucucauuuuagaagcccaguuuucaaaaguaucacugauuaugcagaggccuugaacuuacacuugagacacacaguaaugguugguuuugcugaugaaacagcaacaaacaaacaaauaaaaaauauuauucguggagaagccuuaaggaacaccaaccuuccuucuucccucuucccuguauuuaauuucucauucuuucaucuucuaauaguauaaagacugcuugauuagagucaacaagugaaguuagcgaaaagaaacugaagcugagcucccuauuaaauaguugguugcucuccuuauuucuggcaacuccaacugugaagcaaaacuagcaaaaaaaaaaaaucccucugggugacauaucucuucucuagacucuacacuguguuuucuagaaggaagagaguacauagauugaacaggaauuuuguaggcauugggaaauugguacaagcacaugaagaagcagcaucauaguuuucagaguuugcaugcugcccucuucuggcuucuauguccaggcuugucagcacaucaaaaacuguuuauuucaaccccacaccuguguguaguauaccugggaacacagaaaagaguguugaaaauauucaggacaucgcaucaaaucuauauccuugaagcuaaccagaggaacuugacucauuuucccucuggcuccuggauucccauuugaggcuguccaccgucacagagucucacuucacauucuuguugcgugagacaucuuauucuccacccucuuaacucccacacggcucugggacucaucucuaccaauuagugccccaccaagggcugggacugucaaugugcuggagaggcaaggagauuuuccuacuagaagucaugguaguggcaaguacgccaaagagauagguuaguguugcaacaaauggucuaaggaccacauuuuuguagccugacaugugaucagguuugguuuuauacauuauuaaguccauguguacaguucuuagagacaagagaguuaugugauaggaggagaagcagguaauugaagaagcagaugccaccaucgaucaaauuuauaauuacaugucuuccucuucuacgcaauucgucuuacaugcugguccuuugugcgacuggucagaagcccaauauggggcacauuuucuuggguuggaauaauucauugcuguucuccuaacugcuugaaagagucuaacauagugcucuugccugccaccuggcauauuugcugucauugcacuggagcacaaaccuggcuaacccagccugcagugugcccaagagacuguggucuaccaugguuuacucuuggaccaggcaauacaaucaucucauaucaguagaacccaggacccaacucaggauucaaaaccauucucuugaaucaaaagagagcuaagguggagauguuuuaaaauauuugaaggcaugugauuuguuuaaauuauaccuuacauaguuugaggaaaucuagaucucuggcuggcuauuguaagauguaaagagaaugaggaucggagugccucucuccauaaaaaugauaagcaaaaaacagugaauaaccaaaacgcgguguauguauaugccuagacccccauccagauauagacauguaucugaaagccacucauauaucucagccuauacaaaacgacuguacucucacuuagucaaugcaauguacccagcauggcuuuggaguugaauggcaaggagaaaugaguuauaggauacugacaaauacucaugacaaaacuauccaggcuugcaggaugucucagcggcaccagccugacggccuggguuugcuuucaagaucccaauauggaaggagagaagugguucccuaaaguuuuucuauuagcuccuuacaugcgcacacucacacacagacacacacacaccaacaguaauaauaauaacaauuauuauuauuauuaagcucuuguaacuacaaauagacuuaaguugggugaguugcaugcaaugacuagugaacauuuuacaaucaguuucucagaggauguuaaggaugagauauauuucucuacaguacuaacauguucuuccuuaaacauagcauuuacccagcacaucuauugccugucaagacuuuuuuaaaaaaaugucccaugugaucacucgcuuuggucaaagggcaaaaaugugacauuuuccuaacuccacaguagaacgacgcaugcauucuuccuaaugacgaaagaacacagccaucugauuaaaagaaaaugggucgacguaaacgcuccacggugauaugcaaagugaauagcuuucuuauaacuuccuuaucuugcuugggcaggcacaagauuugggauaagggcagugcuggaacucaggaaccggaggggggaugagccagcucugaacugucaaugaaugggucuccaucagcaaauaccaggagcugacugaguagagcguuccucagauucugcaucugauggcccacgugacauccugaagagaccccuacucuguauccccauuccaggaaaagcacuucguacagaggcuaaggcugugaauaucagcccugaggacuguccaggaccaguccuuuaucacaauuacucacucagucccguuggcuuuuccaggaagauggaacugauuaagcaauguuaauugaaucauaaguaaucaacaugggggaaaaauuacauaaccagcuucaaaauugugaaucaaacauggcaaauucccaggaaaauagcuauuuuaucgccccccccuuaccuuucaccucaaaaauaaacacagagaaaucuauaccuuggacgauuaaacaaaacuacgaacuacacauuucauugccuggaaauguuuauauuuuguacaaaguuuuucaguucauaguuuuaauuauguagcccaggcuggccuggaacucacaauccuccugccucagccucuugaguacugggaucaauucguaugcuuuuaaccuaauuugagagaguuuagaacucauccugucaggggugcugaaagacaaauguaucauuaauugaucagugaagguaagacuaugacaacugcauuuuuuguuuuuuguuuuuuacuugcugucucccuucuuuccuucucuccuucagacacagccuaaauacauagugauauuucagccaugaggcuguauccacuuugguacaugcuuaggaaaucaagaccaugcccaaauccucuguggcuuccugauccuacagggaacacauuaacauauuagguaggcugacuauauucaaaaccugcuuucuaaacaauuacauguugggucaucauuagaaugcgggucaccaaggggaacccucacuacaaugugcagauacugguguuauuuauuuaauuaguuaauuuaaagaucgcugugaaguuuaaaggucugggcuuuccaccuacgcagaauccaauaggugaauccaccugguggccccagccacaugaaagcaguguaacucagggggcauucacucggcacuucucugcgaaccagccagccccgcggacagacgugaaucuacccuaggugccuuagaaaggcagaagauagaaaccugugcgcagucagauagguugugacaagccgcauaccugcaaugacgagauggaagccuccuccucgguucccuugugugucucccugucccucuccucucugugaaugacaggauccacagcgggcugugcgccguaucgucgggggcagccgcagccugguucugcaggaggccugggaagcagcgagggugugcggagcgagcggagcccaguggagcgcacagagggcggagcgcgucccagccgcgccugcagauguggaaggagcuggagacagcacugaguccucuaggcgcugcaug

SEQ ID NO: 534 - RNA, 88058 nt, Mus musculus
caugcagcgccuagaggacucagugcugucuccagcuccuuccacaucugcaggcgcggcugggacgcgcuccgcccucugugcgcuccacugggcuccgcucgcuccgcacacccucgcugcuucccaggccuccugcagaaccaggcugcggcugcccccgacgauacggcgcacagcccgcuguggauccugucauucacagagaggagagggacagggagacacacaagggaaccgaggaggaggcuuccaucucgucauugcagguaugcggcuugucacaaccuaucugacugcgcacagguuucuaucuucugccuuucuaaggcaccuaggguagauucacgucuguccgcggggcuggcugguucgcagagaagugccgagugaaugcccccugaguuacacugcuuucauguggcuggggccaccagguggauucaccuauuggauucugcguagguggaaagcccagaccuuuaaacuucacagcgaucuuuaaauuaacuaauuaaauaaauaacaccaguaucugcacauuguagugaggguuccccuuggugacccgcauucuaaugaugacccaacauguaauuguuuagaaagcagguuuugaauauagucagccuaccuaauauguuaauguguucccuguaggaucaggaagccacagaggauuugggcauggucuugauuuccuaagcauguaccaaaguggauacagccucauggcugaaauaucacuauguauuuaggcugugucugaaggagagaaggaaagaagggagacagcaaguaaaaaacaaaaaacaaaaaaugcaguugucauagucuuaccuucacugaucaauuaaugauacauuugucuuucagcaccccugacaggaugaguucuaaacucucucaaauuagguuaaaagcauacgaauugaucccaguacucaagaggcugaggcaggaggauugugaguuccaggccagccugggcuacauaauuaaaacuaugaacugaaaaacuuuguacaaaauauaaacauuuccaggcaaugaaauguguaguucguaguuuuguuuaaucguccaagguauagauuucucuguguuuauuuuugaggugaaagguaaggggggggcgauaaaauagcuauuuuccugggaauuugccauguuugauucacaauuuugaagcugguuauguaauuuuucccccauguugauuacuuaugauucaauuaacauugcuuaaucaguuccaucuuccuggaaaagccaacgggacugagugaguaauugugauaaaggacugguccuggacaguccucagggcugauauucacagccuuagccucuguacgaagugcuuuuccuggaauggggauacagaguaggggucucuucaggaugucacgugggccaucagaugcagaaucugaggaacgcucuacucagucagcuccugguauuugcugauggagacccauucauugacaguucagagcuggcucauccccccuccgguuccugaguuccagcacugcccuuaucccaaaucuugugccugcccaagcaagauaaggaaguuauaagaaagcuauucacuuugcauaucaccguggagcguuuacgucgacccauuuucuuuuaaucagauggcuguguucuuucgucauuaggaagaaugcaugcgucguucuacuguggaguuaggaaaaugucacauuuuugcccuuugaccaaagcgagugaucacaugggacauuuuuuuaaaaaagucuugacaggcaauagaugugcuggguaaaugcuauguuuaaggaagaacauguuaguacuguagagaaauauaucucauccuuaacauccucugagaaacugauuguaaaauguucacuagucauugcaugcaacucacccaacuuaagucuauuuguaguuacaagagcuuaauaauaauaauaauuguuauuauuauuacuguuggugugugugugucugugugugagugugcgcauguaaggagcuaauagaaaaacuuuagggaaccacuucucuccuuccauauugggaucuugaaagcaaacccaggccgucaggcuggugccgcugagacauccugcaagccuggauaguuuugucaugaguauuugucaguauccuauaacucauuucuccuugccauucaacuccaaagccaugcuggguacauugcauugacuaagugagaguacagucguuuuguauaggcugagauauaugaguggcuuucagauacaugucuauaucuggaugggggucuaggcauauacauacaccgcguuuugguuauucacuguuuuuugcuuaucauuuuuauggagagaggcacuccgauccucauucucuuuacaucuuacaauagccagccagagaucuagauuuccucaaacuauguaagguauaauuuaaacaaaucacaugccuucaaauauuuuaaaacaucuccaccuuagcucucuuuugauucaagagaaugguuuugaauccugaguuggguccuggguucuacugauaugagaugauuguauugccugguccaagaguaaaccaugguagaccacagucucuugggcacacugcaggcuggguuagccagguuugugcuccagugcaaugacagcaaauaugccagguggcaggcaagagcacuauguuagacucuuucaagcaguuaggagaacagcaaugaauuauuccaacccaagaaaaugugccccauauugggcuucugaccagucgcacaaaggaccagcauguaagacgaauugcguagaagaggaagacauguaauuauaaauuugaucgaugguggcaucugcuucuucaauuaccugcuucuccuccuaucacauaacucucuugucucuaagaacuguacacauggacuuaauaauguauaaaaccaaaccugaucacaugucaggcuacaaaaaugugguccuuagaccauuuguugcaacacuaaccuaucucuuuggcguacuugccacuaccaugacuucuaguaggaaaaucuccuugccucuccagcacauugacagucccagcccuugguggggcacuaauugguagagaugagucccagagccgugugggaguuaagaggguggagaauaagaugucucacgcaacaagaaugugaagugagacucugugacgguggacagccucaaaugggaauccaggagccagagggaaaaugagucaaguuccucugguuagcuucaaggauauagauuugaugcgauguccugaauauuuucaacacucuuuucuguguucccagguauacuacacacaggugugggguugaaauaaacaguuuuugaugugcugacaagccuggacauagaagccagaagagggcagcaugcaaacucugaaaacuaugaugcugcuucuucaugugcuuguaccaauuucccaaugccuacaaaauuccuguucaaucuauguacucucuuccuucuagaaaacacaguguagagucuagagaagagauaugucacccagagggauuuuuuuuuuuugcuaguuuugcuucacaguuggaguugccagaaauaaggagagcaaccaacuauuuaauagggagcucagcuucaguuucuuuucgcuaacuucacuuguugacucuaaucaagcagucuuuauacuauuagaagaugaaagaaugagaaauuaaauacagggaagagggaagaaggaagguugguguuccuuaaggcuucuccacgaauaauauuuuuuauuuguuuguuuguugcuguuucaucagcaaaaccaaccauuacugugugucucaaguguaaguucaaggccucugcauaaucagugauacuuuugaaaacugggcuucuaaaaugagagaugaggaaugagcugcuucagugauaggcagaaucuaagauaugcuaacaaaccaagaaucaaguaucuaccucuaggcccagagaugcuuaaacacccagccuuuccuaauuaucaucuaauucguagugauuggaguuagaacugguagcagcaguagaggcucugggucuuagaccagaggugauaaaucuuacauuauucuucaguuucugagcuuaguccuuucuugugcuguuucuaucuuuggagauacucuaaaaguucauaaaagaaagaguucaucacuguuauagggugugacuggcagugcugacagcuaaguagccagguguccuccucgggugucauuuagcaguuuagagauguuagacuuggggauccugugucuguuuucuuuaggucauccaccauacagcucacuauuguauaugaaggcugagaagaaagcaccaagugggguuuuagaauccacacuggagaucacagagaagucucauucugggaaugccuugcuucucugugagugagauggccuggauuaaggauagaugccucagagaaaggaaagaaaagguauuuuuugucaggaaagcaugacuccgagcucagggagcugcccaugugugcgugaaugagcccuugaaagcacucauaucuucuuuucuccagggccauguacucugcucaagguggguugucccugagucaaagaaaagggguuucaaggauaagauuaaaauucuuuagugucugggagaagagugaggucauugugugucucuguucucccccguuuuuuagcugaauggguuucuggcauaguccuccuugcucucuggaacugugcaaugccuccaugcugaagcucuguggaaggauagauuuauucaggguccuuguggaaccaaguacguuucugcaagaguggaggauagcaaggaagagagaaaaggcuaagcccagacacugggggauaauuuauaaccucuggucuaagauccagagcuccuuugcugcuuccaguucacuguggcucagcaucccacacaccuacuccuuucagauagucaaacaaaccaccgcacauccccccuuuuucuaaagacuacuuugaaauuaaaaaaaaaagaaaaaaaaaacuaugguaggagaauucuggcugguauaauaacccuaauaaaaagacacauuugggcaaagaguucauuaaaaggcuguuuaugauuuuuuuuuugcaagggaaucaaaaagagaggaaaugcauagcuuuaggaaaguucucuagaagggaaggucuugaagaaugugacaccaacaacacaaauguucucgaaugugacuuucaugguaugggcuaguacagguucucagcauaccguucuccucucuuguuguauauucagugucucagcaagugggagagaagacacagggcaggggaccaccugacgcucucaugugaaauucuagcccgacauugucuaggugagauauugugugccuuaaaaauauaauucaaccuggcucuguaaccaugacuuaaggcugaaaggaagccagccuauucauccgugaaccuguauuugccucuaaccucuuuuaugcaauuauaccaugaauguugucauauuuucuaauuacuuuaguugcauuggagaaaagccgauaaauguguagaacuaaguagguguaaaaaugugacuuuauaugccccaguacaggggaaugccagggccaaaaagggggaguggguggggguauggggacuuuugguauagcauuggaaauguaaaugagcuaaauaccuaauaaaaaauggaaaaaaacgugauuucuccaccaaucaccuuugcuaggcaucuaaguuucuccagcuuuucaggagaucuuuaauuccccaucccuuuuacucauuugaaaaacuacaauucaucuaacauuuggugaaugcaugccaugugccagauagcaagaggcauauuuacucagaucagugaauuugguccccaucaaaaaaaaaugcagguauuagugaguguuuauguaaccacaacauugaauagcugcaaauauaacuguucauucaaucauacaagcaaggauuucucagauagcuacugagccucuuuguguaauaacaugagaauuauauaugugcuguuaauauugauuuauuuuagugcauauacaaacgagugcaucaguuacauguucaugcuguuuuucauagacuaaacacaugaagacauacucaaacugaagucuguuugagugcuauagcuaugccagucucuugaauaagaucauguuucaugucuugggaccaccuccucuacucaaagagucuacucaaaacuauccuuuaugaaaauguuugcacaacacaggcauguggauucaaguaugcaucuuugagaauuccucucaacaaacaauaugaacgucguugaguucgauuugucccuaaucuuuggaggaggcaaacuagaaauguugcuugguucagaaaguaaaaucauauuaguacuuuguugaucuagaagaagauuaucuaugcauugugaaagauauuuaaaccuggaaagucaggcaacuugguuuucauguucacaucuuucccugggaaaacuaccacuucccccauguucguucuuuguacuaaauaaacaagaguguaucauugugcuucauacuagucuuagacuucagcucuguucuucuuucuguaaaaacagcugucacaaaugugacucugcuaaccauuucauagcuaucaugugguuuguacaaacacaggagcuauuaucagcaucagaagcauccccauuuugcagaugaguuaaucaacacuuugagcuuucagauuaucacauagaugaagauaaauagauagaugauauauagauauauagauagauagauagauagauagauagauagauagauagauagaucgauagaucgauagaucgaaagauagauaggccaaaguguguuuguauuuccagaacugaggagauagagaaagguagaucuacgcucuugcugaucguucagucucaccugcuuggugagcaugaggccagugagagucucugucucaaaaaucaagguagauggcaucugauaaacagcaccugaaauaguauuguggcuuccaacacccuccauaaaacacacacacacacacacacacacacacacacacacaguaccacuagucaaacuguugcagcccuucucuuucaaacccacauuccuuacccuucccucaaguauuccuaaguagguacugagaaguugugaucuagagaacacucugcaaggauauagguuauuacaguaaaggaaagagaaugcccuugagaguggaguaucauacauaggaaagacaagagauauuugaugcgagucauaauccacgacacucugaaaauacagugucaaucuugcuuaauuaaggaagcugguugacaacaggaacucuauuguaccuuaagccauuuaaauccuuucuucacuuccuucuacauuugucccacauaccacuccauccaguuaaguggagguugagacuuccugggugaguuuuugcuuacaucuuccauucaacuuguaaaugaucccugaggaugaagaaugauucuuauucaauguuuuauuucccagacuagaacuggugcauaacaaacuguaucuggucugaguccacuaagauccagcuauaccuaauuuagagcuaggauaggagacuguucuuuaucuccaaggagauauggucuacaaauguuucaaacauacauaucuaccagaaguuaaauaaaugacaaacucugucgugaucucucucuuucucuuucucucucucuccuuucuuccuuacuuuucccucccucccucccugucucccuuccuuagucucucccucauucccucuuuccuuccucuuuugcuuucugugccacaauguaccuaacaccuuaaugcuuauucugguaagaaagucaagcaaauauuaaaaaucuguucuccuuacaaacauauuucucuuuaagcauuaaaaauaugaaguccacuauucugauagauuauuuuccaagugcaggaaaauguauuagaugaugccagaguguuaucuuccaugaugaaggcuccuuguuaugucuggaacacaagcucacuuucugguuauauuguuuaauuugaaaguuuagaaauuccucaugaugaagaagaaaguaacaucacugaaaaauuggggggaauugucaucacuuucagaugaaaaacuuaauuuaagagaaacuggaacaugaauuugcucaguauuaauuucagauagcagguuuuuguuugcuuugauuuuguuuguuuguuuguucauucguuuugcuauacagguucuuauuauguagcucaggcuagaacagaacucacagcccugucucucuugccucagauucuugaauacuagaccugcagcaccaugccaagguuagagggcauguuuaaaacaucuagauguuuuuuuacauuagaagucucacaaaaauuuagcagagucugagaauuugaaugguucccacaauuacaucuugaauucuaccagucuguagugaaaauaucccauccuagccaugaauguaucagauaauaguagucuuaacacaauuguguagaauaaaaaagcuguuugaaaguuuuguugauuuguacaucccaaaauauugcugauacucuuuacaaccucaaaaccacaguaguaauuaaacuucuuuuugaauaguauuguuucguauuagcauuauucagaugcuuucauuuauuaucauuuacauaauauauguguauaucuuuauaauguccuauauugacuuuaucagacccucccccaaaagagguauuuugagaacaaaauauaaaaaccuuaccucacagguaguaaguuaggcuuacuaggggccagcuuuucuaacacuugcaacugucacuauuggaaaugugaggcaaaacauuugugcugaagguugggacaaaggagaccuaguugucaggguuaagccucucacacagaauuaggucucgguagcaccaaccuccaaggaaucccuccaugcucaaaagaaagaggaauguagacggacugucucuccucuguuugaauuucccugccuugagccagacugcuaugccacaagagaagaguccuuguagaaagacuucauagcacaugucuuuguacuuuuaaugguuggucuucaacaucaguaauuuccaguaagauaaguuaaaugacugcggugccaguugacagguagagcucgugucccgaaaagugagaguuugucugcauucggaaucucauccuauauccaacugcuguuucuaugguuucuucccacuucugcacugucagcucuugaaaagaucauauuauucgcaacuucauaucuguguucuguugccuuacaucugagucacgauauuuaauguuuggcaagugaaugaaugaaaaaucacauauagaggucagcacgguuauagaaccagugaccauauuuuaaaaauaauacuuuguagggaaauaauauaagaaauaacccuucugauuuuacuuaguuuagaucugaaauauuucccuaaaaagcauguucugagcuagaaaggugacccagucaaaacauucaauuauuauuuuucuugguguaguugguauuaucauuauugauguuacuguuguuacuauugcucauuguuuugauauuaauggaauaguccucagaauggaugucugugaagguuuaugaaagaacaguucauuacucuaaggacuuuguaacugagacuucaauuuuguaaacugagauaaauaagcuggaguguuugggucucaauuuuaucuuugaaguagaaagaauaauuauuuggauggaaagcuagucagacacuuuucagaggaucauugauucauuuagcaaguauuuauggaaccagggcuagacguggcaagagaucaaaagauggaccauguuuugaaggagcuuagcguucaugaagaaagcaaaauguguauguuaacaguaaguacagaaggggaaaagcaagaaacaccaguaccaacuugaacaaauaaggucuccccaguuuuggagaagcaaaacaucauuuccaaggaagacuuggggaauaucucuggagagcugggcagaucugacuuuguguugcugucaugacucuugccucuucauggcaugugugcuacaaauaccagagcuuuagauagagauaaaacuuauuuagucuccugguuuuauagccacggcagcguuagcacagaaguugccugguuuuucaaaauaaguuggugcacuguagaacuaauuaguguuagaauccagccuccccauucucccauccuuucuuccacaccaucgucccaugcaacacucuacucuuaaggaaccaaaaucaacagcacaugaagugcuacagccuuucacagagguccaaugugcagccugccagaagguugcccaagcuggggaaaagcacuauacuugcugacaauagauuucaggggaaguuuuauuauuguuuaaauggaggaucuuagcuuucuccuauucauuucaguacugucuuaggacucaucucagagcuuagacuccccaaggcuaagauccaaugaaacuaucucaaucucaucuagaaaaccagcaaugucuucaucugggcugggggcuaauguagcaauggcaaccacugccuuucccucuuggauuuucaggcacuggagugaguuugggauucccuaaaugaaugcaaugacucuccuccucccuucuguuuggacuaaaggauuuguauagcauuagaauggauuaucucugugauccaugugcucaaguugucucccacucccaaaccagugucuccuguaaccuaaaugccucauuuggacuggcuuauuugaucauacuuagaauuccuuuaaguagcagaugaaaccucuggacaggacucaggaaagaaaugagucugucagagucuacucucaaucauugguggacaagaggaacuagagaaagcacccaaggaacuaaagggaacugcaacccuauagguggaacaacaauaugaacuaagaaguaccccggagcucuugacucuagcugcauauguaucaaaagauggccuaauaggccaucacuugaaagagagauccauuggacuugcaaacuuuauaugccccaguacaggggaacgccagggccaaaaagggggaguggguggguaggggaguggggggguggguaugggggacuuuugcuauagcauuggaaauguaaaugagcuaaauaccuaauaaaaaaugggaaaaaaggaagcacuuggcacuuuuuagucagacauauagauagaauauacaccauagcauauauaccacagccagacaucucccugggaaaggcuucccaauaaauaguggacacaacuuucaaccaaccauuauugguuggugagagaauggacgguuggguaggaagauggauguccaggcagauugguuggaugagguauagcaguccagugucuccaggugacucagcaggcaaauggacucuuccuaguagaccaaguuuuauccacugaagaagcagcaaauguauccagggaagaacacccauauuucaugguagcuccauucacacuuguccaauuccagucaagguaacaugccauugccaaagagaaaugugccuguggaaaaauagaccaacuaauaccaaguuuuauuuuuauagaaauugggagcaaacauuuucaauucuauucuuggagucgaaugagacaccacugcagaugacugaugugugaauaggcaccauauggauuuguacaaagggaggaaaauaauccacaguuguaaaaauaucucuggucuucuuacuggugauaugugcccacauggcucugucaggugguuucgcuauauaagagauuauuccuggacuaauagaaaaauuuuccuuuuauagugguuguaugcuuucccauauuaucaucguagcaugcaaaaaucucacaacuucagaaauucaaaagaucaaaggcagagaggccacuaagcucucugcacccaccacacaccagcacaauaguuuggcuacuagaaaugcuuuucguugcaacacaaaaguggacuuuuauaaucaccgagcagcacugugaaagcugauaggcauuccuaauucuuccauuagauauugcccuuguuguuugauggcaguaaaauucagauugucuccauaugaugaaaugcuggccagcugaggccuggagcucuagaguugauauuaacugcagugguguuggacugauuuucuguuucaaaugacagccagagcuaucaaauaaacccagugauauuuauuaggguggcuucugaauauacagagugugauucaugacagagacuaaucuugcuaaaguaaagggaaagauguuuuccaucugcauagcugccucaguagcuggcauagagcagacagucagaccacauuggguggaugcuuaaagaccuuacagcaugaagauuggaaguaaaggucucuguugaaacgugacagagucacagacggugccaacaguuuggucagugguuuagaauguaagcccuuuugucaacguucugauuuugcauguuucaucaauuuuuauugagcuuuugcaugugccaggcacuagaaauagaaaaaggauaggauauugcccuaccuuccaggagcucccugcuuaccuaugaaaauaagaaaguaaauaaaauaucaacaaguaaguaaggcaggcaagagcuacagauauaacccagugguuguacguuaccuagugugugccaaucccuacauuugcuccccgagacuacuaaacaaugaaguauaauauguaaaguaagccgaguacauaccuguaaucccagcauauucagaaugugaagcacaaggaucgauguacauuccaggcuaauuagugguacucucaagccucugucucaaaaauaaaaagcaagggcuuuuggagagguggcucaguggcuaagauugcuugcugcucuuccagaguacuucaguucuguuccccacauccaugccaggcagcauagacacauguaacagcagcucuggggaauauggugcccucaucuggcuucugcaggcaccugcaugugugagguauacacacacacacacacacacacacacacacacauaggggcggggugggggggagaacgggacaccaccaucaccaucaaaauagucuaaacagccugugagcaaagcaaauuggaacagggugaccauaagaauuugcaucucugguuuuucuuaacaagggugaucacguaagcaugcaccgugcugaagaauauugccagcucccaguccucagcaguguagagcuuucacacacccucucuucagcagguuagcuuauugguugucacgugucauuuuggaaugcaguuucuucccccacaguguccugugaaguuucaaugcuuagaguuagugguggcuacaccaucuggaugauuugcagacuugagccucgagagucaccuuuggcagccugugcucuccacacgcuaagcucuggcuauugucuuuugcuguauuccagagccaaaggccuuggccuugguuguuuuuguuuguuuguuugguugguugguugguuuugguuuugguuuuguuuaccugcuugauguccuguaacuccaaucauaaaaauccaaagaucacuggaauccaggcaaaucacagucagguguaacuccuuagaaaaauaugguccaaggaacaaugacacagaaaagucaccauguucuuuguuucuuguuucauaucugacauugccuggguuuuuaguguagaagagagcagggcccaacaggugagguguuuccagccucuguguacuugaacaccagccagaacacaggauugggaaagugacugcccagaggucagacuccccguuuuuuucccccuucuccuccacaagugcacaaggagcuaaccaaauguuuguuuuucuaucagagcacgaguuuggguacaucuacgugacuaacagcagcugaguggaaagccuguuucauaacagggccuuuaccugagugcguuaggcuguacuugguagcaugguuaacaaagaacauucaccucauaagagcagguuggugcccagcagugaccuuugguaagcagcgagugggauagucaagguuaggauuggccccuggagaaacacaggggucccuucaaacacaaguuuuccuucauggcaaagaauguaugaaauaaugcauuggauuugggauuuggcauuucacuagaaggcagaaagaccaucucuucacugaauugaggaaugucccugguaccccaguaacaaguagaacaaagucagugucuauugaucaguaagccccuucaaaacuaacaacugccacggcugauuuggcacucauuaugccaggaaccaagucuaaucuuccaaaugcauugcagacggugaauauccguguucuucgcaagaagagugucaaguugacgguccuucaucaaaaauuagcucuguaucuuguccaugaaccaccaaacacuuguucugggccuccaugcugggcucugacccagguucaauguuaaaugcuaacuacaaucacauuuacuuuucaaagccacucaaagccgcaccgccaaucgugagggucuggcauccagaacagguuucaaagccugugcucucuguccauuugcuagaccugcuucagacagcuccaggaugcccaggaugcacaacuuggcccagguugccuucucucugggauuucuggagacucuuaauaaggaaugacacuuuuguugucuaagucagaacaugauuuggaaaguaaaauacuauagggcgauuuagugauugaucuaaaaguaaaauacuguggcuggauuguccacauuuucacaggagggaggggacaccagggaaauggggacacagaagggauggggcagacuucugagaaggcaaaaauaucaaagaaaggagcugugagcugguaaagugaacauccucuuugcucaugccuuuggugugggccaagcugucaggcacaugcuaaccugugugugcaaacucaacauagaauccuggggugguguucccucaaucaaggaugugcugaacagcacacaccaacuuuggucuucucugaaaauuuaguuuuggauuuauuagacuucuuuguugcuuucuggaaaguucuacccaugugggacuguccuucuaaucauucuaaauugcaaaggauuuuccaggucacuuuucucauccucuuagauuuccaucaaauauucaucccaaguuuauuuuucaggaaaacaaagacuaaagaacaaacugagucuuacccuuccauucuccugccagcuacaaagguuaagcauuuccucugcagaauggacuccugucacauauagcugcuggcuuagugcgcugugugcaucgcuggcuaaggaacucugauucugggaaucgagcugaugagacuguucugaaaacuagggugauuguaacauuuaucauccaaacuagauugcuuucagagcauaggggagggugcuauuaauaaacugcccgggacaacaagcagagcuggagcuguugcagggcaaaucaggacaugaaaaaaagugcauacuggucaauacuauauugucagcccuccaguaacacagucucggucagaccauaucuuauuuaauagacucugaggacaaucaugcccacucauuuacaaauauugagggccuacuguguucuugauguuccuaacugggggaagaucugcuagauuccccaagaaagauucacaguucagagaccaugaaaaugugacuugcagauauuugugcagcaacaguacuaaccaauucucuuaagaacuuuacucaugacaccugcucuguugauuuugcucaucaccuauuuaauccccacauaaucccaugaggaagaagacccagacucgguaaggugaauuuuuccaggguaccccaauauauagccaguggagacaguuaguucucaauguaugugguucugaaggcugagcucauaguaccaugccuuccaugguucuccacagagaacacaagauccaugccauuguacaggacccuagaguccacagaccacagaccagucucauucuccacuacucacugcugggaacacagaagggaggaaggcuccucaaaagaggggacaguugagaugagccugauuggacucucagagggcugaguggagacacgaaacucaguuucaagccucacaguuugggguauuggucaggagaguaaauuugucccugacaguacugguaagaggagaauaaugaaacuguacggcuuggcuccgccauggacagcaggaagggcccaaugucuaaagcaucaaagacacacauagagcaucacucacaaagacauuccuggggaaaggcucuguuccuuuucacaaccauugaauccuccacaucacugaggaacacauccaggaaaacaucagcagguucaauucaucagacaacaugaaacacgggagcuuuauuggagacaggaucacaucgaucccaggcucauagacccucagaauggcuaaguguucagggauauccugacaaucuuuugccuccacauccgaagugcugcaguuccagacucaucccaccaagccugguuuaaauggugcugagaacugaaccuggugcaucuuguaugcuagguaagcacgcagcccacugagcuccacuccauccccagcuaugugaacucggaagacagccgagaagcaucguuuccauuaagaaguuuuaaagcuuaaaauuauuaugucgaucucuuugaaaaguaucguuuaucuucaaaaugucugaaaagcuggcauuaggauuauucuuuuugcuacccauggguacaaacaaaguaguuacaggauaaucucucaucaugugaauggcauaugagaugaauuggagcucagaauucuagcuguguuaccuuuaaaaaucaugaaugcacucaucaguaaucguccauugcagaugaaauucaauuaaaaaaaucgucuuaagugguggcacacauccauauuaucauuugagagggaggauuauaauuuugaggcccacuugagcuacaaagaaagaugcugucucaaaaacaaaaucauccugcaucacucuucccugacacacugacaauugcucagauguauguuucacgccaggguaaagauggcucaucucccagcaucuuccucggaauugacaguucuucccacuguagcugggaguccagucuccuaucaucuaauuuuauaucuuuagaacaaaauuguaugauuuuauagccauuuguagacucuugauuaaaacaaacaaacacacaaacaaacaaacaaacaaacaaacaaaccaaaagccuauucaaacauuuuaaaagggaacuucguccuguggcagaguucugagccauuuacuuuccaucccgagcauuagaaguagcagcauaccuugcaggaaaucuagaagccagguuuucagggaugguccuggaccuacuagguuggaugcuagaaaugugucagaacuugacuagauggccugcguauacauguacacacccauuuaaaaaaaaacaaucaugguuaugacaaaacuaguuaugaccagucuuuaccagaucaucaggaaauuuaccagaccugucccuuaguugaaauaaugaccaggaaauguuggaaguggaagaugaaggaauaaaagaauaaagaaaucaagaggaauagccaccuaaaaguagugugagauuucuuuauacacacugggcaguaagauugauuccuacaagucaguaucuauugcuagacacuuaauuguguauuuaaacauaucuccaagcaacacaacuucuuuccuggccaauuaacuauauuuuauugaguucauuuauucaacaagggcaugcugaguccuccucuguacuagucagucugaaaagcucugggaagaugcuaauggacaggcaauguaugauucaugcucucagcagccaaugauagugucagagcuaaaaaauaaacauguacauauuaaaaaauaauguuagauaggcuauagaaaauaggaucagugagcggccagagaaauuucgucaagcaaguuucaguuaagaaaccaguauuguggaaggcuggcacacaccuauaauugcaaggagauucaccaguucaaggccaacccaagcuauuuaggaaaucccagggcagccuggauuucauagugagacuucauuucaaaguguuaaaaauaaaauggcugagcacagcaaagugaaaaacacccaauaaaagaaauauacaggccagcaagauggcucggugggaaagggggaagaagacuugaguccaaucuuugggaaacacacagggcaaaggaagaaguuauccaauuaguccucugacuuccccgugaaugccacagcaugugucaacuuacaggcuugcacacaaaaucaaucaaucaaucaaauguaauaaaauauaguucucagaucaguguucuuaaaguucagauccaucccuaugcaugcugcuucccugcucacagaacacuacucuccaaauagaaauuacuggacacugaggaugaaaaucuuucuccauaucacugcagauccauuucuucuaccucuguaugagcccugauaacccaccaucccuuucauuugagccagcauugcauucuucuauguuccuucuguucccagcucugcucucccccucccccacccaauauccgccuguugaaauccuacccaucucuccaggcccagcuuaaaggccaccuguuccagccagcuucucccucugccagaauuucucuuuccuuccuccauccuuccuaaggacuuugcaccucucccaggaugccuacuacacucugccuggaaucaugccuauuuaugcauaccaccacaugcaccaguagagccugcaggaggucagcugguccucaauuacaacucucugaucucagggcagugcacuguagagagacucaccucaggugccaagcuaacucaaauuuacugggggaacuagcccaaagaagcaggaagaugggagaagaaucagaaauaaauuguaggcauuaagcuguuaacuaccaucaaggaccauucugguugguuuugacucuuucaagugaaagaaaucacauucccauacauuuucuuacuguagguuuucauacuugcuuaucuuuuacaguggcuucuaagcuaaguuuuaauauaagggugugagcauuuggacagacacaaugaaugcagaauucuaaaaugucugaggcuucaggcaaggaaaccaucccucucuugcugaggaggagagcaguuaagacugcuuuauuuauuucagcccuucauacaucccaacucaccuuuauuucugacacacuaguaucauuuuguagauguguaauuauguagucagaaaggagagguuuuagauacuggcuugauuuuaauacccuacaugaacauguaccaccuuacccaagaaaaguguuuaacucagauuguuugcaauauuucauagauagauagauagauagauagauagauagauagauagauagauagauagauagauagauaaacagauggggcuaugacagcuccaaauucuuauaaauaugcaaaaugcugaagugauagaaauuaagaacaguaugguguugcuucauauauggacagaaauguuucugagaagggcuuuguuaggcaauuaugcuacugugacagcauuagaauguaccuacuuagccacuggaugagguguuuugaugggaacuagaaacaaaauguucauauaacacccacaucaguuuuuuacaauaacugguuuuuauuaaaauaacuaggagugcucucuaaaauaaugacuaaagggagagugugguagccacauagaccagcaauguggacacucgcucuuguuaucaaggugcuuuucacuacccauauuguggauguuauaguguauagaaagcucucuucauucuugagaauuucauacaauuauacaaagaaauaugacugagucuacucucuauuccccacaaaauacaaggcacccgcuccaaacccucaugucuuuaaaaauaaaauagcccaguagguccaauuagugcugccuauaugugcauggauguagggccaugcacuagagcaugaggcauccucuccccgaagcaaugauccucccucuguagaaauuaccugucaguaguuucucaguaaggagaagggccugcggagcaccucuuugucuaugccagaaucuuagcugaccugaacuuuugauggucuaguacaauuaacuauauaaauucaugcucgaaauaagcaugucuaaaggacagcacuucaaaggucucuuccauaccuuccaacucauaggucauucccaucuccuuuuccaugucauucucuuagccuugguauguuggagacaccauuuggggacauuuuagguuuguuugcucugucauucucacagggaggauggacaugagcaguugccaaucucacagagugcacugacuaggcagaggaguuauuuaaugucaucaucucuggaacuccugugguauaccucuguagucuuucauuugggguagcauuguuauauggcucauggcugaacacaaucaucuacuugcugacuagguaaauuuuccacaguguuuuuugccacagcaauuacaggccacccugccagaaccucuguugccaaaguaaucaugaguagguaccagaguuuaaggaucccugaaagcagacauuaauccuagaauuuagcaauuccaacuggaaaggaguucuuaauccagugugauagcacugaaaaacagugcaaaauauaucucauugcucauuacugcuucaaggugagagacuuuacuauugauccucuucaccugucaaucauugaauuaaggaaugccccugggaagaccugggcuccuccagguaugguacauuucagagagcaguuggacaccagucuuccauugaagaggauggugcuaggccaugcguaucaagcuagaauucauaaaacaugguagugaugagcgaauacagcagaguguucuccuucgaagcaaucugcuugucagacgaaagccuggaaauugaacuguuagaguagguucaaaaucaaguacaaccaacaaaauagacaaaugaacauuuuccaguccaucugaaauauauauagucuauacuguauuggggccuuuaaagauuucucagugguuagagaacuugcugcacaaggaacacuaguaagauccuagaagccuggaaaaaaaaucuuuguaaauauaguguaaaauuuuuuaaagauuuucuuugagaguuaaguuucuuggugauuuuaguuuucuuuugaucuguguucucuaacuuauguauuggccuauaugacuaagaaagacuuagauccacaauaggaaaagcagaauuaauaccggaggguagagaaagucaagucauccugguagagggaacagcuaauuugacccagaaauauugguaauaugugcucuguauauuuucaaauguccccacugauugcuuuagggucugaggcucccuuucuuuauuuuauuguacucuccuauguauccaguuuaguuuaccuuuguaaaaaaaggauggugggcuugaaccuugaaagaacaauugauuuuguuuguguguguaugugugugugggggaauagugucuauuggcauuggacccaaagccucacauauacuaugcaagugaucuccuacuggaucucccuagcccucuuuuuacucuuuauuuugagacagggguacauaacaucacccaggauggaacugaauucauccuguaacccuagcugacuuuacucuuaugagcuucagacaauugaguagcugaagucacaggcacucaugacagggucuggcuaagaauuuggaguccucuauuucuuugcucaaaguauccucaagaggagauggguaaagaacuaaacccaacacuucugaacuugaccuuauuuguaggaacagaaaugaaggucuuucaacucucauugaaggagcuaacagagguacaaaagggacacuugauugaucugcuuucugcaguaugugcauauuugugguuuggguuugugggaguguggcugggagcuggcuucauuucucuauuccuaggaacuaccuuucuuaccucccaacaccaggucccagagcuccacccgggguaugcuucugcacucaacucacuaaacauuuaagaggcacacagaagaaaagguugcucccugagaaaucucucuagagaucgcuuuguccuucguagaaaagggaguugucauccaucucugcuaagcagagagcaggagaaagucaaacuauauuaauuacccuagaucgugaaggacuuguguuucugcaagugauggauuucugguccaggcagcuuugcaaguauuaauagcauccauguucuuggcacacgaugguccucaguacucgaguaacucuaugcucuggagaugaugccaccacguuacacagccguccucguguccacguuauguugaggcagagagaguuugacuuuaggcuguuucagacacguccccaucacugaccuuuaucucagaaagguguuucuguuugaauucugcauggauuugguuugcuucauuucuccacuuuuaaacgugggcuauaugauuuuuaaaaguauuuuaauucuuuucagacucccuuugagagcucaaguggagaaacuauuuuggggagcaccuuauucgggugauaagcccccucccucugagcacucagagcauccacucagaaucugggaaggauauuucauuaucuaagaaccuuaguuugaguccugagacugaagucucugguaugucucucuuucauccacuccauguugauuguuuguacuaaggaguuucauccuuuugucacuguggaaagacaguuaucaccguguccugggccuucuuaaacaugucacccuacaugccugucuuauuuuacugucuuccuagucuggcaacuaaguuacggguacaauucucuuuuauguaacuuccuugucuaaucugauucucacaugcuacuccucaaagcauacagggaauagggguuucucagauaaaguucuggcacuuaauaaguaggcugaggccuagaggcuucuuuuugauagggauggaggguuggggguggaacucaguauaaguucuaccacugagccacaccccuagucucaaaguuccaguuuggacgaucccugcccccacuucauaagcaagaauuaaaaaaaggagaccgaaagaauaggaggagguuggggaggugguucagcuggcaaaguaccugcugugcaaguaugaaggccuaaguucaaaugcguagcacucauguaaaacacugggcacagcagaauggaccaguaauccauacagccauacauaggaguguccguggaucuuucugguccauuugucuagccaggcagaaagcuccugcucauugaacaccuugucucuaaauggaggucgagagcacaaaacuucagcacugacaucugauccucacaugugauuuucacacaguuguguagucccgggugcacacacagauaggacaagaugaaaagaaaaagugacagaaaugacauacucugccauugucauucuugcuucuccagucagugcugugugggaaaggggacagggugauucugagaguccuuguggaaggcuaaaaaggcgucuacagagaaagagagaaaaucuucuagaucagaaaacaccagaaggcagauggguccuugagugugaaagacauuuucucauuggguagaagucaugugauggacagcaucggugcucaaugcaauggucuaaacuacccuucucccugugaucacaauagcugugccuuucaaugaaaacuguguacuagcuguucagauacaggagggagugcagaagagagcaagagugguugagaguggccacaugucccagcucaugaacuguucaggcuuccaaggauagauaacuaacauccucaaguuagccguaccauaacaccagguuaaaaaugcagaucccugggccuuggggagagggauauugguuaggaaagugcacugcuuuuccagagguccugagcuagacucuuagcacccacagcagguggcuuacaaucagcuucaggguacuuggucucugugggcaccugcauucauaugcucacacauauguauucaccacauacagacucauacucacacaauuaaaaauaguacaaauacauuuuaaaaugcuuuuuaaacaaugagauccccaaauucuaccuguagaccucuccuucguuaaguucuacugaggaaucucuauaucggcauuucaauuaaacucauguaggacuggacguauguguuuaggagauuguggucuaaaacagggcuagauacugcacugugccucuugggcaggugaguggcugucuguguggucacuugagcccugccguuuaaccccaggaucucuuuuuauacgcgauuaccuuauuaacuuucuuaugcauccuuaaagcuugugugcucuuggcagaggugcauauagauuuauggcauagcagcuguuacuaauuccaauuucauuuauuucaccagcagugaaaauugaagucuuggagccuggguggaggcaaguuggaaacaaaucaaaacaaaauaauugacugggaaaugugacagacuaaugagaagcaucauucagaaagccccugaggggccaaccaaguguccuaucaaggggcuuuauaccuacuuccuaagaugagcaggcaaagccuucucaagguaauggaggagggguggauggcaaaccccagugcuucauggcaaugcccagcuuuugcugacgucaguguacccaggauccugcuucucuaugucuaugggauaccggaaggaacuuagucagaacauaaacuaaguuaagagguacucucaagaaaugauggcugaguuucugguuauuuugucuuuaguaaauaggaaacuuauuuaguucaguuaacuagacuuguagccuuucucacaugcauuaggcccaugcucuauuaauuuucauugugaauuucuauaagcuuacuaaauaaaaguacaaaauauuuuauauaguauauguaauuaacauauauacauauauacauauauauauauauauaauuuauaugguuaauauggaaauaucaauaauauuacucacuggauuguucacuagaguuaugaguuaccaaaacauuuucaaacuugccaugaagacugauguuauacacuccaguuucucaaggauaaaugcuucacgaugcuuugguuuacagcaugucuucaaacuguguacacuuuauuguagcuccgccucuuauuauuauugcuuuagguuuguugaugcuuagacaacucaauuacauuaauuuaauuucguuuaauuagagauaggaucuuauuuggagugcuagcucuccuggaauuugcuauguagaccaggcuagccuuacaaacugauccuccugucucugucucccaaaugcugggauuucgggugucaccacagucagcuucuagucucuuugcaauguccaaagggugggaaccaaauuagaaaaacaagaaaucucuugcggacucaaguguggcagaacauaguugugugugucacuguuagagaaaguuauguuugugguaaagaagaggaaucuaaauuaggaacacauuaugauuucuucucuucuuuucuuguaugacacaugacagaagaaacaugcuuuuaauuuuagaacuguugaaauaagucucggagacauuauuuuacaguugacucaauuccauguucguuuucaggagccucaauuuauuugguucuugacacuucugggaaugcuuuacaauuaaauugaaaaagagaucuuugcuuuguagacucaggaaaagaacauaaggagagccacucuaaaggaaggacucauuccgacacugccuauaaauagagauacagaguaaucuggaaaauuggcuaaagguuucaaauaugcaucucauugaccugcucgcaaaagaguacuagggucuggaugucauggcguauguccacaauuacagcauuccagagacaaggggcaaggaccacauggucauggccagucugggauauagagagagucugaagucaaacuaagcacuguaucauaaacaacaccagacaaaauaugcaauaaaaaugagcaaguauaccaugcaggauauacagaauugagcaagauaugccauuaggcaggauauauaggaaacacauuuaacgucaaucugcacuacagucuacaaggcacauuuuuacauuugaaaguagaaauauugaaacuaaugcaaaagggacagguagaacuuagugaacucauacagcuuaaaaauaacuuuuuucaaaguuauucuugauuuuauuucuguguacuuuaaauauauacauauauauuuauauaauuagugacauauauauauaauuaguauuguuaugauuuugagugaccaacuuaaucaaaugagugugcuaacccauuauguguaacaguugcccuuuagacaauuuuuaguaaauuaucaaaacaaauuuuauuaaguaauucauaaauuuuuguacacuacuacuaugcaaucucagauguauuaucauuaauagcauguuuuuauggacuuuuauuuuugguguguguguauguauguauguguguguguguguguguguacacgugagcacacaugugugaacaugugugugugcaugcaaaauuaaaaagcuaaaaaaauauggaaaaguccuaaguaguauaugcuugacacuaagauacccuacccagaggcagguccgacaauacaaagaccauuugcuucuacuuuuuguaagucaguggugacaaacagcuuuaauuaggguaagaaauuuccauuuuaauauaguuaucuagucugcuugacugugccuguaugguuuuugguaauauuugacuuuuuaacucccauuuuauaaauacaugagauaagauuuuugauuaaaagauauuauauauguauuauauuauauaauuaugugccacacuucuuuaacuauuuaaaagauugcugucuuuuucacaaacugacccugaaacuccuagcuagaacagcaggacggauguuguuacaauuccauaaagggaaagaaagaggaggagauugaagaaaaaaaauagcauaaugaccgaaauaugacuuuaauuuuggacuuguuucucaauaggucuuguguuuuauuggacuaguucugucugaacuuguugacuacaggagauacuugaaauaaaucaaguuaaaaauaugaaagaugugucuuguuucacaguuuuaaagaugucaguccaugguuggcccuguuguccuuaccuguggcuacaaagcacaucaaggaaggaacauacaguggaggaugcuucucaacucaugauggguggcaagcaaaaagcagcauacagaagacuuccagccaagccucacuuccuuaagguucuauugcaagcccuguccuccagauagccccauguguugaggaacauuauuuaacacaggguucuaggguaggggucaucuauguaauagcauauauugaccacagaggaugcacuccgaaagcauacacuuaucuucauccucuccuuccccacucuuguuuguuuguuuguuuguuuguuuguuuguuuguuuguuuguuuguuuuucgagacaggguuucucugugcaacccuggcuauccuggaacucacucuguagaccaggcuggccucgaacucagaaguccgccugccucugccucccaagugcugggauuaaaggcgugugccaccaggcccagcuccuuccccacucuuaacacucccccuucccuguugcccuucauucccgaauuuuucacuacugauuacuugcucuuuucacuuuaguaguccuaacugcaacgaagucauugcaguguccugguucuguuuaucacuguuuugauaggcuucuuuucagggucacaaaggucacagagcuacuauuaggauaaggggguuguaguucuguuuauuuuauaaaacugguggagagccaguugggcucuauucucacacauaauucuucucagagcaucccuuugcauacaccuuacucagaggcagaauuaagcaacugauugacuggaagguuuuaggcuaugcccuaaaaauauuuaaauguggaugguucucauuaaaccaauucacccaggagagugccaguaucuauaaagaauaagaauuacggggcaugcauaucucacaucuggaauuuugucuucaauucccuauagucacuggcucaaagcuagcagacaaaaauggauguuggccaugcuuccauugcugcaguagcaagcagaugagcagauguugugcucuuuagagaaaacuuagcuagcaaaggguugucuuauuucagagaauguagaaagucuaaccuauccagugauguaagcuccuuucauuguuguccuugaauucagacucaaagaauagguuagagucucacagugagagaaucacaguguuggaauaaucucgguucucuggugagcuguuguuugaucaacguucuucaacuguucuucuaccaacucugugcaucauaguuuucacaggacucuauagaucauggguuugcuucaaaaaaccagacaauaccacuuuuaaauucaauccuccuccaggauuccuuucaucuuucuaauauaucgaaguauuccuuccaacuacaauuaaaauggaaaaggaugagagaaaagaaagaagaugcugauuuguuauugguccagcgucagguucaucuuggaucaaaaggugccaaaauccuccuggggcccugcagcuguaaucagacuccccuuuggauccagccaguuccaaguggucaugcugacguagguggccggucuuggcagucagcaugucuccacaaugagaggguugaugggagcaggcagcacugccauuuggcuucucucguccuuuggugcucaaauaaaaucuguaauuucuaauuccccguuuacaaacagggaggcaauuggucaugccauaggagcgccuaguuaccaccucuguaaaaguuuauccaggagcaagaaauauaugugccaaaccagaaacucaccugaaucuuccucuauggguuaagucaaaucagaaaauuucacucuagcagagucucagaaaucugcccauuugaaggacuuuuguuuuaacuugaguuauaauacuugaacaaaagcuccuuuauuuccugagccauauugcuagccucaccugaaauauuauauaauugaaauuuggaaugggaaguuauugacauagcuaugggagucuuuuaacauaugaaauauuuccuguccauacccaguuagcuucaauuuguaauaaugcacuaagccuaaugaaguguggcauuuguauuaaaaugcagcaaguaacaauauauucuauucaggugguuaugucuguguacauuuuaucaagguaaccaauguccuuauucaaaaaggauuuugugauaugcuguauaaauaucuuauuaaaucaugcucacuugacacugucacuuuuuagacaaagugaaaccccacagcagaauuguccauaucaugcuggucuccucuugacuuaaagacaucccacaacacccccucucccaacauagagcagcuguaagucagugcuugcuaugcaugcauaagugaacugggccuuuuuacuaagaggcaagcaaagcauggaagagauugucagugaaugcuaagaguaugguggucaaacauccauguaccuucuaggaaucuaucaagagacaaucaauaaaugaauauccaguugggaacagacagaaauuucuauugaauuucuuaaaaagaaagaaaggaagggagggauggagggagggagggagggaggggagagggggaggugaggagagaaagagagaaagaaagaagccuuagcugugccuguuggcauuugauaaacuauguguacuguuuugauaaacauuaguacaauuuagauauuaaaccuugccaucucucuagaaguuucuucuugcaacuucguaccuuccuguaacaacucagcgcuagaaguuuguacacaugacgucauguaauaugccuaguuuauuuucaauuuauuugcuguuguuguuuugagauucacuugugugcugcuuuggcugucuuguauguauguggacauguauaugguugcaaguguguauacaugcugguggaagucagagcucgaugccagugucuuccucagucacugucuacuauuucugcugagaggaaaccucuaacugaaccuagcuagagcucacuuuggcuugcccugauggcaggcaagcuccagggaccuuacuguuucugcuacccagugcugggaucgcaggcuuguguagcaauguccaucuuuaucagguuaucucuuuaauguagcuucugaggguccaaacucacgacuuauacaugcacaagcacccaaacacucuacuaacugaaacaucucuccagccccuuuccuuuuuucugaguaccauugaauaguauggcuuuaucucaguuucuuuauccucuuauuuuaugcuggguaucuguauugccauacauacuauacagucacuuccaacauaugaauccaaguuuccucaaauaaauauuuuccccucucuugacuaaaugccuggguugugugguagguguaagcuuaacauuuuuaaagauuccaguguucuccagagucuguguguugcucagcauuuguacaaugcuaacgaaacaaaucuauaauaaagcauuauuauguccaaauuaaaaaauauaaaaauuaggaguggcuucaauuagaaaaguuuagguugcuaauuugaagaacauuacauauaugugaaggccaugaaaaccucuugaguuucacauguccugacauguaaagacauggaacaaugacagaaaaguccacaaagccaucuuaaauuucacauucauacaauaggguauuuccuaccauguagaauauuauuaacauaagauaaacauaaaaagacaaagggaagucaggagccaacugaggcuuagcagaaucuauauguugcauaauuggggaaaaucuuauauaacaaacaaaaucuaaaaugaucagcauacaagugguggagaggaagucaacacaguggucgugaaaagcauccugucacagaaaggcauucucacccaagaacaggauuccuuacgaaucacauaaaugauaaaugucuucuaucaaauccaaugaaguccagcuccaagcccagaagaaaaguccaaaauauguccgugcuuacauggcagaaaagaugacaguggaaaggcagucaacauugcagaauuacagcuuguccccugugugucucugaggaucugcuuuuuaguccagggaagcaggggacuuggcaggugcaugaaaugacacuaaaauccuugcauuuccuccuuucuuuuaacaaaucauguuugaaauuucaauacuaguuacuuauggagaucuugccucuaauauugcccuacgcaccaaacauucaaaaacuacuucguacaugucugccuauauguuuuauuuaaccaggaacauugauaguaagaauuguuaaaggaaaucuauuuggagaagauggagaggugucuuaaaaaaaaacuuugucucacagguuaucuugcuagcacagagauuuacaaaacaaccugagguucccagguccaccuggcuacccuagcccuguccacagucagucaucaggaaccuaagcuauugccuaagauucuucuaagucccuuugacuaacauccugggaaacucagacaaaagguagcaacccuaucccauacuuggauuaauagcugggcacagaacauuuuuuuccauccucggcuauucuguccuugccuaaauccauuuguuaugcuguuauguuacagaauguauucaugcagcaauuucugcuaacucgauuccuacccucuaaugcgcaauagccaacuuacagaaguccauucaccauggaacuuagccuggggagcacuguguucucuagucaggaguuuucauauuuuaaaggcacacugauaugaagagacauuaaaucccaaacaagauguuucuaggcacacacauacauagacagccuacaauagaacagucuucucgugccugcauucgaaguacccaaaggaaagcucuuaucagguacaaacaauuuccucuagagccaucggaaauccugggacacuguccaggacauucugccuuggugucuuucccacagagaaauaguaaacgcauggcguagauuacaccuacagugaaacgggaaacugaacaccaggcagcuccgaaaggaucagguuuagaguccugacgccaccuguuacuacaggagccauaauccucagaagcacaaaaugacuuagucuuggagggaagacugcucaugaguuuucaaguggcccgucaguuuucuuuuuaauuuuagucacuucauuagggugggcaaguggacaagccuccagcaccacacguagauggguagaguucaccaaggaauaaacuguugggccauguguuuaucguuaccaugcucaacauuucugagucagcagcaaagcagugguugcaucaucugccuucccuauauauacuuuggccaaaugugccuccuccaaagagaaaguguguccucgcccuguuuaaagaagcuuuggauuagccagaagaugcugaauacugagcugaaucuucacacagaagcggugugcuuaauuaggcacguauuuaauauuuuagucagugaagaagugcaaagaaucaacagugugcuugagauucagaccucaacagaggccaguccagggcguacagcuuagaggcucugguuguagacaagcaguuuuucccuuuaaaggaccuguuucauuucuauaaacaagagaugcuaauauuuaugugcaggauuugaaagguguauucaugaugugauacaauccauaucaugguaauuauauucaaucugcaguuacuagaugguuuguguguauauaugugugagugauguguguguaugugguuuggaugagugugugugugugugugugugcugggugugaguguguuugugugguguggugcaugugauauguggugugugugugugugugugugugugugugugugugugugugguuuggaugaguguguguguguguguguguguguguguguacugggugugaguguguuuguguggugcggugcaugugauguguggugugugugugguguguaugguaagugugagugugugugaguguguaugugagugugaugacagaauuuuguaaauauuccuuuagagucucaaaaaauucuuuccaggaaauccucucaugggaacacugaaaggaccaauguugaaaauauuugaugccaugggccuaugaacaguaccaaggugugguguuugaagaucuuaacucuucaccauguccacuuuuugccugagccuauuaaaacaagcaaauauaauguaaugcgacuugcucagaagcccucuuugccuugucuguguucagacuucccauauaacaguccuuccugucucuuuacucacuuguagcuaaucauccucucagauucccgugcuuucuguaucuaaacacaacucuguauggacaacaaaugguggcagauuauauacugaguacucuugacaagccucauuaauaccuguuuccuccuucucuucuaccuacucuuucuuucucuuuguuguucugggaauuaaacuucagaaacuugcaugcuacaugagaaccucacaauggagguauuagcccagccuccuucauucuuuucuuuuuuuuuauuagcuuuguuauauuuauagauaaauugcuguuaucugacaauuuucucccuggauauaauauuuucuuaccaaucuucccuuccuucacuccauccuucucaagucucccccacuccccuuuccaacuaguccauuuucagccuaauuauguaacucauuuaguguaacagagccauuuguguuaccacuggauuggaacugucuacuguacugggauagggauguuaguggguauguuacugaaggcaaugauucccuuucccugaaucuaucuguggcaaauaguccaguagugagugauagaauucuuuacacccuucccuccauauguaucugucuguuaguaagcucauuuugugcagcuuuucuuuaauuuucccuuuuuccucuuuuuuuucuuuuccucuuuuuccacucacuacugcauagguuggucuugaacucaccuuguagcccagcuaugccuugaauuuccaguucuucuaacucagccuccuaaauaagguuagccuugaggccuggcugaguguuaccuugagaaagauaauuuccacacuucagaagguugaaaucucuggagauaauuugucacaugugaauuaauuaaugauggggggggggaggaagcaaaaggcaccuaaccaaaaugaugcucaauaguugaucaaagacaguacauaacauuuaggcauuaggucaccaggaaauacaacauggaaauaguuuagauaagugucccaguggggccagggagcagaagagaaaggcugaggacuaaugaaaggauguggguggagaugggaccaccaauguguggaaggugucaacaguggaucuggaagaagggguggguggagucucuuuuggagaguuagaguuggaugagaguuucacuucuagcuagguuauucuaugugccaauauggcaggaguugguugugaugggguggagggauagacagaugaguuuuaaaaacuuuacacaggguacaaucauguaggagcuucaauuuuagaggaucuaucuauugucuuaguuuccuauuaauuuaucuacuguuaugcugcuaaaauuauuugguuuccauauacuucucauuauuuaguucacuguaccuuuugaccaucucagguacuaaguauagucccaagagcggcacagagaauaaaucaguccucccucuugaguuuucuuuuuaauccagaaauccaaagaaacuuucuaagaaccacaauaauacccaaagacugugggucuuacacuacaucaccuuuaacucagauaguacauaagcaaaacugcuggugucugaggcuagucacagcagaguuaucuaauacauagcaauucacagcagagucaucuagcacacagccaaucacagcaaugucaucuagcacacagccaaucacagcaguguuggcuaacacacagcuaaucauagaugagcuagaucaccaguuucgcuuaugaguuuucucuaaauugggugugauggcacacucccuuaaucacagaagguggaagaguaagguaagagaaucaggaauucaggccaguaugaagaauauagugguauccauucucugauaucagaaaaggaggagggucacaggaggccaugaagaugaagcaauuuuguggauucaaagagaggugagauauaguuuuuuacuccagcugcaagauaggccacugagggaccacauccaggcauacucguauacacacagaccacuugggugguagacacauagcacauagaccuagaaacacauguaggcagacugacaaaggcaaaggcuacaaccucuggccucaaugccauauuuauacagaauccacacaaaaacuggcagccuuucaggaauaguuaaaaaauggaguacaucacugcuugcuuacuuuagggguucccaggaugucuggucuggugucagacauuuugugcugacucaggccccugaauguccugugucagucauguuuuagcugacucuuacagcauaucuacaucagcaccaugcuguuuaaacauaaacucguccuauggccuucuggugccaguaguaggucaaugggcuuuaauguagccgcgggcaagaaguucacagacaagaguucacaguugcucaugucaauucaaacacaacaaacuguuucaucucaaguuuugguucucuaccaaauaauacccagagccauuauaagaagggauagauucugauuaguaugucugaggaagccuagagugaaugauaauuuacuuuguagcucaagcuggccucaaaaucauuacauagcccaggcuggcuucaaauuugauuucucugcagcagccucccagaauuuuagacucauagucaggagccauuuugccuggcugaucagcuaaaaauagcuaauuaaaguaauuaauuaacagcugaugaaaacaauuaagguaucuauaaagauagacuuaccaaagugugaauguauaucauucuaauuuuugaaguugcuauuuuugaaaauagaguuuuauuuaacacaacaugccauagauuauuuuaaacaaagucauaaauaauucagguuguuugacuuuaaaauacaauaaauaugauagcuguaauagaaacaaaagcuccuugagguccuuaagaguuuuuaaagagcaaaaugagguucugaucauugcaacuuugguaaggguugggucuagucaaggaaaggauaucagggcuggacuccccacuucauuugcuccaaugcuugucugauaaauaggaaucaguuuuucgcugaugagccuugacgaaguuaugcuuugauaugucuuaugcuucccaucugcacucuuaagcccucauauuuccuuucauacauugguuguucuuacugauauaauuugaaugccauauauaguuuauuuuuguuucuuguggguguuuuucguuuguaucuuaauuuucaagauucuuuucuuacuuccucaaaguagguuuuguacaguuuacaggcaggcuuuugugccuacaaagcucaucaagucagaucccccucauuugccacccucuuucuuguuaaguuccuaaaagacaguuacucucuauguucccccaaugauugcugcagcaucccuggaucucccugaauauacauuagacuguguucauucuuuggguggucacaugaucugcucacaucuaacugacaaagaugacauccagacucuuuaguuucacacugucuaaggcgaucauugcuacccaccauauacauguauaucacucaugcuccuuacacccaaaugugcagauggguauguguggaggccagagguucaugucugauguuuuuccuugguuucuucccacccuuacuuuuuuuuuuaacuuuuuccaauuuuuauugggcauuuucuucauuuacauuucaaaugcuaucccaaaguccccuauacccuccccccacccugcuccccuacccacucacucucacuucuugacccuggcguuccccuguacuggggcauauaaaguuugcaagacuaaggggccucuccucccauugauggcugaccaggccaucuucugauacauaugcagcuaaagacacgaacucugggggcacugguuaguucauauuguuguuccacccauaggguuacagauccccucagcuccuuggguacucucuccagcuccuccauugggggcccuguguuccauccaauagcuggcugugaguauccacuucuguguuugccaggcacuggcauagccucacgagagacagcuauaucaggguccuuucagcaaaaucuugcuggagucugcaauagugucugcgcuugguggcugaugaauugggaacaaaauacccauggaaggaguuacagagauaaaguuuggagcugagacgaaaggauggaccauccagagacugccccacccacccuuacuuuuuaaaacaagaucucucagugaacuugaacuauaucaguucagcuugauagcuuagccagcaagaugcaggcauccucugucucuguaccuucuaccaucaaugcucuagaaauaagcaugcaccauuaagucagauguuuuagaggguucugaagacccaaccucauguucaaauaccugguuguccaacacuuuucucacuuagccaucuccccuugucauuuugucucucguuuuaaaaaucccauuucguaagugauuuauugucauuuaaguaucuuuuggaaaugcagugaugccuuuauauguuucuauucauuguacuuugaguaguuucuuacacugugugugugugugugugugugugugugugugugugugugugugugugaccaaauucgagucaccagguuugcuaacaaguaccuuuuccuggugagccaccucauuguccccauucauugugacuuuaaagacucacuuuaauuuccauucuucuucagcaaaaguuccaaaaauugucagaaaucucauaguguagaauuuacaagaaauaaaaacacuuuaaagaauuuuauuucauucugaucuuauuuauaacuuugacuauaaccuuuaguuuucaaagaucaaacaaccuaaaauaauauauauuacauggaaccacuugaggguauuagaaucuuaggacagaaaaacaaauggaggguucauaucugauguuuaauaauacuuguggcuuacuaccuaccucaucauuuucaguaucuguuggguuuuauuuauuauuaagauauucuccacuagaagcuccuagcuuagaagguguugcaaagcuaauuuuugauauaucuuuaaaccauuaauucaacacagaaaguaagagccauaugccauugaaucaaaggugacuaaaauaucuuggcaauuaaaaucugccuacucugugggaauuuugaguugacuguaguucuugcaucuguuuucaauccugcucuucuccagggauagucggggugggugacuaaugcauagcauacuuccagugucuuucuacuacaaacauuuuaaacucucaagucauugaaggcccauuuuauacuuaccucucuuuuuaacauuuuuaaauuauaauuuuguuuuaugugcauggguguucugcuugcauguaagucugugcaccaugugucugccugguacucauggaggccagaaaagguguuggaccuucuggaacggguguuguaaauaauugugagccgccaugugagggcugggaauugaaccuguguccucuagaagaacagucgguuugcuuaggcauauagccaucucuccaacccuacauccaccucuuaaucaaguaaaauuuucauacucaguggugagaauuuugaaguugugguuucuuuaaaaaacagaaauauuagaauaugguuuuguucauggggcuguuucagaugcuccacagcaguugacucugaugugccuuguacucuagcaggagugugauuuugccagugacagauaauugcugcaacugugugacauuuggaauucugggaguuuuucagaacauauauaaaugcuagagccccaagaggcugcuggugggguuuugguuggucauuaggugguuacugguugguuuuuggcuaacuauugguugguuguuuguggcuguugguccugguuuauuaaguagucauaaggaaagaagaaacaucaagaagaagaaaagggaaagauuaacuuugccccuaggaacuugaugacccuaaucagcaggaaguagucuaacaauaaugccauccucuuucugaccccugacuuuauucagggagcuccuuccuuuccucuguaucccauuuucucucugaucuaguguuagggaucuaguugaaaggauggaaaaaagguagagaaugguggaagaaaagagaacccacaagggagucaagucugacuacaaaacacaauaaaauuuaaugccaacauuaccugacaucuauacucaauacuagucaauguccagcucuuguuaugaccccagagacaguaacaggguacuacacucaacuacgcagagaucuauauuuuugccuaauuagcuuagacuugacuugguccuaaaaaguuuuguuuuaugaaguguggacuauuugccauaauuuuagacaucauauacacucauuuucauugucauacacauagaaaaugcuuuuggccucaaauuugugucaugcuguguguguaggguuuuagaugucuuaaacauucucaacucuuacaacagucugguaccacagauaaagaaauugaggcaccaaaagguaggcaaacaaaaaccugcucaagaucauauaauugagaaaaccuggauucgaacugagccucggcugcucgcaaauucugcagguuaaaaaaaaaauaguacaaaauaaguccuccaaagauacaauuauauguguaaagugacaaucuguucuuaauauuagcauaacuaauacagagaaggagggaaagggagaaggaauccgccaacccaaauucccaaagaaggacagcauuauaauuauuggaacaagauaaaaacuauuaggaauacaugacaaacaucguacaaauugugggauuuaaagcccugaucuguuuauuuuucaacaaucugaaacaugcuucuuguguucuuugacaauuuaauaauugcugugcucugccuguguguguuuguccauguuggcaucuccucaucaaaaccacugcugaugucugugugaugacucacaccugcaaccucagcacucagaaggcucagccagaaggguuaccauggaugaaaggacagccugggcuacgcagugacauccugccucaaagcugaaaacaauaaaccauugcuuccagagacaaauucaacuugguuucagagcugccagaacucucaaaaaaucaaguaggcucaacuacauacauacauacauacauacauacauacauacauacauacauacaugcauacaggcacacaugucagauaucacuauaccuaugcccuugaaagcauugcuaaggauuuaauuuuaggaugcuauuaauaugacauucaucucugcaguuguccacucucuaggauuccugggcagagagaggucugaauaaagcgaaggaaucuaccaacuuguugcuaauaauggaauauauagaaaccauagcucuguagucugaaagcuaaagacaaaacguucuuuucgguguucauuuaguuuauuugauaaucacuuaugauacuacuuuuacaacuaggaagcuguucuuuuuaucugaauuucucuucuucucaaguacccucccuccuucugccuuucuaccauuucucuuucuucugccucuucccacuuugggaugagcccauggcucaugcuauaccacagagccacauacuuagucuuuaaaaaucugaacuuuaguuuuagcuucugaaagauuuaaaauuaaaauaucuuuucuuccucuguuuuuugugauucucuuacuuagauuugauuugaacgcuuuucugagacuuggggggaaauuaaguuuguuuuuuuuuuuuuuuuacacucuauaugcuauuuagcuccuuuguaagagacaaaguucaaccagagcuacuuacugcucugaaucagaccuaaaugaagcuugaggaaaaaucaaaugaagauggacuaauguauguuuaucaguaguuacaauaaaagacccacaguguucaacuccuaugagauguacauugugauagauuuguuucaugaccgaacuauaucauugcucuugcuucucuggguuaaccaaggaauauaaauuguuugcucucucucucucucucucucucucucucucucucucucucucucucucucucuuccucucucucuugucuguauauauauuuugugcuccaugaauccaugaaauauauguguauugacuuuuaugguuccaggauugacacauuguugauuuuaaaaugauaaaauguggccagaaagccaggcgaugguggcacaugcuuuuaaucccagcacuugggaggcagaggcagguggauuucuggauucgaggacagccuggucuacagagugaguugcaggacagccaggacuauacagagaaaccuugucuugaaaaaccaaaauaaauaaauaaaaaguugcuggaauuguguguguguucagcuuuagauuuuuuuuauuuuccuguauacaaugaaggucauuuggucuuaaaaguguuuccucugacaauccugagaucccacucuaccuuaccaaugcuuacaguacaugagcaugucuaugauugcuaacuggacaguugucucauugaguguggaagcuuuucacccugccacagcagcuacacuuuauguugaguugagaagacuucuaugcagcugagaaguuggucaugaggaaggcaggcaccaaugacucuuguaaaacaaguuuauacaacuugauucccagagagccaauugaacguaucauugauccuguguccuugaaagcugaacacaggaucagcuuucaauauaagaggcuaccuccuaggcaacaaaagaagguucuagcaccuuggcuuuugcuuuugcuacacuuaggucaaacccauugguguagcuuuaacagaugccugaaaagaucaguuguuuccuuuggauuuucaagggucacucuggcucagggccaggaaaucugacacuucagagcaaagcagauagaauucugaugccccuuggcaucaaagcauucugaggucagguugcaaucuaugauuucccauaccaucucggccagaaauacuacugccuuucuuccugagaagauguuuuccuggugcuuaaggcaggaaaugaaaaagacagggaaggaacgcuuaaaucaguuuaagaauacguaaauagauagaguguggucaccaucuacuauuaauagccauggaaaaccauagaggagaagagaugagcaauggaaagggaagguuucauguucugccacauacacauaaacuuuucuaagaccagcacgaggugcaucccccacaucaacaguggcugggggcugugucuuuauucugcaucugugaucagaaagcagagucuuuugucaucuugccucuaaacaguagagcuuuaugauaagacccacuaccaugacaguaggcacccaaaccagucuguauauaugcuugcuuuuaaaugaaagcucuuagaagcuggaaaggaauggccagaugcuucuggcuguucucauuucuacauuaguagcuuacaggaaacagaagauuaaauugcauaggauuucacaguugcuucugccuuaagauccuaacgcuauggcuacauaaaaaagagucuauugucaccucugaacuuuaucuaguuaaaauaugaagaaagagagagagagagagaucugugagaugccagauuucaagagagagaguacugguuuacuggcuuagauuauucacucaugcugugcaucccuugaauugcuugaagucacagcuucucccaacgaugagaucugaaaagaugguaccauguguaaccuacccuccuugcugcaagaaacugccuucugaagcuuuuccucuuucuccauuaauucaaggcaggcaccaaugacucuaguaaaacaaguuuauacaacuugauucccagagagccaauugaacgugucauugguccuguguccuugaaagcugaacacagcucauauauaagaggcuaccuccuaggcaacagaagaaugcuagaagucauccuuaaagaggaaauaaggaaaggaacacuuguuugaaaaccugugggguuuuaaauuuuaucgauggucauaauuuucaguaucuauugaaaaacaauauucaaauauguauuuuuucaccucaugugauguugagcgaacaucagaucauuucaucgcauggcaggaaguuagguucuccagucguuucaucucucgagagccaguguuucuucuuacuuucaacccuuauggaaaccauccaaaugcaaaguuucuuccaaaacugaagaagacucugugcuuggaugaacuccacagaaagcacacggacgacaagaaacuagcccgauuucagcagacaucagaauaaaucaaauuaaagagcauccagaaaggcucagcccaucaccgaacacucucgguggguucuuuuguucucuggagauuuuuuuuccuccaaauuuauuguugcuuuagaauucuauugcuauucuaguugaucagcauggcucucuuggaucuauugcaaugugcccaaaugcauuaaggauauaacagaagcaacauaaaguguagcucuuugaaaaugaccacuuacucuguauguagacauaguaucugcuuugaacccuucacauccuugccaacaugugaugaaaaccagugugaauuuggguuuuuaaaaacuuuuuauugauucccugugaauuucccuaaucccacucaucuuccugcuucccauaucugccccuuugccuccaucccaaaagaugagaagcaaaauaaauaaauaaauaaauaaaccccaaacagcaaaaauaaacaaacagaacaucauugcaagguguaaguggaagcugaagugugucauggaaguuagcaacuuguaacaaaaguaucauuaagaccuuucauauugacccaaaagaucaauguggaaauguuggaaagguaacgcugaccuggagcagaagagucaggaaccaauugcugaugacguuucagaaagucuguuuccaacucuacuuuuuagguccagaacaauccuuccuugccuuuuaguagaugguacauuuuguucucuuucccucuccagugaucucuaagaccacccuggagaguucucaccacucuggcuugucacaccagucccuguccuaaggugucucuuuagucaccccgucuugagugcugcuguguagaaaguugugcuguggcuuucuuugcagauuauucauuuguacauccaucuggcuucaucuugcuuugauuugucccccuuagucauuaguuaucuuguuuccaaagucaguccugugcgguuaccgucagguggccaugcucuuccuguaaaaggaagcuggaccuuccucuuccuuucuccuuucaucuccaucucacucccauccaagaauaagacuuuccuguaaaauauuuucugacccuuuauaaacaaaaauauaaaauaauuaauauaguauaggaauuaaaauuauuuuaggcuuucaaauuccuucaguuuucuauccaugccuauucccuucuauuggcaauuuccauguacuauuccugguccccauguugaaaguccacaaaggaccagucaccucuguauacaauaugugagaggauaugcuaaagcaaugagcaauacggcagguaucuauguaucuguugacaauccuuucuuauaaucagaugaguauuuuacuuucaaaaauaccauggacagugucaaaaauauaucacaaccuaugucuaaaucugcaaaaggaaugcacaccuggaaauagauaaaagcaguauaugccacaaguuccuggcucaaucaucucuguacugaaguuaaguaaaucuaauaguuacucacagguagcugaucguguacaaaaccccaccguagaucucaggcgagaggcaacaaugaguacaauaacagaaccuccuugagaaaugaugagauuggcaugcugcauguucgugggcauccugcacugcuaggcacaaguggaguuuacuugguaacgcaaaugaauaggcagcaaauuacauuuagagaaauuggaggcaucugugaaggaauugcagagaaaauggacauuugcuuacugacugguuuuguauucugugauccuucuugugguugaaaguaauaacuaguuaauaagcauucccuggcuaauuagacaacuuuuuuuuucuguugagcuuuaugcaaagagguuaugcuauagugaauacguaguuuguaaucugauuuucuuuuuacgacaacauuauuuggugugggugaugguuguuuugaauuuggggaauucugcaaauucucagaagcuugagagaaauaggaaggaaaccagaguucugacacuugaguugugugcugcgcauguauauagaucacaugacagggaacucaguauugugaagcaagaauggagcucugaggauuacaaauaaaucaacuggagggauaugaguggccuugaaauuggugaaaauacacgggugcaucaacuucccccuaauaacagaaaccacaaugccugacagcucagaaguauuuccagucacgguugaaacauguugaauauaugagucaccucuagucuugcuuccauaaagaaagcuaauaauacagcuuugagagucuaguacuuucgcauuauguauaguauuuccuuuagguauaaaguuucagaaauuguguuaaaccugucaaccucuuuggaaaugagaaagaccaauggcaagguggauuaaguuccucggagcaaguuuuccuugaugacauaguuuguguuugggucacguauuuguuuucacaaaauguauuuuguucuuaaaaauaacauuuccguguuggcugcugggcucauuagcuaaugaugguacaugaaaccugcuuguucuccuaggcuauagacuaaugaugaaguaaaaaagucgagcgucauguaguucaaaagagcucaggugguaaaggcucaccgagaaggaacccaaugggggugucaauacaaauacuuucucucccagagaaaguagaauuguggaaaauagggaaagcacaaaggcagucaaguguuacugucaaaggugugacugcccagccuaggacugagggcacagaacagucccugagcccacuauacucuuuaucucuacaguucccuccgauuuaggaagauuuaccugcucauccugcuggaguaaauacacaguuaugaacgguggcaggaaccugucauccucucuccucaagugggcuguggcaggaggacgaguuuagcccaggagucacccgaguaacagagggaaaaaugugccucaaaauaaaaacaaaaacaaaauccaaaugcaugcaccaccaccacuaccaccaccaccaccaccaccaccaccaccaccaccaccaaaacaagguuugugagauggcucaguaagucagggugucugcuaccaaaccuuaaaaauugaguuugauuccuagaacccacaagaugaagaagagaaccaguuccuguaaguugaccucugacuucauguguacuccauugccacacagaggcccccucaaaauuaacuaacuaacuaacuaacuaacuaacuaacuaacuaacuaacuaacaguuuuuaaagccaucagaacaaacaaacagaaauauacuauaucaguucuuuaccucagacccagcuugaacauuacuccagaagcaauaguccuuccuauauacaaucugugaauaauaaacaaauccauaccaccaauaaaaagacuuaggaauuuagacucaccgaaaguccaaccaaacuggaaaguagauauuuuaggaaaagcauaguugaagcaggcagaaguauggcgaaaggagccagcagggccuagggaaccaaccuauuuugagugugcaaaagugguggagaggacacaaguagaggaggaggaggcagaagugagcaaguccaggcgcugaaagaaggacuuggcuaaagagaauaacccccaggacaagcccuuucggggcuccagacacucccaauguucccaaggcuuuggcauguggaacucaagacauggugccaacugaagaggccuagccuugcccggaggccuuucaguguguaguguucauccagaggcuccuuaaguucaucucccucgucugaaguccgggccauuugaagugucuccauugcuuucccacucagguuuuuagaaagugugaaugagcacccugcucuucuucaguguccugucauugaagggauuuucaaaaggauuuauggccaacggguuacauuucucuuggugcacucaucacaaauaugugucaagacaaggacaucacacaaguccuuuuugguuguuuuuacugugcaaagcccaaauagccuuuguuauaauaauuguacacuagagaaggacccagucaccauagaacauccucaacuugguagccagccaguggcacuuccuuccugccuaucuaccuaucugcuuugaagaggucuccauuuuuuccucacuuuccacauuaucuaagggguuauuugccauucaugcuacaggcacuagucucuaaaacgcagcuucccaacagggugacuugaagccagcaugugcuucaggaagcagcccacucauggagaacccccccuggucccuuuuuacugacuuucuugguuguuuguguuucucaccacuccucguuuggcuggcauugaaggacuaaugauuuccacuguccccuagaaaagcagcacuuuaaaugcaauaaguuagucuagacaaagaaaauuaaagucauuaguagaaagcuugcaaauguccuguguggguggggcccugucauuacagacccucacccaggcuccugugguuuuccguguguacaagacgauaguucugccuuuccuuucuguaguggggaaucaaauaauaguggguuucaauuauagacauaacugcaaguuagucaggggcauaagaacaggguggcugucagcuaugccacgcuaaugucauaagacaugaaauccuagcacauaacaagagauccugaggccccugaauuaccacagcccacauagucaauaagacaccaagaguaacaauuaggaugcagacagaacaaauauuuacauuuugagaaaacaagaggggaggcauccacagcagaaugaaucaaaagccacaaggucucagauguggguaggcaaaguguugcugucagugugaagcaggaaggcaacauggguuuccaguauuugccauucagagggccagauuacuggaaaauuuacagcaacauugcagcuuaagauucccccuccgucucuagcugccugccuugcauggaguuaccaguggaaaccaaacaauccuuuuccuucuuccauucuuaccacaggucuguguauucugaagacagauucgcgguccugaaaagcaaucagguauauuuuuaaagcuauauauaaacccacacguuuaucauuaaggaacccaauaaggaugaucagaggcugucuuaaaaucugaucauagaaguuaacacugugcagcagggugugucugaagagagaguggggauuuucucucaaaguagaggucuuucuucucuucucuucucuucucuucucuucucuucucuucucuucucuucucuucucuucucuucucuucucuucucuucucuucucuucucuucucuucucuucucuucucuccucuccucuccucuccucuccucuccucuccucuccucuccucuccucuccucuccucuccucuccucuccucuccucuccucuccucuccucuccucuccucuccucuccuccccuccccuccccuccccuccccuccccuccccuccccuccccuccccuccccuccccuccccuccccucuccauuaaauacuuugagacaagacuuuccuacaagcucaggaagcagaacaggagaaggauaacaaaauccaaaguguugagagagagagagagagagagagagagagagagagagagagagagagagagagagagagagagagagagagagaaagaggggaaguccucaaguaagccaaagcaaacagcuuugcucagaagcaugcacuguucguguguaugccaguguauuuaugggguaaauguggaggccagagguagauauugggugaauuuuucagucauucucaacaucacuauuuucuguuuuaaaaauuggcuuucucacagagcccagaggucaccauuuacauuagccugacuggccagcuagccuuagggauccuccugucucugccuacccaaugcugagaugauaggcauuuguugauaugaccauuuaaaacuauuucacuuauuauuuauguuuugggguuuuugguggaucaaacacaagcaauuauaacugugcaguaaacacuuuaccaacugauucauuuccgcagcccaacauguuugguuuuaaccaagcuaggaugcaucagacagugguaaaucaagacagaauagcuggagccugauagagaggggaagggcucagugcacaugguuuagcucuaacauggccucugaggcaaggcuauuuguccuccuucaaacaugucugguucugaaauucuguuaguacccucccuuuuuaaucuaugcuagaucuuaauaggcauagaauugaggcuuagggauucuuuggguuuaauagagcaaguucuguccuuuauagaaagccauuucagaguucaaucucaggaguaccuuguaaccgccauaaacguugcaagagugaugggcaucuugugggacuuaugugauuacuuuccauuucauaaggaagaaauaauccuucugugccugcaggaccuguugcacucccucugauggcuuguauuuguuuuguguuuugguaguuuccuguauauauagcuuguguugugauuauauucaccccuauugucuucuguuaccuaccuucccuucucucggaaccccuucugcccaacuaguuucccaguagcuacaguguucaaaaugacauuugacucugcagcaacaacgaacagucaacggcucugcagaaaaggcugaggcuccgugggcauuuccuugaagcaggguaggaugcuucaaggucaauucauuuauuucauccucauccuacccccucuuccaccaggguuauuuccuaagucaaccaagcaucuuauagucccaucccuugcacugguggaucguuuucccucugugcuuucucaugagaugccuuuagagggcagagugucugcccagacacaaacucgcucagccccacaguguuuccuaccaucauuuucuccuuauuuuccaucucagggggaaaaaaaaaacauagcuagucuuguccaacuugcucuuuauuucuucuguuucacgcuccccuaacuuucacuguuucuuccuuuuuaaaauucuuuuauacuuuccuuuaaaucaguuauuuacauauauucagguaguuucagauuuacacuguaaaauguaaauagcagaaggauggaaggaaugaaagagggagcuuaugaagaagacugaaaccucagaggccugaucugauuuaucaggaaaaauauccgugucuuuuuccucucccacuucucccgugguguaacuaaaacugcugugaugguggcuccugacuggugggugggauuugacuucucaaucugcugugaacucaguccguuguuuaucuuucacuguuaugagugaaugugucuauguguccauagaugggugcuugcauggguguaugcucguguguguguguguguguguguguguguguguguguguguguguguguguguuaggcauguguguauaugaguguauggguguguacuaguucaugaauguacauguaguggugauauaaugccaucuuagcugguauuauagacacugcugacuccauccuuugauuauugguucauccuuuugguuauugccugcacagcaagcacuuuauccaaggagccaucuccccccuuggcauuccuucuaaauaucuucaucuccuugaaagauucuuauccuugcuuagucuagauaucgguuuuguucaagcucaguguucuuuccugcuaaaccucuucugauaucugagaagucuuguccucagguacagacacacagauggcuuccagaucugaggccauaggcaacauuuucucagucucccauauuuucgacaugucauauucuuucacccaaggaaacaauaagccaaugugcccagacugagaaguccaauugcucagagcaucagcuacuuacccguugucaugacaauuuauaaacacacaccuccaucccagaacauucucucuguggucaaagacaaauuaaccuuuggccaaugugagcacauccaucuaugcaggagaugcucaucccaucuauucugcuucccaguagaccuugcuagaggacugauuauaugcucuuaagucuuccauuucuugguaaguuuuucacccuucacucuagaacuaaacucaaauaaggcucuguucaaggaaauaugugaacaaaguaaauuauguccaaugagucaccaucgugguaaccacugaaguugauaacuuaucuuguuucuuccccugcuagucaauuuucugaaaacauccuacaaagagguucuaauuccuugcaucuuuuugagucaucauuucacucuugugacauuugcuacagugacauugcucugaaaaagaccccuugcuucuugccuguuccaaaaggcaaaagguucagaucaacuguguccagauucacuuggugacagugagcauguggagagcacuuucuucagcauuuucuuacucuuuguucccgcugcauucucuguucucuuuauguagaagccccuggaaaaauacuucuuccuucugcauauauuauaaaaaaauguaucuuauucuuuacuuauuuauuuuauacccuacucacugcccccuccugguaacccccucccacaguccuucucccauucugccucccuuucuccuuugagucaguggggacccucuagguauccccaccuccaucucagcauuucaagucucuaugagacuagguguuuccucucccacugaagccagacaaggcaucccagcuagaagaacauaucccacauacaggcaacagcuuuugagacagccccuguuccaguuguucaggacccacaugaagaucaagcuguacuccugcuacauauguucggggaggucuagguccagccuguguauguucucugguuggugguucagacucugagagguccauggguccagguuaguugacuuuguuggucuugcuguggaguuccuauccccuuggggcccacaauccuuucuccuauucuuccauaagaguccccaagcuccauucacuguuuggcugugggugucuguaucugucugagucagcugcuggguggaacccucugaggacaacguuguauuuauucuuuagcugcuuauuauucugugauuuuccaaaggugacauucuuuucucauuuuauaucuucauuuuauaaucacucuuuuuuuuaaauuuucaugccuuacuaacacuugaucuucgcuaaaaggccaagaaacaauguuuucaugcuuuaaaaacucaaagaaaaguuauauuuaaauaucagaaauaacagaacaucuaguuuugaaugucuacacaacaaggcugaauugaaaucccagcucuuacacucacuuuccuaucauucaauuauguaugaguugcauggucaucuuguuauuauuuacaacuucuauaaggucaaaguucacuuucaugcaaacuacagucauugaaguugauggagcuuaugugucuauacacuaauguagucccauuacacaaucagagagccugggggcacaacacaaccaauuccucaccuucucuccuacuuccaguaucuguucaucugcccacuuccuuuccuuccuuccuauguacccucaaagcugucaaauccaaccauuuuuccuuguuggcuuuuucuauaaguuuugagagggaccugauuguauagaucuauagauucuacuauaggacucuuuuuuuucuauuuguagaaaacuccaucuacuuccugccucagugacaucuccuuacugcuaaaaaguuuauauuuaaaaguuuuaaaggacuccuuaaguucaucaggaugguguuguaucuuuagagugagacccccaagggcuuuccaaacacugaguuuucuguuuucaucuucaugugucugucauguacccuauccuucagcuaugaagacuuugucucaauuuuuagacuaugaaaugcccugaccucgaaguguguguauacauauaauuauauauauauauauauauaugaauauguauguauauaaucauauauaauuauguauauuguguauguauauguacauauguaauuauauauaauaguauuguaaauacacauuaaaauuaguggccucuuccauugcaguagaugaauuuuucccuuuccaagccuuugcccagcuagcuguucugauggaaacugauuguuauuuacuuaaugucuguucacaaauucccucuccacacccaaggcauucuuaucuuaauaguucacagugaaaaugaugugacacuaucauuauuguuuuauaguauaauucucuguaauacucaaaauucuuucuagauauaaugaauauuuuaauguucacuguaccauaauagaugauagaauccacuacaguaaugaauuguuaccgauuaaguacauaaauacaaacaaauucuaaguuaaaugacuugaagagaauaaaggaacccaaaggggucuuuagagugaaauauuacaggcaguaacuacacagguucuaaacauaguuaaagaagacaaagagcccggguuugucucugaccuuggcgguucacuagcuguccuacaauagaucuucccuuagcauucucccuuaguuccacuauguaguauguaccauugugauaaagauuaugaugaugaugaugacuccaggggcaauuacugcauagaccaauugaucaaauuauacauagcauuugauauagugcagucuucagugaagacauauucugcuuccuccauccccuggucugucacauuacucuauuauaaaaauaaaaauaaauuacauaacuuuggaucacuucguaaaaucaucauucagacuuacagaucuguagaaaugaaaugacaauugaaaucauuuaacucaagcccaucccauuuucauaggaaaguaucgucuacauuguucaagauacagucacacaguuuauugaaaguuaguugguaaagaucuaaggccagaguaaacuaccucccaauggcuuccauuuucagucacuuguacugaagaaagagugugacaaguggauuuuaaggaaaagcauagacauaguuaugacucuaugucgggaaacaagcagagaccaugugugugcagacuaauccuugccacauaaccacaccaaguauacuauucucuuuuuuuaaaugucuguuugggagguuuuucuuuuccaaagaaaggagaaaaaggcucaguggaaaauuaugaaauacuauuacauucaaaucugauuaaaauuacagugaccguaaagcccaaguugaggcagacacauucccuagggcuggcaugucgcucugaucaugucuaaucccaccucuuaugucuaguuuuaacuauguuaucuuucuccuacuaagugauauuccaagaaaaucaauuuuuaguuauauuauccauuuguucaaaguccagcagcaggguuagaauaaagaaaagaaaucuccauaaacgggguagagacaguuaugagaacacaaacucaaacuaucaguuugugccaaaaagagaaagaaaacacacuauaagagugaggauauuucuuccucuuaugggaauccaaaaaagaguuucuaaaugaaucuugcuugguuugagggauuucucucucuuuuuuuaauuccaugaguuucuuggucagaaguucaauuaucccaguuauuugucacuaaaucugauugaagacuuaacaaaacacaacaaagcccuuaauaacugggcucccagaugucugucauaauuucagaguugguagaauugucuauuuuugcucugaaauuucuuaaaacagcaagaguuagugcauucauguuuacuauuguucucaaacauuggaucauuugauggugaacaauuccccagacuggaagaagggcuaauuuuuguucuguguaugcaagggaaaagaaugcaacagcaagacuggaauuuuaggagcuggagagcuggcucaguguuugagggaugagagcauuugauacuuuaauagaggaccaaaguucgguucuuagcacacaaaccaaguggcucacaacugccuauaauuccagcuccagggaaucugaucccaucuucuagccuuuguaggcacuggugcacacaugugcaugaacacacacacacacacacacacuaaaucuuuuuuguuguuuuguuuuguuuuguuuuuugagauagggcuucucuguguauuccugacuguccuggaacucacucuguagaccaugcuggccuugaacucagaaaucugccugccucugcuucccaaguucuaggauuaaaggcguguaccaccacuacccagccacacacuaaaucuuaaaaacaaaagcauaacauuugaccuggagccuucuacacacagagauucuaggaagacucuccaaaccuuuugguaaucaccacugcauugcucuuauaccacugaucuuguuuuccaagagucacuucaugggagauugugcuaugucagggagguuaaugaugggaaugaucauuuggaaucgagcaaugugcuccuugagucauauaccccuucuguacagugguuuuaagguccuuucuucucccuggugccaaaucugaucccuuugaucccuuuauuccaccuuuuaaaaagagccauauauuuaaagaaaacuuaaagcuuuuuaugaaagcuaaggguguaggaaauaucugcagaauaacuuggucuucaugugaacugaagaauaucagaauuuagagcaggaaagagucuucaaaaucauccugucuagccagucccuugaugaaaauccuguucuuuccuauugucugagaauccaggaaauccuguacaccauaacucuuuuuuagagacucacauaucacauuagucacacuuaugucuuccagaaaaggacucucuauagcucuauuuaacaaggguugacuuaauuuauuugaucucagacaucuuuuugggagccagcaaucaggaauucauguaauauggaguacugaucuaucuucuuuccuuaaaagucuuugggcuugauccgcuuaucaaugaucaauggcuucuaaaauuagaaacuugguuuaauauauaaccaaccagguguacuguuccaauacauagaaaugcaaauuagcauuuaaggauuuauugaguccugagcuaacuuuuuauaaaguagugaaauggugacuguuagggccaccucuggaucugcuuaugaaaugacuguucuuacaccagcagcaguaacugugagcaucccacagugaugcaaagaaagcuagaaaaaacuacuuaagagggcucaaggguccaccccacauaauaaggaaaucaguuuaaaguccuaugacgucaugucagaggguauaggcaaguucauauaacucauacacaccacuagcaguuuucuugagguguauuugcauaauuuucugauaauccuggaauuuugggacuaguaguguuuccaaaaaaagugccguuucuguuauauaagcauguaauuuauauauuuauuuuaucagcuuguuuuucuacuuaucugagauauuaacagaucaaaggggccacuccucugaaaguugcuuucuaauagagugguucuggagugagaggcacaagaggaaaaaugaacaaauuuguuauuuugguaaaugauucauuauuuuucuguguucauugugguuccaaaugucuguguuucgcuguaguuucauaaaaacuguugauggaaauggcaaucaucaaauuagcaaacuuuauaagaaauaaaucgagcugaggagagaacucaauggcuacaguaccugcuuaaaaugucaaaauccugaguuguaucccuacuaccaaaacaauaauggucgucaucaucaucaucauugucgucgucaucaucaucaucuucuucaucauagggacuauuuuguuuauuuguguguauuuuggcgucuauccugugguuuaaaugaauccagcauaagacucuggaugaauuaccuugacucacuagucucauguccauaaauucccaucuuuaucuucucagccucaccugaaagucuuacagaaaucugccucuccaacaccuuuacauaugaagugaaugaaagccauggguaugaagugggguaccauccuuagaaauggcuagaucgaaaggaaaagugaaucuagcaguucuagucguauuuuaccuuauagcaacauuggcugcugaacauaggaauucaucaacuacucccuuuaugaaaaucccaagagccccuucaugaagaagcaggagaaagagauggaaaagaauucagguuaaaugauucuccuugauguggcuuuggcaaagcuuggugcugagucugaagcuccacuuggauugaaagagcuguucuaaggcuacaggcagucauaaaaccucagcaggcagccuguugaucaucucucuggcaaggcugugguagggugagaagugacuugccagaacacuugaaccugugcucaggggccagagagacauaguugcaagugaagguuuauuucagccacucacuaaacagaccgcgauauacacuuggugccaauuacuuaguuguuuuaauuaacuaauugaauauagcugguguguggcuuucagguuucuauagggaaaaaaaaaccauauauccagucccuauccaauuaaucuuucuucuuguagucaacaauguuccuaaaguauuagagauuggaggcagguaagcacaaagugacugguuggugagaaccaugcucauuuggaaauuagaauacacuaguuuaaagaaaagagcugagccucuuguuuaugccguucacauaguaaaacucaaucccaggaauuucaaauucucaugagaaaccucauuauuugagaagcaaauaauaaaaccuccuccucuuagucaagucugauauucaguacacauuucaauagaagccaaucuugcauaaauuuuuugucuccuugaauauaacaaaagaaugaaaagcuuucuaguaagagauacauuaaaugccaggugcuuagcacuuagaaaugguucuuaaaagcucaguuuaccacaauuuggggucaucucucuaaacaucacucaaaagaucaucuaccuuauucuuauaacuuucuauaacuucauauuccuguaggaggguagauaagaagcccaaugacugagccacagccaugccuuccaucuuauauaguguauauugaaguuaaagauguagaauuuugacaguucagaauuugaguuuugucuccauacccuaguggccaugcuuguaaccaugcaauuaaagacucaaaguguuugucuagagaguauggguaguaaggaucauggauagcccaugcugguucuggcacagacguggaauaagcaaguuugucucggugaauuccuuccaugcuucacuccugcugcuauacgugucuuccagugccuucuuguccucagaccuuuuagaaauacaucaagcucugauacccuuuacaccauccauagaaagagagaaucaaaacgucucuuuugguuauccuaauccuuagcguguguggagcgggaaagguguuuaacuggaguauacauuaagaguacuucaaaaccagagacacuaaaauuaagacuaaucuacuuuaaugauauacaauuguucuaguuguguucauguagcauuauuucuaauagaggguacuauaaaugcuuucaaauucaaaauauugagauagaaaaauaacugugcuucuuauuagaacuacuguagauauacuuccuugacccuaauaacaugcaguggcauuuugagcuaaggaaguggaucucuaagugcuugcuuauacagacaagaagaucugcggaucccuagaacccacauagaacuggccagaguagagcguaucuguaauucuggugguccaauggugagauggaaagcagagacaguagcaucucccagaagcucccagaaagcuaucuugguuaauguaaugguaaacaagauacuuuguccucaccaaggagggagcuaaagcauggcagucaguuagauuguucucggccuuccacauuuguaccauggaacaucauaccuguacauaucuguauacaccuguucucucucucucucauacacacacacacacacacacacacacacacacacacacacacacacacauacggauugauuuuaaaaugcgauggggagggcauuucacauuguauuucuaagauuaguguaaggauuaagcaacauauuuagaacagaacuagccaacaggcuguggguccccaugagggauauggaagaaguacccucucccucaaguggacuucuuguccuuuuccugcacaccaacuccuuuucugcguaucucucuuuauuucucaaccaccgcucuagugucauccugucgagugcauuuaguaaguauugcuuagcuagcggaauaucaacuaaucggguuaaaagguaacaagauagcugaccccauggcagaggcucagguuucucucuagccagcacacucuaagccaucccuuuauaugcccagagaaguaguuuagaaaugcacuuuuaacuggcagcaucuucaucccuccuccccuuacuguguucaaacacugagagucuucccuggagcacaauuuucuucuugaguacugaaagaacaacgugcaucuuucuauucaaugccacugaaggcaaguccacacaaagcacagagauuuggagucucaaagacagacaggagucagagaguaccugguagagcaguaacagaauauuuaaaucaaaguucuucuugggagggggccaagguagaguagaagugguuguaaccagauccuggccauggcaccaaaagcagcagcugugcugagggcccuuuggagcgcuugacugcacagccaagcaagccagagagaacacggcuuuaaaugccugcuggauuagagauaaaggcagaguggcgauugaguugcuuugauuucugcagaaacuggcacauuaaagucgggugcuguuuguaagaaaggccuuaauuuugacaaaacaaugaaccccaaacuaugcuucuaauauaucuauugugaccugauuuauaaaauacaacuucuaauaucucaggauuaaugccucaccuuuuaggccccagaaucaaguuagagcagugugguagaugaaaugugccccuccaaagaugccuauacccugcauaugucaccuaaaguagccacauugacuuugcagguaugacucacuuaaagacguugaguuuggagauuguuuuagauaauacaggugaguccaauaagaacucauggguccuuugaggaaagggaauuucugggguuguggucaaaaggaaguauggcaaucaaauaauaggcauucugagcugaauaugguaacgcauaccuggaaucucagcauuuggaagguagcaggauagcaggauuaagaauuugaggguggucuaagguauagagugagagcaaauccaaggaagagagagagagagagggagagagagagagagagagagagagagagagagagagagagagagagagagagagagagagagagagagagagagaggauuaagaugagaugaugggcagaagguuuucucacuguucuugccuuggagugaaaggaccaagaccaaauauguucccuugggaagacacagcucuguugaacaccuuggauuuagcccagugagacuucucacucagagaauccaacccuaaccuaacacaucugugauguauucaguggauaguagcugagguagaaacaggaagugaaagcaauuggauuuagaagcaaagcccuugccauaucacuucuuucgaaaaaacuacucccugguaccaggcugagaaccaguugaaucuuaagaaccauuucgggguauguagcucucucuccagaagaaagacuccaaagagaaaaaaaaaacuauaaaccccccacaacacaccuuucauuagcuuaccaauacuauagcaagugcauggcauaagcaacuucaaagaaaaaaggguucagcuuuggcucacaguuccagauuucucaguccacacucacuugauccuaucacuuugggccugugaugagacagaccaccauagcgggaaaagcgugguagaagaaagcuguguauuucauggugacuggaagggagaaagagaagggguuaggguccccauaucuuuuuaaggacauagucccaaugccauaacuuccucagucuaugccccagcuccugaauguucuaucauauuccaacaaggcuacacacugaaaaucaaaccuuuaacucauaggcuuugauggacauuaaagaucaaaacuauaacacauuguuuaaaaaaagaguuaacaucaguaacaguuaaauuccaaguaugucuaaacuuuuaaaacuguaacacaauauuguuuguucccuacaaagcucacacucaggaacuguacaaccaaguaacaagaaauacugcaaaaaaaaaaucucauaaagauuuaagcaaguuuaugauuuugugcugggucuccauauccuaguauguccagaacccacagaucacaauauugacagauuugaacacaauuuugauguacauaaucaugacagcacuuccugucaggugugcgcuugggaaguaugcagaaguuugaaccagaauauuauguuaaagggaaaagggaggguaagggaugaacccugucauuccgagccuaugccuucaaugugggugaaguucccaagaaagcagaggcaagugggacuuggacuaauccuaugaagguaucgagaucagagugucucuggcaguugacacagaaguaagaaaggaccuucuggccucagagcuuauggcccaucccucugugcuauucuuagucuaguuggugaaucccaucgcuucaauggcauauccugaggucacuggagacuccugcugaauugccugaggcuuugcugacacaucuauuugggguuugaaauuaguucaguagugaguaggaggcaggggcaggucgaucucugggaguucaaggccagcguagucuacaaagugaguuccaagacagccaaggcuauacagagaaagucugucucaacaacaaaugaacaaacaaacaaacaacaaagaguagugagauagugaggagggacaacgguacaaaggaagaaucuucuagaaauaaacaaauuucaauucuguauggugcaaacgcauauguguguguguguuugugugugugugugugugugauagcagggaaggccuuuuccccacaagcaggugauuaaaguaauguuucuuuugacacuauuuauuuuuagcuaaaacuuggaucuaugugaaguauauuggcauuacuuuagccacucuguauuuuacaaaugacuugugaugcauucuacuacuggucauacgauauacaaugccagacccaucuucuuacacauucccauauguaccuauguuuuuucuuuuucugaauuccuucuguuacauaaguuaaucaacagaucaauaauuuacaggauagcaaacaaacaagcagaaagauguguagguuaaagagaugacucaguggauuaaacguuuucuguguaagcaugaggaccagagguaauauccccagugcccauauaaaugucaggcaugaagaauggcccaccuguaaucuuaguacuccagagacagaaacaaggaucccgaggguaagcuggcuacugaagcuagccaaccuagcaagcucggaguuaaagugagagaggacuuggugaugacaauacauaguuucagucuguggccauggcaugcaugcacacacacauaaauaugaauaccuaccuacaaacacacaugcaccuaccuauauacauguguaugaacaccaugugcacaugcaaugacaagaagaaaaaaaugaaauucaugccauauuuaaagaacgugguauguccaaagacuucuaaaaacuuaauuauaaagggguguuucauaaggaaacauaaagcuagaucuuaaacaaagaaaaaagcgacuuagucuguccacagagcaauggaaagcaaaagaacaaugaaaagcugucuuucaccugaguuuggcaacaauccaaguauuacuaccuaucaaaaugacaagcacucacacacuuugauccagccauuucucuuguagaaauuuauguuaaaggugaaacuagucuauaugaauagaaaugaccugaaauguguaugauuuuuuucauuacaccauguaggugacggcaaacaacaaacaaacaaacaaaaaggacuaucagucaguuucuggauaaguaaguuuucacauaaacuuaauaaaagaugauuguacaguuaguugcccaugcccagaaaaugauucauuugugcuauuauaaaguuuucuuuuaguauaugguucaguguggcccucaaaggaggaguuuuggugucacaucuuggaugugacaugguguuagagugaguagaagcaaggauaccacugaacaacccagaauaaguagagaaaucucaucuccagcguagaguaauccaauccuaaaauaucccuagagucuuaaggugagaauugcgauucucgaauggugccagaaacugauuauaugguaucuaugcggcugggcuuaugagccaggagaggguagaagccuuucugugcuuuccacuuuguaguuguucaauucuguaucauaaauugcaugcauugcuuccuucaaacuacaucacuauugccucuuccucuccucuucucucuccuuucuucccucucucuuuuuccuccucccuuccuucugcuuccacccccucucccccuccuucucuuagcuuuuguugagcuuuuuuuuuuuuucuuaagcccuucaaagguugugaagaaaaaagucuuugauuugauucuuuagcuucuuugcuccuggcucuugcucccaggaaaagcucaaggauaucuauacugauugcuccaccauaggugagguauucucucauggaaaugaucaccaaaugagaggagacaguuguaggucacacaauuguaauggguucugucggaucaaaggagcuuuggagaaagguaaauauuagaaaaauuacacuaaagucugaaaaugucaacgucaauguuuucuccugggugaagacaaacauuccauuaaaggcacugauagcauagaggugccuuuagauagggagugacaguaguggcuuucuauaaagaccucuaaagauuucucuaaaauuuauuucauaaauguguuguaaauugucaggacuggcuuccucuuagugucgccacaagauagcagccagaagaagacaguaaaauucuauuuaccauaaaaguuaugcucacccccaccucucaauugccaauaggccaaagcuauuuauccaagauaagccgccaauggggccuuucaugugccagaacuaagucuacuugggucaagauaggaaccuggagaauuguacgugguaauagcauggcaaggacccuugauccaaauuuacuuucccuuucucaaucuuuuccucuuuauuuuagcauuucuauucaauuuuauuuuuuuauuuguugcuauuuuugaugcagaauucugugauguuaucuuuugaugcaaaaauucuuugaucuuaaggaucaguccccucaagaguagaaagaacugaccacuuucaacacagcaggagcugucuucuggcggugcuccucagcaaauagacaauauucuaacaaagguaauugacaucugacuucauuauccuuugggauaugcauugcucuguucugguucauagugaaacuguauuaaaaccaaaaagcaggugauagagggaguauaccgaugucuucguggggagacaguuguaagucaccacuuucacucacaagccaacuccaggaauggucaaagcuuuuguaguuucaagcagcaaggagaugaaaaaagaggaucagaauggaccagauugggucaaaagcaaaauccuuuuaagcacugcagccuuagagcuuguucugacagagaaacuuacccugucauuccagauauucaaagggagccagauugugagugcucgguuaaacuaauucccuccccaaccaaagaacuucuuuugcucaguaaaauaaaauauuauuuuuaaacgaggaacagaaaaccagagagagagagagagagacagagacagagacagagacagagacagagacagagagacagagagacagagagacagagagacagagagacagagacagagagacagaggcagagaaauaaaaaacauauaucauuaaaaagcuacagcucugaaaaucaugccuucuagaaccuuaauggaagaaagaacacacagagucacaugcgugugaugccugcuccuuacagcaacauaucaguaagcagaguuccccuugcagggugcuaacaugucauucggcucuaacccugcugugcaaacauagccaaggucaaggugguuauuggucucauuguagcugaaccucagacucugcauugugaagaguuagaaggccaccaagggccaaggcucacuuguaaaaaugaauguacaagauugaggagcaauguggggccuuugggucccuugcacucagguacaauugucagaaacugaaacucuuaccuggaguucaagccuuguggaaguucaagaaugucuggggcucacuacccaaagagcucuaccauacugaaggggucuagguucacugagaguuacuguuucacuaaagaauaugggggcgcugauuaggggagacaccuaauguugcuuguuuccuuaaaaagcuaugcuauguaaucucuuaaauuuuaucuguaguaaaaccugugcuauguucaucucugugugaccacugcaauagcuguacagaggggugagaaauccaguuuguucucuguuuguaccacaaagcuugcaagcacaucagacaugcacuuuaugggucccagagaguacaaaagaagugaggcuuaauuugauuuuuagaugcgaaguuaugguguucuuuugacacuuagaaugaggcuauuggaaagguauacuguucagguucaggaaagucacugacaaaucuagaaaaaguagaaaauuuuuugucagagaaaaucguaguuugaauccuaacucuaaaauuuaaugguggaacccuuaguauuuaugucugggaaauggaaaguaguucauguaacaacuagacaacuacuuacugagaagagaaauucccugauucuagauucuguguguguguguguguguguguguguguguguguguguguguguguguguguguguguguguugguuucuuugucuguguauaugcauguguguuuuuuguguauguuuaaauguguuucuuuguauauauguguguauguuuguguacauuugugcuuuacucguuguucuauugcugaaaagaaaaaaauucauggugaacauagugaaagaaaguauuaaaaugggggcuuacuuacaguuucagaggcauauuccauuaucaucauggcagggaccauggugucaugaauacagcuagagugguagcugagagcuacauccuuuuucccauguuuagagacagacagacagacagacagacagacagagacagagagagauagacugagaaagacagagucugaguccccugagcuuuugaagucuaaaagcuaccccaagugacacacuucuucuauaaaggccacacuugcaaaucccuauaacucuuucaaauagugccauuugcugacgacuaaacacuaaaauauaugaacccauuggugccauuauuauucaaaccccuacaguguguguauguccauauauguauauguaugcauaugugcauucuauguauauguuucuguguaugugugauccuuacaacuguauucacagguucugcauuuuuuucacaguuuggaggacagaaauucauggugcagauauguaaauucuaaucaaguuuucauuuacaguaaguguugguuuagauagaguuggaacccaggacaucaaagccuuggacucuacccaaccaccaucuuuugauuuguuauguggauggagcauauuguaccauuuauaauaccagcaaugaaucaauaucacacuuuggccucagaauugaagcucaguuuauauaugaugucuuuuuguuaucuauacuuuucuaauuuuaaaaucuuacaaauuuaucauaauuaagggacaauaucaaccaaaagacagcucuuauuuuuguugcuaaaaucccaacaagagauuacauugcaagaaucagaagauuagauggaauuuuucuagaaagauacugauuguuucauuaguagaaguccuuauaaaugaaguuuuuuuuuccauaaagccauagauauagucuaugauuuccucccaaggucucauuauuacaaaguucgauaaagcuuccaaaagagguaagcaacauaggaguaugcccucaacagccauuuuauauccucuggaucaacaggaacugaguguguuucccucaggagaaaaaaaaguuaagucacaccacugcucaaauuuaaguuuguaaauucuaucugaaaauuauuugcaguuuccaaagaacugaaauuucucaaucagggucugagggacuggggagauagcucagaugguacaggaugcuugcaacuuaaggauaaaacuuggaguccccauuguucacacaacaagccaugugcagugacaccugucuuucuaagugucagcuuagccaaaauagugagcuccaggccuagugggagaccuugugucaaaaauaugguagagagggauugagaaagacaccaugugaugaccuguggccuccauacuggaccauguguacauguccacaccauacacacacacacacacacacacacacacacacacacacacacacacaagcacaaauagguguuggagagaauccagugacuaugauucuaaaccaaacuucucagaagucccagaacauaguaguggagagaagacugcaugggaggucuccccagaggcaccgaugaucauucuuuuuagaaggaagauccauaauuucaaugacugagaucuagaaaccuuuaggagccaaaggagucaucaccuaguaauuuagcaucagcucugugguuugcuggugguucuuuucauguucaagacgggaauuguucaaacaauauaguugguuugaaaggcuuccagggccaaugcaaacaccaagugggcuacccagaaaccacacauuguuuccuuuagacaaaagauaaugaugcucuaaugaguuuuacccuuuauugcccucucuggaacacagccucaggaagaaaacccacaaaaccaaauuuguuagucccaacguuuacaaucuuuugcaaugaccccagucccuuuuacuuuaaaugcugguacuuguguuaagaguuuguguuguuuaacucauauaucccaaccucauguaaucuccaaagugcccucccagagagagaaaggaaaugagcaaaugagggaaaauaucaagaggguuggugauagacccuccaagauaaucaaagugcuucugagauaugagccaacucaugguaggugacaagccaauacuauuuuguacuaucuagaaggauugucuagugaaaagaaacugggcuaauaugaccaugugaugagaaacauuuaauagauaaccaaagguaagaguagaggacauuccucaguugauuagacauuuaaaggcgugaacauuguaagguaugggacccacagggaucauuugugguaugcuugagaagagauauaggugccuaaccagagcugaaauuacccauagaucuuucauauccucauaguacguccucuccuugugccaagcacugccucagcuccaugcacauauccaacagcaguucuaaacugcuuucuuugaguguugcuugauagcuucuuaucagaucugcuggaugcagcuuucuucugcugcugcucuucugcucuucugaagguugacugugaucccucuccugccagaucaauaguggcauuuauguuucucugccuguuugauuucaauagauuugugaauggcugaaucccccuccucgugucuuggucuacauggcacaguuucuccaguuuugcaugacuuaccucuggcuauuccuuugcggucuuuuuuucucugauuccuucucaacaugacucgcugauccugggggagggggaaauucucaguucuuuuaucuccagaaucuauaagcaugcugcucugcccuguuuuccuguccuugaaauguaucuuacagccauuuccuucucuucuccaucacuaucacccaaguccccaaagccacugcuuugucaucuagauuauaccaauugccuugugugcucuuguaucucuacagaguacuugaguucuugguucucuaggcauugaauuggaacugggaacuuugucacuuuaaauccgguguugugcuucucacuaaacacaaacaaaaaaacuccacuuguucuccacuuucucacaguccgcaaagccauccauucuuuagucuauaccaucucucuuuccccuucccucucucccuuccuuucucauuguacagcccagacuggccuggauucuauuaugaagcgccagcuggcuuugaaccccaauccaacauugggauaacaagcauaggccaucgucuucagcccuaaaaauucaucuuuaguugucuuugcagagcuagaggucaaugcagggcuuugugaauguugaguaagcagugaaccucggagcuacauuccuggccugucugugccucucuaucacucugcuuagccacuaaacuccagauauuaauuguacgucaucacuaaaguguaacuucuaaggaaaguggaacauuauuuacuaucuuaaacauauuuacauuauuuacagugccuaccacagugccuggcacccagucauuucauaguaaaugucuguugagauaaggaguagaugaaaguuggaaguuucuuuuaaaaggggacccccagaaacagaucuuauuccagccaauaauaucaccaauggcuuuugauaggacaacaagggaaagauauaacaaaucuccaucagaaaguugagcuaugaagguggguuuuucaugaaaucuuauacaaaauuauucuuaagauauccccuuauguacagugauuaaaauauagagauccagagugcugcauuauguguuuuuaaaaguucacaauuuuguggcaucugaaugaacugcaauuaucaagaaguuuuuuuagaaauuucauuuaauuauuagcauguuuauaagucaaguccuuuccuauaagcuuuggaaggcuuguuccaauacagagugcuaggcuucaaacccccaucucuacaguuucuuauucugcauauuugagggauguuggggauaggagggaggguacaagauuugcauuuuucaucaccauaauuuaagaaacucugcaucaagauuaaaaagcaauuguaaaauuugggaaagggccccaguaucaggauaguauuacuaucuagaaguuagaaacagccaaauuagaccaacaauuaaauacuuugaauguacuuaugguagagaugauauacaucucuauauagacauagacauagacauagacauagacauagacauagacauagacauagacauagacauagacauagacauagacauagacauagacauagacauagacauagacauagacauagacauagacauagauauauuccuuaaaagcuguccauacuuguguuuggauuuggggucuuguaaccaaaauauaaugauguaaaaaauaaguuuuuaaauaauuaagcaagugaacuuggaccauguacagaaacacuuuccucccaaaaccuuucacauccacaucuucucagagauacaaagcuuagugcucugaagcaaaccaugcacugucuugcucauugacauaauacuaauuauugauuuugacuuuuaaccacaagggaaguuuuuuacucaggucauuuuagagcacuuguuugaaauucccauuuaguucauuccucuacuaauuaugcuuuuaaauugaaaugaaauucauauaacauaacauuagccacucucccuaguugugugcuuuugcauauucaucuucagcugcuugggaggcugaggcccugaacccuggaacucaaggcagcuugagcagcacagggagagccaucucuagauaaauacauauaauauagagaaaccauugaccuucaaguucacuacuccauggccuuuagcaccuuugcaauguuuugaagucaugagcccuaucuaauuaaaauuaauauuaccucagagggaaagccugaacugaauacuuguuuuucauucugucaccucuagacccugacaacugucacugccuuuugucucccuguuuucugcauuccauuagcaguuuaaauagcuguagaguuguugcuucuuuguguuuguugaauacguauuggguaggaauacuuuccuaugaccuaucuggucacuggcuauuacuuuucucuggaguaccuuaacugugauuucagagaucauggugguagaucuuuguacucaaauuguaugaggugagaggugugugugugucugugugugugugugugugugugauguguguuugaauacauaauagcauauguguggacucaugacuauucagaugugcaugcaugugaguuugcuuguguuccagcuagagacugauauuuggucucuucuuuggccauucuacuauauucgcugaggcaacauuucuugauaccauaucuuggauauuaggcuauucaagcaagccaacuugucucauguuccugucucugcuucccaaguacuaggauuacagacaagccauuauaccuauugacauuucauuaggaugcugcagauccaaacuuuggccacagagccaucugccucuuucuucuuuggcuuucauauuuucagaguguaucuagucugaaaaagaccuaaacaucaagaaaaaguggagaaaaggagaggcaguugggggcauucagcaucaaaugagcugguuccuggaaaaggcuuugcguaagggaaaauggcagacaguaaaccagauucuuggguugugacugcuuuucuuggaacucuccuggacaucauggcacucaggcuucacaggaaagggauccuaugugagagcgcuggucucucucacaucccuccaccaccauucacuacagauguucguugcuuuaaacacaggcaaacuguuugaagagcgguuagaucucaguuuccacuaauguugccccugcuugcucugcaugucugcucuuuuguuuuugaucuuuauuaaugaagacauaauuaaugaaguuuacacuugccaguggaccagaaccaagauaauuacuguuuagguaaauacucuugacugggauuugacguaagggugcauauuaaaaaucccaguucucagguucugauucaggucaugguugucaccauuccucccaucccacuguaugcacacaugagcugcauuucuagcaaguccucagguauaacugguucauagcgacauguaaucaacacaagacucuuuauugaauuugcauugcauaccaauaacaaauauugugacauuuguucuugagaaagacgugccaauauugcuuggaaacaguauguuagaaaauaauuugauaagcuuggcuuaagguagaagugggucuguuugauguuaacaagaaacauucucugcgaauacuucaaaaguucaguggaaguccauuuuauuuacauuauuuauaauuaggcugaucuaagcaaagaucuaaacagaguuauaaaaugcagaauggacaccaagccucaugagcacaugugcauucaguaaauauuugcugcaugaaugguacacuuaaauuugcuuuauuucccaaauaaaaagcaaaagaaugauggcuuuaaucucccagacuuuucccuucucggauaucacuuauagucuggauguaugaauacuagcaaaugcaacaucuguaauuucucagaaauauugaucuccauucauuugcucaacaaguauucauuguucaucuuuuauguggugagacaugugcuacauucuagggauaugguagacaugguuucuacucugaugaaguuuuucuacuagagaaaauaguaagucagguuuacugggagaagguugaccacuagggaaaccaaagaauucucagaaaaaguagaaugagcaucagugaaaggcauagaccagcuucagauuugauucauuuuguccauugcuucaaugugacucagccuaauuucuuucauuauggcuuagagccuauaaaaugaaagaaaagggaaagguaaaagaacguguauguauuuuauaugcaggaaugugugcauguucuuaugugugagcauauacauuuccacaggugugaguagaugugugugcauguggaaggcagaagucaguuuggagugucauuucucaggagcccuccacuuugguuuuugagacaugagucuauuauuggagcucaccaacuaggcuuugucugcuggucggaaagcccuagggaucugacugucucuuccuucccagugcaggaauuucuaugaaagcgugugucacgaugcacagccuuuaauaugggugcuagcgaugggagccguauuuuccauguaaugcagcacacauuggauucacuaagauaucuuccuggagcugaacaaugggaguuuuauaaguaguuuuauaugucuagaauuggcaaguauauagagacagaaaguggacaacugguugccuggggcuggaggugguguccuauaaaugggugaggaguaugcugugugaacuauaacucaguaacuuggcuucaggaaagagggcugggaguguggcuaagugauggaauguagcaugcccauggcccuggacugaauccauagcaucaaaagaaagaagaccaccuuuuagccuucccaacaaccuacugacucagucucuuaaaugucugaagggauaucaggaguauuggaaagcuaugcauuucccccuugguuuguuccaccccuguugcaaucuugcuccugaccacaucugccuucucuggaacccauccaucaaccuggaccuaaauccauccaaccaggaagaauuuaguucucauuaauuagauuugcucguugacaauuucaugcacucauauaaugcauucuauacgacucugaccccauugcucagcuccuccuuacucaugucacccccugccacacuucccuaaacaccucuuuuucaccuucaugccucugaucuguuuuaggacccacuggauuuaaccagagccuucucuggggccauggguucagaacuguccacuggagcuuccugggcucgccauugagggaaggcuuuccagauguugucuccgcuaacuucuggcagccuuuguucuuuaugauuuugcaaggucacccucauggguuuccuuucuguacugugcuggaaagcuuguuugucccagaguugcacccacaggcucuggguaagauaccagcucuacugugcuuuacagacaagccaucuuccugcucucacacagccagacacaacuauagcuuggcguccuacaauccaucucuguuggcauuuucuuuccuagugcauauagacauccuguccccaugcaacugcucuuuucugaucuccgagguuagucagcuccucucacaacauccaauugacugacccaaauaaccuaguuuuuuuuuuccauuguccuuauucuugggucuauuaaaacacaacuacauuaaaaaaaaaauccuuccuuucucuucccauaggcccuugauucagucuagaaagcuugauuucauggcucucuucaaaaacucaaucacauaauuauauauucuccuacucucaugguuacaggaacccuuuucuugcucuaggauaccaauaacccccuucauguaucaagccuuauagagguacacaggguacgaaugacgaaccaguggaugaguuagcacacagcuuuaacagaagugcccccuauugagggccuguaaguggagagugauuuuccucuugguauucauuuuuaauauguuuucaacacuuuuuuucuucaguuuuuccauagcuccaucuccauuggcauguuucaagucuccugguugucucugauuauguuuguuuucuuugguccagagccuuggauuugcccuccaauuugucugaauucagcaucaguugucaauagcagcuaacuugaaggaggccgagugccugagaagcaacaccaaccaaaccagacuucuuguuucaauuagauuacuuaauacaggguuuuccagucucuucaggccgauuagccaacuaaguauuuuugaaagacugucaggaaaagagagguugcacagcuugaggacacgagugaaugaaucagagaggagcggagcuugagcgcuuuccuaaccuucauauacgcacauaaaauuuuuaugagccaaagagauggagggugacuuacucuccuugcccagcauuauagccacacuagucauauuuaugcaagguaauaauagacuucucugccugcacuaaugucugccucuccaacaugguuauuucuaaauauaaccuguggcuuuuuucaguggucaucuaaaauuugcagugaguaucauuuaaagaauaucaaagguuguguguuucaaaccaaaauccccccucauaaccuuccuagagggcucuaaauaucauacauaucucaugcauauuauuacauguauuugaaguacaaauaaaauauuccuuuaaugaaaauuuuauauaaugucuuuuucuccuuaaguacauuuuucacgcuagcgguccugguagguuuuauacuuguaaauccuuugcuuucauucucuuugucuuuucaaugaaagaaacuaagcaucuaagauuuacuuuuuagucaguggccacaaaacaugaaauauuuaaaauuuccugugagucaagcauuuuugugacuaacaguauuuuugaucaaauaguaugaccaugguaugaauuuagcaauuaguuauuaaacagagacuuauaccuuucagugacauaccucugcagaguuaucuccugugagauguguuuaguauguaugcuuugugaaugaauacugcugaucugcggucagccugagcugcaggagaaccugucucuaaaagccaauaggaaacuacauuuauagaauaccgguaaaauccauucucucacccacucuuucaucacacauaaauaaauauucuacaucauucuccauagcuaucauaaaugacuguggaaacaaagauuaaaaacccuugucuuccaauuauuuacauucaaauaggggagaaaaugugcauacagugguuauauugugucgguuggcuguaacugagcaauuauuuaaaauaugaagaacacaggaaauaaagaugcuguagaaaacaugaaugauuucacaaugaaacucauauucaaauaauaaccagugacuaacagugacccuagaaacuacauaaggcauauaaauaauaauaaauaauaauaaagaaaaauggcuuucuugacauauagaaguugcaagcacccucacauaggguugaacauguaguuuuacaaguuucacauauagaguagauggugaauagaugccauggggucagacaagaaagggacaaagauccuugaaggucuuugcuaacugccaaagagguugaauuugugauggaaaacuuuuaaagggugaauuuuaaaggaacauucuagucagugucugauuagaaauuuuguguaugagagcucaaucuggaacuggaagcaggcaggccagugaagcgacuagcaucaggaccauuaucaaggaccuggcucuaaggauuauguguaagugagguguggaagagugacgucaguguauuaaaugugugagaagauaagcucaaauucccauaaacuaaucugauuucaaaacugaagauuacucucgggaggcagagguagauggaacucuggguuuaaggccagccuggucuacauagugaguucuaggacuguugggauuacauagagaaaaccuguuuaggaaaacaaacaucaacaacaucaaauugcucuugcacuugcaaguaucaagcacagagcagacaguaaccaaaucuggcaggcucgugagguaaccugauaaagauuagucagugaagacucucuuuucaaaagauucuaugcuucgucaaguugacaguuuaugcuauuggaacagguaucagaucuuugcauaacaacacacacacagacaaagacagacagaaagacagacagauagacacacagguacacagauacacagaaacacacacacaaucugcaguaguaauuucucauggcggguguuuuuucaucuacgaaaaaauaguaccauucuggcaauguggggacgacacugggcuguacaguaucugcuguggucagccuccuuggacaucagcccaaaugaugaaaugaugaacaguuugacucagacaggucaguaaaguggaaauguaaauuaauccguuuagauuucaagcuccuaaaucacaugggaggccuugauauuucugauuugagguugcuagccacuucagagucuauucgugacacuucagagacuugcagucaggacuucugaguucaccucacccaauauuccaacuaacuucucugucuuccagugagcugcaaccagacuucacuuuguagucagaggacaacugggccugaacucgaugugaccuucuaaucagagacaugcaaauuaaucauaagauguccuuucacguggguuuuuuuuucagauaggcaaaaauaaugugugcuaauaucaagugcuggcaaguaugagcagcugcagggacccacauccuacucuggggaaagaaugcuggugucagcauuuggaaagcaacccgccaaaccuagcccagcugaaucugagcacagccugugacccagcguuuugcacuucuccauaucuccuguaauaacaacaauaauaaacaaacaaacaaacaaacaaacaaauaaauaauaaaaaccugcaacuggcaggcauagauaaacagauauuaaaaguguucaguguagcaaccuugacugcaguagacaagcagaagcacccucaguaagaugaauggaggagaucagucauuuuaauagucagcagaaggaugaacugaugucugcagguacccaaggguguaaagucucaagcauauauuucugaaacagaaaguagagggggguauuauuuauguaaaaaauuauuacacacccucaaacaaugcucaugcauagaacaugagcagaaacauaagcaguggaugguaugaugcagaccagagacagaaugcugguagucccaauaaggacauccagaaagaguuggggagggaacugucauauagccucucuacauacucauauuauguuuuucaaaauugagacuuguaaaauaaagaugagaagugucaauauuguuuacaucuuggugacaggcacauaggauuuauucuguuuucugugccucccuguuugaaacauugaacaguuagaaauuuugaaggcugaagaacugaacccuaaaaaaagcaacaacuaaguuagacaggcgggcuuuggggcaagacuugucugagcuuuucuguaaaaggccacaagaaaauauucauucauucauucauucauucauucauucauucauucauucauuuauuuauuuaucuaucuauuuauuuauuuauuuauuuauuuauuuauuuauuuauuuauuuauuauauguaaguacacuguagcugucuucagacacuccagaagagggcauccgauuucauuacagaugguugugagccaccaugugauugcugggacuugaacucaaaaccuccggaagagcagucagugcucuuaacucgcugagccaucucuccagccccaaaaauauauuuuuugacuuugugugcaucauagucacugacuucacuacgcauucugcccuuacagcacaaaggcagccccaggcaacagguaaaagagaguguggcacaagcuuauuuacaaaacagaaccucagauuugguguggcccccaugggccacaguuugccucaguuuaaggcugccaggggggccucguuucaauagcaagcuaccccaucugugaucugugagaucaaggaauuccugugucucuagagaguuagauaaggagcauaacauuaccuucuugguauaagauucaaaacgagagaugaagggcccuuagcuguggcuggagaagacccaccaacaauaaucccugaacauuaaaaaggcugggggguugcauuugcauuuuuuuuguuguuguuguugcuuagauucugccucauuggauagaugagaaguuuaucucauuugcuuucuuccauccucugguggucuggaauucuuagguuaucgaaucugcucuguccccauucuauucucuacuccuaccaacagaguccaguacagccuugcccugaugucuaaaauccauuaaggucacucugagggugagguccccagcuucacugcaucuuuggcuuuugcacaucugcagaugccuaagcacucagcacuuccaugccuuuucuagaaaucagaagugugcugugauagaagcuucucuuuagucuugacuguucugugaagaagugauagcaacuuauuauuuggcugccuaggugguaggccacucuggcuucagaggucaggcccaagggcguucacuuaggggaaauacuuccacaaccaacucucucuuuauacaaucaacucuggccaaccuagucugcuuaggccaucagcauuuauaguccuggcacacuuugcacauugacaauguugucgggccagaaggaugguuaauaaaaccaacaggaguuauuuaugaguuucuucugauacaagccaaacacaagaugugaggauaaaaugaaguauccccgugcugucguugcuggcagucggaacagcauuccugagaggugguuauaugccagccacuucucugaauagcuaagagguucaggacagcacugaaaugcuaaacucaggucccagucagcccacugggguaugugggauggaugacaaacugaagaacagguaugcaccuucuauccucuuaugacccuuauaagagcaagggccaguagaguaggugccaauagcaguagcuagcuuaacuguccccaaaguuauaagaacaccuccccaacagucauuguagcaaaacaggugaguaacuggcuuaccuguuguggaacugagaugccauguccucagccaguuuccuauuaccacaugggaauaaguuauguguguaagagaguugggcuggggaggagagccagacuuguccccaguuauguagauuucaucaguaucuuucccuuuccuaaaaguuggaaguuuguucuacuuccucaguuccugggagaccacgcuuccaggcauggaugccagauguucacaugccauuuuaaaccguucaaagaacgccuguuacuaaucaccacuucgaauacuguucacacgaagaguuucggccccaaaaucgaucugagcauguuuuagcucccuucucccugacagcagugaggagcugcugaaggagaagccugaaguuugagcugaaccaagaguucaugacaggcuguuguuggagcucagagcugaggacuaggcugaccauaaaucuuugcuggcugagacuugaaaacgcuugguuuuguuuacuuagaguguuaauaauuuuuggaaauuauuaaaguagaaccaaaagacucuccuuucaagaggcgacugagaucccaaaucacuccacagacucaauaagccgaacgaguccaagucucagcucuugccaugggucugguggauguguggccauuaucauaugacacuucauguguggaaccgaggaagcgugagaaaagcccaagaaacuuggacguaaaauuuaauaauugugguggacaaauguuuuuauagugacaggaaaaaucaaguccuuucuuucucagcucucuagugguucuuccuguuggucaguagugucuacauugucuaaaaguagccugagacaaauucuuuuuggauuuuucuccccuuccuuauuuuuugagaauggaucucgaugaacccagggcucugggguuggcuagauuggcuggcccgugaagugagcccugaauccucuucuugcuccugaccagccuggaaucacaggugugugccuucaugccaggcauuucuuuacaugguugcuggggauggaaacacagaucuucaagcuuucucaugaagcaccuuaacccuugagccaucuccuuagccuacuggggacucgucugcccuagacuugaaauuacccggacuauuucuguuccuuucccaagcauaauccgugcauuuuccucauacccuaacacccacugguagcaguuuucuuuuacugaagcaaagcugagaaacugaaaaguaugaaugguuuauuuuggcucacaguuuugaagguuuuaguccuucaaaacggguccauggagaagugucggauuaagguaggacugugcagcagagaaagcugcccacugcaugucagcccucccccaccucaccccccaaaaaagaguagggaugcucacccuucagucucuuucaagcacaaacccacagucuuccuaccagguucuaccucugaauguguccuccacaugcaaacucagcgggguuugggggacucacauggagucuggaggauguuugacagcucaacuguaacaugaaaaugcugguguuagcaaaaccucugauaguguugacucuagcuccaguucuccacauguaguugaggacaggagaucaucaucuuugagaugagguacauugccaauugucacuuagaccuagacuacuaagagugacauacauugugauuuaccauaggcaugucaacauaacuuuuuaagaaagagcuagcuacauucauggaaaucaguauaacagagccgguacgccaggauucaaauacuucauauacaggcuuugugauuucuggcaaguggcauagccuuuccaagccuguguccuugucugugaaguugggaagacaguuauacccggucuaugcaacuccaacuauuaauuacauuuacguaugaaaggaaauggaaaaccuuuugauauaucuuaagaaccaauaaauugaagcuauucuaauacuaaauggcagcaugagauuagaguuuggagaaggaaaucugagaugaaggacuuugagacucagauaagcuauggcaagacugaaaugucaagcaauuaagccauuauuaaccuacacagugcacaccugcuggcuacauccugcaugcuauuguuguuacuaagcuaucuuggcuuugggcuacaucaacacuacuggcuuuuuuuuucucugaaauuguucaacuuacugcuguaacaacgauccuuuuuguuguuguuguuguuguuguuguuguuguuguuguugacaaaauacuugacuuagcuaugucuuaagagaggguuuauuuuggcuuacaguguaaagggauacagucugacucuucaagaaagguaugguggcaggaauacagguggggcucuucaacagaccggaaguagcaccaucuaccccagugacucaccagcugagaccuaaauauuuaaacagcaugagcuaugagggacacugcccauucaaaacacagcacggcuuucucguauuacuguaaaacauucugguuauagggcacugugcaguguggucacggcugccuucuguuauacucuuuaauuucuggguauccagccauaaacacuaagugaaaacgauggauagucaccagauaacccucccugaucagcucuucuuucguugcaggauguucuggaagcucucgcugaccuugcuccugguggcugugcugguaaagguagcugaaacacggaagaaccggccugcgggcgccauccccucgccuuacaaggaugguagcagcaacaacucagagagguggcaucaccagaucaaggaggugcuggccuccagccaggaggcccugguagucaccgagcgcaaguaccucaagagugacuggugcaagacgcagccucugcggcagacagugagcgaggaggguugccgcagccgcaccauccucaaccgcuucugcuacggccagugcaacuccuucuacaucccgcgacacgugaagaaggaggaggacuccuuccaauccugcgcuuucugcaagccccagcgugucaccucugucaucguagagcucgaaugcccgggucucgacccaccuuuccgaaucaagaaaauccagaaggugaagcauugccggugcaugucagugaaccugagugacuccgacaagcagugaacucauggggcaggaugcagcucagccuugagcacuccuaccccuggguugcgccaccgccacuucuguugagcucacucacacucugcccggugucccagucagcagcaaaugugucucuuagggccaacagugucccugucacaaaugaggaccacaagugaagcuuugucaacugucccagauccaccccaggcuacacuugugucucuaaauccacuuuguggaugggacacagaagauguuggaaaacuccacucccagaaacucgacaagauuuuucaggagaugcacugucaucugggauugacgacuccaccauguggaaaagccagucuuucccuggccacauccuacacuccagcuugagccuuccucuggugaaggaugcacgacucuucugucgcaaacuuuuguuggucaccggaccucuguggugugaacauucuuucuucugaccugggaguugcccagcucugccgcugcugugaugcugaugugggcagcaucuauaaaggagaugcucacccgcaagggguuccagaacaaaucugguacccacgaggacaagccaaaccaaguggaucaggaaauggacuucccuaggaacuguacugagcaggcaagacucuccacaccucuggacaccaccaccucuuuauuuccuucucauagccccuaucuguagcucaagauaaacucuggugugcaugcuauuccugcugcuguguuaacacucacaaggucucuguauuagugucagucuuauaauugaccuaucauguuaaaaacaguuaaaaguauuaucaacauauucauauaucaagucacguguuuggacucuagcuuagcaucacuguucugaauagggaguagagcaucgagugaucuguggaaaaguauuuuacagaggaaaaacugccaggucagcaauucacuccccaacccaccccccacccccccacccccgcuugcucacacacacucucucuuuccagauugagcagggagaugggacacaucaugauuuuacuuuuaauaugacaucacaggagagacuaaagcauuguggcauaguguacaaaccggauugggacagagguguguacagaggagucacuaggaagcuguaaagauuaaaaggcacgugugagaggagaccugguacuguuuucacugccauuacacuaaguaaaaaaauauuuucuauuaaaagauauguaagaauauaugguauugagacauuuugugacacaggcagaaauauagagccaauauagaggguaguaauguagguaaacugucacucagaggauagcuuccuguacaaagaauagacuccuaaaauaccaagaaacauuucagucaucuucaguucugcugaugaguuguuggagucucuguuguguggucuuuugaugcgaggacuuugaaauaauuuauuuuuccuucaaaauuacacucaaguucaaucucuuugugcaauuguucuagggaggccucccugagaauggcacguaugcaaucugacaaaugugaaugagaaaccuuggugggaauccgaaugugcugaaauccuuugguugauaauuucccaguccaugcucuugccaagauggguguccuaguaugugagggagacuauccauaagcugcucugagacucaggcuuguggaugcccagcagugaugcuggcucuccagucugccaccuggaggaggguugggaugagcuggggaggguaugccuuggacucuuuugccuguauugcaauguaaguuuucuaguuucaucacuucugcuacacagcaaccaugaguagagacuaugugguuuugaaggggauauuagcuucagaaaugagagugcacagccuggaaucagcagagagaaacaagggggaaauggaaaaaucacagagggcuggaaaccccagggauaaaggcaaaaagggaagagggugccaaaggucagagauacaauuuucacuuuuagcagaaaaucucgagguagagccaaagcagaacaugcaguagaaaagcugugaaagagauaugaguguccuuaauggaggauggugacauguaaccggagggugaggagaagagucucacacccagcugcgaagccagcccaugucauucuauuaaugggacccacacaucaccaggaaagguuaagcuagggacccacaauguauguaugugagcauucuuuuugauccuaaugguggguguacccaugaaggcuauaugauaugcuguagucugaggcuacuucuuggcuuauuguauguauaaaguuuaccuucgaauggcucaaauuguauuuaaauugugucuuguuuauaaaugaagaaaagcuauaaguauaauguaauuauuuuauagguauacuauuaaguuauagaacaaauaaagauacucuaggauucuaugugauccuggcaucaugugccauaaaagcugaauucugcacuuguguccuuguguacucagagugcauuuauccagccucugagacuucacccacgguccguaucauaaacguuccuucggggggcuugggaucuucuaggagaauuagaaacaggcaucaaacaagaagaauuggugggauggcucucaccuccagucuaugggaacuucaagccuuuauugaaacacccaccagcugaauacagaauguacucagaguguucuuggaauaagaaauauugaaugaggaagcuuugagagacagaugcaaagagaaguccacuguaagucucuucuucucuccuguagccagugcaccacacuugugucuuacagaagccagagauuguauuguuuuguucuauuuuauguuuacuuuccacggguuucaacauuucuuaauuuaaacacaucucagccucacaguguugucaucuuccugcaaacugaguuaucugccauuuaagacaugcaaugaucaauaaaagaaauaaaaaccuugacaaaacugca

SEQ ID NO: 535 - RNA, 80468 nt, Mus musculus
cgaggcgccugcgcacugagcugccguucgcugccguucccgcuauguguggggcguguguggaauaacguuauugcccagcggaaccgaggggcccccagcuccacggcggcggcgacgacgacgacgacaacggcgaggggguggggggaggacagcguggcagagacagacgggacgcgccgcgccccgccucccgguccggucccucucugcggugagggguaagugaugcgcucggggucggcauggcccgggauucugcacauccauagcuccggcggccggggccggggccugggcgcggcccgcggcgggauggagugcgggccuggagggcgaggggcgccaccgggacgccccgcgcggccgccgcccucccguccccucccuccccucccccaugggcugcggccggcugcacagggccggcuucccuucagugcgcccgguccucuucuguucacucccgcuuuguguagccgccgccugagcugccugggaacgcugcgggcggagcgucuaaggaauggcugcgcugccgcugggcaagggaguuuuccagggcgcccaucccuuuuguaggguugguuucggggugugaggaggguggcggcggugaggagggggugacggacgacuagccuucagauggcguugggagggcguggaagacgugcugucacgcaggcugccgggcgacagcacaccacguagccuccagcucgguaguaaacccacgggaggagcgaguggcuuccugugggcuucauugucccaagauucaguuguuggguuugggucuaguucacuuccauuuuuauucaagggagagagagagagagagcagcugcgugacauguacgggaagacaaggaauuguguccuaagucauaugaucucuguuuucugauuuugaguauaaacugucguccugacccccauccccaaagaguauaaagacaggcuguacaggcuagagucccaagucugccaagcugaucaauuuaaaauuacuaggugacaaugagggcuggguuuagguagggccugacagcgaagcuguuguuuagcagggaaaugaaccagcagaauuauuuuuuccacuggguggguaaugcguucauguuccuaagggaauacauuaggaucugcuuaaagcaaacaacaacaacaaaaacauaggccaccuauguuuuaguuuaugaaauugauugguuuuuauucuguuaaugagaauucaaccacuuggagaggaaggaauuuauugaagcagacaauacauuuacuugaaaaugcauccuuuaaaaucguuugaaaucuuaagcuuaugguauuugcagugcuuugccaaccuuuuugcuuaaaacaagccgacgauaggaugaagcaggaugaggaggagcaaguggaaggauagugugagaguuacauuauaaauacagaaccuaaaucuuuacugauaaagcccgauguauuuaggcugcagggacugaggaagucagcccugggaaauagcaaguuacaaaccaagcaaucuguauuuuugccauuguuuuaaaaaauaaaacucgcacagcuuuuaguuuuuccuucuguaaguacucuaaaacguugguguccuaaaacaggagucuuaagugggcuuaacauaaaaccaagaagauccuaagguaggcaaaguuggaugacuugucugccaacucugaggcaauggaaggcagagccaaacaaaaccaagaucagcauuucagugugaucucuccuauguguguacccuaguccccuuguccugcacacacauauagaacauauucuacaugcuccuugaguggucugcuucaguuaacucuauucucacaguuguauuaauuuaauccuugugacauauauuauuaauuauacugaaguggagcuugaguuuuauagacuaauggaaaaugugccuuuucuuaaaaaaauggcuucccugcuuauuaauaaccaaaauguaauacaugucuccuaauauuuucuagcaugguaacccuauaaccuguguuaaaaauaaaauauacacacaagaacuucguuuuuuuuuuuuuuuuuuuuuuuuuuuuuuuuuuuuuuuuugguuuuuugguuuuucgagacaggguuucucuguguagcccuggcuguccuggaacucacuuuguagaccuuuguaguucaaggcuggccuugaacucagaaauccgccugccucugccucccaagugcuaggauuaaaggcgugcgccaccacgcccggcuacacacaagaacuuaauguugguuuuucuucaaugaauuguacucuucucaacuuauucuagaacucaccuuuuguuaacauuuuuuugcuagaguggaauuuuuuauauuuaacuuuuguuuaauucuacucuuaauguuauuuuauaucagauuacagccaauuuuugguuuaucuggguuguuguuguuguuguuguuguuguuuuggucuuuucuuuuuuuuuuuaacacgguuucucugguuguccuggaccuuggucuguagacaggcuggccuuggucuguagacaggcuggccuugaacucagagagauuugcuugccuuuacucuccuagugcugggauuaauggucugcuugacuuggcuuugauuucaaccacauuuuuaaaaaauucauaaucaaauuccaugugugaauuuuauuuaguaaaauuuuaaauauaucuuaccaauaaauuuauuucauaauuaguaaguuguuucacuuucuuauuacucuuucuuuacugggggaggggucaaaacucaauuuuauuauugcaucugguagagaucagauauugcaccuguggugguaaaagcuuacuauuugaacuuugcauagguauggguuugcuuucucuucuuuuccuuguacgugugguguauuuacauguguuggggcaugcauguaugccugcgcacauggaggccugagacugaaaucuuccuugauugcuuuucuacauuguucauuuugaggcuucguugaaccuauagcuuaugaauaaagcucaucucacuagcuagcuuguuccagagagcuccuaucuuuacuuucugagccuaacuguacauuccucacagaggucaccaagccugcccagcacuuacauggguucugccuaucugaaccaucugcucgucuugcuuacucaauaaguccuuuaacagacucuguauggcuuauucacuuaacaaaauucuguuccugauaaauauuuuucacuauuuaauauguagugguuuuucuucggucuuaaacaucagacuguuaagugguguacuauucuaauaagaauaugauaggugacacuaagaugugaaauaccuguauaguugcaaguuuuccuagauuaauuaauacaccaauguuugauggauugaugaugauuaaagcauuaagcauaggccucuuuuacccaguaauaggguccuguuuacuggcauaaaagccucaucuuuucuccuuuaauuuuccuuaacuaugaaaauuuugaguaacuacccuuggcaaagugagcuuugauugacuugcucuaauauuuuaugagggaugucuucagaagugaguucacuuuuuuuguggcauaaaagaacaagaaaacaucuguaguugauuaaacugguuauauuguccaguuuaguugaaauuauugugcaacaggauauguauuuuuuuaggcaaaguaacauagcaaauaugaaaucuaucuucaugucaaacaaaagcauagaagaaacucacaggaggaaagcuaaugccuuauaaauuacuuccauacaauaguaacaauucaagggggaagaauucaagcauuguagagaacugaaaccaagugaaacauagcagaaaaauaagcaaccauuuuagugcacuaaucauuauugagugcuauggagaauauuucucuuugggggcaugguauuauuggaaaagugaauaauacauacacuguauagagcucuuacuaauggcaggguuuuuuccuuucaaaacacccuuauuuaucacaguauuaucuuacgcauuuaaaguuuaaaaccuugggauuggagagauggcucagcaguuaagaucacuaguugcucuuccagaggaccuaaguuuaguuccuaacaaccaagagguaguucccacccuccuauaauuccagcugcaaggagcuagagacacucuuuugcccuccagacaacagaaaaguuaagcauuguaacagggcucccaggaggaaagacaguuucugucccaacugaucucaauacacacauggugaauauuguacaugcaagcaaaacacauaaaguuuuacuaagcucuuaaaaaaaaacuugaagcacaaaguuaauaacucuuucuacggcacauaucacagaauuguuaagucuguaacugaaccuuuguauuuugaccaaagucaaaauucuuuugacuuaucuuuuuuuaguaaguuaagugauaauaccuguuccuuuauugucauuaauaaaaugcuggaauuggaugcauuuuacaagucuuuuguacaaugugccacauguugcuaaaauucuugagauucaacuucaccuugagcucuucuauggacuugaaaggaaguccauuuaaccuucagaaaguguaaugaaagguuguuaccagaguccuaggccaaaggaggucccagcuaaugagucugagccaucugcugcaugaggaguagagaggagugagaugcagagaaggccuuuauucuguggccacacuuggauagagacaguagcucugggauucuauaagagaaggaaaaagguagggaaccagaggcauuuauaaucaaauauaaacagccaaacugugauccaauagaugauugauuaccugcuuuuccuaggucugcuagcaccaagaagucauuguugcuugaagggagauaauuggcucacacuuaggagagcagccuaggauccuuccagaaaguguaaaacaacggguuugguguuccuacaauucaagauagaguguggaaaaagggcucuuaagaauaggcuggagaaacaaauugagaucaguugggacagaaacugucuuuccuccugggagcccuguuacaaugcuuaacuuuucuguaguagcacuuauuaauuauaauggcuuuugcuaugacauuuucauacaagauuauaauauauuuugaucaucucuuugugucugcucgucuccucuuucaaacacacacacacacaccauguauauagacccuaggauacuagaaaggagcccauaagaggguaacauaauucuuuaagggacaggaaagauaagaacacauaugaguugggaaggagaauacuggagauggagauuuuagagugggggagagaagcagaauggaagugauagucagccaucacuaaggacuuuuuaaaaagcaugcaaucuaaugcugauuuuacuaucugaauucuuccugugagcuguaguucucucuuaagaacaauacaguaagauucucaauaaaguuuuucaaaauuaccacuugcaacuucauauuuauguaguuuccuuuaccuuucuuguuucugauuugagacacuuaagucaaugugguuuuuuuuguuuguuuuuuggguuuuuuuugcaguauaacuuccauauuuaaugcugcaguuauagucuggcuguauaccuauugcuuauuuaaagcccuguccuuuuuuguuuguuugcagucugacguugugucauguccuuagcaacaguaauguuuuucuguucugagacauccaggggaggggaaucaugguucuugaaaguuacauucuuguaauagagggugaaauucuguacugcuuuccuaauauuaaaguacucuuucuuaugaacugauauucuuaauaagucauaaguuuucuuugauacuaguuguaguuuuuauuguuuuuaaccauuagaaacagcacccuuauauugguucucauuuuguuuucugaaauuuuuugucugaaaauuacugaugcagucuauauaaauauccuuauguauauuuacuagucucauacuucauuuauaacaugggugauauuucugaagcaaugauuuacccuuacugucuacucaguuuuaucuguuuuaaugugacuauaguacaaauucauugacguuuucuugaaugaugauucuaucuucucauguaagggauuagcuucccuuccuggcuuuugaacauuuauaaauucaauaaacaucucuaaugucuucauccugucugaguaauugucauagccaaggauaaaaccauccagauuuauaaauagaaucagugccacauaaaaugugcuggggguggagaagugauacaaagguaaugaaaauuauuuguaguuugguuacuuuucucuuuuccuugauuaacaaaggaauugaaugagacuaggaguuuugaagauaugagugauaucacuauaugauaauaaaguugaguaaggaaaagugcuaugaagcagaauuuaucagcaccaagaaaggcauugcuguuaaguuugugacaacuguagacuccaaacacuacagcaugggcuuaaaugaggacagugguuucacuacaacuguguuuagaccauagcugcagaauuaaucaugaaaaguuggcagaauuuuuacaaauagcauugauaaauccuaagccgguugacagaagagaaggcaaaagaaagugaauaaaauuaaucaaauuagagagugagggaugguagacuuuccuuuuugauuuucaaucuguaaguacauacaaaugguucaagugguucaauguuuuuaaaugguguguaaauuccuuccuaccacuguuuuguaaauacugaauuaccaguuuugcuaaugcagugaagcaccuuuauuauauauuauguaucucaauucaaacaguuacaaauaauaaucuuaacccuccuuccaucuuuggcaggaaagagaggcucacugcacacucacuguaucuugaaugcuguuacuucugaguguuugagaaaugagucuucagaaacagugcucaccaccccaccccgauauuuaacauuccaguagaagugggggaagacacacguagguaucuggguagagaauauucucauaugcagugugguucugcaaggaaugggauaagugaauuugagaacaaugaggccacugugacuggagaugagugagagaagggaagaggaggaggaauuaaaaugggauggagcuuuuauugguugauguuauuuaaguaccgugggaauuuauugaggacuuugaaaggauuguuuuauauguagcagugacaggggugcaaguauggaaauaaaaugagcuaagaauuaauuggagugauauaagcaacuguacuugaaguacugugauggugauggugaaaguuguccaugucuggcuuuacagaaucaagaguuucuguaaaagcuaggaaucuccuuuugaacaucuaaguaaacauaucaaguggguaaugggaugcaugacacaaauucugaggaggagauuuauggauucuuaaaauuaaaacacuaccaguaaacuggaagggaucaaauugugugguaccccagaaaccaagggaagaaaggaauuuuggagguaagaguguccagucacuguaucaaauuuaauuacuugagaaauauauauaugugcauauuuauuuauuuauuuauuucagcaccaagaaaggcauugauguuguuaaguuugugauaacuguagacuccaaacacuacagcauuaaauguuuauuauauguuauauguuauauggaauaacacaucacacauucaagccucagagcuuaaauaggaaggaaucuugcauuccaggcaaacaucuagaaaucugauuugagccaaucauaggaaagaggcauaaaguauaaaauaauuugguggaaaacacauuggaaacagacuuccuguggaacuguaauuuaaaaauauaagagcugaggguauagcucagugcgagacucugugcuuagcauaugagaagccccaucuuuuguccacagaauagcagagcacacacaaggcaguuaucccuugguaucuaaguagaauaaaaucuuccagugcuugagaccuuuaaauaaaauuggaauaguauuuguauauaaccuauugacaucuucuuaaauacuuagaaaaaagcuacaauuauuuguguacaugauaugcuacacaagaggaggccaaaggauaucucggaggagucaguucauuccuuccacugugugaguuccagggacuagcucaggccaucaggcugggcagcuagugccuuuccccacugagccaucucugauugauccuccuauguacauuaucuaaauuaucuuuguguuacuuacagugccuaauacaaugcaguauuccacaaaugcuuaauguucucuaucacuugaggaaugauggcaagugaaaauaucuguguauguuuaaaacaggcauaauuauucucuccuuccaguauuuuucaucugaguuucuuggauccaugaguuuggaacccuugggaauauguguuuguauauguccauauauauauauauauauguauauguauauauauauugaggacuuuaguguuauuugcugugguugcucaagagaaauccuccuaauuguacagcuaacacauugcaaagugaaggcuacuuauuuuuuuuacagauuuaaauauaauuguuacauauuuuaaaauuucuaaaagcucugagucaaaaagcacacacuuugauaauucaccagcuauuauuaucucugucacauagucuugccuagucuuguuuaauuuggcacgauucuaucuuagacuuugucacuaauuuuuuuaaauauuuuuaucaaguuagaaaaauuauaaaauauuuguauaagcacgggagugaggaaaaaaaucucauuuugaaauuagugugaguuuuagaauucugcauuuguauuugcaucagaucugauauaucucuuucaaaccaagggaaaacagugauuuccacacagaucugugagaaauguccauuuuaauguuuacaauuuuaaaaccaauuuaaauaaauuacagguugguaaaauaaacuucuaugccacuauauaaaaucugaauugaaacacugggaauguaguucaguauagauacugccuagcaugugugggcaguuagguuuggcuuugaucaguagcaccaggggauugugcagggggauauugagaauuuuuucuuaaaaauaaaguggaagccauaggaaaauaacuacaaaaacuguauaugcuuuugucagugccuuaguuaagguuuuuuacuauuaugacgagacacccugacuaaagcaugugugguccagucaggaaccuggagggaggaguggaugcuuaggccacgagguaguggggugcagcuuccugacucgcucagccugcuuucuuauggaaucaggaccacagcccaggaauggcacaagcuacaaugaguuggacccuuccccaucaauuaguaauuaagaaaaggcuugccuacagcccuaugucuuauaguugugaaaacuccaagggcuacuuuuaaaguuuuagcaaguuaaauaucugcugaaggucuuuuccuuagagauagcaucaacuaagugugcaaugggauagaugagcaagaagcuccuucuuaguuucugugucuuuuguaugaguacugauucugcucccucccaaaggcugcaucucaucaucaucaucaucaucaucaucaucaucaucauuauuauuauuauuauucacuuuacaucccacucacugccccuccuccuggucacucccugccacaauccucuuccccucuccccuccucuucuccucugagagggugagucccccacccagcaucccaggguaucucccaacccuagaacaucaaggaaggcuaggugcauccucuccacugaggcaagacaaggcagcccagcuauaggacuauagguauaagaacauaucccaccuauaggaaacaacuuuugggauagcucccugcuccaguuguuuggaacccacaggaaguugcauaucuacuacauauguguguguggggggguuaaguacagcccauauaugcucuuuugguuggugguucagucucugagagccccaaggguccagguuaguugacuguuggucuucuguggaguuccuauccccuucagagacugcaguccuuccuccuguucuuccauaagaauccccaagcuccauccacuguucagcugugggaaugugcauccaucugagucagcugcuggggggagccucucagggcagccaaacuaggcuccugucuacaagcauaacagaauaucauuaauaguguuagggauuggugauugaccaugggaugggucucaaauuggacagguuauugguuggcuguucccucagucucuguuccaucccccaucccuacauuucuuguagaugggauaaauuuugggucaaaaguuuugugggugcauugguuccuccacuaggguuccugcauggcuacaggaggaaggccacaucucuuaauacaguugcauugaggauuaacaaucaacaugaauuuugaaagaaguacuauauuaguuacuuuucuccuuguugugauuaaauacauacuagaaagaaucuguagaaagguuuuacuuuuugguuuucuccuugguuuuacacaggguauaguucuagcauggcagggaaggccugguagcuggagggccugcuccauugguaacagggcgguagggucugccugacuucuuuaaaacuaggcagauuggagagcagagagcuggaccauaaacagggcaaaacuauucaucucaaaaagcccauaagucuagccaucaaggcuugaugccucaaaagcuucaugaacuccccaaacaagauucagacacauuaggcuauuggauggcauuuaagguccaaaccacaacaaauaucuucauuuaaaucauaccauagagccaaagaaauuaaaggauacuacauaggcaugcuacauagugguguguagcgauugaaguaagaaggguggugguggguuggacaggaggaaagaaauguagaguuggagaaauuccauuuuuggaagggaaacacauguguuuuauuggaguuaggguuggcauaugaguucacccagggaguauaucauuuccuaacaauaauuguucuuaaaauuacuaacauuuggagcuaaggaaauagcucacugauuuaagcacuuaccaagcaaaugugaagaccggaguucagauccuagaaacccaacauacacacuggauagauauggcagucuacucauaauuccagcccugagaggugagauugucaaaacuagccauguugguaagcucuaggcuuaaauccaagacccugcuucaauaaauacugugaaagaguaauugaagaugauuccuagcuccggcaucagcuaccacgugaaugugcauucgugcauuuacaugacuccacacacacaugcauacauuuuaucaucuuaagcauuuaagucuaguauauauacacaguacuguacagccagcaccacuauucauccauaaaacugagaugaagaacuacuaaccaguagcugcuucagugcucccaucuccagguccuagcaucuacuuuccuuagucacuauaauuucugcuauugaaaguaccucauauaauugaagacacauaauguuuauauuucugugaauggcuuaucuuaacauauuaccuucaagguugauccauacuguagcaggugucagaauucccuucuaacaaugaacaauauuauauuguguaccauauuuuaguaauucaucugcccaugaacacuuguuuccuauguauugacuauugguaguaguaaugauuuaucuauguuagcugcuuuucugccucaaaauugcugaaguuguuauucaaguaaaauaauaguuccaaguguuuuaugcugguuguguuugagaauuauccccuuugacaaaaucucuguauuucacauucucagaaauuaucacacauuguacuguuuuuauugaauucuuaggaaccuuguggagucagguaaugaugacauaauuaucuucagguagagagccaaaagaguagagucuagacuauaaaagaacacaggugauucaaagguuagcuaaaggaugagaguucauuguuuucuaauuuacuaacuuaaauuugcugcuaccuuuauaaaugaaaguacaaaucucuuuaugcuccuuugauugcaauaaauuaucaucuuauccauauugccugcuaugaauacaaaacacuuaacugaggucaucccucauuuaaaaagcauauggucucuguuuguggagcugcaguaacuaggguagccacuaaccaccuguuuaacaaguuacucaguucuacaaaggaaagcaagucacacuuuacauuuuucauaaacuggcagagaaaucuugguaagaacucucagugccucagccaugcaaauguguagcauuuuucugguaggacuauugaggacuuaauaaaugugauuuuaugaaggaaguuuauuaaguugcucccuuuucucauugaauugaaguuuucuuuugaaacuguauaguaaaguucgauagaacaugaggcuucauacuuggaaugccaucugguuugggguggacaaaugcuaaguuguuauauuugguuuugguucauauuuauuuuaacugcuuuuaaagaagaguuguugauuuauauggcagauaauaaagguaaaguuaggcauuuauuucaaaauaaugaauaugagaacaaaaguguucccucccugcccucccccucucuuacaagcaucuucuuccgcuggauguucaugugagcauagagucaguaccuuggcaggaguccaaaccagcacagcugcagauuuagguuuugugaggaacugcacaaaugaggguggggauuaaagaaaaugaaguuuucccaagaacagcauuuuucauucucugucccagaucaaguuaauuauacaacagaguugaaauuuucaguguguguguguguguguguguguguguguguguguguguguguguguuacuuucucagagaugcuuccucugacgguccaucuuaaaguguaccacccuaaacuauuacaucacccuuuucucucugcuuuauuuuuuucccucuuccacugucagggaaacuacaagcuauuuguuuauuuuagcuucuuugagauuaaauacuuuuucuaccuuaauucucuacuuucuuccuaguaucuguaauauuuaaaacuuaaaaaugaaaauggauuuuuaucaaauuccuauaauguuggaguauucuuuggaauugauguauaauauuuguguucauuuccaaggaaauacaggauuuuaaagauaauauauuuauacuuauauauguguguuucacauaugaaguuuuuagaaaaacgucuaauacaugguuaaugguuaauaaauucucuuauauacaggaucacagaaaauuaugugcuugcuuuuucaaaccccaguggcauuuuguuugauccuuaguccauaugugaaaugaagcuauagcuguuucuuucauuuucaaauucagagcaucaaaaucaaagacauuaaugucaagcaugcuaagcauaucuuuguuagagccugacaucagugcagcgaugaauaaagaaucuuuaauuuguguauuuaguuauaguuuuuccuguuucuuuuaaaugcuuucuaugauagggaaaagcaugauacaaguuauaaagucuuaugggcucauucauguagcgguuuauuacauuuguuuaguuuaugaaucuuacugauggucaaaggauaaauuugaaaggagaaauuuaucacuuuauuguuuuuuaaccaagucucagucguucuguuuaaccaaugaagacucaagagcuagaugugagggugaaggccugcuaacucagaggcaaagagaacagcugaccuuccuccucaguugacaucccagaaggaauccccucucauucccuccauccuacuuccugugugucucuguccauccuucugacucccccucacucuguuuuucauuuccguuuuuauuauuuauucacuuuacauccugaucacagcccucuuuucuucucaguuccauccucacaucugucuccccuucucagagaacacuguaccuguguguuacuuucucagagaugcuuccucugacuguccauggguaccacccugcccugaccucaaguugcagcuggucuaugcacauccuuuccccagcuagagaaaggggauccaaaggcaggcaacagagucagagacagccccugcuccaguuguugggggacccucaugaagaccaagcuacacaucuacgaauauguagagggccuaggucuagccuauguaugcucuuugauuggugguuuagucugggaacccacaagcccagguuaguugacucuguaggucuucuuaugguguccuugaccccccuuccauuucucucaaccccuaccauacucuuccacaggucucccagggagugcugccuaauauuuggcuguaggucucugcaucuguuuccaucagguucuggauaaagccuugcagaagacauguacauauucaauuccugucaacuuguuguuugcuccaccucuugaccuauaguucacuuuauuuaauccuguuuacaaucuucaagcagaaagccuuugaauuaaaggugugugcugaggcugagccauaccacaacucaaaacagguuucuccaguaaauaacacaauuucaggguucacagugugauaacauauccugcagcacuuuauuccucuuuguuuaaaguuucacuuauuuuauuagaaaaaacauacucuggaaacaguuaggcagugagucaaaucuuuagaggucauuaucucucauacuuccugguaacuugaaaaaaaaagaguugucaaaugauauuugaucaucaaauaagguuagagaaaagcccuuuccacucugaagagugauaguccuauugugaagccagcuauuuauuucucugcaauagcagagauuauaggguaagaugaaccuuauucuguguaaagccaucuggugaugaaucagccagcugauugcagagcauaaggauggacuauccuuaacaugugaccuaguucaaguaauuccaugcauuaauuauacacuagguauauaauguaaggaagcaaguuuuuuuggcauggauuaugcaaugcacuguuuccuaguacuguagcaaugccauugucuaucucaaaacuccauuauaauuuacaucccucagaucccucuugacaucaguucucaguugaguuacauguaacuacaagcagcacuucgaaaaauguauguuuaaaauaacaauacaguuggguuucccucuggcauuuucauacacaccucuuuuucuuuaucuuuuuuuuuuguuugguugguuuuuuguuuguuuguuuguuuguuuuucgagacaggauuucucuguguagaccuggcuguccuggaacucacucuguagaccaagcugaccucgaacucagaaauccgccugccucugccucccaagugcugggauuaaaggcgugcgccaccacgcccggcuuucuuuaucguucuuuacuucccuccuccaccccugcucuuucuuuaucuuucucuaaccauuagaucccauuccacauuuuuaacauauacucuaguaaccgcuuuuccucuucuccugaagacuccucuccacuucauaguccucuccuagucuuaugagccaccuacacacucaaaaaauuaaaccccagaauccacauaugacagaaaaggugagauauuuuuugcugcgucugggucacuuaauauaauaauuuccuuaauauaauaauuuccaacuauauucauuuucuuaggaaggauaugguuuuauuuuuuaugguugaauaaaauugcauuguauauauguaccacauuuucuuugcauucaucuguuuggaugcaaaaaugaacuguucccacaguaaaguccaauuuuaaaacuagucuaggaaggugaaggugugacuguggugcuagguagguuuacaccugcuagccucuaaauguuggaaugcuaaacuguuguaacugcugaaaagccaagcccugugugacaagaagauaagcuguaaaagauugcuaaagaggagcauaacugggaaauaagggccagauuuacucagaaacagguuaggugacccuagagaguuccagguuaccuguaagccaagaauucuaguggaguuguccuuuauucauuaaaaauacccucugcauuauauuagauuugaucucuuacagagagaggggugaagugggcaauggugggaagaagggaggaagguugccaaaacaauuacagugggugaaagguuguucuagacuagaaccuagagaugaagaaacuguaugaccuucuacuggcauaggugagaucaucucauguccccauucuagucuggaauaagaacagcuuccuguuuccaucuaacuucccagcauucucuacaggauuuaguucccugaggcaagauucucuuguuuguuuccccuagcaacccuggauuugguagguggcucaauagguguguguguauauauuuaaguguaucuuuuuuuuuuuuuuuuuuuuuuuuuuuuuuuaguacauguauacuugguuuagcauuuaaaugaguugaacuugucugucucauuauuaacucuuuuucuaauguuuugggauccauuguauacuaucuacagucacauaugcaauagcagagcuuugcuucuacugaacuauaaauaaguugaucauuggucaccagccucuccucauccucccucuccuagccauucccagauacuaccauuauacucugaauuucuaugacagcaacauuuucgaauuguacauaccugugagguuuuauguuauuuccuuuuucugugccuagcuuauuucauuuaaccugagaguccccauuuucaucagugcuguaucgaauggcagaauuucgugcuuuauuaugguugaagcauauugccuucaugaguauauggacacuuugcuugguuucuuggcuguugagguuagugcugcaauacacuugggaaugcaaauguuucccucauuauaucuaccuccuuuguauauacccgugaauagggcugcagcaucauacaguggcucuauuuuuguuuuaauuuuuaggaauuuccagaaugacuuuuauaguagcugugcuaauuuacauucucauuugaguuccuaccagcacuuguuaucuuuuaggguguuuggauaguaccuauaaggccauaguucauugugguuuugucuuccauuucccugauguuuacugcuggccacuuacaugucuucuuuuaagaaauaccuguuugagucuguugccuauuuuggaauugcuugggagcccacauagaugacuuauuuguaaucccagcacucagaagguauaggccugaggucccugaugcaguguauuuucugucuagcuggacuagcuggaucaggaagauacccauugucaaucucuggucuuuucaucuucucuugccacauaccugcaaacagaaauauaccacaaauacauauacacuugaaaaaagaguaccugaggaaaugaugggaaagcugucuuagagaucccuguagaaaaacagagaauguggcuuuguauuacauugcauuucuaagaagaaacgauacugaguggacucaagaccacugccuuagcccaaaagggaauguaauacccugcauauuaaauauuauauuuuuauuucauuuuaggaaauguguauuuucuaauuuuaagcuucaugaaaagccaaauaagauuuguaaaaagcuauuauaguuaaaauauuauuuuauguaauuauaauuauauaaguacauuuauauauaaaauuacauguuauauagucacaguauuauguguugugcucuauaaauauuuaaaggcugucuuauagcaaaugaaaguuagaggaugcuuuauagcauaugaaugauauuuguuuaaacugauuuuuuuucuacauuaagaaguuguucuuuuugaccaugugugguucuuguguuuagauugcccuguuuaagaugaauggauuuucuuugacuauaucuuacagcaguuuucauuuuugcucccuugaaaaaauuugcaacuauugaccuacuuacuauguuuuaaaauuguucuucuguguaaauggagugcguaaauuauauaauauauuuacagaauuuuuccuuuaguucugguucucuauugacuugaccguggagacuguauucuaaaauagagaaagaaaugcugcaacuccaauuugacagaaaguguauguaagacuaagaucaucuguauuaaauaguugguugacgugggagacuuaauaagccacauaaaccagacaaacugauuaaauaagcugagaaaguaaaaaagacuuguuuuagcuucacacaaaguuauuuguuuauugugguaaaaguugugugugccagguauguguagaugacuguggguuauuuuugucagcuugacacaaauuaaggucacuuaggaagagagaaccacauuugagaaaaugaauuccucaaacuggccuguagaccagcugugaggcauuuucuugaugaggaacagauaugggagggccuaucccacuguccacccccgggagaguggcccuggacugcauaggaaagcaaacucaacaagccaggaugguauagcccccaguggccuuugcuuccguuccugcuccauuguuuuucccugagucccugccuuggcuuucuccaaugauacccugcagccuauaagccacauaaacccuucccuacccaaauugcuuuucauuaugcuauuuuaucacagaaacaaaaaccaaauuaagacagucacauuuaacauaaaacauacagaguucuuaccaggacauuggacacuguugccuuuagcauauacaucuauuuuauuguagaauacuucaucccaugauaguaaaguuuacuuucuaguuaagagcagcacaguauacaucuuaggaaaagcugaacauaaucuuuggauucccaagacaaaacuugaguagauggcaucaugacacuaaguaggagaggaagcuaaggagcaugacacuuuuacggugccuguggccaugcagaguaaaaauaguaaaauaggauucagacuuaaucuaacugacucagagucugagauuguuacugacuaugccauagcccauaggacaguaaucguucaaagcucagucuacagguccuugggugucugucccugaaggcaaucuuuucugccucuuguugcauuucuauuagcauacaugauacaaaaacaacuaugguagcucaguagcacagaucaaggcagugaaccagacuguaugcuguacaucugcauuaaaaacaauuuuaaaaauccacuaacuuuaccuaauacuaucucacaaaaugguaacagugagugacuuuguuaagaguggacuuugaagucacacuuucguaguguucugcaggaguagaggaaaguacuuauagagcgcuuacacucggugccagacuacaauggcugucuccaagaaaaugagcugggucacugugugacuuguaagcugaauuaggcccaugcuuucauaaaacaucaguuguacuucagugauuggcagauugcuaaguagaacauuugucaaaaugaaccucaagaaaaagugacaggauuuuaauuucagugauaaaauuuuaggugucaaggaucuaauuugagagcuuguuuggagguucuagcaggguagcacagccacucauauaucuuugacagaggacugguccuccucuguucggggagggccauccucuucgaccuagcuggugagggaggaaggggacaccugccuagccagccagaucagccaaaucaacccuggcgaucaaugaggugacagaugucacagccagaucacccucacauccaaggauauaauuugagauaaugaauucugucugagcuuaguaguauccuaauauuuaaagacuuuucuguugacauggguagugauauuuuuagaauuguaauaaaaauuacuaauaauugaucuccuuuuuauuuaccuucaaucuuuccuuuuaacuguacucuggaguuuucuagauucugacacugaugagagugugguauauugggugaaaagguugagggcaguucugugugaggccuacuuccagggcuggugacuggauacugaaggguuuguaacguguucuuguucacauuugcaggauaauguagcuuugcuaaggauucagaagcuaagcagaaaugagccuaacauccugguuuuuggugagcaguggaggcacucgccacaggcugccacgagaaaugauuuucguuggaagagacgacugugagcucaugcuucaggugauguauccgccuucucuaagcaaguacucagcuugguacucuccuccuagagccagaacauucagcuggaggucacguagacuucuuacauucagacuuacauuuucuugcuaaccuaacucucaugucaguuugauuaauuuucauccuaguaucauuuacaguaaauucuguguuuugaggauuauuuuuuuaaaaaaugagaacuuagaguagagaagugugugugugugugugugugugugagagagagagagagagagagaaagagagagagagauguacauauagguauacucaccuguauuuguggggggaaaaguaguuucuuaaaaauuccaguuuuaaaauucacauuuuaagugauaauuuuguuuauaacgugacacauuauguuccuuuuuaucaucuaagucuuuggguuccuugugcaauuuguguuguaauauucaauaauaaaaaaagaaauccuaccuacaagguagcaguuuuuaacaauaugauagguaaaccauuagaaaauaauucacuggauaucugaguaucaauuucacaauuuuuaaacaauaugcaccuuuauacacucaacaaaauaagugaauuuaaauucucucagaauuuaaagaaguauggauauaauacaaagaguauuuuaaauauuuagguacuuuccuuauucggaaauaaugccaaacuuauucuguaucauaaccaauuuaaauuucauuuaaucuauguuuuugauuuaucccucuauuuaucagcuaucuauuaacauuguauguauaauuaaaaaucuuuuuuguuacuuuaguauuuuuuuguaguuuaauuuuaagcuaauuuaaaauuuagcuuaauuuuuuuuucuuuuagucccgaaguguggauaaacaacaugcaguaaucaauuaugaugcaucuauggaugaacauuuggugaaagauuuaggcagccuaaaugggguaaguuagccaguacuuuuuuuugaauauuugauuaauguuaauaaaguuucaguacuuguuugucugcuuuccuuuuucuuuagauuguguuucccuccuaguacauugaagucacauguagcagcagcugaagggacaaauagaggaaaugagaaaggcauuuaauuaugugaccugugauaaagauuucccuaagaugagacugaagcuuagccuccacaugugccugcaguuaaugugugggggaacagaaaaagguccuggcaguaagaagguagaaaguaccuuugggcacaagagauauguucucgguuuuauaaaguaagaaugaaaagguagauugggugccaaauccuggaggaccuccuauagucuagggcuggggcaaaaccaagagauuuaaccauuuacuuuaacacacauacuacuuuaucugaacacuaggauucagucuugcuacuuucuuuuugucuuuguagguauauuuuguaauuguaguagauuuuuuuuuuuauuauuucuaucugauguuuucacauuuuuuuggacuuaauucauuccuuuuuucuuuuuuuauugaauauuuuuauuuacauuucaaauguuaugcccuuuccuaguuuccccuccaaagccucccuagccccucccccuccuccccacccacccacucccauuccuggcccuggccuuccccuacacuggggcauagaaccuucacaggaccaagugccucuccucccauugaugaccggcuaggccauccucugcuacaaauauagcuagagccacaagucccaccauguguuuucuuugauuggugguauaguuccaaggagcucuggggguacugguuaguucauauugauguuccuucuauggggcuucaguccccuucagcucccuggguauuucacuggcuccuucauuggggauccugugcuccguccaauggaugacugugaguauccacuucuguauuugccaggcacuggcagaggcucgcaggagacagcuauaucaggcuccugucaauaggcucuuguuggcaucugccuagugucuggguuuggugguuguuuaugggguggauccccauguuucuacauuuuacagaaugaaaauaaucacagguguacugaauuguuucagcuucucaguuuuccuguggcucuggaggcucuuguggcacuugagugcugggaauggaaccugccucuucuagaagaggcuccaaugcucuuuaucucucugguucaguauacuuuugauacuauuguaauuccagaauuuucaacaucaaaauaaagauuaaugucagaacuaggggaaacagugaagugcuauuugugagcccaguuuuaauuauagcaagugguauaaccuugggaaaauuaaccucuguauuccucgguuuuugaaaauagaaauaaaauuauaccuuacgguuuguugaaaagaugaaaauaaguaaaucauuuuaaacaucuaaaccaauacgcaauauaaauauucaaaaaguauucauuuaauauuaugauuuaguuauuuuaaaaagauagcuaagacaauuuuacuacuuaggaaccuauguacuuuucaacaaauccauuguugcacaugcguuguuuuuuaacuguuuauuucuaacuuauguagauguguguguggacaugugaaugugagugaggguacucacagaggccugaagaaagcuuugcauccucuagcgcugaaguugaaguuguuuaaguuguuggauguguguugcuggaucuaacuaguccucuauaagagcagcaggugcucuuacccacugagcugucucucuugcccucauuauuuuauauuuaagaaacauauuuaacccucugucuuagcuuauucaagucacuacacucucuaaacugaaccucaaaauauuacuagcauucuugcuccuuuuaccccaucacaaauauucccaagggaccugaauauauguuuuuaccaccaaaaauguuacuaaauaaagcagagaaaauugaaacuaguuuucuugcuggauuuugguggcccacauugcugggagcuuguugaagcuuuucugugagacccuuauuugcugucgucaguccuccugccuccucccuccacugagcacuugccccugcacccuaccaucccacuccuggcuuuguuacugugcuacuguacacagccuacauucuagccuaggccugucguuucccuuuuuuucagacuagaguuccaugagaacauggguucaauacccagaagacauaaaauguugggugugauuaccugcauguuuguaauuccagugcuggggaaugaaggcaggugauucccaguacuugcuggccagaaaaccuagccaaacuggcaagccccaggucccagugagacacucugccucaaaaaacaagauagauagauggugaagaacacugucugaaguugaccucuggcuuccacaaacaggagcacugauauguguguacagucaugcacccccccaacacacacacacacacaaaaauuacuuauguuuuucggaaauaccgcauguuccuucucauugaaugaaucugacugacagaaugaaagcauccuaguuucuuuuuguccuuagaaauacucuuuucucauugauucuggguaaaagaaaagugagcuagaauuguccucauuuccuggagaaacagaaugauaauuuuguggauacugugauuaugucauuauugucauauucuacagugcuccagucucuucacuguaugauugaguuuugcuuuuuugguuuguuuguuuuuuccugucuguuugcaucuauaucuauagcugaauguuuucagccuaacaguaucaauguccucugauagcauaaccaaaagaaaaaggaaaaagaaaaaaaaaaaaaaaccuuaaaagauaauaucuccagaugucuucuuggaaagcugaugcaguacgucagacauugcaguaagaaacugcaggaugacagcgggaugacuuaugucucugccgcuguguucuguguccgggccuuucacuaccauuagugaccacugaauacuugagaugugacuagucuaaauuccaauggcuucacgcgcacacacacacacacacacacacacgaaauaccuuacuaauuuuuacuucuugagauaguuacuuuuuaguauacuggauuaaauuuaaaaugcauuaucaaaauuaauuucaauucuuguuacaagccuacaaaaaauuauuaaguaguguauauuguuugggaaauugugacauauuucucuuggauagcuguucuaaguaauucugcuauuugucuugauauuucggugauuuuucagcauuguuacaaacaauugaguaaagauaaaacaucaugacgaggauauagcagaauuccaauauauagaaggauccauucacuaaaacaccauaauguaucuuaacuuuaaaaaagauccaaagaaccauuaugacaguuguaaaguagcccacaagaugaccuagcaguuaaagaugcuugcugguaagcgugaugagcugaguuuuaacucucaaaacugguggguagagaacuaauuccagcaaauugcccuggccuccucauauaguguuguacagugugugugugugugugugugugugugugugugugugcgcgcgcgcguucucucucucuccauaaauaaguaaauaaauaaaauguuuuaaauaguguuucuuuuuccuuggaaugagcuuuuuuggcuucauuuuuaagacaaauuacaaaugccaaaauucaaccuggucucauuguacucugugugaccagcaauauugacaaaaggguuaguaugaaguaagugucauguuguaggacgcuugacagguuaggaugcaguucacaauacguacuuuaguaguagguugcugaauuugacuggaaugugcuaugcagaguaaccuuugucucuuuccucguagaccuuugugaaugauguaaggauaccagagcagacguacaucacuuugaagcuugaagauaagcugagauuuggauaugauauccuuauauaauuuggugcauuuauuaaaaugauuacaaauuuaauaucuuguaauauaaaaauuaauaauacuggaacuuuaugccuacuguuugucuucaguuucuguguuccuaaguguguuuccuagaaagcuugguaauacucagcuguugcccaucucuguggugcuacuuuccagaauuuggguguuagaauggagcucggaggaggacuguggcugucuuaagcacugucugccuaggauucuugccaggugaauuacaagguuccaagucagucuauuaggagaauauggacauuaaccugccuucgugcccgugcuauauacugcugguuuaauucaaaguuuaacacauucuauguuuucugacaccaauauugcaugacuagcacauuuucauuucaugugaauucaauuauuuguuuaaaacuuagagucuaacagcuggacaaguauaugauuuuacugcccaauaaagaguaguauaaaggaaccuaguaaaaugaaguaguaagaguaagcaauaauaaaaccauuucuauuuguacuaaauuaaaauaaaaauauuucccauuauguagaacauuucucuugagauuuaguuuuuaaacauaugcugaaacucugauaauuuaaaaugcuaaacauuagcaaucugguagacuuagaucauuuuaucagagaagguaggcucggauaacuuaaguugauacucagauguacuauuacauauaacaaaagauagaauuuuuaaaguuuaaaauuuaaacucaaauaguuuuacaccacauauuuuacacuuguacuugaaaaacugagaaauauauguuaaauacuuguuaaauauuuuaaaucuuuuaaaaauaugugugguauggcuggugagauggcucaguugguaaguugugugcugccaaguccagcaaccugaggucagucuccaggaccuacacagugcugugaaagggugagcaaucuguugugugccacaccugcacuuggugugcacauaagcacacauacaccaaguagagaaauguaagggcuuuaaacuacauauuagacaaacuaguuuagaguuaucuuuauucagccuaaguguuagcaagcauauuuuguauacaaguaccuccuguaauuaauguacuauuagaugucuuaaaauaagaacaaauccuaagaaauucagauuuuaauaaaauuugauaaagcuaccuuugaguuugaguuccagaagaaacaguagcauacucaguagagcacaccucuaguccuagcuucucugaggcuggaaaagggagaugacaugggcaugacauaggagcacuuucaagaauaggaggaaggcaugagagaggagucagcuuaagagauagcccauauuuuugcagauugcacauuguaauauaugaacggcaaacuaaccuuuccuaaggucaacucaauaccucuaaaacuggcuggggccuuuaaguuuuuaucccuaaggaauuccucagacucacagccaggauugaacuagcacugccgcucagaggcccaggggaagugcauguagucucacuguucauggaacaguucaugcugaaauggacaugucagaaauuguauuccaugggacagaauuauuuuuaaccauuuuaugugauggcuauauuuauuucuguauuagcuauacuagauuggggaaauugucaugcuuuauucauauauaaaauuaaguuuauagccagucucaaauacuguaccuuggagaggaaagcucugauuaauaacauguuaccuuaauggagagacaauuuuaauaugguuuaagauuuuagcuagagaccauauuguauaugcuauacaucuguuuucugacuagagaacuuuuuuuuugaaaagcaugaacucaauaaaauguucuguuuuucaaaaugaccauaaacuuaaagcagcaaucaguaaacacucagaaacgugugcucguucagaugaggaggccagagugcuuucauugcacauguuagauucccccuauugcacaaggguaguuguggugaucugcgauauacuaaaugguuuuauaaauaauauuauuuuagucuuugaagaugucaugcaauuuugugaauauuuauucacucccucucccagcaauuccuucuguaacuaugcuuccaccguccucuccuuccuucccacccaacuuccagguuuuguuauuacuauuauuaagucuaccugccaccuaugcacuccaccauugaauaguuuguguggccuacuuagcuagacucaggagugguauaauuaaccuaccagggguugcaccauuaaagaaaaccaucgcuacuccagugauuggccuuaaacccauaauccuuuugacucagcucccugagugcuaagaguauacgcaugugccaccauuuuuuucucuuaauauuauuaacugccaaacacaguucuggguuucaaacaguuugcuuuuguuguuacagcuuacaguuuuacaucccagugaccucuuuucugcuuucaugucauaaauguccucuacaauaccacuuauuccacucccuugaacuucuuuccaauuuuauuaccuguaccguuacccuuccccuccccccccccacauacauguacauuaaaauccaaaguccgcauuuaaaacaguacguaaaguacuucacugaaaaagucuauuucccugauuauagguguaucacugagaauuuuguucugacagauaaaugggaugcuuuucccuauuuuuuuucucaacaauuauuuuugaaagauuuauuuauuuacucuguguauaugaguacacuguagcugucuucagacacaccagaagagggcaucagaucucauuacagauguuugugagccaccaugugguugcugggauuugaacucagaaccuuuggaagagcagucaguggugcucuuauccgcugagccaucuuuccagcccccuacucuucugauccaucucuccagcccacagauuuuuuuuuaguugaguauuaaaacccuacuuuuuacauguugauuuuaugccccauaacuuuucugaaauuguauaaaaucugaguuauuugauagagccuguagagccuucugcauauagaauaacaugugcaaauaauaauaugacuucuuccuauuuuuuguuuuuuguugucuuuuuguucuagcuaaaacuuugaacauuaugacaaauaagaauguaaaaagugcuacauuuauugcacuggauuuuagagaaaacucuacauuguuuugcugguugguaaaauguuguuauagcuuuguuguauauguuauuuguuauuuugaguuaaaguuuucuuugaaaguugauguauacccagugauaucugauacuuauguuuuaaggucacagcucuuuuaaauaacuaaaacuauuuaaaauuuuacuuugcucagucauaauuguuauuaagguaaaaugugucuaaaagcauacuccuagcaugcaggugaguuucuauguccauuuuagauaaauacuuauugaauaaguuauauagggaugguuuaaauuaacuaucauagucuuauaaagcacugaaaaaauaagcuucaggauuuauucacaugauuuguagauuuagccuugucuuucccauuacaccccccaaaaguuuuaauuuuuaaauaagcuuuaaauuuuuuuauaaauuacugacaucauaaguaacugcauuucuaucauuuuucuugauuggcaaauugaaaacuacuugugaagauuuauacaacugagaagaaauagguuuuaagauauaaaagcuggaccaucaugucuaguugcuuuucuauugcuauaaagaugcaccaugaccaaagcaauguacagaagaaaacaugaaauuagggguucacuugaccaucauaagcagggagcauugcaggagccaggcagaccguggcacugggacaguagcugagagcaaguugguggcagggagaagcugauccuggcgugggggccauuucauucaaaccaccacaccguagcagucucagaucccacaggggaaggcuucugauuucacacguagaaaacacaaaauauuugaacauaagaaacaggaccccugucugaggccccgaagaagaggugugcaugugucuauuagagguagcgcuaaaagucuauauucauucauguuuucaucugaaaacauagguaucacugucaacuuuuuaaaugcuagcauuuccauugaaaaguaguuaagcugugaauuuucuccuaagcuuuuaauuucugaggccaaaaaaaaaagcuagagccgugguucucaccuuccagugcugugaaccuugaauacauacaauuccucauauuguuguggccucuaaccauaaaauuauucucaucauaacuauaauuuugcuauuguuaugaaucauaauguaaagcuuugauuuuuuaggauaucugauggggucacaacccaaaaguugagaaccaauguacuagaugauuuuuauuaaauguucaguuauaugaacauuucuauguauaacaacaaauauacauauuaaaaaaagagaaauuccacaauucagagucauagaaagcuucuuuauugacaagaaacuuccacacagaauucaggaacuagauucuuugaaaucacaggauucuguccacucacuaaaguauuuguugcagaacagagauuaauggaguugaauagaguuguuuauaggucuaagaaguucuguucauaaauuuacugauuuuauuacucacccuccuucucacacacgcacaugaacacacacacacaucaugcugauuacagcuuucuccccuugaaaugauugaugaaugcuuugaauuaguaaaggaugguaguagaauuuaguacguaauuauaaaauugcuuucauuguaggguuaaauaaugguaggaaauaggaccucuagaggauugaucuuuaauaagaagccuuguuguuuaggcauaauaaugaaagcauucauuauaucuaaguacuuguucucauguguauagaaucauuguuugauaauguaacaugaccuuauugcaguacauguagggaaggggguggugagguuacauaugaacccuaauuauagcauucauuuucuuuguacuugcaaaaugaaccccauuuuuaucaaaguucaugcaaaucuaaguaaucagucccuuaaggauugauuuuuggcuacugacucaugagauauuuuuacacuuuugugacuagguaucuauaauuuucuucuuuugguccugucauauuguugcuuaugaaaauuaaaaauguuuguguucuaauuauuuaaaggccaauauugucuaagauuauauuuacuagauuuuaaagguuaauauuuaucauaauauuuauuauguauuuuaaguauuuuuguuauuaaagggaauauuccaggcucaggcuacauuccagguacucuggagcuaccaggagaaucucaaauuuaaaaauagacuagagaccugcucuauaaaaauauuuuuguuuaaguguggagaugugguuuagugaaguauacauaucuagcauauucaggguccugggcuuaauucccaguacuguacuauaauaauacuauaaguuacucuugaaauaggacaauuucuaaacuauauuugaugaccuuuuugcauuuguucauuuuuuaauuuuuaauuauuuuauuuauuuacauuucaaauguugcuccuuuccuagucccccuccaagaguucuuuaccccauuuccccuccccuuugucucugagaggguuccccuccucccagccaugcccuuugccuggagcauaaguuaucagcacagugaccagaacuguggaguuacauucuuccuuagcucuguuuacauacaaaucucuucacuguaguacgaggagaaaugagggucccugaagaagcucuuaagguaaggguuucuccuguugccagccuugaauugcuagacuugacuucuuucaugaaagcuucacuuugauuuuaaauguuuuguagcacgagaaguuuaccauucagcuucaauugucccagaagucuucagaaucagaauuaccaaaaucagcaagugccaaaggcacagacucaaaaguggaggcugcugcagaagugcagcccagagccacagaagcacugaaaucugaagagaaacccauggguaaguggucugcaugaucuggagagugaucuacaguagccauaucgaugggucucuacagagggagggagaagagagaggaagcacacacacgcgcacacacaccaucauaccaucguaccaucguaccaucacaccaucacaccaucacaccaucguaccaucaaguugguauguacagaaacugacuauguaagcaccuagaacguagguagcugauguucgcaaugcaaagucccaggggucccugggugucccuuggagugagacuuccaaguaaaagcaacaacaaacuaaaauauagaaagguaguauguugcucacaacaucuaacagaaucugacuggggaaacugaggcaguuagcuacagucaguccucaauugaacuguccccugguggcccagauucccagagccaaguuuccaacuucucuccucugcagauacuugcauauuaguggacaaacaauaauaaucucugugaaaacaguuugucuuuuagcuguucucaaggacacacauuguacuuuugggcuguuuuguuuuucucuucucucccugucauccagcuaaggggacuaacccauccccugaccuuggaggacacuuugagacaaccauccuuggggucugacauagggcuugcucucugucucacuuccagagauagcuucucacugagcuccaacaacacacaguaguuugucaauauaaacacaauaguugucaauauaacauauauugcaauuagucuaacuucuugggaaauuuuugaauuuauacucagucuuaaauauuuuuguucucauacaccuaucuguacaugcauaaaaauaauauauauuagugacugauuccagaguacauuuuaauguagccaguuaacccuagaaaacauuaacaaugaugucuaaauauaccccauaucuuaaauauuuaaggaaaguagucugaauacuugaaggaaauaauaguuuaaaacugcaucuuauuauuuuauauuaucuauauuucucugaauuauaaacaaaaaggaauuuuuuuaaaagauuuauuuauuuuuguauaugaauccucuauuugcauauauaccugcaugccagaagaggccaucagaucccaguauagauuguuaugggccaccauguaggugcugcgaauugaacucaggaccucuagaaaagcagucagcgcucuuaaccucugagccaucucucuagccugcaaaagagaaaauuuuaauaauacugcauuauccauauaucaucuaauacuuacaguguuaauaauuacaaaugcuuuacauagauaaucccuucaaguaacaacuguauuaaauugauaaauaauacaucuacugaaaccaaagauuugcuagcauugagcgagcacaaauguaguuauuauuuaauacccauugugucauuucucaugccaaaauuugcuuuaguuugaucuuuuauauauuuagacuuaaugacauuccugaucagacuuuuuguauuauucccuugguaauuacuguuuaauuccaacaaaauucuucuguguaagacuucuucugucuacauacucaaugauccuuuuuuacagaguuacagaucucaguuauguaucagagagggcucuaacacuuaacaaaaagcuguugucacacguagcaaguugcaucacuuagucauugccagugugcauucacuuagucauggccaguucuguuuaagcucaggcacaaaugcuacauugcugaaacuagagugcuuuuaaucaacgaaguaaauuuagcaucacauauaauauauuuucuugucucaucugcuuuagaaggauuuguuuuaacccacuucuuuuuagaugucucugcuaugccccgaggcacuccauuauaugggcagccguccugguggggagacgccgaggaggaugaacaaagagcuuucaaggccaauggcaagccugagggaaaaagucaggaagcuggggcuucagguaaaaauaccucaguggcuguggcaucaaauucauauugggcaaguauuuauagucuaaacaaaagucacucuacucuauaaugaaaaaugaucuacacuauagcuucauucuuaaaauggcuuugcuauuguaguguauuaugagucccgcauaaaauacuaaauacaauguguauauaauacaaaaucuuauguuuuucuuguuuaugaaauuguuuuagaaaacaaguuaauagcauuaacugaacauuuuaaguauuucaaaaugauuauuaaaauaaauuuauaaaaguagguacauaugaguuacauguuuuuacuugauucauucucauauauucauuauaaaauaaaaauucuguuacauucagaaauaugauacaaaguaauaaguuucuuaaagccuuauuacuuugcuuauuuuuauugagauaagauugcaguaugauucagaguucaacagccaaaggccagaaucaauuaugguuuagauccucacauuaguaacuaaggaacauguuuuguucuuggugguguacuuaaguggugaccaauauguagaaaaaucaagauuuccaggauuaauggagauagugucacauaaaguuguugaaaagaaaucagagcugaagaaaccaguuuguuuaguaacagcagauaaagaucugaaacuggaggaauuaacuacagauaccaaggaucaguuugaaagacauaugaugugugacucugaggcaaggacaguacccaccagaacuguuacaaguucccuuugacuuuauuuacacaaaguaagcauggcaguuuucucagcuggagaauuaugaacauucugucuuuugacauagucuacuuaaacccguguacaagucuaaaaaugcugccaacaauaugucugaugaugaugcugaacuuugcaaauaacucuucaucacaacuuuguuucuuccccaaugcuuuuucuuuauauuauuuaauaugccuccugucauguuaaugacagaauggcugccugauacagacuaggaagggaauguacuagcucccauacuugauuccucucauggcugugcagugcaacagacaggauuguuagcuagucuugccaucucugccuugguauccacacuacuuacacacugaugcaguuaccuucacauucaaagcugcugccaccagcauuccaaguuacauaguuuuugaucaaaccagcaaaaaaagaacaaaaguuguguacagaagacauucuaggauuuggaagaagaccuuucccaaaaaucuucaacacaucucucaucagcgucucacagauucagaaggucacuugcuguucuaaccagucucuggcgaugcaugugagauuaucacuauaaaacccuugcucuccucgaagcaucauguagaguuauuugucucuagggaauaugagcagugucagagaaaagugauacuagaaauuauugaaguucuuuuaggaaauguuucuuuaggaaggagaaauagaaagaguauaccagaagucaagaauaucugcuuuaauuuuuaauuucuucuucucuccauuuuauauauuaaccauuucuguaucuuuccacugcugagucauaauuuaacuuuuaaguuuuaaguuucaaccucauugcuguaaacuacauagcaaauaugaacugaucuucacuuccgaaacaaauacagugacuuuguuuugccugccaaguagaauuugaacuuuuugaucccugauacaccuuguaucucauuauuauuuuuucaguauuaucucccuuuguacccccacauaaauugugcuuaauuccugccuccucccacaauaugcaugguauaaaugauacuauacugcugguauguaauauuguuucauucacuauauuugcaucuugacugaacucuaaauuccuuacuucaaguuccauacauucuaacuucauguugcacuagagcgaauuaccugauaugggguuggggugggggaauguggggugaauauaaccaguuagauggguuagaaaacacagaucaauuuaacuauugcaguauucugaaaauaauuacaugguacugaaaacuaaggaaccauuaaaaaaaugugucauuuacccucacacaacuuuaaaauucugaguuacauaacuuguaaaauccaguggugcacgcauauggcuaguaagaguagaagccugagaaagagcggcuggcaccagguuugcucacuuuguucuucucuuccgcaugcaugcuuuguaugcaucucaucaucauggcaauauccagagauagcacuuacugucauguuaguuuacuuaccagagauagcacuauucaugagauucccaagauaaacaaacacaccaaguucccaugcagcaggugcagggcgugcuucauucaccauugaauuugaugagauuaugucagagaaaguaacuauuagagaccaugugacagaauuuuucauccggucuacaaguaaaaccauagugaaauccucucucaaauauagauggauggguggguggguggauggaugauggauggguggguggauagauggauggauggauagacagacagacagacagagccagccaaccagccaaccugggcuauauaagcccuaucucaaauaagcaaaaccaaaccaaaaauuauauaaauuguuagcuguuaauaucuucuaguuuaugcauauagaauaaauucuagcuuaguuacuaaauucuugauaauugagguuaauuacaaaguauuaacacaaacaaauauacuaucuucuguaguuuaauuugguuuaaauaaaaauagaugugaauagaaauuaacaucaaauuuaugaacauccauguauguucuaccaauguuauaagagaagaaaacuguuuaacuuuucuaacaugauaaaauuccuuaaaauuagagacacgagcuccaggggguacugguuaguucauauuguuguuccaccuauaggguugcagauccucccccccaccccccagcuccuuggguacuuucucuagcuccuccaucgggggcccugugauccauccaauaccugacugugagcauccacuucuguguuugcuaggccucggcauagccucacaagagacagcuauaucaggguccuuucagcaaaaucuugcuagugugugcaauggugucagcguuuggaggcugacuuugggauggauccccggguauggcagucucuagaugguccauccuuucaucucagcuccaaacuuugucucuguaacuucuuccauggguguuuguucccaauucuaagaaggggcaauguguccacacuuugagagcucgugucucuagcugcauauguaucagaagauggccuagucggccaucaguggaaaaagaggcccguuggucuuggaaacuuuauaugccucaguacaggggaaugccagggccaagaagugggaguggguggguaggggagugggggggggggcguauggggaacuuuugggauagcauugaaaauguaaaugaagaaaauacguaauuaaaauaaaauaaaauuuuaaauuaaaaaaaauuccuuaaauuauuccacuaugaauuugaaagggaccacuggucuugaaauaaaucucuaucacauacuaaaauuuccacauaaucuaacuuuaauuuuauaacugcuauuaaaaaauuaaaccauuugucuuaagucacuauggaauguaauaucuauaucacuaccuuuuuagagaaaucuaagaacaauuuaaguuuuuccuuuauuauugagaaucaucauuaaguuauugaacaauaccuuacaguaguguuccccagagccugagccucucagguauggggauacuauguuuucaaggccaauuaccugcucgugauuuucaucuuaccucucugcuugcuguaauaauuucucugagauacuuugacuuuucauugguaaacccaauggaauuaauuuugaaaagaauaauuuuuacuuuguguauuucuauucuuaaauauucuuagacuuuuuauauuuuuuugacaguaugaacauggcuaucaugauuauuacuauuuuaguaauggagccuuauauccuuuuaccuuauauaucuuauauaucauaccccacauacuuaaugacaagacuauugcucucauucuguaacauaaaagauuuuuauaauuucauauuuaauauauaaugacaucaauuauagcaccuaaugaauuguacagagauguaauauuugaagauauuucagaagacuaaauacuuuguguaauuuuuaaaaacugauuaaaaacagccuacuuugucuguauuaccuuuucuccccaguaaauuguaauugauuuacuaugaauaugauuaaaauaaaguugauauuugagccuuaggcaaauuuauuuuaauccaauucuuuuaugauuguaggcuauuuugguaauagauaggcuuuuauuuucucaaccaaaggauagguuuaucuucaccuccuuucuuguacaucuaccuuaaugcuuaagaacagcuucucacagcuuuaugcagugucuuaagcaauggaggaauugucacagugcucuguguuugucccccuugccacucacugguugcuaugcagcuuucacccacguccuuuggguuuuguacacacucugcugugcagagcuguaaacuaagucucuuccagacuuacuggcugacaacagaauuuucuguucuugcauuguuucuuucauacugcugcuuagauggccauugcugcaagcaagccacacguuuuaucacuaaccacuuucaccuaauaaugugugucaucucccaagcuuccauaauaucaguuuuguccuagagugggcucugaacauuauaauugagacugguaaguggaauuguuaauuccaaagcaucgcuuauguauuaauuucauaucuccaucuucaccugacuaccucuucacuauuagagcccuacauuauucacaaauguuucaaauagcccauucggugacguguugaggcuauucaugcuuuuucuaucaaacaguguguguauauguacagagcaucuccauccauacuuuaauucuuucucaccuugaguuuuccugcuuugcuuuuuuuuggcauugcugcuguucaccuugcaucuccugaucauagucaagaccguuccuugucuguuacaucugucuaacauacgagugcaauucuuuucauccaggcuguuaaucugccuucugauucucagaauaguaauggucauuaccaaugacccucaugcuucaggcuuccaaauauuuugaauucucucuccuuuuccucauuagggugcagcacagaggccaagcacguggagggacagucugcggcugcaagugaagaagcacuuuuucccuucuguagggagccaaguuauuuugaaauuccuacaaaagaauuccagcagccaucacaaauagcagagagcacuauucaugagauuccaacaaaagacacaccaaguucccauacagcaggugcagggcaugcuucauuuaccauugaauuugaugacaguacgccaggaaaaguaacuauuagagaccaugugacaaaauucacuucugaccagcgccacaagucaaagaaggccucuccaggaacucaagacuugccaggaauucagacaggaaugauggcaccagaaaauaaaguagcugacuggcuagcccaaaacaacccuccucaaauggugugggaaagaacagaggaggauuccaagagcauuaaaagugauguuccuguguacuugaaaagguugaaagguaaagugaucuucagagauuccuauuguaucauaaguuaccagacagacuacuguuacuuaauuauacacuggaaaauaucuuuuucaaaauuuacguuuaauuuuaaagcucaagagcaaacagcacuguuuauguccagauuucucauucauauuagcuuuucuuuguuuucuugccaaaaccacauugguuuggggauggcagguuacuuaugucauuuaaucucuuuaccugcagaaauaaaaaucuauuaauuauacaaagcagaauuuuccugaaaauaauccccaucauuuucuugauuuaaagaaaagauauguacaguucuuuuucucucuaucaugcuuccaauauagcaccauuucuagguuuugaaaacaaaauuaagcuacuuaccugcuuacaccagaaagucagauugcgcuggagugagugcuucacacugucagcugugugcagaagcuccucacacacagacgcuuucagcugagauacauucacuagguaucuacaauucuaacacaaaguuugugcugucaacugcaauuugauguucauuugcagaaauuaaucauauuauauaguaauauuagcuauuacauauacuuuauucaacacuuaguuacagucauugcauguauauugauuguaacaacuaaucagcuuucuucccacugguuuugugaauugaauuucuuuuggaauuuguguuauuuuguuuuguauuuuaauaugcuaucaauaagggaauugcuuugaacaaaugauugugaauuugacaguucuguggcuuuuauggggagaugauuaauucuauucuaaaaacugcuuuuuggggucagggaacauauauagccuacuguauuccuuaacccugcaucugggacuucagcauaggcuauuaucuaauggcuucauuguuaaugacaggacugacucuggcuuuaauuauagugaucagcaguuaccuagcagaaagauaauugaauucugauugugauauauuuacuccuccuacauguuaguuauaucauaguugaaucauacgcaugcaaagguuaaagauaacauguaaaaugacugcuaauguaaauuugaugaaaaauagugauaagcuaguaguauaucagagguaguauaugccuugaaaaugagucuucuuaaaacccauacacuuacugcauagaugaaggaugaauuaaaaagauccuuuggcaagauuccaucaaaauaucuuuguuaaggagcuggagagguagcuuagcaguuaggacccagguuuaauuuucagcauccauauguuggcuccacaccauccauaaagaggggauccaguguccucuugugacuucuucagguaucaggcacucacaggguaaacuuacaugcuugaaggcaaaacacucauaggcauaaaauaaaauaauacuuagagaaauacugaaaauccuuuuauagcaguguaauuguuaaauguuuucuguauuaacaauuauccuuaagccaucauuuuaguauauucucugcucuucaccaggaccuauuugagccaaauuagaaguagaaucauuaauacccauaugaacacugucuuuauacugaucagaauauauuuuuaaauuuugccaaaaauuagucuaaucacuauugaccuugaauuauucuuucauacuugacauuagccuauuuugaaagccauccaaaaaaaauuuuucccagcaauaacucacuuuguaucccaaauagagccaugcuauuuauuucuucauacuuauuuacaaaugacauuaacuuucuucaaaauucagagcuguuaucaauaaauaaguuucccauuaguuuauaaaacggauacauucagauuuugaauaacggagguagauaguaguuaguaacaauuuauuaaaacuuggacuuugagcaacugugaaaaucaauugauaugagauauagauagauagauagauagauagauagauagauagauagauagauagauagauagauagaugccuugcuccuacaagaguaaagugcaugcgcuuugggacagugaggaaaauaauguucacaaagcccauacacuuucacccuuuaggagaguugcagcuugcuuuauaccaacuucucacaaaguacagccaagcuaaccugagggauagcaagugaaugucuguauuuaggauaguuagagaucagcagagggguuaagaaguaugcugagcauuucugcguggucuuuuuacugaauagaaacauaagauuacaacucugaucuaaucaugccucaacuuuuccccuuggguaauacacagaagcacuagaaggacuaauagcuuuauaagaaagaaaaugacuaaucuccaacagauuaguaacaaugaaacuuguguuuucauuaaaaauucugaaguaaauuuacagucuuacuuacaggucuaacaguauagaaacuauuaguguuuauucuuuuggaccuuaacaaacugaauuccuauucaguuuauccaacccaguauguuuuaaacaguacuauaauaaaaugugugucuaaacuaguaguuacaucucuguuuguuuuccauauacuacucaugauuccuaaauuaucaguguuggagauuccacuaauuaagcacauuguuggguuuuuuuuucuuuucauaguacuuuuuggauaguaaauaauuugaagaauuuuuacauucaucucauuugauuuuuauguuaaucugucacuuugaaucugccuuaucuuuaccauaguagugcccuccguuucuccuccuuuuucaagaugucauucaguucuaccauucccuugucuguccucauuucuuuuauguacuacauuuuacagguaguucucuuguguuauauuucacuguuauugggagcuuccagauuuacuaggaacaaacccauacacguuauaaauccuuuccccuagacauacaucucauucuuucauacacagcaagccuuuucuuucugauugcucucuuguugacagauguuuacuuuagaguagacagcgugggaauguuucaaagucagauuauuucuacaagauuggauucugucaauguacauucuaauauacuagauucauuuauaacuuugaaaagauuuuuguuaauccuugauuggugauccaucuaaaucaugcugucuuaggguucuacugcuaugaacagacaccaugaccaaggcaacucuuaaaagaacauuuaauuggagcuggcuuacagguuccgagguuuagugcauuaucaucaaggcaagaguauggcagcauccaggcaggcauggugcaggaggagcugagaguucuacaucuucaucugaaggcagcuagaaaacgggcucccacaugguuagaguagguucucaaagcccaccagcacagugacagacuuccuccaacauggccacaccuccuccaacaaggccauacccccuaaugaugccacuccuuuggucaaacauauucaaaccaccacacaugccuagaguaacucuugcucugaucuagaaaaaccuuuauugggaggcuaguauaauauuggacaugguaucuaccuauaucuguaccauguaguuuauuagaaggaaggguauaguagaagucuuuguaguugguaggaugucagcaucauuuaacucuuugaagccacuagaguucuaagaaaacauuuguaaacauugguuguuacuaauaguagcuacaaauuucagucuuuuuauugaaagguguguugaacuuuuaaaauuauugaauaucauaauuuagauauacuccauuuuaaugacauucauauuguguuaaauaguguuucgguuacaccagucuuuuaaaugauuccuuuuauuuguugcgauuauaaucauuuuacuuucccauuuccuuuccucuguacaaacccucccauaaaccucuucucacucuuuuucaaauuauugcucacuuuuuucauuaauuguucuuacauacauaauuucuaaacaaucuacugugucuauauaaucuugcuuuucugauguuuucaggcagggcugaccauuugauauuggauaaucaguugguguguucuuccuuggggacgacuguuucccccacucuuggcaucccuuaguugccuguaguucuuuguguaggguugaaaccuuggagucuggucuuuuuuuuguuuguuuaguaccaaagguuuacgauugagaggcagagcgaauguguauuaauguuagaaguacaaacuaugacaggugauggaacaucgcuuauucuuuuaagggauugaggaaucuuuuauaaaguugagauuuagagaaagaaaaguaauaacucaguuguuuauaaagggccucauugacgggugaaauauaauuauaacuguugugcaggagggcaguaugcagaaccuguuacacuaaaggacauacaacucugucuuagaaaggggaaggguagcaaaacaaaugacacuuuuguaugugcuucugauuuucuacauggaauuuuuuucuucucuauuauaucaugucuuuuuuuguguccaggaaacaaacaugaugaugguacacagagugauucagagaaugcuggggcacacaggcgcuguagcaagcgugcaacucuggaggaacauuuacgccgccaucacucagagcagaaaaagaaggcccaguccaccgagaagcaucaagaacaggcugcuguaagucaaacugcuuuuaugauugcauucuuugaugaagaucauuccagaaagagaaggucauauucuuuuacucaaaguucaggcaucuuaugucaggaaacuacuuucucaacaccacauaaaaaacuugaaaaagcaaaaucuccaccagcagaugccaaagugguuucuuugucuuuacagacuagcucuacgcaucacagaggggggcaugguguuccacaugggaaauuguuaaaacagaaaucagaggagccaucggugucacuacccuuccuacaaacugcauuauuaagaaguucagggagucuugggcacagaccaagccaggagauggauguaauguuaaaaaaucaagcuacuucugccucuucagaaaaggauaaugaugaugaccaaagugacaaggguacuuauaccauugaguuagagaaucccaacagugaggagguggaagcaagaaaaaugauugacaagguaaauaauugaaauuugaguaugaugguaguuguggggggcuguugacucuuggaccuuauuggagagguggugcgaaauguucucaugcaauagguggaguugggacuuuaggguuuuguuagggaccuagaagacuaauagcaagcaauucacuuauauucugaauuuuccuaaauuuuaagucuucuacacuuaaacuaccugggccuuuuuaagguauauaaauuucauugucauuucauguuuauuucuauggaaacugaacaaggaaauagauuucuacaugaauauaaauguuaacugauuuucuaccuacuaauuucauuuggggagcagaugaauagcauuugcuuugauuagcuuuacccauuuucuguuuguuucucuucacuacuaucugugcugaaucagaacaaaaucaguguuuauauguuuuguucauuuuagucagguuuauccaguccaguccuaaugauuugucuauauuucagauauuucuuugauguuacuuauuuauuuacaaggugauuguuguaugauuuauaaaguacuucccaauuuguuaugauaguaaaugguggaccuuagaaugagcuauuuauuuuaccacauggaaaauagcaaucuaaguuugacuaaacauaaaucucuuguuuaaauucuuguuacugaaaauaugcucaugagugaacaacauugauaucacuuaaguggcuaauacauauauauucaaucaguuucuauauuaaaaacaagauaaccaugugguucguguguacauuaacauuuagaauauucuaauuuuaagaauuguccgucaaagaacgaccaagauauaacccucugggauguaggcaaaaauaguaugacuauguucacuuuugauucucauuauauuauuuuuauuuuaguauuuguucuguaguauuugcaaugcauugacugauauacauguauaauuuguaagcauaaauguauugagucuguacuuauucuacuguuagaguggcauugugccugacuuuuagagacguguuagucuugaaaauaaguguuauauguaagcaguacuuugaccauuguuaaaaaagaaguauggacuuuaaaaggccauagacaguuuacuccacaguugaguaauauuuuuuauuaaauauuauuuuaugauuauauauauucauuaagaacauggcuguuuccaagcaucuggaauuaagugucuaaacuauauguacuacuuauccucuuggguuaaaucaaucucuuuaagcguaagugucauuuguuuaagaaauuaagacuuuuuaggcucaacagguauuuaaaaaacacauaggaagcuugucaugucauauagcuguaugaagaggaccucuuaauuauuaguuuuuauauuagucauuucuacauaugacucucuacccaaagucuggugaguccuguaaaguuuuuucagcacuaaagggguuaaauaaaaaaaaaacccaagguggaaauuauaguacaagggacaagccuggccuggugcagugugcagaaagaaggcauuucuacagauaggccuacuuaggaaagugauaggcaauggggaguucacagaaucugaucauuaauuguugucuaaaauuaucauaugcaucauuuucauucucaaggagcccuuuaauacaucaucacuuucagaauggagaaacccaagauuuuagagcaaggaccauuaaaaagaaugguauuaugcaacuggauagcuaauuuguccauucuuaaguuguguaaaccagaaaaaucuaaaaccaauacugcuucaaagucacuccauugucaugugucugccacaguaagaaagcugagaguucaggagguaugguuaaagcuagacgccgaggucaggccagcuuaaaacuaggcuuugcuagaacaaacauggagaacuggauuuagacaucugaagaagaugaagugauaaauggaugauugcagagaaaauaaagggcaaaaaaagcuagacugaggcauaagcagagacuugaaaggucuagaguaauaaacagacaugcucaguuaucuguagcucccucuuuaaaguuggaguauguaugauagaaguuggagcagcuguuguccaacuaaauuuguuuugaucugcaaaacucccauauaguuuuauuuccuuucuuauuccuucauugaagaaguaauuucauugauagugugcuagccucuguaugaggaaaagauuauucaaauugaaaauucuguguauucuuugucucaagauguacauacuuagugggauauacuuacaaauaaaguuauauguuaaaugcuuugagaaguguaacauguuaaaggaauguaucagguuaaaauuucaucaaagaauuagucacuuaauuuaaauaguuaaaacucucuaaaagggucuguagacacuauggucuuguugcauucuagucuuaagcauagucauugcuuuacuaguucuaugguuuuguccuuauuuaccuaagugggaaagaacuauaaacuccauacuauaaggaacuguccucaauauucucaaugaacacuagauuuaacugccagcugaguuaauuuugcagcacauauaauuaacucuguaauagagauaagaguuuauuauauucauauguguguauauauauauauauauauauauauauguacacacacacacacacacacauauauaugcaccagucuuaaucagaaaaugaagggcaagaguagaggagaaagaaaggacuguucagaggaccacaguuacuuugcagagagagaacuuuuaaguuaagaaagaaaacaaagaauuuaaacuauuuuuauucagaaagaagcacaaagagaaagauagaguuauaugguaccuuauuuuuaaaaucaaaguaaaauuccuauaacauaaaauuagauauuuuaggcauugagaaugugcaguucuguuaauagucaccuauaauuacaguacuugguaagcugcagcagaaggaugaccaauugaaagucaucucggaagugucuuggaugcugugguacauucauacuguugugugacgauggcgaugucuaauuccagaauguguaucauucuaaaacgaaauugcacuuaaguacaucuuuucccauuguucugacaccuuagcaacuaacuaucugcuuucugucccugcauuuacuuagucuagauauuucauaugaacagagucauucuauauguggccuuuaaugacuggcuacuuuuacuuagaauauugucgugaaguuucaucuauguuauggcaaugcuaugcuacuuaauucuuuuaugucacugaaucauaaauuauucuauuauagaaacuuuuauccauccauugacagauguugaguuugaguccauuuuugacuauuguaaaugaugcuauuaacaagaguauaucuguauuggggcuggagagguggcucagcuauugagagcacuggcuguucuuccacaggaccuggauucaauuccuagcaccagaauggcagcucacaccuguacugccaguuccagagauccaacacccucauacagacauaaugcacaggcaaaacacaauguacauaaaauaaaaaugaaaaaaaagaaaaauuuaucuguauguauauguguauuacaaugaaugguaaauaauuucuccuaaccucuuucugaacucuuguaacaauuuuguuuaaauuuuagauuugaaagguuaguuacaaauaucaaaaucauaacguuaaacacuuauauuuauuccauugaauuuuaagguacuuaucuuuuaaaaaguuguuauauuuuccuggggaaaauacuacagauuuaaaaacaaaacuccuuucuuaaaucaucuucaguuauuugacucuaugcacuaggguucagcauaguucuugaguuugugcuagugguuaacuuacagaggcccaacucaucuugcccaacagggccuuguuccuuagggaaagaaauguucagaucugagacuugacuauucuuauuuugacaccuugauaggauuaaaaugugagugcaucaccauucuuuaauuaauauagccuacaaaagcuugguguuagcuuucuuaugaggagaugaauccuaaguuuaguugauuaggacuuuuuuuagugcuaaaacucauuauguuagauaugcacucugccacuaauaagcuauacucacgguccuaaauauugaucuaauaaauuaaguauuauugcuaugaaauuaucauuuugucuaaauguguacuguuauaguuaugacauagcucucuccucucccuccucucacacugggcucugcuuccugcuacagugagcugaucuccuguaucugauauuacuagguguaauuuugaucuguguaccugauuaauagaugggauauaaacauccaugaaacuugauucugcucuuuagaauggaguacaaccagucccuagccccaccaucccauuuugaauggaaaggugugaaacuuuggccauuguaguuuggacuuuuacauaaugacaauaauaacuugggaguagaaaaaaaaaaccaaaaccaaagguuucuguuaauaacugaagaaauuguuuuuguuuucuuuuugucaacuaaaauugagacuggaaccuaaaaguauagucugauauucacggggauuugguuuuuauaauaaagugucucugugugguucuuuuggacucguguguguguguguguguguguguguauuagacuuugguaguaaagaagaaauaagucauauagauuuuucaauauccuguaguaccuggccuaauugccuacaguauuaaguaccaugccucaguaaccaguuguucaauuuguuuagaguagccacugagcuauaaaugggaauucuauagugaauaugauauguaccuauucugagguaaagaaugagaagguauucaaagaacaugcaauagaguagagcacaugcaguagugagacaaaagguagugaccucuuuccccaacauuaaaauccucagguagagauugguaugguaucuaccuggaucaaggacacagugguagguggcaugugaaugucacuccucuccuuagacacaugagucaucucagucaugugucagucccuaaagaguuucuuuuacaucugcccugggagaauuaaaaauggacuagcaaacuucugugaagauuuuagaaagaaaggauacagauuagauaucuuuauguccuuuuuaucuugucgaagaccaaucuaaagaaguccugccuagaugagagagccagauuuuguugugaacaaauuuggaauugugacugacaccaggucagaggaggacagggagaaaauaaaaaacuuaaggcuaacaaaaugcaaguaccuugagguauucaugauaauaaugacagguaagccacuuucuauucaggugguaaaucaaauaacgaaguacauauggaugaaaucuagugacagaaucuagaaucaaaaauggaaacccuugcaaauuuggugucugaagcacucccaaguucuagaccauuaucagaucacaugucagaguguaguauuuuagaagugaagaaaauugugcaugccucagaguaugcguguaggcauguaacuagcugugcacuguuuccacaugcaggaugucacaagcaaaugucugugugccucacacagagaugaaugcauucuagguuaaacuggacuauccauuguuaucuuaauuuuuucaguauguuguaaaagcuggccaugguggcuuauuuauccuauaauuacagcucuugugaagcugaggcaggaggaauguggugaguauguaggucagucuggauuacaguaugagaugcucaaaaauaauuaauaaauuaauuaacuaaaucauaaaugugaaaccuaaagcuuuuugccacacuggaauucuuccugcccuguaugggaaagaaguaauuugcaguucucuaaaagauagauguauagguguaucucugauaagaggauguauagaaaauugcuaggaguacuaucuguugccuucagcucccacuagagcugaaguauucaagcuauaauuuguuaccuuuucaaaauaauagucuauuaacaagguacuauccaagucauuuuuacuaggaguauuuugaagagaucgaccauauucuuuguugaaaaccacugaugaauauauuuuaagaagccaaacuuauaucugaugcaauuaaauaucuccaaaucagaaacuauaaauuggcaugccauacugaugcaaaauguaagaaauuauauaugguuauuuuuuuaccuucaaaugaguuagauuuuucuaguuauauaaaaauaacaaaaugaaccaguaaauuugaagugaaccauuuuguaaaagucacacaugagccacuucagcagcuaguguugcuuuccuuauaaaucaggguaaagugacagaacacagguauaccuucuuugucaugcuuaauccacucuguuguuuaggaaggugaagcaaagaaacuguacucccaucuauacccugguuuccauguacuauuaaaggucuuauuuaucuuaaaguuaguaacgugcagccuguacguaaagcaaagauaauucuaaccaaauucuugggggaaaaaaacuugucuuuaaauuaagccauaaagccaucuagugguaaaauuuucacauuucacuuaucagaucacuuuaugaccaucaguuucuuuuuucugugucuugguguagcaggcaugcccaaccuacagccuuugcacuauauaugugccaauauagcuaugaauacacucauaugcaaaugagagucaugugucagugugaaaagaguuggcaccacugaaagugguauucucuuauaaaaaguggagguccuaaagguuauuucuacagauuacuaguucaaugauauauguuuuuauuguaauaaacaaguucaaacugaauaguaaaacgaaauguuaaaugugauucacuauagcuuuuuuuuuucaucuguuugcaaggucuaauauccaagucccuucaugugccagaaaguaacuaacacugaggucuugccugaugggaaaauaaauuggcauggcuauugucucugugcugagcuuuucaaagugcugaccauugauagucacuaaaguugaucugugugaguaggucaagaaccugcauuucagacaaauuacuauacucuguuugaaaaucauacagugaaauuuguuuggaaccauaggaaauuauagguauaaaugcaaguuauauauguaaauaaccauuuuagugaaaaaacaaauaaaaagaggcauguguuucugcucucuaacgugcuucuccaaaauggaaacaagaaacaagcugagagugugcucgaguauuuucuugacucguuccaugauuuuaauguuuaaugucaaguccuuuaaacaaaucuaauguaguauuuugaauauuuaguuucaucagcuggaauauuugcuaacuauuaaggauagucacaucuacagcugcuggcuucauguccaguccagcuggaagucacccugucauuacacaaguuucccuuguuucugaaauugccagcugaggguaauuuagaauuuuuuuuuauuugcuuuugaugcuguugauauucacacacuaaucuggugcccacauuuauuuucauuuugaaacaaauuuuuccuucuagguauuuggaguagaugacaaucaggauuauaauaggccuauuaucaaugaaaagcauaaaggucucauaaaagacugggcucucaacucugcugcaguaguaauggaagaaagaaagccauugaguacaccuggguuucauaacucagagguaugcaauucuuuuuauagcauaaaauacaaguuuucaucauuuggaaguuauuuuaaguauauauaucuccccuugugaaaugcuuaaaaaacuaaauuuggacuuuuuuauaauuuugaaugaaaauguaaagcaauucuaguuuucauuguccuuucaguguuagugagugaaauaauuacaaaucagcaaacacguaauaagcuccauauuccacuuuguaaguagcacaaugagacaaaacaagaaauauacccugcuuauauucuguggggguuauguguuugcaauuagaagacugagcaggaaacaugagagggauacacuugaucgcugcaguaacaaccagugugguauccuggauguaaggagagucauguaagaacaacugaucacugauguaagagccagugugguacccuggauguaaggagagugauguaacugaggacaguuugaccacauaacuaugacaucagaauuccauuccagucuauguagcaaaagggaauauacuugcauaacaccuauguuacugguucagauaacaggcagugacuucuaguggaagcagccuucaagcuguuuuaaaaauaaggaaaaugcagugcaaauuaacuuggcugcuaucuuaaaucuugucauuuguaaggccagaaaccuuaaaugacuuugauuuuuuuuuuuaaguuugaggugagcacugugugugcaugugcgugugugcauucacgcguguauguugcacaugcaugugggagccagaggagcacaugcauguuuuccucuauuacugucugccuuauuccuuuaggacaaggacuuugacugggcugcccagcugcuugccuuuacuguugcugcugaugucacaagcacacacagucaugaucagcuuuuuaugugggugcugggaauuugaacucagguugucgggugcucuuaaucacugagccaucucuccagccuuuuucuuaauucaucacuuuacucuuuagauuaauuuucucuaaggaguaagugagugaugaauaaauauaaaauguaaauaaaagaaaauccaaguuacauaacauuacuauuucauuuauauuccuacaaauauguuuuuagggacagauaaauagaucuguaugcucaauaguguuaaaauuguuacccugcgguuugcuauuuucugaaaauuguuagaacaauuacaggcuuuuaguguucuuuauuucucuuaaacuuagggaaguuuuauucuaauuucuguuuaauuuacucacugaaaacagaugauauuaguaaugauaucaggcaguguguugguauuuugauaaauccagggaaagguuuuuguaaauuacuuuagauucccucgucucucuuccuccaucuaugccagguaaaauucauauaguuccaguaaguuacugucuuuguagccaucguguaacaggccauuagaacaaagcacaacaugccauaaguauauaauagugaagccgcucuguuguggaugcucuuugcacagugcaggaucaucugguacugucuuuggugcucaagaguuauagauggggauuguaagaccuuggaagggaguccaagaagucugcuaacuuugguguccaguuugucuauauacaucuuucucuacauuuauuucaaucuauucuugauaccauacaauauauugucuacaugaaucauuacuuuaucaguaucuagcaucaguuugcucauaauuaacacaguaacuuuuuaaaaaaagguauauuuaaauagcucaaaaugaacuuuuguaguuuuauauuuuuagugugaauggcugccugaguuaagguuugggugagaggugucuuuguucuuuacaguacuagggauugaaccugccuuguacuugcuaagugagucucuaccacagaacuauauauccccacgcucccuuucuguacgucacuagguuucacaggcugaucccaccucugauuucagcuugagauagauaacuuuuauauuacccucagccuacaaaugcuaggguauguccaugaguuaagggauacacacuucacuagaaggguucaaagacagauaaaaacauagaugggucuggguacagacuggguauagcaaauuucauaguguguuauuuucagcuuaaauaucauagaaauaccaggcuuugguuuccuuuuuuuaagauuuauuuauuuuuguuuauaugaggacacugcagcugucuucagagacaccaggagagagcaucagaucccauuacagaugguugugagccaccaugugguuguugggaauugaacuugggaccucuggaagaguagucagugcucuuaacugcugagccaucucuccagcccaggcuuugguuucuugaaaucuauuaaaauauaaccuaguauauuugauaagucuugaaacccugaagccagucugauuucuuagaaaguauaggacuaacagguaacuuuaauuaauaacccuuuagauucucuuccuuuuaauggaauaaaaccaauugcacugggcuagcugcaaagcugugauuugugucuguccuccucuggcaacagaauaacuguuguaccuaguaccauguuaguguauaagaagcacaggagauuguauacuccguucauaauaagaauacauugugguugaacggaacagcuagagagccuugauugaagaaucaaugcaucauaacaagcugagcuugagacauggcuucugugucacaugcugugacugaaugaaguucucgcucaugaaaaugagcauuggcaggguuguugcauucucucucucuguuuuucuccuuuaggaagccauaucuucaucuggaagcaaacguuggguuucacaaugggcuaguuuggcugcuaaucauacaaggcaugauccagaagaaagguuaauggaauugucugcaacuguagaaaacgguaauuucucucuccuccuccauguuuaccucuuuucucuccccucccucccucccucccucccuuccucccucccucuuuuaguggaccauguguauuuaaaaacaaaacaagcuaaacuuaauacaguuagaaguaaauuaagcuuaaaugaaguaaacugaggacuaguguauauauuauacaagaugcuaugcuaugccaccuaaccccaaguccuuuuuccuuaaaaacuuugguguaguucauaaauugaaccuuccaaagacaaaaggauaacuacuaagauuuaguauuucauuuucagacacucugcuuuuuuauuguaaauuuuugcuguucaaguacaauuuuaaaacuucaaaaaauuaacccuucuugauaugccaaucuguuagaaaaauauguaauuaccauuauaguguaaucauaaagauaagguaauaauuugcacaugauucauauauguaugaauuuauauuauaaauuaaggugucaaauauugauuuaauuauuuucuauuucauuuuuuaguaauaauguuaccuuguacuacauaaguauauaguauucuaaauuaucaguuuacacuuaaaaagcuuuacaguuaauuuuacacauuaaaaugcaaaacaaagacucacauaugaucccuucauuuuuaaauucuuucaaauaugaucaaauuuuuuugucucugucuuaucaccucaaaaguauucacuuuugcauugggaucuacuaaauugaaaaaaagaaagaagucauuuauuuuaauaagcugccuuacuuaauauaccagaaaauuaugguuuaacagucccuugguuauaaaauuaugacaaguccugucacuuuuuacuauuuucauauuuucuauugauacggauugucuuaggguuguccugcugugaagagacaccaugaccaauacaacacuuacaaggacaacauuuaacuggggcuggcuuacagguucagagguucaguucauuaucaucaaggugggaacauggcagcauccaggcaggcauggugcagaaggagcugggagcuuuacaucuucaucugaaggcugcaaggagaauacuugcuuccaggcagcuaggauaaggguguuaaagcccaccccacagugacacaccuacuccaacaaggccacaccuccuaauagugccacucccuggcccaagcauauacaaaauauuacauggaauuuuuuuuuaaugccuugcuaaaagcuaagauauuuugcccuuuuuucuuuucuuuuuuuaggaaguacaaauuuuucacagaaggcauucauuuuauacugaggauauuuuuaaacuuaugcuguaacuaguagacauuccuuuuauauguguccuuuugcucucaugaauuucugcuuugauauuuuuauuuuagagacagauacuggugacgcugguguuucccuaagaaguacuaguuguacaacuuccuuggcuagucagggagagaggaagaggcgaacucuuccccagcucccaaaugaagagaagcuacucgagagcuccagagcgaaggucguuccacagaggucagagauaggagaaaagcaagacacggaacugcaggaaaaagaagcccagguauaccaaagcgagaagcacgaugcagaccgaggccugaguaaaaugagcagggcagucaauggugagaguccuaaaacugguggagaugguaaagcccuccuucacucaggaagcucaucuagcaaggagaagagugagacggaaaaggaaacuucuuugguaaaacaaacauuggcuaaaaugcagcagcaagagcaaaaggagcaggcccaguggacuccuacuaaguuuccuucaaaaaaugcuuuaggccauauagauaaauguagggaggaaucuucuaagcaagagucccaacucuuagaaaaaguuucaggacauucuacgagcaaaggagacagaguaauacaaaaugaaagcaagagaagaaaagcugaggaaauuccaaaaugccaggccucaaaaggagacaagaaagagucuuccaaaucguuagugcgccaagggaguuucaccauagacaagcccaguuccaacauccccauagaacuuaucccccauaucaauaagcagaauucaucuguacccacugccuuagcacugacgucugcaaguagacuccgagaaaggagugacucuuuggauacugauucuagcauggacacaaccuugauucuaaaagacacagaagcagugauggcuuuucuagaagcuaaacugcgagaagauaauaauaaaacugaugaaggcccagauacucccaguuacaauagagacaauucaauuuccccagagucugauguagacacagccaguacaauuagucugguuacuggagagacagaaagaaaguccacgcaaaagcggaagaguuucacuagucucuauaaagacagguguuccacgaguuccccauccaaagauguuacuaagucaggcaguagggagaaaauugaaaagaaagcaaaaagccgcucugcagauauaggugcaagagcagauggucgcaaauuugugcaguccaguggaagaauccggcagccuuccauagacuuaacagacgaugaccagaccucuagugugccucauucugcuauuucugacauuaugucaucugaccaggaaacauacuccugcaaaucucauggacggacuccacuuaccucagccgaugaacacaacauacauuccaaacuggagggaggcaaagcaacaaagucuaagacuucuccuguugccucugguucaacaagcaaauccacuacucucccaaggccacggcccacccggacuucccuccugcgaagagcccggcuuggugaagcuucugacagugaacuugcugaugcugacaaagcaucuguugcuucugaaguguccacuacaaguuccacaucaaaaccacccacaggaaggcgaaccaucucuaggauugauuuauuggcucagccucgaagaacaagacuuggcucauuaucugcccguagugacucugaagcaacaauuucaagaagcagcgcaucugcacgcaccgcagaagcugucauuaggagcggagccaggcuagugccaucagauaaacuuucuccuagaacucgagcuaacaguaucucucggcucuccgacuccaaggucaagagcaugagcuccacucacggcucuccuucagguaauugguucuagauuuuuaauaacagcaguauguuuucuguauuggcuuuuuauauuuaagaauuauauuucuagcugucuuagaaaaauaauucaagaauaagguuaaaauuagugaguuacuaucuccuccauuaaaauguaaaauuccaaauaaagucuuagacaaaguagugauuucaaaauaagauauuaacuaaacacauuuaggagguuuuuuuuuaauuugauagaauuauauuaggaauuacuauuuuaaaaauaauguuaugcuccuaaaaccagguguuucagauuucuuaugaaccugaagagaaauaauauaccuuuuuccauccuuuuggaaauaaauaucugauuaaaaacuguuucauauacuuacacauuuauaguuggagcuguugaaaauuaacuucauuuauuucaguggaagaucguggauucauggggcaaucacuaaacaugugugggucaaauuaaacuggaaaguuaauugugaacauuaucuuguacucuuagcguuuaacuggagugauuaucugucacuacaaucacuacucauuaucucuaagcgcugaagugcuauugacuuacuugucugcacuucguauuuaagcugaagccauggagacuguguggcuacagcugugaggcagcuagcuauuuguguguauccuccaagcgugcucuuauuaccucacaaucagcugcacguguggguguggcugcaaaggccaguaaggguagaccagcuguucccagacuuaaaaguuuaugauucuuuaccaacaagcuaagugagcccuaagucuugaguuaaaaguagaggaacauugguguguaaucuugauuuuacuuuugcuuaauuuauaauacauccuucacgacucaacaccaagccaaucgugcguuguaacuguguuuccuccuuccccacuuucuguccuccuuucacugcugcucuugucugcuccuguucuguccugucgcugcugcucagugacuguguugaugacagucagagccuaugguaggaccaaaugcagacugaagcuuaauggaggauaaaugaugcuuucuuuguuauucuggccuguuuccacacaucagucuuugauuauuaaucaguugauuaccagguauuguuauucaauuaucucuuacggcucuuacggcucuaccuucuuaguucaaucccuuugugcugcugcauucugagcuguguuccccgauuucuucugcaacagcgcuuguucugccaucuuaccuccauuuaacacauuaagauauguuuccuuccguccuaacaugagcugugauguaaguuauauuuuacaaagagcauaaugucgcuucuucucugaucauugacuagcucuuaccacaugauuagucugauuuuauuccuuacucuuuagcaugaaguggcuuauuuaaaaugugguccaaauagaaccacuuggcaagucuaaaaaacaaauauaagauuucauaucauauacagguagugauuuuuauuucugcuuugaauacagaucuugguacuccucuguaucuaaacaaauaauaaauccuugaauuucuuaaugaaagucccuagagaaaauugaguuaaauguuacuuuuauucuuuauacuuaguaguuggauauuacauaauuacaguuacagaauuuaagaucuagaaaggauauuuagagaacugguaccaggagaugaaauaaccugcccugaucaaaucuuagggcagaaugagaauccagggucuuuuacuagcuguugcuacucuguuaagaaauguuacuguauccuagguuccauaagacacuaguaucuguuauguuauuacuagaaauauauacaagguagaugugacauaauuuugguggugaucacuaaagcaucgaaaggcuauuuuauccaguccagugaagaauguacuaaauaguuguuacaugguaugauuacuagaaaauuugauugauuuuuaacaauugaaugucuucgaugcuauaacauuuuuauuuaagauaacuguauuaucuugagugagaaugaaaagaaaagaaaaaagaaaagagggcuuuaauaaacauagaaucauacuggccaggguuucuauucuccauguaacauuaaaagaccuuggaguuaucuaccaccugugauacuggccauauugacauauguaaaaaguauucuguaguauuuuggacuaagucauuaauuuuuuuuccuuucauuuaauguguuaagcauugaugacucagaaugucuaguaacauugguagcaguucuuuuaugcaauuugcuuccaaggguuuaaugacuuuguuuuacccauauucuuuuguuaauuaaaaucaaggacccuaaguuaucaaaauaagaauauggguugcuuaaacaaggggacuugaguaaguuccaggccagccuggcuacuuacugugucucaggcuuggacuguauagcaagauccuguuuuacacuagcuaguuaaugaaguagcugguguucauuguuuuaaguacauaguuuagaaaguguuguuaaaauuuuuaagguuuuauuucuuaaauauuuuccuuauucuaaaucucaaaauucaaacuggaaauuaaacagugggcauuuacagcuuguguuaauuuuucuuuuacaugaauggugaaaauagaaagcuuucccagagaaauguuucucccugaauaaucuuauugcuaagugcuuauaaauauacacaacaaaacuuguuuguacuuuaauuccucucuuaaguccuaugauauauaaugaaaauguguauuuuucugaucuuuuuuuuuuuuuuugcuaaauugguaguuguauuuuaagaucgacauaguuuuguuacguuaaaaagaaauagucacaguuaaucauuaauaaguccuuuuuuauucuagacauaauaaauaauaguauguuucuaguaaaaauacuauuuuauaccuucaguaaaauagaaauauuguauauuuuauaacuaaaguaaauuuuauuuuggguaaaauagauagucuauuaucuauugucaaauuaaaguuuuauauaguuucauuucuaaaaaauauaaaaauacauauauggauuguaagacaugauucugugugcuguguuaaaauaauuuauaauguuauaaacaaauauguuucuuauggccuacaagauuaaaauaaucuugaaaguuacuuucauuuuaauauguauugauaacuagugcuucaccaaagaacaaauuagacauugauauuuuaaaaguccccaguauggauuuucaauuuagugaucuauuaagugccuuaguaagaucagucuaauuauauaaauuaaacauauuuuuguaaauagaaaauuuaagaaagugaaagugauuuuuaaauuuaaucuagauagguaaaaaaucugaaaaccuuauaugaucuauuuuccugucauuauacuuucuccuccuuuuuuccuucuauacggaacuccaggcccuggguucagucagucuucccugcucaauuaaaccuuucuagaaacaugcucauaggcacacccagaguuguauaaccaugaugauuugaaauccuguaaagauaaugaugaaauauuaacuaucacauuccucuucagaaaaaagaaaaauauuuauauaugcuuuuuacagagacccaugagcuuccucugcauauuccuaucuuccuguacccauuagucuagauccuaaccccaggagagcaaauaguugugugaguaaguacaggcucugauuuauacauauugccccuauagauuccucugcuuuaagccaucuucaguggcgauguguauaguuuuaucuaagagccagcccacuucaaggaaaguacaguuugaagaaguaucaggaaaaguaugaaauucuaauggaggaugaggaaauucugggcuucacuuaccuacuauauggaguaggccacccucgucauucagaacuauucuuaaucacuugcuagccagacacaucaucuaaaugcuagguacacauuaguuguuaaauaacauuuucugcccuuauggaguuuaccaugaauuagacauuaacuucucuguucuuuucuuguuuauauuuuacaaauuacuuguauguuugauuuugcuauuaacaguaaaaugucuacauuaauuugucuucuaauuuucaaugugucagcaauaacauuuguaaaaugucuuuacuaacuguaaaugagaaaguaauugccacuuuccuuaaugacaaucugaauucucucuugugccuuaaaugucagugauugugagguuuuguagucucaugcuuuguagaguuuacaccauugucuaguuugaccauauguuuuugguguuaaagcagcaaagaauuguacugaagaugcuuuguuguguucuuuuaccauguaaagagacuuuuuccaaccauagcauaacaggauguugaaugacagagguaauguuuuuuuuuuccgccauaaaggcauaauuucuggacaggaauuaugcacauauguauguugggaaaagaggguuuucuucaucucuguguucaaaguccauguggcaugaggaagucuuuucccuuuuuauuuuugucuuguugguguuuuugcugucauuuaaaaagcauccauaucucgacucaaaaaguaugugcaacugaaaacacccuuguuaagcauuuaugacuagagcuuguuuaucauuagugaacuuuuucaucugaauguuuauucgcuacacuaugaaaaacacggucuuuugauuguuuuuaaucauuguuuuuaauucaccaauguauaauguuucaaucuuuaaggaacuguagacuuagaauuuuuugugagguaugugugucaguuacugaaaauugugcugugugugaacucucguggugaucuuguaaucaugauuuuuauuuaaaaaguuuaaaugauaacauaauaacucuuuuuuuaauaauuaaacaaauuuaguaaauucaagauggaggcgcuuuccuacugauuaugcuuccaccucagaagaugaauuuggaucaaaccguaauuccccuaaacauacucgucuacguacuucuccagcccugaaaaccacucgcaugcagaguacuggaucagcaaugccugcuaguucuucauucaagcaccgaauuaaagaacaggaagauuauauccgagauuggacugcccaucgagaagagauagccagguuggcuuuuauuuauuuuuuaucagcauugcugguuauugggggcuggagagaagugacucagcaguuaaaugcagaggagaagaaaaccuggguuugguucccaguacccacagaacagcucucacuguaaauccagucccugagcagccagugucucuucugacuccucaagcucuugcuguauaugcugcccagacauacacucaggaacacccacauacauauaaaauaaaccaaauguuuuuuaaaaauaucaaaaacauuccagguuaauaacaaaaauuugcuucuuuauacaaauuaucuaagaaguaaaauccucaggucuaauuaaauguuuuauuaaaagaauuacucuuuaucagacuuuuguuuucauuuaaauuauuuaauguucaugcuguugauauagagcagaauacaucacagaauacauucauuuugguucccuucccacugucuaagauuucuaguagagaugccaggaauuauaacuuuuuagaguuacuuaaacuccauauaguuaagauuuguuuggucaguauacagauuuuucuccuuuuaaucuaaucuaaaggagcaaucuuuguuacagauaggcuacuaauguuacuggcaacuuugagacaggcauauuuuuaccuuuuuuguuguuguuugguuuuugagacaauuuugcuaugaaaucuaaggugaauuagccauuaauuugggauucuucuucuaggccucaaauguugugcuuacaggucugcucuaccuugccuggcuuugcuuacauuuuuguaaauucauuaaguguaguucaacuccuuagucaucaugguuauuauggauauuaagugauugcuuauuauuacuguuaaacacauaaaguaaaacucacauuaugcaugugauuaauuaauaacccugcaguacuguuaaacacauaaaguaaaacucacauuaugcaugugauuaauuaauaacccugcaguuaaacauuuuagacucaacaaaagccauaguagcuaaaaaucuaaggaguuuaauucuaagauuuuaaaaauuuuuuuauuuugauuucuuugauuucuuuaaauuaauauacauauaaaauauuuaaauuauuuuaaauaauuuauuuuauuuuaauuucuaaauuuuuuaaauuuacucagaaugcuuauguugccuaaacacuuuuacuauguuacuugcuaauuguuuuuugccuuuauauuaagacauuagauuuuauucuugcaauauuacaaacaauguauguacuauuauccacaaugcuuugagagcagcaucaacuuuuaccauaauuugauguuguuuuucuuuguucaagucugugaucagguuuuuuuuuuuuuugggggggggggggggcgguuuucgagaccggguuucucugaagcccuggcuguccuggaacucacucuguagaccaggcuggccagaaauccgccugccucugccucccaagugcugggauuaaaggcgugcgccaccacgcccggcuaaugaucagguuuuuaaugagaaacuuacuauaguuuuuaagguaguugcucuauaucuuaguuuggauuuuauugcugugagagacaucaugaccaaggcaacucuuauaaaggacagcauuuaauugggcuggcuuacagguucauagauuuaguccauuaucauggugggaaacauggcaguguccaggcaggcauggcacuagagaaggagcugagaguucuacgucuuguuccgaaggcaaacaggaaaacacugucauccaggcagcgagaagggucucaaagaccacuuccacagugaugcaguucauccaacaaugucacaucuacuucaaaaaggccacaccuccuaauugugccacucgcugggccaugcauauucaaccaccucagucuaauuagagaaaaggaaucugugaaccaugugcucacaugcacuggcagucagauaaucuugacgcgcucugugcugaucucucgugccagcaagucuugcuuugguccugucauuggccccucuugcuguacacaguaaaggacaagugguaccaaagaccuagaagaacaagucugucuccucagaacauugucccucacacagugcuauaaacuauuaggaccaaaauccuuuuacuuuuggcagucaaaccuuucauuaauccaaauagagaagagugagcacaaaauaagaaguccagagggcuccagacauuguuuccccaugguuuuauuuguuauucggauugguauugcuuuugucucuguuuauucuauaagagacucuaaacccaaaccauucuagcaauuuucaucccuagcuaucucuauuuugucaguagaacuauaguaauagcauucaaccuuuuggauuuuauuuuuuaaaagaauauaagcaagagaacaacuguuguugauaaugaugauauugaugguuuuuauaaaaaugggaaaggaagaacaaaacuauggggaguguuguucagugcucuaacagaguaguaguaaguugugguaaugugagaaaaaucuuuucaaaggccuuaaaucugacuagauaacuaaaaucauucuauuuuauggaauauuuuugacaccuaaacaaaacuuacuaagcauugaagaauacuugaaauauuuguaauugagaaauguaaucuuaaacuucauuacaaaaagugauuuaugcucugguagauccaucuuuucauuuuccaauguagaccuguuacauucauaguuauuaaccuguauuuaaaaacaagauuaauccugaauauauaacguauacacaaaauagagcaugcuggucuuuuaguuuguaaaagaagguuuuucuuacagauauucccaguacauguuccucaauacagacagcauaagauaaauuucuuucuagugggaauuugauaaguguuaguaguuuuauaaauacugugguacacaguacuagaccuuugcaaaugacuaaauacuuucaacauaaaagguuauacuagaagauuauauaauucacauuggaaucacauggaacuuagcaguauuauaguguuuuaaauucauuauuauauauaugcacuguaucauuuaauuacacuuuaagaagagaauuucaguuagcaggauauuaagagaaaacaaccaguucauuauauuaaaauauuuaaaaguaaagccgauauaucuucucucagcugcaugauuugcaaagauacuauauucuuuuuuauguacacuucuagagugauacuuuucauuguauuuauauuuacuugaguucuuuacauaugguguauuaauucaagauuuuuaaguguuccuauaggauaacauaguuauauuuuagugcugaacauaagauucaauuggagcuagaaucauaguuauauucacaaagaaaauacuuaaaagccaucauauuacuugagauugugaacagacugaauacugcugacucuagguaguaaccuaaauuauggugcugaagucuaaccaaauggugcagaaauaaacucagagucaggccuggauccauaucuuuuuuaacuauaaagucuguguaaaucugugguagacauaauacuaguguuagcauuaguguuuggcauugagauaaguuacuaauacaugucagauuuuaagaacagaaaaaauagugauaauugaauuucuuuagaacuuaaguuuucuauauaucccaaaaauuuuaugagaauuuacuuacaaguagaguuuaaggccaccacuaaguuuuuaucacuucuauaaaauauuuugcuaaacuguuguagucaagaaucccaaccagugaagauccauaucuucagugcaaacccaaauaauuuuauauuguucucauaauaaaaauacuuuauaaguuuucugugguuucuuaguacuaaaaguucuuagaaaguguuuucuugaacuaacauacuuguaaaucuguaauguauuuuacaucauacaucucuacagauagaucuuuaauuuauugaauaagcuaagcacaugugugaaaaucauaaacuuucugauuuuaaguacauuuuaaaacagauaauucauuuuucuauaaaaucuaugaaguucgaucucagcuucugucauuuggguggaaggccuagcaguaugcugggucuuuacauuugauuuguacuuuagaucauugggauugucuuucccuuacaauuuuguaaugaggaaaauagaauuaaauacggauuguauauuaggcuuugaaauuggcaaguaaaauuuugauacuugcuaaggaaguauuauuucauagaucuccaaauaagaugaguuuacucuuuugggguuucuucuugcagauuugagacagaaggaaaaugagagaaggaacaaagauuguaggcugagaggcuaaaagcaaagcagagcacugcauggaaagaaauguguuggauuauaauccaguagauggaaccaagaaaauuaagucagaaacucuaguuuaguaaccacguaauuuagacccauuaucuggauugaacagacgccuuauuuuauuggaauauuucuauaacucuuuucugguuuuuuauuuuccuuucuaauuuucuuguaauaaauguucagggcucaagucuguguuuuugaguuaggguuucauguaguccaggcuggccucaagcuuaagccgaggauacccuggaauucaugauuuuguuguaucacuucucaagugcuuauauuacagauaugugccaccaucccugaccagcugcuuacaguuuuaguaauagguuaucauugaaucaacuuucagacaggacuugucugugucaggaugacauguuuaauuuugguuggacaaauuaguuaccauggccaaaguagggcagggagggugucuugguugcugggcuucgauacuuugauagcuggaccuugguagucagccucaggaggaggaaguagccaaauaaaggacuagaccuugguggccaacuuuaggaauauaaucuaacaguuuuuagcagggcaaaggaguugggaagaaggacaaggccugcaagagucauguuugccaugcuuggccuggcuauagucuuucaauuuauaccuuauacacauagccugaagguaauuuuauacauuuuuaauaugccugagguuaaaugcagccuauaauguaauaucagcuagagaauuuuccauuuguuuuguuauguugauacuuaaaaguuuuauuucgaagcauuuuagauccaauaauuucaguuuaggaauauuaaaccuguauuacauaacacauaccccagcuuacucucgcucacaucagcaauuaaguuugaaaaauuguaugauaaugugguauaauucaaaagucuaucaauguucuuacucuauccuuagccuacaaaguuuacauugacuucuaaacuuaauuuuuaucguuuguaaaauaugaugauaaacucacuuagagaaggcauuugugaagauuagauaagaugauuaauauaaaaguuccuuauaaugguacuugaguuauucuaagcuucagaagagcgagggacccuaucuguuuauucauugcuauccucucaggaugcugaguaccuggcaaguaacaggugaucaguaaauauuaacauugucccuaccuuuuugcacugguauaacaagguuucaguuucuuacaaggauuauauguguguacauuaaaucaccuuacacauugucaacuccaaaacuuaacacaacuuuauuuuaaaguuggucagauuuuuacacaaguguacuccuugaacauccuuuaaacucccauuuugggacuagagagauggcugagguuaagagaauuuguuucucucacagaggacucagauuugguucgcagcucacccauggugccucacagccauccaucaacacccucuucuuacuuccuugggcaucaagcucugcauggucugauacuccuauguaucaaucuaaaagaaauuuauuuuuaguuuuaaguccacauuuuauauaacuuuuaaaaaauguuucuuaaauauauucuaucauuuuagguccuucucuaugaaagaaaccaaaucgagucuuauggcaacaaauauauaauguguaaaaauucuaagaauugcaaucucuuuuaagauguaugggaauaucaauaacagaauucuguuauuucuuucuuaaagauuuuuguuuuaaugcuaagagaaaacucuuuucacuuuaaugugacuacuaacuagaggugaccuggaggugugacugguagacuagugcuugccuggcaugguauuguggcacacacaugccaucccaguacucaggagcagaggcaggaagauugcugaaaguuuccagcuauccuaguacauguagcaagacugugucuuaaaaaaaaaaaaucccuaaacagugauuucaugagcccauaugaaugaacacaaagcuucauagacuugaguaauaaacugagaucugguccuucuuguacagucauaaacuggucucugaacuugucuagugaugucuauuaacaaauccacuuaauccuacuucagaagagcauuaugguccucagaugacaucagauagaaaaugcugugcauaguguaaaacagcgcuucaguccauaaguucuugguaucauagaacccgcuuggugaagcuuaggaagauaucuuaguguuuccaauuucaugaacaugaguaaguacuuagaauuacaaacaauuucaguaaugcugaaauacaguuaucagaauauuuugcaauguaguagcuguugauucuuuuauuaacaauuuaguaaaugucauuaguuuggguagcuguguauguuugaaacaguagucccuguagaugacuguaagcaacuaucaugcgauuucuguugguaacaaagaccuagccuuguuaauuucacuguaguguguugcugcuuauaguuauaauugaaacacuaagcaucaguucaguuagugaaaauguuuuuguuucuuguuauccagguucagauacuuucugaauucugucauugccaaauucauaauguaauuuuuaaaguuauuaucuuauagauuauuuggaacuuaauucauauauuuuuuguaucagaauaguaaagagcuuuccgaagagucuuaaguuugggaugucagucugcaauuagaguuacaaguuacaugacugccaaaauugauuguuucuagaacuguuaacuuaaaggaaauuacauuucuuuucuauaauuauugccaggaucagccaagaucuugcucucauugcucgggagaucaacgacguagcaggagaaauagauucagugacuuccucaggcacggccccgaguaccacaguaagcacugcagccaccaccccuggcucugccauagacacuagagaagagguaggagaucuucauggagaaaugcauaagguucuuucuuuucuuaauuucuuuugcuuuuagcuuuuugcuugguuuauuucaaucauguccacccucccugucugcaugcagcucugcauuuuccaacuuugcuuaacaaauuuauuuuuuguaacaauuagugaagacuaaaaggcuaauauuuggucuacuauuaacauaaaaaugggaagcuauuuagcuauaagcacuuugccuauugauuacugaucuuacuugaaaugugaauauagaaguaaaccgaaguucaacaaauuacucuauaagguuucaaugaaguuugacaguaaaaagaaauggucucuacuaguuaauagcaaagaaggagacaauuucuaaacuuuuuaaaauaggaauuucauugacagauaucuaccauauuguuuuuaaaaacggaaaugucuauuauacaaauacuauuacucauauauacacauaaauacucaaauaaucuuauaaacucuggaauauaaauucgcauguauagaguguugaucaccuaaaaccauggcuuccaacaguacaguuccaugagacgccacuugcauaacauuguuccacacaguacauuuaacuuaaaguuaaugauacaguggucuuuccuuuucuauggagauuaauucuaagacacacaucaaaaccugagaauaucccagugucuuagauuaaaagguauagaguuuacauguaggcuguaggcauccuuccccuguacacucaucucuggauacuuagaauaccuucuaauagcaugaaagugcuugggcuauauuacuuacagaacugugacaagcgagagguccauauauggaauuuaccauuuauguaucuuguuaagaaauuaccucuaguaaacacacagcauuuuaaaaauauuuucaguacuuaguugaguccucagaugagaaagguugaccauaguucucuagccauguuggcuauuuuuaucuugagugaaaguauaaaccaaaagucagccuuuuaaaggaacuaauuugucucuauauggccuaaaaucuagaaauagauuuguuuuuuuaaaggauugaaaauauaaaaagaauagugauuuuauaacaugaaaaucauuuuaaauucacauuucaguuuuguugcaguauaaucauucuuguuugccuaccuguugucuguggcuguuucuguguugcaaugcagacuugaguucucaggcagaccguaggguugcaaagccaagaacacuuacugucugcuacuuuauagaaaaaugcugcuaguuccucauacugauaacucgacuucuucaauuuauuaaauuauaaauaguaaccaaaaaugccuagccuuuuggacauuuaauccuggcaaauugugcugauaaucuuuucuuccauugcuuuuugucucauuuuuuuuucuuauaaagcuccuuaauggucacuucuuguguauuuuuuguuuguauguuuucuaauuuaauaaaugauauuucauuaauuguguagaguuuuguuaccacacugaucaauuauaaauguauauaaaaauugucuuuguugguuaaaaaaaaacaaaaccaagaggaucuucaugguggcaagacauacacaugucucugguacauuuaaaugauauuauuuucucagcuuucuaacugaauuguaccuaacaugguuauucauucacugagcccugguagaauuacugaaacauuucauggaauagacuuucauuccccuuuuguuuuauuuaagacuguuacccuaguuauucuuucgucgguaaaccuguuacuugguguugcauguccauagucugcacuguagaugguaggacauuagugcuacuggcagaagauguauguucucuaucauuguuaaaaguuugacuaagacaaaauacuuacuauauggauuaauuuuguuuccuuuuauaaauuuaauugaauuuaccauucauguaucuugugaagaaauuuagcaccuggauuuggggaggaaaaaaggaaaaaaaaacaagauagaaaacuaaaagaaaaagaaacaauauuuugugcugguaaggcaguaugaguaaagugaacccauuguccacuccauggcccaggguuuuucucguaaagcaucuauuuuuuuuuucccuauggagaacaucaugaaaacaauuguuaaauacuuucaacccugaaaauaagauuagcauagaugaacaucuacuuuauagaagagaccuauuuggcgugcuuauuuaaaaaguaauugguuuauugaagaugucaugcuucuguucgagaaugaaauaauuucucucuaaucauaaaaauuauaguaccaguauuucuacacuucucacuauucuguucucauaaggauuuacuuuugucccacuaguugguugaucguguuuuugaugaaagucucaacuuccgaaagauaccuccauuaguucauucuaaaacaccagaaggaaacaacggucggucuguugacucgaggccucagccagccgagcauccugaucacuuaacaauuacaagacggagaaccuggaguagggaugaaguaaguaaacugcagacuuggaacagauggcgaagaggcaucucugcugugccauauuagcuaauguuagguuccagguacuucacggguaccaaauucauuauuuuguuauuaaagagaaagaguuguucaaacuaaacuaguaauggauacaagucaagauuaauucuaaguuaaccuaaaagccaguguuuguuaaaacuauuuaacuaauccuuuaaaaaaauaaggaacuugaaagauagcccagcauuuaagaguuacugcugcucuggcccaggacucagguuuggccucuagccucuaguuuuaccccauucugaacugaggcaauaucaacacccaucaugacaauuuacucccucacuugucucugaagagcuggugguugcucucuuucucaucuuuguauuuguauuauuuaguaaauaaauaauauaguacucuacuuccauuuucccuuuuaugauaauguaaauuauauauaugagaggcagagucaugauaguaauuaaagaggauaaaauugguuguuuuuaaaaaugggaugaccaaaauaauagggaacauugacaauuuuuuuuaacaaaggaacucuguugauguuucuucugcucucuggaauaauuacaucauccguauauuuuaaguuaaaauuagcaucaauaguuugaguauagugaauugcugcuaguguucuuaggaguuauucaauaacuauauguuacuacacuuuuucucuguuucaggucaugggagauaaucugcuauugucaucagucuuucaguucucuaggaagauuagacaauccauugauaaaacagcugggaaaaucagguacuuguguuucucuaaucucuacuucuuguuuccuguccauucucuucaaaccuguggccacugcugugaggagcuagagacgucacugauguggguucuuacacugcucuuaccaguuacuucagauauaaagagcacuaacacuuucaguuccuaguacuaaaaccauuuucuuucuucacaaaauauuaguaaauauuuuaaacuuagcaaacucuugagguuucuuuuauucagacuggacucuagugucuuuggauaagguguuagacugagcuguuacgacucuggaagucuaugaugcagcagccuuaaagauuaaaauguauguagacuguucagccauagguccacauucuuaauaaaaacaaguagcuaccagggcuggugauagaggccaaagccugugacaguuuaaucgcagggccaaccugucacuugugaggccuugcaaucgauucccagcacagaacauaaauaaguaaauaaacaaauaauguaauuuuuuuaaaucccuauuuaaagugagauuuguaccauuugcuuuccucuuuaauuuuaguaguguuuaacaguaugugagccagguucaaaacuccaaauguuuaagauauauuuacauuauacauacacuauuuagcaugcuauauguauuuuuuucucccuuuaaguucaagucucaacagacagaauccugaucacuuguucuacaucuugggcuuuuuauuaacugaauaccuuuacuuuuucaaauguaucuaaaauauugauagguccuuaguauuugcuugaaauuggggcauacagccaccugacucacuguucacuuguuguggaaccugcucacauucccagccaacuccucacccccacuccccacccccgugguuagcugucacaaaucccuauaacccagugaaaucaaaacuauagagacuuguaauuuaucagucagauuuauaucaguaaauucucaacccacaaaaugaacucagagcuaauuacugauauaagcugcccaccuagauuguacaaauuguccuauauuauucuguccauucugagauauucauagcuaccuguggcuacugaaagccagguggauuggguuuguacucuuguucuuccaucuucucugucuuuucucucucuccuguccugucucugaaacucucagccccaccuuccuuuuucauuguccaaucauagacucuagucuuauauuacuccugcgcucaccugcauauugacagcaaucgacauuuuaguaccuauugaguuauguuuuuaauagauuuucacaagcuugaaucaauaguguucacuauuauacaucugaguucauugaaugauuauuuuucuuaauauaguuuugaaauuacacaaacuauguauguaguuuuugauaucaucaacaaaaccaugaacuugaaaugcuuguguuuuuugacuguagaauauuguuuaaagacaaagaccggaacugggaugacauagaaaacaagcuaagagcugaaagugaagucccuaucguuaaaacuucaagcaugguauggugguuuuucaagauuaaaacauuucagcugcauggcuucauuuguagggaaaagcauaguuuugaauauuuguuaguuuacauucuaaaagacuguauaaaugcauagauucagcuacaguccauccagugguguuuaaagucucuguuguuucgaggcuacaaagagcauuaaggaggaucuuguguuuauuaguuacugugaugcaucuuguucacaugauaacuuuacauuaugaaagaagcagcuuuaaauuuagaacuuaaauauuaaauugacauacaauuucuauuuuaaaggcacaguuuuaucagauuuuucuccuauguugauguuucacuuuucauauuaaaaaaaaaaaaaaccucaaaggcacaguuuuaaaauguugcaaaguuaaucagaacagauguuucaaaacuguccuuucuuuauuaguaaauugccuugaaauuuuauuauuauuguuguugaaaaaauuucauuauuaacgauuauaaauuggaucuugcuugauggaugucuuguguguagcuacgagugcaguaccauagaguugcauugcuguaacaggagaaugguuuaauuugguaagaagcuaauuugggguauuucuuucccuacaggagauuucuucuauuuuacaggagcuuaaaagaguugaaaaacaguugcaagguaaauguacugcuagauuaaguagugcugcaucuggauaagguagugugcgggguucugggaugccugaggcccagcauuccagaggauugaguuugagaccagcucaguguauuccauuucugaaaauauauuucuuacauucuuaauuauugaaacaguauuugacugaauauaucaaccaguacuuauaaaaguauagaguugaauauauccaaguuauucauaaagggaaguuuuacaacucuauauauaaaggacuagagaugugucuccauccuaggauaucugccuagcauguguaaggcccuggcuucuuuccuagccccauaaacauggauacauagauauagauaguucccaauguaaaaucuuuuuguuguuucccucuaucggaaguggucuaugcagauuggucuggaccucaccaaguugcuggagcucuugauccuccuccuccaccucugaggccgccacaacuggcauagagauaaugaacaauuguugauauuuguauuugauaaaaaucuggauguugaaaacauaaccaguauuuuuaguaauccucuaugaugguaaaagcaaguuuagaaagcucuuggcuuuuucccuuccaugcacuguuugcagucaccuaaagugucuguauggacugcagaguccuaggagaagcacucagauauguauagucuacaauguagacuuaaccacugguuacugaaccagguuauguuagaucuagcucacuuaacuagagguuacuagcuuacuuuagcuaaagucucuauuaaugauaagaaguauucauaucugcaucuugcuaaaaacagaauuaccucucuuuauuuuuuguuuccuuuagugauaaaugccaugauugacccagaugggacuuuggaggcucuuaacaacaugggauuucccaaugcuauccugccaucuccaccaaaacagaaguccagcccuguuaauaaccacagcagcccuagucagacgccagcacuuugcccaccagaaacuagagcccuacacccugcugcugcgggaguggcagcagcagccuccacugaguuugagaaugcugaaucugaggcugauuucaguauccauuucaauagguucaacccugauggggaagaggaggauguuacaguacacgaaugacguuuccuuauuuguuagagacauuacccauggaguaaguaggggcauuggaagcagcauaauguugacauacaaaacaagagagcuuggucagcaacaaucuuguuaucuuugucuucuugauuuauuuauuuauuuuuacuucuaaugugucacaccagucuuuucaaaccacucagacagccacuugaagcacacucagcagaggcagcuuauaucggcuucgccuuuugugguucugugauuuucagaugaaaucauaucauuucauccuuucccuucauaguuuuuuuuuguuguuguuuguuuguuuuaagccaugcugugaccuacaaacaaacuaaaauauccacauuucugagccccugugucuccugugccaagcugcccccugagaugaacuuuggcacccgcuguacagauuguuaaaccuuucaauuugcuucuuaauacuaggguuuauauuauuccucacagucacuggacacagcgccgcccugcucuguagagugaagcagacccuccacagcagccguccugcguucuaagacuuuccaacauagugugauuuauaacuguugcuaaguaacuugucuugggguuuauggaaauuaauuauuauguuugcacuaagauuuacugggagugauagaugggcguaugcauauaucacuaaggacugacauuuguacauaggaaguugacaauacuguauuguuuuaaccccacaguguuuuacuccacuuuucauacaaagcuauuuggcacuuuucuuuuuuuccuuuuuuucuuuucuucuguuuuucuuuuuaaggaaauacgauuuugucucuccuuuuagauuaaauugcuaggaagguuaaauuugacagauaguuuagguggaguauauuuuuaaaauuaagaacauguauauuuguccuguguuaccaaguuuuuauguuacagaaaugccccucaaaugaucaugagguuaauuuuucuucauuaggagacgugaagaucaguaguugugagaguaguugauaguugcacucccagucauugaauugcuucuguguuucccuguagguccauaguaacccuuugucagucuuacacauuuguaaggacccugcaagacagcaacaacgacuaaggcuuugggcuuaucgcuacuaaaaagaaagccugugaaaaauaucuucucuaaacuugguuuuuguuacuguuuuguuuucuuuccaguaagcucacauuucaauaaguuuuuaaauaaaggaauuauuuuuguguuuccagaacacuauaauuugggugaaucuuaauucuuuuaaauauauuaauaggccuggauuuacucaaaggcucuaagucuauaaagaguaaacugcagcuuugugauguggucuuugauaucuuagcaauaaccuacgcuacauuuguuuuaaggaaaagguaacugcucuucaagguuuuuuuuuuuuuaggaucuaagaaauccuaugauguuggaucaguuaauaaaaaugcaaaauguuuuuguaagauguaaaacauaagucugcuguguaauggaucucauauuuuucuuuaaauuaaaaaacagaaaaggauuuguucuccuuguaaagcuaaauucacagcucucaugaaguaaaacuucaaaaggauuuuaacaaauguaaaagggaagugagaugcuuugaaggaacaaacaaaacaucgaagcagggucaguccauuucaagaaaaaguuaugcauaauaaucaugauuguuccccccuuuaguuaacguuugguacugagucuaucuacaugaagaauacaagauaaggagucuaagaagguauuaaauuaucuacuuacguuauuguuuguuuacacaguuuuguucaauuauaaacauuuggccuuuuacuauguuauuuuuauuuuauaugaauacauucuccuuauuuauuuuuguuacauuuauuacuuuauuuuguuaugcauuuacaacuccauuuuuaaauaaaguguuucuggaacuuuaugcaaugauc

SEQ ID NO: 536 - RNA, 4362 nt, Mus musculus
cagcuguagccacacagucuccauggcuucagcuuaaauacgaagugcagacaaguaagucaauagcacuucagcgcuuagagauaaugaguagugauuguagugacagauaaucacuccaguuaaacgcuaagaguacaagauaauguucacaauuaacuuuccaguuuaauuugacccacacauguuuagugauugccccaugaauccacgaucuuccacugaaauaaaugaaguuaauuuucaacagcuccaacuauaaauguguaaguauaugaaacaguuuuuaaucagauauuuauuuccaaaaggauggaaaaagguauauuauuucucuucagguucauaagaaaucugaaacaccugguuuuaggagcauaacauuauuuuuaaaauaguaauuccuaauauaauucuaucaaauuaaaaaaaaaccuccuaaauguguuuaguuaauaucuuauuuugaaaucacuacuuugucuaagacuuuauuuggaauuuuacauuuuaauggaggagauaguaacucacuaauuuuaaccuuauucuugaauuauuuuucuaagacagcuagaaauauaauucuuaaauauaaaaagccaauacagaaaacauacugcuguuauuaaaaaucuagaaccaauuaccugaaggagagccgugaguggagcucaugcucuugaccuuggagucggagagccgagagauacuguuagcucgaguucuaggagaaaguuuaucugauggcacuagccuggcuccgcuccuaaugacagcuucugcggugcgugcagaugcgcugcuucuugaaauuguugcuucagagucacuacgggcagauaaugagccaagucuuguucuucgaggcugagccaauaaaucaauccuagagaugguucgccuuccugugggugguuuugauguggaacuuguaguggacacuucagaagcaacagaugcuuugucagcaucagcaaguucacugucagaagcuucaccaagccgggcucuucgcaggagggaaguccgggugggccguggccuugggagaguaguggauuugcuuguugaaccagaggcaacaggagaagucuuagacuuuguugcuuugccucccuccaguuuggaauguauguuguguucaucggcugagguaaguggaguccguccaugagauuugcaggaguauguuuccuggucagaugacauaaugucagaaauagcagaaugaggcacacuagaggucuggucaucgucuguuaagucuauggaaggcugccggauucuuccacuggacugcacaaauuugcgaccaucugcucuugcaccuauaucugcagagcggcuuuuugcuuucuuuucaauuuucucccuacugccugacuuaguaacaucuuuggauggggaacucguggaacaccugucuuuauagagacuagugaaacucuuccgcuuuugcguggacuuucuuucugucucuccaguaaccagacuaauuguacuggcugugucuacaucagacucuggggaaauugaauugucucuauuguaacugggaguaucugggccuucaucaguuuuauuauuaucuucucgcaguuuagcuucuagaaaagccaucacugcuucugugucuuuuagaaucaagguuguguccaugcuagaaucaguauccaaagagucacuccuuucucggagucuacuugcagacgucagugcuaaggcaguggguacagaugaauucugcuuauugauaugggggauaaguucuauggggauguuggaacugggcuugucuauggugaaacucccuuggcgcacuaacgauuuggaagacucuuucuugucuccuuuugaggccuggcauuuuggaauuuccucagcuuuucuucucuugcuuucauuuuguauuacucugucuccuuugcucguagaauguccugaaacuuuuucuaagaguugggacucuugcuuagaagauuccucccuacauuuaucuauauggccuaaagcauuuuuugaaggaaacuuaguaggaguccacugggccugcuccuuuugcucuugcugcugcauuuuagccaauguuuguuuuaccaaagaaguuuccuuuuccgucucacucuucuccuugcuagaugagcuuccugagugaaggagggcuuuaccaucuccaccaguuuuaggacucucaccauugacugcccugcucauuuuacucaggccucggucugcaucgugcuucucgcuuugguauaccugggcuucuuuuuccugcaguuccgugucuugcuuuucuccuaucucugaccucuguggaacgaccuucgcucuggagcucucgaguagcuucucuucauuugggagcuggggaagaguucgccucuuccucucucccugacuagccaaggaaguuguacaacuaguacuucuuagggaaacaccagcgucaccaguaucugucucuaaaauaaaaauaucaaagcagaaauucaugagagcaaaaggacacauauaaaaggaaugucuacuaguuacagcauaaguuuaaaaauauccucaguauaaaaugaaugccuucugugaaaaauuuguacuuccuaaaaaaagaaaagaaaaaagggcaaaauaucuuagcuuuuagcaaggcauuaaaaaaaaauuccauguaauauuuuguauaugcuugggccagggaguggcacuauuaggagguguggccuuguuggaguaggugugucacuguggggugggcuuuaacacccuuauccuagcugccuggaagcaaguauucuccuugcagccuucagaugaagauguaaagcucccagcuccuucugcaccaugccugccuggaugcugccauguucccaccuugaugauaaugaacugaaccucugaaccuguaagccagccccaguuaaauguuguccuuguaaguguuguauuggucauggugucucuucacagcaggacaacccuaagacaauccguaucaauagaaaauaugaaaauaguaaaaagugacaggacuugucauaauuuuauaaccaagggacuguuaaaccauaauuuucugguauauuaaguaaggcagcuuauuaaaauaaaugacuucuuucuuuuuuucaauuuaguagaucccaaugcaaaagugaauacuuuugaggugauaagacagagacaaaaaaauuugaucauauuugaaagaauuuaaaaaugaagggaucauaugugagucuuuguuuugcauuuuaauguguaaaauuaacuguaaagcuuuuuaaguguaaacugauaauuuagaauacuauauacuuauguaguacaagguaacauuauuacuaaaaaaugaaauagaaaauaauuaaaucaauauuugacaccuuaauuuauaauauaaauucauacauauaugaaucaugugcaaauuauuaccuuaucuuuaugauuacacuauaaugguaauuacauauuuuucuaacagauuggcauaucaagaaggguuaauuuuuugaaguuuuaaaauuguacuugaacagcaaaaauuuacaauaaaaaagcagagugucugaaaaugaaauacuaaaucuuaguaguuauccuuuugucuuuggaagguucaauuuaugaacuacaccaaaguuuuuaaggaaaaaggacuugggguuagguggcauagcauagcaucuuguauaauauauacacuaguccucaguuuacuucauuuaagcuuaauuuacuucuaacuguauuaaguuuagcuuguuuuguuuuuaaauacacaugguccacuaaaagagggagggaggaagggagggagggagggagggaggggagagaaaagagguaaacauggaggaggagagagaaauuaccguuuucuacaguugcagacaauuccauuaaccuuucuucuggaucaugccuuguaugauuagcagccaaacuagcccauugugaaacccaacguuugcuuccagaugaagauauggcuuccuaaaggagaaaaacagagagagagaaugcaacaacccugccaaugcucauuuucaugagcgagaacuucauucagucacagcaugugacacagaagccaugucucaagcucagcuuguuaugaugcauugauucuucaaucaaggcucucuagcuguuccguucaaccacaauguauucuuauuaugaacggaguauacaaucuccugugcuucuuauacacuaacaugguacuagguacaacaguuauucuguugccagaggaggacagacacaaaucacagcuuugcagcuagcccagugcaauugguuuuauuccauuaaaaggaagagaaucuaaaggguuauuaauuaaaguua

SEQ ID NO: 537 - RNA, 4362 nt, Mus musculus
uaacuuuaauuaauaacccuuuagauucucuuccuuuuaauggaauaaaaccaauugcacugggcuagcugcaaagcugugauuugugucuguccuccucuggcaacagaauaacuguuguaccuaguaccauguuaguguauaagaagcacaggagauuguauacuccguucauaauaagaauacauugugguugaacggaacagcuagagagccuugauugaagaaucaaugcaucauaacaagcugagcuugagacauggcuucugugucacaugcugugacugaaugaaguucucgcucaugaaaaugagcauuggcaggguuguugcauucucucucucuguuuuucuccuuuaggaagccauaucuucaucuggaagcaaacguuggguuucacaaugggcuaguuuggcugcuaaucauacaaggcaugauccagaagaaagguuaauggaauugucugcaacuguagaaaacgguaauuucucucuccuccuccauguuuaccucuuuucucuccccucccucccucccucccucccuuccucccucccucuuuuaguggaccauguguauuuaaaaacaaaacaagcuaaacuuaauacaguuagaaguaaauuaagcuuaaaugaaguaaacugaggacuaguguauauauuauacaagaugcuaugcuaugccaccuaaccccaaguccuuuuuccuuaaaaacuuugguguaguucauaaauugaaccuuccaaagacaaaaggauaacuacuaagauuuaguauuucauuuucagacacucugcuuuuuuauuguaaauuuuugcuguucaaguacaauuuuaaaacuucaaaaaauuaacccuucuugauaugccaaucuguuagaaaaauauguaauuaccauuauaguguaaucauaaagauaagguaauaauuugcacaugauucauauauguaugaauuuauauuauaaauuaaggugucaaauauugauuuaauuauuuucuauuucauuuuuuaguaauaauguuaccuuguacuacauaaguauauaguauucuaaauuaucaguuuacacuuaaaaagcuuuacaguuaauuuuacacauuaaaaugcaaaacaaagacucacauaugaucccuucauuuuuaaauucuuucaaauaugaucaaauuuuuuugucucugucuuaucaccucaaaaguauucacuuuugcauugggaucuacuaaauugaaaaaaagaaagaagucauuuauuuuaauaagcugccuuacuuaauauaccagaaaauuaugguuuaacagucccuugguuauaaaauuaugacaaguccugucacuuuuuacuauuuucauauuuucuauugauacggauugucuuaggguuguccugcugugaagagacaccaugaccaauacaacacuuacaaggacaacauuuaacuggggcuggcuuacagguucagagguucaguucauuaucaucaaggugggaacauggcagcauccaggcaggcauggugcagaaggagcugggagcuuuacaucuucaucugaaggcugcaaggagaauacuugcuuccaggcagcuaggauaaggguguuaaagcccaccccacagugacacaccuacuccaacaaggccacaccuccuaauagugccacucccuggcccaagcauauacaaaauauuacauggaauuuuuuuuuaaugccuugcuaaaagcuaagauauuuugcccuuuuuucuuuucuuuuuuuaggaaguacaaauuuuucacagaaggcauucauuuuauacugaggauauuuuuaaacuuaugcuguaacuaguagacauuccuuuuauauguguccuuuugcucucaugaauuucugcuuugauauuuuuauuuuagagacagauacuggugacgcugguguuucccuaagaaguacuaguuguacaacuuccuuggcuagucagggagagaggaagaggcgaacucuuccccagcucccaaaugaagagaagcuacucgagagcuccagagcgaaggucguuccacagaggucagagauaggagaaaagcaagacacggaacugcaggaaaaagaagcccagguauaccaaagcgagaagcacgaugcagaccgaggccugaguaaaaugagcagggcagucaauggugagaguccuaaaacugguggagaugguaaagcccuccuucacucaggaagcucaucuagcaaggagaagagugagacggaaaaggaaacuucuuugguaaaacaaacauuggcuaaaaugcagcagcaagagcaaaaggagcaggcccaguggacuccuacuaaguuuccuucaaaaaaugcuuuaggccauauagauaaauguagggaggaaucuucuaagcaagagucccaacucuuagaaaaaguuucaggacauucuacgagcaaaggagacagaguaauacaaaaugaaagcaagagaagaaaagcugaggaaauuccaaaaugccaggccucaaaaggagacaagaaagagucuuccaaaucguuagugcgccaagggaguuucaccauagacaagcccaguuccaacauccccauagaacuuaucccccauaucaauaagcagaauucaucuguacccacugccuuagcacugacgucugcaaguagacuccgagaaaggagugacucuuuggauacugauucuagcauggacacaaccuugauucuaaaagacacagaagcagugauggcuuuucuagaagcuaaacugcgagaagauaauaauaaaacugaugaaggcccagauacucccaguuacaauagagacaauucaauuuccccagagucugauguagacacagccaguacaauuagucugguuacuggagagacagaaagaaaguccacgcaaaagcggaagaguuucacuagucucuauaaagacagguguuccacgaguuccccauccaaagauguuacuaagucaggcaguagggagaaaauugaaaagaaagcaaaaagccgcucugcagauauaggugcaagagcagauggucgcaaauuugugcaguccaguggaagaauccggcagccuuccauagacuuaacagacgaugaccagaccucuagugugccucauucugcuauuucugacauuaugucaucugaccaggaaacauacuccugcaaaucucauggacggacuccacuuaccucagccgaugaacacaacauacauuccaaacuggagggaggcaaagcaacaaagucuaagacuucuccuguugccucugguucaacaagcaaauccacuacucucccaaggccacggcccacccggacuucccuccugcgaagagcccggcuuggugaagcuucugacagugaacuugcugaugcugacaaagcaucuguugcuucugaaguguccacuacaaguuccacaucaaaaccacccacaggaaggcgaaccaucucuaggauugauuuauuggcucagccucgaagaacaagacuuggcucauuaucugcccguagugacucugaagcaacaauuucaagaagcagcgcaucugcacgcaccgcagaagcugucauuaggagcggagccaggcuagugccaucagauaaacuuucuccuagaacucgagcuaacaguaucucucggcucuccgacuccaaggucaagagcaugagcuccacucacggcucuccuucagguaauugguucuagauuuuuaauaacagcaguauguuuucuguauuggcuuuuuauauuuaagaauuauauuucuagcugucuuagaaaaauaauucaagaauaagguuaaaauuagugaguuacuaucuccuccauuaaaauguaaaauuccaaauaaagucuuagacaaaguagugauuucaaaauaagauauuaacuaaacacauuuaggagguuuuuuuuuaauuugauagaauuauauuaggaauuacuauuuuaaaaauaauguuaugcuccuaaaaccagguguuucagauuucuuaugaaccugaagagaaauaauauaccuuuuuccauccuuuuggaaauaaauaucugauuaaaaacuguuucauauacuuacacauuuauaguuggagcuguugaaaauuaacuucauuuauuucaguggaagaucguggauucauggggcaaucacuaaacaugugugggucaaauuaaacuggaaaguuaauugugaacauuaucuuguacucuuagcguuuaacuggagugauuaucugucacuacaaucacuacucauuaucucuaagcgcugaagugcuauugacuuacuugucugcacuucguauuuaagcugaagccauggagacuguguggcuacagcug

SEQ ID NO: 538 - RNA, 1515 nt, Mus musculus
accucuguuaauuguaacuuuaauuuuucaaauucuuaaaugaguuaacccucuuuuagcccaccacccaacagaaggugggaaagaaaggauaugggggaaguggaccuguuuagaaaacuucuuuggagcaacuccugucuguguugucuggaaaucugcaguucaguuuacagguuagcagauggcggcaacaaacuuuucacagauacacagcagugcaguucaguagaguugggauagcaaacacgaaucaacaguggagacaugaccuagcagagauaaccuggccauagcuucagcuugagucagcaggaaggacccagaggaaugcccugagaaguuccugguugugccucuccucucagcagugaucagcaaugcugcgagacugacaaacuguugcacagcuagcucucuaaacaagccaagcucagccucugccacuguccgucaaguucuauuuagucccuccauagaucacguguccuccacaugccuugccucagcacaaucgccugucucagcuggcaucacucugccaaucagcccgaguccuuggaagcaucaagaagcugcagcacaccaccagaaguuuuuuggugcauuucucucuauggcguccuggcaaaauacagcucaacuacacaauguaaagcugaccaguacaugcauguuguuaucgaagaauccuucaucagguauccuuucuugcuuuagcagaacauccucucuccugugucagcuucaacaaaacguuucuucaggagucugccuuagccuuucacaccuguguccacuuuaacgcaacggcaacauuccuucacguguuugccccagcaaaacaccaucccaccgacuuuccaaagaacccucaaguuuccacuucccuuaacagugaugcaggaugguggcagcggcggcagccuaagcagcagcagucccaggcgcacacgccagcucgccugcucucgcugcucuugcccucuccagcucucuccaucccgucuaccgaaaggugcugggcggauccggggcgguggaggccgagcggcugcaguggcgguaccggcggaggcagugguagcggcggcgggaggcaggaugagcgcacgcggugagggcgccgggcagccuuccacaucagcccaggggcaaccugccgcccaggugccacagaagcgaggacgcggccgacccaggaagcagcagcaagagccaaccuccuaagcuccugugagcccucuccuaagagacccagaggaagacccaaaggcagcaaaaacaagagucccucuaaagcagcccagaagaaagcagagaccauuggagaaaaaacggccaagaggcagaccuaggaaauggccacaacaagucguucagaagaagccugcucaggagacugaagagacauccucccaagaguccgcagaggaggauuagggggcgccgacauucaauuucuaccucagcaucaguuggaucuuuugaagggagaagacacugcagugacca

SEQ ID NO: 539 - RNA, 1515 nt, Mus musculus
uggucacugcagugucuucucccuucaaaagauccaacugaugcugagguagaaauugaaugucggcgcccccuaauccuccucugcggacucuugggaggaugucucuucagucuccugagcaggcuucuucugaacgacuuguuguggccauuuccuaggucugccucuuggccguuuuuucuccaauggucucugcuuucuucugggcugcuuuagagggacucuuguuuuugcugccuuugggucuuccucugggucucuuaggagagggcucacaggagcuuaggagguuggcucuugcugcugcuuccugggucggccgcguccucgcuucuguggcaccugggcggcagguugccccugggcugauguggaaggcugcccggcgcccucaccgcgugcgcucauccugccucccgccgccgcuaccacugccuccgccgguaccgccacugcagccgcucggccuccaccgccccggauccgcccagcaccuuucgguagacgggauggagagagcuggagagggcaagagcagcgagagcaggcgagcuggcgugugcgccugggacugcugcugcuuaggcugccgccgcugccaccauccugcaucacuguuaagggaaguggaaacuugaggguucuuuggaaagucggugggaugguguuuugcuggggcaaacacgugaaggaauguugccguugcguuaaaguggacacaggugugaaaggcuaaggcagacuccugaagaaacguuuuguugaagcugacacaggagagaggauguucugcuaaagcaagaaaggauaccugaugaaggauucuucgauaacaacaugcauguacuggucagcuuuacauuguguaguugagcuguauuuugccaggacgccauagagagaaaugcaccaaaaaacuucugguggugugcugcagcuucuugaugcuuccaaggacucgggcugauuggcagagugaugccagcugagacaggcgauugugcugaggcaaggcauguggaggacacgugaucuauggagggacuaaauagaacuugacggacaguggcagaggcugagcuuggcuuguuuagagagcuagcugugcaacaguuugucagucucgcagcauugcugaucacugcugagaggagaggcacaaccaggaacuucucagggcauuccucuggguccuuccugcugacucaagcugaagcuauggccagguuaucucugcuaggucaugucuccacuguugauucguguuugcuaucccaacucuacugaacugcacugcuguguaucugugaaaaguuuguugccgccaucugcuaaccuguaaacugaacugcagauuuccagacaacacagacaggaguugcuccaaagaaguuuucuaaacagguccacuucccccauauccuuucuuucccaccuucuguuggguggugggcuaaaagaggguuaacucauuuaagaauuugaaaaauuaaaguuacaauuaacagaggu

SEQ ID NO: 540 - RNA, 238130 nt, Mus musculus
cugcuccauccuccgccaccgcccgagcagcugcggggccgccgccgccgccuuugcagguaacagccaccgcccccagcucucgccccccuccccgccucgcccgcacuccccgagggccccgcggcucccucccugccucccccgggcgggggcggcggcggcgcgggugggugaggcgggggcgucugggugucaccgcggccgccgggggcgugggcggggggccgggguuccccuccccguuccuccugaagcuuuggggccguagguguggaggcggaggccgggggaugccccgcgugggugacacggacaucccccuagcuuuugggggugggggagcggcggcggugcgcgggcggccagggagggggguguuccuggccuagcgguaccgugagcugcgcgucuggguugcccggcccggcgccuuuagggcucuuguuuagcucgagccgggucccuucgccccgacucggucggccgcgcggcccggggagggggcggcgggccggggcgaggggcggggggcggcggcgagguuauguaacgcgagcgagcggccgguggcgagucgguguuuggguuggggggaggggccgucugcgcauguggcgggagugcgggcgaggaugcaccggcguccccggggucuccuuccuuagccagcuaccuaccccaccccaccccaccgcaccccgccggcgcccgggagaggacggugcugauggggugcgggugugcgugugcgagguggguaacgugcaagucuguguuuuuaauaguagugggguuuugauccgcuagggaguugugugcuaagaauagaaaugugcggaagaugcuggguuuggcugaucuacugaugcugucgcugcuggcggcggcggcgacggcgggcggcucaggcugcaaguaaacaaaccagcuucuuccuaguccaccuccuccgccuccugcgcaucggucugcaucagccaugaugcuagugaggccccuuggaagcccgaaguugaagcuuaagcugguggcauccauaguccugaugcugagguggggucgucccuuguuugagauuuccugggaaucuacacuuagguuagagauaaccgaaucucuccuuugggccaguuuuugaacaguaguaguguuuacuguuuaucuuuaggaagcagaaaaaaaaugcuuacccauaagucaaagcuuggauucucucaaaugucuucaucagaauaauguuaugaaaauaaaauucauuucucaaguguaauauauuuugguucaaagcauugauggauugaaauugauaaaguuuacagauaaaaauccagcaauaaaaucucuguauagauuaaauuaugguauuaauagaaucaacacacuuuuagcguucugaaaaggauguagaacaaggacuucauauguaauaaaauaacaguugucccaaaucuuuaauuuagacaugucuucuguauuugguaaagcaaaguaauuuuuuguuagaacuauaaauuuccauacagucacugaauuuuauuuaugguaggacucauucauuauauuaaguuauauuugcauuuaggaaaauguuggaaaagccaagaguggaagagucuaguaaagaugguuuagagcuugaagaugaaucugaauauuccagaagauaggaugucuaaaacaugaauucuuuuuuaaaaaguaucuuuauaaauuguuuucuagaaacacaauaccagauacacaguuaaauucaagaugcaguucaagacugaauuuuguuccuuuugucaauauaaaauuuugauucuguuugaagauaacuuuuuaaaagccagagaugaccucaauaucuauaucuugagguucaaauuuuaaaguuagggagaacaugugcuauuuuaauguuuguacauuugcaguagcauagagguuauaccuagucuaaaggaguacuacaaaaaaugaaauuguuauucauagucaucuuguccccucuacugucuucuguaaugaugagugauuaauuuucaacuuaaaauuauuuuuuucuuuaaucuugacauuguuguuuuguauucuauauggaacaauacuugaaaauucuuugggcuuucuauuuuuugcaauuguauuuauuaugguuuuggaguagagggucucccuguguaauuuaggcugcuaugaaacucacucuguagccuagguuggccugcuagggaucccagccuccugaaugcugggaucacaggugugugccaccauuacaggcuuguuugugugauuuuucuuuuucaccuaaaauauuuuaaauaaaguuucauucacaaaauaaauauuaagaggaggagugugcuuuggaggaguaagguuuuuugacuucauucagaggaucacugucauuaaaguuuguacauuuaaagaucacuguacauuuaaagucuguugguuaaacuucugcgacaaauguuagcauggauuucaguguggggguuuaggaguuuuaaacuccagguuuugauuuuaacauggaaguuucuaaaugcuuaggcuucuuucugaagaggaacuuguuucauacauuguuguagaaguuuagcuuucauuuaaacuuugcaucuucuuaggaagugauaacuaguuauaauuuacucuguaaugcccaguaguucaagaauuugucccugggaugaugauucuuguuaauguguuaauuggaucagaaucaugauuuggugagagcuuggcuuuauagugauuauguuuauggcauuaaaaagcaaaccaauuuuagauuuguagaauaaaaugcaagacaaaaauacuuuuauuugguuuauuuuauaauuugacuugcauuuucaaguuacucugaauuaauaauguaaauauucuuuaugguugguuugugcuuaagucuuugaguaauuuaaaaguuguugauaagcuccagauuucagcaugugcaucuguauucuuaaucuuguuucagugcagcauacucucugcaaaaguaggcuaauauuaacagauguguuaugauagucuuuaaaaucugauagaauuagauucaguuuccaguuaauuccuacuaugugccugaccuugcuauauguacuucauauauuguaauucaucuacuucaggacaaucuugcugcaauuuugaaagugaauuucacaugagaaaacacuucauacagcauaaaaaucguuucauuuaaacuugcccauucaauauacauauauguauguauauuucaaauuuauaauuucaaauguauagauauauuucaaacauaguauaguaugauauauaauaugcuauuuuguaguauacauuauauuauauaucuauacucuaaguucuacagaaucaaguuaauauaguuuaaaaagcuauauugauuaaacuaacaucucuuucauuuuaauuguuucaaaugccaaaauaugugaacuguuuacauauuuuauugugguaucccucauccaauaagagguaaauuuauuucuucaauaaggaaaucuucagauaguaguuggugaguaagcuagcauaugcuuuugacuuauaaauaugcuuuuaguucuuagaaacuaucuaaauauacuuaaagauuuauugcuaacuucagguauuuuauauuucuaaauggguauuuuugcuuguauucugaagggaagguaaaaagguauacuagaagaaaauagaaaauguucagaugagacuuugucucuucuauauuaauuauauuugggugucugggggauuuggcagaaaggaagguagaauuuagccaauaauggaguuuagcccagauuuggucugaguugaauggcuacuuguuuuguaguagcuguauauuagaauuugaggauaggagcuauauauaaccaugauugucaucuauacuacuacuucuauaaaugaaguugauuguagauuucaguguaaagaaucuuacauuuuauuggcucugaaagagcuaucaagcaucuaaugcuaccuuuucugaaaucacaguuaaggacauugaggcagaguugggaacaauuaucuaaguuuucuggucugucugaugcucuuuuuaaaggacacuuugagaugaacuuuauuagggauucuaaucccgggacuguguuggagguggugguggggaucuuccaguaauuguuggcauuuaguuuuuauguguguguauuaagaauuuucauuuuguaguuugagagguaccugaggcagauuuuggaauuguguguguauugaaugaaauggccaggugagccaguguucuguaguccccagccucauacagugcugggccacaguucacauagaaauugagggacucugccuucaacagcuuguccguugguuuaugugaagcugaggguaagcauauccccagcccccaggguuuuaaaucagaaaaucaaacauacgacuuugcacaaaguuuuuaauaguggacauguugguugagauuguacauugauaaucuaagagaaggaaaaagggggagaugcuuugugguuuuuuugguagauauaauuuaaaauuauaaaguguuuuuuaggaguuaguuaacuuucgaauuugaaaguucugauaguuugccuaaaaauucuaggcuuuaggaaaaaauauuucccagggcguuaugacuauguucugaagagaggcacugugaauaggguaacaacuccuaguaaggacagauugccucagaaguguuugagauauaagcugucugcaauguuguuuccacgucaguggggucacuuuugcacauacccuuuugaaagcuugauauagccuugugcauuugucauggcauauaaaugagucuuucagaggaguuaaaccaggaucuguguguccuaaccccucccagcucccuccuuuuacuacucuuauuuugagccaugaucuuaccaaguguuucggacuaaccuugaauuuacuauagacaccagaagcacuccugccucagccuccacgcuaguggggauuacagucaugugccacuauccuggcuuagauuuuccuacaacauaguuauugaaaucugaaacuaccauagacccuaaaauaguuccuccuggucaacaauuauguuuuaaaauaucaauuguauuugaauuagcuuccuuuauuaauccaguuuuucuauuauaaagucuauaaaauuguagcauagaacauuacagccaaagaagauguauaguuuaaaguuacuuugaauuuuaauuuagaaauaaacauauaggaagccauguugauaaucccagcacuagggggaauugaaacagguucaaguacauuuuaguauauauagauagcucuaggguagguguggcccacgggucucagguaaacccccugccccccaaguaaucaacauuuaggaaguuacuaacaugagaacuuugcacuuguaggaaaagaggcuuuuccaccucauuuuaauuucacguuauuucguuugugaugguuuuguugauaguuucguuuuauuuauuuuugguuuuuuucaacacauuuugauaauuacauuucagaguucauauauaguaugaagcagaugaagcugauuaauuuaauuacaggugguugcucuuacugaaugucccuauguauggaaacuguggggaauauugucuuuguuuuuggcuacaauuuucuuagguucauaauuaauagaguaauguaagugaaagaucuuggauaacaaacacauaauacacuuggaaaauacuuaagaugcuuuuuuaguucuuguuucagaauagacauaagguauuaacuuacugaguaauccugaaacauguuugauguuuuauuguuuuaaauugcaugauugguugcugaaguaaacaaaaagucuuuugaaaacucuuuaaaauaucaguaagaaaauaaucacuucuuaacuuuuucuucccauaaugaguaacuuuggguagcaaugagguuucuuuuauuuggauuugaaaauggaugaucucaauaaaaagugcuuuaaaaugucaagaaaaaauagaguaguuuugauguaaucaaaucuuugcagaagacuauggaaggccauagggagcaugauuuaaaacgugaauuuuaauuauuuagauauaauacuuucauaauguuuaaauuuaguuuuguuuuaaacauggugucaugccauggcugcuguugaccuaaacuuguuugcuuaguuuauuuauuccuuguuauccaaagcuuuuacaucuuuguucauucaucuacuuauucacuaauucucuauuuguugaauaagugccagacauagucaaguugcuuuaauaauuuauguugugauacaauggaauuaaauauggggaguguuuuguacauuauaaaaugauauucaaaugaaguuauaaucaucaaauucuguaauaguguaucaugagugaaaauucuuuacuauugaaucuacuaugaauuuugugcguaacuuuuuuauaaaaaggaaugauaaaaauuagauuaucuagcauugaaauauuaaaugcaguugacuuaaaaauaaaccauauuuuauguuaacuggagaucauauuucuacagaagcuacuauggaaggagggugaagcuugcuuuaccauuagaaacaggugacaacauggcgcaucuuguaaacuauuguuuauaacuguuggagacuggagaauguaggugacuggaacaggagaaaucaguauguguacuguguaggagccaauagcauugcuuuuacauagaaaagacaacauacugcuaauccaauaauuacauuuuaaaguuuuguuucaagaugguaccguuuucgccauuagacacaggaauaauuuuaaaaguugcauauugugauuauggauagaauuuaggaacuguuuaagguacaguggaauaagacgaccucuaauacuuaguuagggucagugaccuugauaaaguuuguuuuaacuuaguguacauuuuaaaaauauaauccuaauauaagcauugaucucucucucucuuucucucucucucuuucugugugugugucugucucucucucucccuucuucccucccuccuucccagaaucuaguuuucagaaaaagucuauuauaagauucauugauuuggaucgaucugguucaauuucaggaagacuuauauucucuuaguguucuucauaaggauauuccaauauaguuuauuuuaauuggaaguauugauuggcuauaucuauuuauucuaccuuuacuccuaagaaugauacagguucucuuuccuucagcuuauauacuugagagagagggagggagggagaaagagagagagaagggggagagagaacaugagugugaacaguugaucgaucuuacuagagauggagcucauuugugaaaguagaacugacaacaacucagugcagcuaugauggcagcauuugcacuagucuuuucuaguauuuaacuuacaauuccuuaugcauuauauggaguuagcacuuucuuucaaacuuuuuuccuagcgauuuuuuuucuagcucuauaauauguagucaguuggguuuuucacgauaugaugucaaucaaaauaaaauauuuugaugcuauacucuagagcuuuuauuuuuuuuccuguuuguauuguuuuuaaugugaacuggguauuacuuuaaauaauaugacugcuuccucugucaguacucagugugggaauuauugguaaauuaucucuuauuuuagaauauuuaauguuaguagagauauuucauggggacaaaauuguaaacauuucccaaacaacuuuaacaaaggacuuacuuuaucuaguuucuuuuaguucaacacucuaucgaacaaucauaauuuugggaaagagacccagauuacaguauccuucuuuauucugcagcaacacauccccauaauuaugauuuugaguaguccugucccugucuuuauguauugugcaugacauaugugcagagcccaugagaggguggucuucuguggagccuuugucagguuguauagaggaugucuauuuuuggucacugauugaugaacggguagaauuugcacauaauuuguauuggaagaggaauuguaaucuaguuaaguacuaucugggaauucaaccuugaauuuaauucuauacauauuuaugaagguccgacuucauagaauaguacaauuagucuauguaccuauuuuuuuuuucuguuuacuuaaaguuuauguugugugucacuuaagacugguuaucuggcccauauuuuugcaaauguggaagcacuuucacaaaguucuguggcaacauuuccccucuuagauugguagggacaauaauagugcaguucauuaagcuuauugcucuauguaaggaugccuugaagaaaccuuuuacuaaguuaucauguaaagaccuaggggauaaacuucugguuaauaucuuaggaaacacuguuuucuucucagcagcucucgucuuuuuuguauuacagacauuaauacugaaaccuaucaugguuuugaauuagcaguuuuccuaaaacauuucauuccaaauuuuugacuuucacaaguagaguuuugaaaugaagagugccaauuuaggagugagguacuccaaauucagauuuuggcucuacagcuuacuaccuugaaaucuagcaauuaguuauucucuuugagccccaggcucacaguucugugaaaugaaggccgaguguccuaacagaguuguaaagauuaucagagaaugacagaugaacaauuuuggcaugucuuuucuacuuuuauauuuccuuuguucuacuuuuuguaucuacccaaggaaauaauguuguauacuuaauguaauuuaccuaaaauauuuuuagaacaaggcagauuauaugaauguuaguuucuugcaacauuguauuuuacauaaaauaaagcaauuaaaacuauaaugauuuuugaaauuaaagggaugugggccacucaacuuucauucuuucuccccuucaucccaaauacacaguacaaaaugugcuuucuguauauuuguagaucugacaguuauuuuguuaggacauuuaauuucagucucuuaaguuaaauauuucacuaucauuuaacaucugccacaagaccagagcaguguauucauagaaccauuuauuaauccccccauguuugagaagcuagacuuuaugugcggucaggccaauugaagacauuuacaaagacuuaguuguuuguuauugcuaugugaguucaagaauggaaaaaaaaaaaagaaauucuuucuucaauacuuccuuccaggcugagucaucacuagagagugggaagggcggcagcagcagcagcagcagcagcagcagcagcagcagcagcagcagcagcagcagcagcgaauccaaacccuaaaacugaccugcaaagcaccauuucuccaaguuggggggcucagaggggagccaucaugagcgauguuaccauugugaaagaagguuggguucagaagagggguaaguuaagugcugagcugugagugggugcugagaguuggucuuuccucuggcgcuguugaaucaagugggaagugcugucugauagggcugaaagaaacuuuaccauguauguuaggagucugcuuauuuagggauuuccuucuaauucuuuuuuuuuuguaguuuauaauuaugacguuagauuuuugcaugcaugcauguuaguaauguauuuuucuauaaugucuucagauucaacagacuuuacagaauuuaacauagaaaugaacucuugugucuauaaaugauauauugauauuuagauaaaaauauggcucuguguaaauuuguaugguagcauaaagaauuaauauaguaaggcgagggcuuacauuuaaacuguuagacuaaacagacccauaaauuagguaaauuaaagcucuuauauaaaaauucaaauguggacagugauuuuuuuuguuuaauuuuauauuuuuuguuuacaugaucuacuuuuacuguauauuuccuguccacucuuuuuugauaaaggcauuauuuuuauuauuaaauaacugcuauaaaauuuaguuuauaaugugagugaucaccuccuuacuuaaucuauauguuuauuagagaucuggacuuuaggcuaguugcucagcaauuauaccugucuacguacauggccagauucaguagacugaggaauccuuuuggcccuauuugagaguugaaaguuaccucuaaccacugacuuucauuucuuugaaaaucuuugguuaaugcuuaggcuaaagagcuguugucaguuuuuaaauggaauuuuaaaauaggccuuaucaaguuauaauuuacauacaauaaauauuccaaaaaacccuuuuaauggguugugccuuuuuaugguguacauuuguggugauguaacaaacacuacaggccuaaaauagaacauuucuaucacucuaaaaaguucuuuccauguugcuuuuaguucacugcuucucuuucaacuuuggcaaucaccugauguguugucucuuacuauaauuaugauuuucaaagauuucaguucaguggacucauaaaacccauggucuuuugugucuaguuucuuuccuacucacacuucacugcuuuauccaugucguuuaugugaaaagaagaacuacuucaggaaauacuauucuucauuuauuuguuuauuuuuaacuaauuuucuuuuugaaacagaaucucacuuuauacccaaguugcaguuagacuuacuauguagcucagguaguuauucaacuugaugauucuccugucuaggucucuugagaacugggguuauaggcauguuuuaccacuccuggcuuugucuuuuuaauacuugguagaaauuugguuugucucuggauauugugaauaaaguuuuuaugaacauugaguacaugauguuuccauuuguauugguaauaaccuaggauaagauugcagguuauaugguaagugccuguuuaaauuuauaaaacugccaauuuauuuuccaaagugacugaccauuugugucauuauauuuguccuuugcuuuauucucucauguauuuggaaaguauuuucagauuuuaguguuguguuuuuuguuuucuuucuuaacuaguuuauauucuuucaccuuuuuagaggggagcaaaggagaggaaauggcaagucacuuaaaccucuaaaaauuuccuuuauuauuuccuaaaauuugauccuaagaucauuguaagacucaagugaaauaaugaaucugccuuucuguauacucaugucugucuaaggucuuagggugguucuuaauucuguaaaauuacaucuuuucugaaguaccaugaugaaagcuuaguguuuagcucauaagauauauaauagaaaacaaagaaaaugguacauaagaaauuuuguuguucagagguccucccccaacguguaucugccuuucugcauucauguucgugcuuauugaaaaauaauagccaucugaacauauugugaguaguacucaaauguaugaaaugaaauguaaagacccuucuguacuuuaccucuucagcugguucuucuucuguugaucaguauccuaauugugcauauaauauacaauacuuuauuuucggauagccauuuucucauaaucuaguguuucuguuaugaaaaugaaaaaaauaccuuugaaggccggcuuauccugcucaccccgcucacccugcucuccccgcucaccaauucacccuccuuuuuugggugggguuggguuuccggcuaagacuuugauguuagaucaucacuuuugagaacuuuuauuucuaaauuugcuucuuguaaacuauguugaauucccaacauucccuucauggauugugccaucauuaaugcuuauuacauauugucaaggcuuauaguaguuaaacuuguugaaucugaaaagcaaugaauaacauuauaauucuuuaauguuagugauaugauaguacccuaaauauaaaagagauuuuucacaccucaguucucaauagcauguauucuauaguuuauauaaugacuauuuuuuuuuugaacuucuuuucuuaucuuuuugauuuucuuuccuauuuugacuuuucagacgaggucugacuacauauucuaggcagaccuucaacuugaguuucuccuaccucagucucccaaguuuggaauugucgauauuggccacaguauggcuuuccccugaacauucugauggccauguuuuccccaugcugauugaaggacauaugccuuauugauuguuuagcuuuuuuuuuuuuuugguuuuucaagacuggguuucucuguauagcccuggcuguccuggaauucacucuguagaccaggcuggccagaaauccgccugccucugccucccaagugcugggauuaaaggcgugcgccaccacgcccggcaauuguuuagcuuuuuauuuacaauguuugaaguacuagugcaugguuuucuggauaugauacuuacaaauacuauggaauguaauucucugucaaguuccacacguucuugaaucucaugucauuacucuuuuguuuuggacucauuuuacacuuuccugagcguuuccugagcugauccuuguuuccaggaggaauguguacgggugcuugucagugugauauuuaaaacucuccuuuggacuuucaugucugguacauuucuugccuguguauacuucacauuuaaauugcuuucauucagaacuuugaaaguugcuuuguuuugcuuuuagcaaccaguuuuacugaggagaggguugaugcucaugaguuauuucuucauaggaaacccauuuuugugcucuggaaccuguugaugcuucuguaucuuuggaauuaugaaauuaaaggaggaugaguugcagucuaauuuuguucauuguguuuaaaguuuuaggggacaauuugaauaugaagguuuagguuggucuuuucuauuucuauaauuuuuuuauaucuuugguuauuuuuuucucuuguguauuuucuuauuuccuagagccucuaaauuaaucugagauguaaaacaaaaaauucuuuauuuccaugucuuuuuaggaaggaggagagaaacuuuuucuugaacauuuuauuuacuuuuucuuccaguauguuauuucugcuguuuugauauuucuaggaauuguuuguacuuuauaguugcuuuuucuuauaauaguuuagaacacuugauucuauuuugaaguuuuucuucuuuuuaaguacuuugauuaguuaauuauagcucuuucuugguggccguuucuuuaggugucucaugguacuauuuguacaguuaugagaggauuggguuacuggcagugcucucuguuugucacuguuuucucuguauuauugacaaguagguuugcugaguuaggaauugugaugguaaguaacuguacucuugaaagcaacaguugaaacacuagaguaacacauguugacauccuccacuauuaguucuuguagacaaucucaguauuguaugaguaauaauguaaaguuucagucaagcauauuucacaggguaaacuguugcuuggaauuucuuuggcuccaagaauuucucuuccccaaagaauuauuucuuuuuuauccuggucagauaauuacaaccugaucucugguguauuuauuuggaaauaucugucuccuucacagugugguuuaagcaguauuaggucugaguguagaaagaagauauuaaaauuacuuacucuagugaguaaaauauaaaaaguuaggaugaaguuaaaaucauugccaagaguugcucugugguuguucagugguagagcucauccuccaaccacugaaaaagccauaauacaguuccugguuugaaucuuagucuugguucucaacccuguacauuuggaucaguuucugauaauugagcuccuuucuggaugcuaccuuauuuguacuuuuaauguaagucgguuuuugaguaaauacuuucccagacagugaggaaagggagcuaaauacugauguuuauguaggauaaguuaaucuuguuuguuagagauuuaucaauaaugaaauuaucuacauagcaauacuaguguagaauugacaguucuuacuaaguaugggcuaagcuaauaccuauaucuucuucuauggaggaccuaaggaguaccuucuagacuagcuuuguauuaccauaggaagcaccuguauuuguagcaaaugcuuauugaauugcucaaaaaauaguguauugaugauauauucugggugacuccaaacuuuuuaagcuagaugcagagcuuugcuuccaguuuucugaguuuauuauaucuauugguaauguaggaauauaguacauuaguaaauugggaaauucaacaaguuuacaagauuuauauaauaaaaugaaauaaacugcaauaauaauaauaaagaacuucuuguaacuucuaaaauuuacuuguuuaauaauacuacuuuuuaaauacccaaauauuuuagccuacuuuuuuuuuucuuuuugguuuuuugagacaggguuucucuguauagccuuggcuguccuggaacucacuuuguagaccagagccuacuuuuuaaaaauuagauauuuucuuuauuuauauuucaaaugcuauccugaaaguucccuauacccuaucccccacccugcuccucuaccccacucacucccacuucuuggcccugacauuccccuguacuggggcauauaaaguuugcaagaccaaaggaccucucuucccagugauggccgacuaggccaucuucugcuauauauguagcuagagacaagagcucuggggguacugauuaauucauauuguuauuccaccuauaggguugcagaccccuucagcuccuuggguacuuucucuagcuccuccaucgggggcccuauguuccauccaauagaugacugugagcauccacuucuguauuugccaggcauuggcauagccucacgagagacagcuauaucaggguccuuucagcaaaaucuugcugauauauacaauagugucuggguggcugauuaugggauagaucccuggugggguagucucuggaugguccauccuuuugucuuagcuccaaacuuugucucuguaacuccuuccauggguguuuuguucccuauucuaagaaggaaugaaguauccauacuuuggucuuccuucuucuugauuuucuucuguuuugcaaauuguaucuuggguauucuaaguuucugggcuaauauccacuuaucagagagugcauaucaagugacuucuuuugugauuggguuaccucacucaggaugauauccuccagauacauccauuuacccaagaauuucauaaauucauugauuuuaauagcugaguaguacuccauuguguaaauguaccacauuuucuguaugcauuccucuguugagggacaucuggguucuuuccagcuucuggcuauuaauaaauaaggcugcuaugaacauaguggagcauguguccuuauuaccaguuggaacauuuuucuggguauauggccaggagagguauugcuggaucuuccgguaguauuauguccaauuuucugagcaaccaccagacugauuucuagagugguuguacaagcuuuuagccuacuuuuuaaugcugugaugaaauaccugaaagcuacuuuguaaaaagaagagguuuauuuaguuuaguuaguauuuuggaggcuuaagcguuugucaccuuuauguacucagcauucuuguaaguucccugucagguggcuggugauaacucugugggaauacaagccaucacauuugaggacaggagacagggagaggagaagaauggcaguaguugcucuuuuauaaguuuucucuuaugugaacuaaagugaucuuagaagaacuacucaugaggagcauggcaccgugacccuaaggacuuugagugucacucccaaaguuuuuaccauaucugcaagcugccuccaaaucuaacaucacaaaaagaugcuuguccuuaucacacuccaacuguagcacuaaguaguaauuuauuaauguggagagucaguucuuugauaaggauuaggaucuaaugucucaguagucaauucauaauaugacuugguaagucaauacgauuuaagagauaacuuacuguaaacauuuucauugauaaaaugauaccuguguaaauuuguuacaccuguauuguuuuuguaucuaacagauugaaccuuccuauuguuucucuguauuguaaccaguugugccuucaaaugaccauuuuucuuauuuauauuguauuuauaauaucaucauguuugucaauagaauacuugucuugcauuauaugaaaugguugaguuaaaguagauuugguaauguaacaguugugucuauaaauuguuucauaggagcuaaauccuguuaugcaaaauacacuguagcaacguaaggauugaaagcaggcuauauuguuauuugugcuauuguugaucuagaaaauuauauaauuuguuguggaaagcaaaacuuucuuuuuaggugcaaaagauugagagucuuucauuuuucuuuacuuuguauuuguguuucuuuguuuauguuuuacuuaugaaaucacuuuauagaaauaagcuauaaaguggauaagaagaaugaaagcaacaaugugauguccugauuacucccuagcacaguguuucuccauagagaguagauagcugugauggugacuguguaagccauguguucaauuagagaaguaugcugcaacuauugaaacagugaaaaguuuuguuuuuuuuuuccuuauuuuuugagacaguucucauguaaccaggacuggucuugaauuugcucuauggugaggcuagcuuugaacuucaauccuacugccucuacuuccugggauuacacauguguaccacaaccaauuuuagauuuauuuccuaauggcugugaaaauuagagauuuaauuaauauauuuguaauacggaauuuaguuuuuuauuuuuuauuuuuuuacaguuuucauacacuuauuuuaaaauuguaagcaagagaaccuaauagaauaccaucaagugauaagcuuucauaguuaaguuucauggaguuaagggauugugaaguugcugugacgcaggcauauacuuagguguuuccaauuaagagugaaguuguguguacugacuugcagcuucauucaguuuacuuaggaauguuaguuuguuuuuguauguacaagacaaauacuuuaccaggaaauacuuuaccaggaaaauaucucucucuucaaguuaucuuuaaagaaccaggauucuuuuuuucauuucuacaaaucaggcauagccaucuuguggcucaaggggugcuuguggccaagaauaguuguaaacacugcccaacauuuucuguuauuuaacuuguguaguuugugugugaacuuuguaaaugacaaaauuaugcugaaauaucuagagguugaacauuccugcaugccuuuuaauucucuuuuauggucauguuuuacugggaagggucucuaauacaguguuuaauaagagaauguguauuuuaacacaaguuuucaguuagcugucacauuuccacuucuaccauucaucagacugcaguccuucuuucugaugugcugaguuuuauguaaugguuuuucaguuuuucugaaauauuuuacuguuucuauugaaaugaccauucuuuucuuuuaauauauugaugugugaauugucauucuggaauaaauccucuuuaaucaacaugcacuuuaaaauguuccauuucuuuuaauuuuauuuuuuucccaaucuacuauauuuucuuuauuaauuuuccaauugagagacaucuagguuuucuucuaauuucugccuguuaugaauaaagcuacagugaauacaguuaaguaaauaucuuugcaguaggauggaauauccuuuguguauaugcacaggagggguacaacugggucuagagguagaucaaugccacuguauugauuuccaaagugauuguauaaguuuguaaucccaucaacaauagagaagggugucucuuauuucacauuuucaucagcauuauuuauuuauuuauuuauuuauuuuuaauuagguguuuuccucauuuacauuuccaaugcuaucccaaaagucccccauaccuucccucccacuccccuauccacccacucccaccuuuuggcccuggcguuccccuguacuggggcauauaaaauuugcaaguccaaugggccucucuuuccagugauggccgacuaggccaucuuuugauacauaugcagcuagagucaagagcuccgggguacugguuaguucauaauguuguuccaccuauaggguugcagaucccuuuagcuccuuggguacuuucucuagcuccuccauugggggcccugugaucauccaauagcugacuaugagcauccacuucuguguuugcuaggcccaggcauagucucacaagagacagcucuaucuggguccuuucagcaaaaucuugcuaguguaugcaauggugucagcguuuggaagcugauuaugggauggauccccggauauggcagucucuagaugguccauccuuuugucacagcuccaaacuuugucucuguaacuccuuccgugguucuuuuaauuuucuuuaaguagauuuuaaagaauuauuuuauacagaauuaaaaaucuuauauuuaaauggauuaguuugcuguuaauuagucuacuacugcuauacuagaaucugcuaggcauguguuucaaaauauagauauaaaauguaaguuuuguuauuugcucucuaauguaauucuuauaggaauuauuaguaccaaguuugggagguuggaacuguuagacaagaagacuuaaaacccccuaauaguggaaaaggugaaaguuguuuuuuuuuuuuuuucuuguggauuccucuuguuuuuuuuuuuuuuuuuuuuuuuuuuuuuuuuuuuugucagucacugcuuagauccuagugggaaauacagagcuguaccuguugagcucauaucuuuucuugagugacugucuuuacagcuucuauugucuuugcaucagaaaaaaauuuuuaauuacuuguuagcauucugaauuaugucuuaugcuaacuacacauuucugcaacuguauuuuuuuuucucuguauuuuaaccuaugcuaguuucugguuggcacugcuauauuuuucuuuuugucagugaaaaucuccuucaaggcuaaauuuuaguaucauuucaguacuuuuccauagcucacagucuuuucaaaguuagaauguuugcucuuguuuguuagauuccaacaauaccugaucuuugccuucuuauggcuuuguauuuggucauuauaaacaucuaucuauugaaaacuuuccaagauuaggagcuguucacuaguuacuucaacaugcagccuuuuaaucaguauuuaaugaaugacuaaagaaaaaaaaucucuagaaguucacagguagcacagauuucagggcugggaaagggcaagagcagaugaaagguaugcaaacaaucuguguucugcacagcgccagggcagggcuaggauucuugaaccaugcucucuguuaaguggguagcacaauggaaccaacgggagaggaauuaggagaauuuacugaauaaucuuuccuggccaaggagguugagcagaaugguucuagaaauggucaauauuauaaguuaggauagugggacacuagaaugggacuauaguaguguuuauaauuguggaggauugauauaaacacacagguagagagauaggcuagagacauugagauauauauauauauauauuuauuuauaaauauauauauauauguauguauauguguauauaugugugauuauaauuuguauguauguaugucauggauacuauugcgcuacuuauaacacuuacagugcacuucuaaguuucuaauaaguaaaugaucacauuucaaguuugagaguagguuuuucuccuacaauguggguccuggugagugaacuuagguugucaguucuuuauuuauugagccauuuugccagcucugcuucugauauuuuuaauucuaauauuacaagucuaagaagaaucuuuucuaguguuggauuauucauuucauauauuguaagugaaauaucauuacauaaaagagcaugguuuuggccggguggugguggcacacaccuuuaaucccagcacuugggaggcagaggcaggcggauuucugaggccagccuggucuacagagugaguuccaggacagccagggcuauacagagaaacccugucucgggggggugggggggugguggcagggguggagcaugguuuuaaucauuguaaauauguuuauauuagaauauuauaaucuauuauaaaauacauuaauacauuaaugauauuuuuauuuuaaaguuucauauaaaguaauguguuguaucauggcaguuuuauauguauauguuauuauacuucacuuuuaagucauucccuagccugccaccuaccuuuugacaucguuuauaucccuuucuuacuuauuccuuccccccaaauaguacucuauuuuacuuuaaggucauguguucuguuacuuacacuccucucuccucaaucucuuccuccccaaagcuucuucuauauucaauacacuaguccccuguucucugucccccaacugccuagaggggguggggggggggagagcacaguaaagaagcauguguugguaucuuuguguuuaaguuuuuacugcuuauauacaggaguuguguagcuggguuguaggguauaucuaauuauauguuuuauuaguuuuaaaaauuucaagcuuauuuacauauauauguauauacacacauacauauacguugaauauauuccuuugcauacaccacuuguucucuuuucucauauccuugcauuugguucccuuugcuuucugucuacaguguuaacuuguacauucaugucauauuuauuaauacacaaacacaauuuuauguaccuuguuuguuugguuuaaggaacuuccacaauagacuuucauagugguugugcaagcuggcagucucaucaguucuuuucccauguuguaacuauuuguuuucaguuuugaaaaauugacucauuuuacauauauuaguauauggucaccaugcaugugcagugccuguggaggccugaggagggcguuuagauuccccuuucuccaaauauuauuaaugauuguguuccucuuuuucuguagcuacaguagcuuuuucuguagcuucaguuaacagaaagcacguuuuuuuauucuuuaaaucaaugaccagggauucuaauguucucauucaaaaugucugguuugaauuccagaaaccaauccauccaccugcgccuuccucuuuccaucccucuccauccagcacucauuauguugcucaggcacuccuuuugccuaagccuucuaguaccugaccacuuaauuuauuuauuaauuagugaauguucauugaguucuauccuaucauauucuuauuacuguguguguaguuacuguuggaaugugucccaggugccuacucucuaaugggaagauagagauaauaaacaaguaauuaacaggaacauuucauguagugauaaguguuaugaaggaaguaagccaugauauguguuagaaaguuguggguaaagaagauaacugcaggggugaucuuugaugaaagagucuuugaauaggcaaguuuauauacauaaacauauauaauuugccuuuuuaaagugguuuaguucacugccauuuguuaguucuauuguagugcaaccauucccuaugacuuuauauaauuuaguugugggguuuuuuguuuuuuugcuuuugucuuagaaaacugaaaguuuguauucauuaauuaucagacucuuauucuucucccaguauacagcaaccacuguuuuuucuguaucuauguguagauagaaucugauggaagguuguggugcuguaauacuuugagggauuuucacucugguaaugagcccuacaaucuggauccugaucuuagaggugcauucuagcaggucugaauaacaguuagacauacaauaauaguaaacauuuaucuccuuuucuuucucccaucccuaucaaaauggaagaaaaagaaugagauaagaagagauuaccacagaagacagaaauaaauuucuaucuuuaaaaaaucaugcuaguggacaggcaaugauggacuccagugaguaaacauuauagucuguaaggcacagugcuagccauauaaaguacaguacuauguuuuucucaaguuuccaagaaccucagcauuugaagacuccagauacuaaggaagggaggagucagaaacuaacagguguaggccucuaguucuacucacuuuugagauggauagaugguuugaacucaauccauagauuuaggagaucaagguuuauucuuugcauagucauagagaacgugccuagguuaaaaaacaagguaguagauagcugauuagguuaaaacagggaaaccaaggugaaauauacaucugaacugaggaacuuugggcugucauuuucuacuuuuuucccagaacuucaucuacaccuguccugcccaccuucuguguacaacugaagauaaccagcaucuucauaugcugguagcuuaccacuggagcucccaguugccaagcccuuucuuuauauuaauauuucaaccauuucuuuucagugucuuacgauuaaauauaagcccaacaauccaaggccauuggacaugggggaaaucacaaacauaaaaacgaaaguuuaaaucaaccaaaccagagcugggagagagacucacugacaguuaagugcagcaggaacaaauagacaucguaagagagagggucaaaacacaaagcccccaaacaauaaaguggguuggcauagauaguucugccgauaaagcauuuaugcuaggcugauuugaguucacuugcuggagcucacaagaggacuguuggagagcaucaacuuuacaguugucuucugacccccauauauuacuccauaccugauugcacacaccauaugcacaauaauaauaaagaacuaaauuuaaaagaaagcuggaaaaaaaaccuuccaggauuguccaaaaagacacuuaaaugauauuaagagaacauaaauaaaugugugaacaucagcagaauuagagaacucaagaauguugcucacagaguggguaguugagcaacuaaacuuugauuuugcuuuaacuuaugcuguucuguguugucccccucccucucucucuuuggcuguccuccccaccccccagcccccgcaccuccccgccucacacacuuggucuugcuuggacuuggcugaacugguaauuaacaugaaauucaggcaaaccucaaacuccugccaauucugugucagccuucugagcgcuguaauucuacgucucaccauauccaccuucuggguaguuuuagagaaguugaaaccaucaguggacugucuacuaauggagaaaucagaacgcuugaaauguaggucucauuuucuucugguuauacauuauauacauuauacauuauacccuucauguugcuuauaugccaacauuuauuaggagaggauauauagugaauguuucuuuuuggaugguauugauagugaaauggaaaagaauacuugaaaagaaauuaccaucaguauuaaauuuauuaauguguucuaacuguuauuugucacauacuugucuaaaacuugauucuuccuuuuugacuuaauuuuagcuagauucuuagaccaaacuuugaaagaucagcaaugaaguaaagcuuuuugaauucuuagaaagaccuaauaacuuuguauuuuuuccuguagggggaaagaucuuucauuugugguuauuagauucauugauucaguuaccacuuuuguguugucacuuugguuaaauacuuuacauuuacugggucuuaguagaauauauguaauuagagaguaguagcugugaugauuaagugaaauuaaaguaguuuaaucacuccagcuagcuacuggaccugaaagaauauauacauuuuaaguuuuuguuuucauuuuuccuuuuuuguaguauguguuaguagggaauauacuguuuuccuagaucuuaaggcauguuguauaugacuugaugauauauauguauguauguauuaauauuuuuggaguggcaguuuugugcuuugaaauacuuucuuuuuuauuauucaugauacaacuguuauuuccuuauuuaucucuugucuuuuuaauuuuuuuuucaauuuuuuauuagauauuuucuucauuuacauuucaaauguucuccccuuuccugguuuccucucugaaaacccccuauccccucccaccucucccugcuuacccacccauccacccacuccugcuuccuggcccuggcauuccccuggcauagaaccuucacaggaccaagggccucuccucccauugaugaccgcaucccacugccccacacuaggccauccucugcugcauaugcagcuggagucaugagucccaccaugcuuucuuugauugguaguuuagucccagggaguucuggggaguacugguugguucauauuguuguuccuccuauugggcugcaaaccccuucaagcucuuugaguucuuucucuagcuccuucauuggggacccugugcucagcccaauggauggcugagaguauccacuucuguauuugucuggcacugguagugccucacaggagacagcuauaucaggguccugucagcaagcucuuguuggcauccacaauagugucuggguuuggugguuguuuaugggauggaucuccaggugggguagucucuggauggucauuccuucagucugugcuccauaguuugucuuuguaacuccuuccaugaguauuuuguucccccuuuuaagaggaucaaaguauccauacuuuggucuuccuuuuuacuuucuuaauuaucuaaccucuuauacuaugaacuagauguccauuuguuuacuauucuuguaguuuuuguagucacuccugauuugcuuuuacuuuuaaaaguuuuauucuaagauaauuucaaaacauuuguucugguguuuuuuguuuuuuguuugauuugaauccugaauuauaugacugugaugcauuuuauuuauuuauuuauuuauuuauugguuuuuuugagacaggguuucucuguauagcccuggcuguccugaaacucagaaauucgccugccucugccuccugagugcugggauuaaaggcuugcgccaccacgcccggcugauaugcuuauuuuuaaaaggauagcuuaauguguuuguaggauugagguuauuugacuguuugacuuuauuguuagaaaauggucugaguugugaaaucuaguucucagugaaaauaaaauaagaggugguggucauuaguuuucuucccacagagauaaaauggauuuccugaugucugcuugcuuuauucaagcuguugcuuuauuuuuagagccauaugaauuuuguccuuuucuguacuaacucuucuuuucucccauaguuuggccuuuuuauuucuggaaugauagaaaggaagguguguguguguguguguguguguguguguguguguguauacaauucugaguaaugugcuaaggauguagcucaggagguaaggugagugguuguucagugugcacaaggaucuagguccaguuuucagcauugccuaagccuagcauuguugcacaugcccauacuucuaguacucaguagguggaaagaagaggaugaaaaguugaaaaguaucuagcuacauacagcacgucagguuggaggcuaaccuugacuacaugagacuuagucugcaaagacccuucucauuuuaucauuaguagguugcaaagcuaguugucauuguucacuuuuguucacuuuuaucuuuuguaucuagcauauaauuaucauucaggacauuuuaauaaauuaacaauuucccacaaguaaaugaauagaaauauaaugacaaauaaaaggucaaacguuuccuuaggauuauaaucauagccuuugcuuuggccaacacugaguuucaaaggaaagacugaccaaggugguuauagaaauggcuuucauuauuguuuguccaagaacagugaccauucccuaguacaggaagugacuuucaaacacuuuuggcaaagcuaagaagcaguacuguccuugacccuuagaucaaauguuauagagccugaauuucuuuaaaucuucuucagucaaaaaaaagaaaaucaacauuuugauuaaguggaaaauuuauuucauguauaaagaaccugacuaaguuugcuaacaaaguaagauuuaauuuuuucuaguuccauuuuaaaaauguuuucuuucaaguauauaacacuguaaaaugagcucaacgguagauuagcagccaaacauguugauucagcccauagcuacugaguuaagucuggaggggcacaguuuauucuuuacccuguuccaugacaguguguauccuucuugucuguguugagggaaggagacugaaauaaguuacucuggacagcacugccugaacuguugagaggagcagggaaaagaauuuucaaccauuuguuuuuaauuuuuuuuuuuagcauaaagccaauguacacaucccauguuuauugugaaauacccauguugaauaauuacucacagcccuauuuugcucaugcuuuuguaaagcaauuuggcuuaaugcuuuguuuggaauagucuacauaaagauaugaguuagguguccuaugauguauuacauuuuuagggccuacuugaguugggaaacagaaugcacucugcuauaaucagcagaguuuuauauacucacauguagaaggcuaugguugggauuucauaaaguuuauauaaacuuguuuuaaugagccagaguaaggugauccuugguauuuaaaguagcuuuuaaaauauaaucgggauauguagcagcuaguauaacauagcccuauaugcuuuugcauauauuuugcugugaauuuaaaaugagaagagggaaauuuuacugaguacaagcuuacugaacuguaagcuguuugguaucauuuccuaaagggcauauuauuaauaaugccucuuuaagaauagauuguuuucugagaaauacuuagagcaaagaaaauaaaaguuuugagguacugaaauuaaaaaaaaaagauuauauaauagaauuuaaaaauauguuuuguuagguuuuacagacuuuauugauuuuuuuuuuucugugaaacuucuagaauggaaucugaugguggaugugggagagacaauggguaguaacauuuuuaguuagaacauaaugguuauauuuaauuauaauuuucauuaugcuaguagugauuauaauuuacugauuaauguucuuauucaaccuguuucucugucugauguuugcuguagaaucccuaugcuuaauuuuuuuauuggcaaaaugaggacucuuggaucucuugauugaauuauuaaauugaaacagauuaguaaauaggagauaggaacauugccucuacuuuagccugacucaaaaucaacuaaauuuuucagaaccauucuguguuggcugcucugucuugguguugcugguuuaucuucucuaggugccugggcuucaaaucaguuacuguuauuuuccucacucaacccugcucagcuuuggucaugaaauaccaaguaagguuucaucagugucccuucuauuuucugagcuagacauuuagcggaaaguuauaugaaggggugauuaguaagcauuaauauuuuucaaauuauuagaucuauauuaaauguuugugauaugugugcuuugaagcuacuaguucugaaccugugggucacaaccccuuaaagggucccauaucugcuaaucugaauaucagauguuugcaucacagucaaggacaguagcagaauuacagcugugaaguagcaacaaaauaguuuuaugguuggggucauuacaauaugaggaacuguuaaaggguugcaacauuaagaagguuaagacccauacagaaaaugugguacauuuacacaguggaguacuacuuagcuauuaaaaagaaugaauuuaugaauuuccuaggcaaauggauagaccuggagggcaucauccugagugagguaacccaaucacaaaggaacucucacaauauguacucacugauaaguggauauuagcccagaaauacccaagauauaagaaauaauuugcuaaacgcaugaaacucaagaagaacgaagaccaaaguguggacacuuugccccuucuuagaauugcgaacaaaacacccauggaaggaguuacagagacacaguuuggagcugagacgaaaggauggaccauccagagacugccauaucuggggaucuaucccauaaucagccuccaaacccugacaccauugcauacauuagcaagauuuugcugaaaggacccagauagagcugucucuugugagacuaugccggggccuagcaaacacagaaguagaugcucauaguuagcuauuggauggaucacagggccccccaguggaggcgcuagagaaaguacccaaggagcuaaaggggucugcaacccuauagguggaacaacauuaugaacuaaccaguaccccccuuuccccucccccccccaccccgauugugucucuaguagcauauauaucagaagauggccuagucagccaucaguggaaggagaggcccauugguugugcaaacuuuaucugccucaguacaggugaacgccagggccaagaaguggaagugggugggugggggagcaggugggggacuuuugggauagcauuggaaauguaaaugaaauaaauaccuaauuaaaaaaaaagaaccagugcucuagguuuuacuuaccuguaugaacuccuaaucccccugccucaacuuucccaguuuugugauuagagccaugagcuaccacauuuggcuaggcuuguccuauuguuuucuaucacuggauggcuuauauuaauuucuacuccauguucuugguagcgcucuuuuguuuaggaaagugauacaaauguccuaaccuggcacuagugagcagcaccaacuacuauucuagcuucagccuuccccauauuuuguuucauagcauggccucugaaugcuuuaguuguacauuaucaugaaauguuuacuuuuguagcuuuuguauaacccucagcaugauuuaaaucaagugcuaauauucuguaaucuuuccagcuuaaagugcuguuguuguuucuuaacauuauuuuaaacuauuuaguguagguauguauaauagguauuaauauaccugacuaaucuagucuaagaguuuauguuuuuugaggcaauagauuauugaaguuaacugcuuugaccuacaaucauuuagauagaguuauaaacacacacacgcauauaacuugaauuuauaucuugcugagcaaaguaaaaagcaaguguaggaaugguauacugguucuccauggucccacuucuucugcaaaugguuccugucagugcaugcuuaguugcaccaagccagaauaggaaaagacauagaagaccaccuagaacagauuuauuagugggccagccuaacagugguacuucuugccguccacauuuugucagcuacaacucaaauggccauauugacuacagugaauacagaguaauaugccuaggaagaggauaugguguauauauggaaauuuccagagggcuuaaaagcuuguaguuuucaaguuggauaaaucuguaucuuaauucuggauguauuucuuaucagagaugugauuaggaaauuuuaaguaacaaugcaaaauauuucacuuauaguaauuucucaguaacuauuggcuguuacuaucaucuucaguaacauaacuuuguucaacagucaucuugauauguauauauacauauuggggguuuuguuugcuuuuugaggcagcauuucauuauguagccugaguuuccauagaauucaaccuguaccuugggcugcucuaaaacucaugauucuccuguauuagccucccaugugcuuagcuuacagaucugagucaccaugaguagcuaguuguaugucaaucuaaaauggcugcauuguguuucuuguuucauaauuacuuuucucuaguuaauauuaugcugggaauaccagaagauuuauuuauaccagaaauuauaacauuuaauuauuagcauuucuuaaauauacuuuagaagaauggaaauuacuuuuggagaaguuuaaagauaaaggagaaagaacuucuaggagguaagaaagaaauguguacuggagauacgacuuagcuuauagagugccuaccaugcacaaaaaccaagcuuuuaucuaacuaauugagcauguaagugcacauuauaauguaggcacucaggagguggagauucauaauuaaaggugauccccuacuguauaaugagauuaaagcuagccuggaguacuugagauacugugccuuaaaacaaccaaccaagucacaucaacaaaaccaaagcgacauauaaacaaucuaaaagucauugucaugaugguguaguguacaccugugaucccagaacuugggagacugaugaaggaagauggagaucuggagaauagcuugaguuaauuuaaggugaagagagggaaaggaagagagcaagagcaagaggaagagaagcuaagaaaauuugaaaacaaauguuucuaacaucacaacggcagguuuuuggagagaagucagaagcagcagaaugagguaauuauuaaagaacuaggaacacacagagaaaaaccugucuuaaguaaaucaaucaaucaaucaaucaaucaaucaaucaaucuaaugaccagcacugaaaggcuucauuuguucaggcacauagaguauauuuuaaaaagaggaguaucuuuuagguuggcccaugccuguaauccuaccacuucacaggcugagucuagacaauuuccaggaguuuggagaccagaaugggguaguuagugaguccucaacagcuuuggcugcaguauaagguacugucucaaaaagugaagaaaaauaaauaugucuugcuacugugaauuaguagucuguuagcuuaugucuuuuuauaggugaguugaguccauuaauauugagaaauauuaaagacaguugacucucgguuccuguuauauuuguuuuuguagguggcuuuaugugauugugguucucuccuuuuggcuuuguugugaaaugcuuaauaucuugucuuuucuuugguuucuugucuuaccuuccuuguguuggagucuuuuuuucuaggaucuucuguagggcuggauugguaaauagauacuguuugaauuugguuuuguccuggaauauuuugguuucuccaucuauguugguugagaguuuugcuggcuauuugugcucucuuagagugugcaugcccucugaccaggcucuucuggcuuucauagucuguugaaaagucugguauaguucugauaggucuaccuuuguauguuacuuggcucuuuuucccuugcagcuaggauggccaaucggucuaaggugcuguguucagguugaggucucccguggaugcauggguucgaaucccgcuccucacauuuucauuuucuagcuaaaaagauaauaugagaugagauaauucuucauagcaauuauucugggauaaaguuaacaauaaucuaauccuacagugcuuuuguucugugucucccacucuuaaacuuaaacauucuauuuguauaugcuuucaaaucaauuuuuauuuuuaaaauugaauauuuuauuuguuuacauuucaaauguuaucaccuuucccaguuuccccucugcacucccucccagcccaucccuccuuacccuguuucuaugaggacgcucacccacccaccuacccacuccugccuagcauuccucuacacuggggggcaucauacuuucacaggaccaagggccuccccucccauuuaugacagauaaggccccuucaguuccaucaguccuuccccuagcucuuccauuggggucccugugcucagucugaugguugucugcgagcauccguauguauauuugucaggaucuggcagagccucucaagagacagcuguaacaggcuccugucagcaagcacuucuuggcauucacaauagcgucuggauuuguugucuacaugugggauggauccccagguggggcagucucugaauggucuuucuuucagucucugcucuacucuuugucccuguauuucuuuagacaggaacaauucuggguuaaaauuuuugagauggauggguggucccaucccucaacuggggggucaugcacaaccucuggauauggucucgacagguucuaccucccucuaugugggggauuuucagcuaaugucauccuuaugguguccugggaggcucuugcuuucuuggcaucugggacuuucugguuguuaucaucacccaguuccccauaccucauugcuauacaccucuguucaauuuccugacccucuguacaucuccuccuucucuucccauaccugauuuugucccucuuuuuccccucccccucuucccuuccucccaaguuccucccacccuguacuucccuugauuauuuuguucccccuucuaaguaggacugaagcaucugcucuucagucuucccuccucuggagcuucauguggucugugaguuguauuguggguauuucacacucuuugccuaauacccacuuagaagugaguacauaccauguauggucuuuugugacugaauuaccacacucaggaugauauuuucucuauccauccauuugucugcagauuuugugaagucauuguuuuaaauagcugaguaguaaauccauuugguucauaacuuguguuauuuucacaguguuucuguuuaguuucuguuuccaugaucuguccauuggugagaguggaguguugaaaucucccaccauuauugugugaggugcaaugugugcuuugagcauuagaaaaguuucuuuucugacugugggugaccuugcguuuggagccuagcuguacagaauugagaguucaucuugguagauuuuuccuuugaugaguacgaaguauccuuccuuaucuuuuuugauaacuucagguugaaagucaguuuuauucgauauuagaauggcuauuccagcuuguuucuugggaccauuuguuuggaaaguuguuuuugauccuuuuacucugagguagugucugucuuugucacugaggugcauuuccuguaugcaacaaaaugcuggguccuguuuacguauccaguuuguuggucuaugucuuuuuguuggggaauugaguccauugauguugagagauauuaagaaauagugauuguugcuuguguggaauuauguuuguguggcuaucuucuuuuggguuuguugaaagaagauuacuuucuugcuuuuucuaggguguaguuucccuccuuguauuggaguuuuccaucuauuacccuuuguaguggagagauauugcauaaauuuggcuuugucauagaauaucuuggcuucuccaucuauggcaauugagaguuuugcuggguauaguagccugggcuggcauuuguguucuauuagggucugugacaucuucccaggaucuucuagcuuucauaguugcuggugagaagucugguguaauucugauaggucugccuuuauauaauacuugaucuuuuuuccuuacugcuuuuaauauucuuaguuuguuuugugcacuugguguuuugacuguuaugugacaggaagaauuucuuuucugguccaaucuauuuggaguucuaucggcuucuuuuauguuuaugggcaucucuuucuuuagguuagagaaguuuucuauaauuuuguugaagauauuuacuggcucuuuaaguuugaauuuuuacucucuucuauaccuauuauccuuagauuugaucuucucagugugucaugcacuuucuggauguuuuugguuaggagcuuuuugcaauuugcauuuucuuuaacuguuguauuauuguuuccuaugguaucuucugcaccucuucugcacaagagauucucucuucaaucucuuguuuucuguuggugaugcuugaaucuauuacuccugaucauuuuccuaggcuucuuucuccaggguuugucucccuuugugauuucuuuauuguuucuauuucuauuuuuauaccuuagaugguuuuguucaauuucuuuaccuguuugguuguguuuuccuguaauucuuuaagggauuuuuguguuucuucuuuaagggcuucuaccuguuuaccuguguucuccuguacuuuuuaagggauuuauuuauguucuucuuaauguccucuaucaucaucaugagaugagauuuuaaaucagagucuugcuuuucugguguguugggguaaccaauguguuggcugaacuggguucuaaugaugccaaguagccuugguuucuguucguuauguucuugccauuaccucuugccaucuggcuaccugugguguuagcugaucuugcugucucugacuguggauugucccuccuguacgccuguaugucagcauucuugggagaucagcucucucuggguggaauuuggguauggagagcuguggcacagggucagcuccagggcacauacagaaaccagaaggauccuauaucucaggcuguucuuugguuucuguguccugauggcucugggcugguccuucuugggccaggaauuugagcagaagugguggucucaccugugcucucaggugugucagcacuccugggaaaccaacucucuucaugugggauuuggguauggagagcuguggcacagggucagcuccaggugcagauggaaacuggaagguuccucugauccacaucuugaggcuggaagacacaaauuucuggccuggaucuuaacauggagaucuugaggcauaguggcuaugaaacacuuucaaaucaaauggugucucuuucucccucucuuaguuucuuuucuuuagcauuuuaguaguaguggucauuuuauaaugagaugcuuuugugcuucucuauuauuugcuauuguauacuuaaacauuagguucaagguuauuaauuguuuguaaacaaaguguaccuuuuuguauuuugcuaauuuaaauagaaaugagacucauugaagguauuggccauucucuuaacaaaaggauacaauagacaauugauguuccggccauacagcuacaggaaguacuuagcuggugcacaguaacugaguauccugcuuuugaagguuacuguuuuuuauuacauuaauuagcucuuaugcucucuagugauaaacuuagagguuaggaaacuuacuacuuaugggaauuccugcucuggagguguugauacccaagauuuguacauuuuggaauuuaaaauugagacuauauaggaagagaucauauaaauuuucaggagauuaaagcauaucuuuguucuugaauaucccuuugugaggagaguuagaagacagccuuagaucaaugaauuccuuaauguguucauauuaaaucacgauucagaucccuugauuaaaauucuccauuagguucucaucuuauauacaagaaaaaaaauucaaacugaucuugauaaucauuaugguucagacuuaccuggucagagguagaaauucuaugaaacuaauaaggcuuuuugugggaaaggacuguuugcaagaugaaaagaauugguuaacucuaguuucacacacccuuuucucugucaucauuuccuccaucauuucaguuuguauuugaauggacauggggaauuuuguaauucuaaggaaagagugaauaaagaaauuuuguuuuauagucacucuuguuuacuguaauuuuugcuaguugguacuguauaagacuacuuucaggagcugcuuccaguuguccacucagcuggaacugucaaaugaggguacaggcucagagcacacauauagguauggacuuaggguggucacccaacaaauaaagaguuggguaauggaggagaaacaugcaguccuucuguacagagagaugggagauggaagcucucucugggaggcaguuuuuguuguuucuuuguuuugugauaguacugacuagaccacugugauuguuacuuugauuuuuuuucuugacccuugaaaaucucuacuauagaauggucacuauuauuaaaugcaaaagacaggauuggagagaugccucagcaguuaagaguacuggccacucuucuagaugaccuagguucuauuccaacuaccuccauaguggcucucaguuauuuguaacucaaguucaaggugauacaggguccucuuuuggcauuugugggucccagcauauacacgguacacaaacauacaggcaggcaaaccagccauauacaauaaaaaaacaugauagaaaacauuuuuuauacagucaguacuuugcaguuuagguaauuguuuugugugugcucuacaugcuucaauguaauaucugcuguuccaaguagaaaacuuuuaggagauuggaugugaucauuuuucacuuuuacuggguuuugaacauugcuuucuaaagugauuccuguuaguuuacuuucauaggcaguuauggaaauuaccaguuuuauuuucaugcauuuaccauuguauucuucaaccucuagcuguuuaauguguaaauuagcauuucucuaguuaauggugggauuucuuaauucuuuuuccuauuuauuaccacauaguuauucuuguaacugcccuuuugucauuuauacuccauucucacauguuguuauuacugaauaauuuguuguuuuaaaacuuauuuauuggaauccugguguucuagauauuaaccauuauauuacuugaaugguaaauaucuuucaguuugugguuuuucuuucauuguuacauauuuauuuucauaaugccaaauuuuuuacuuuaguauugacauuuuuaccugucuuaugguuuugauuauguuaucccuauuaugauaacuuauguugaauuuauaauuuauuauuuauugcuguguagcagauuauuaucaaaaucuauuuuaugaacagaaaaacaucauuuuuuuuucucuuucuuucuuucuuugagcaagaguauggaagcaacaaggcuggggaucccucuucagagccuggucucccuuagguugaaguuaaguugucaggcagguuaccuggaaaaguauuacuggaggauuugccuguaaagguaguucauuccucugcaagagcagugugucucuucacugccgaauuauuucaccaucucucuugcuaccauuuuuaucuaggugugguugauuaagucacuggcuguuaauucauaaucccuccuccccaaaggaugaggaugaggagggguugaaaguaacaaccuuuuuuggcagcaagucugcauuauggagcugucuagguagggaccccagccacugauaaccugauuaacauacaaaagucuuuucacuuggggaauuucagggauccuagagacuuuuguguuaguaauggggacuaauacaaauauaagaaaagguucuccuguucccaagggauuuacaaggguuuucugcuaggaacuuaugaacuagggaugaagauuauauauguauuuaguauuuaauaagaggcuucgagcaagagugugaagaucacuggaggccaccuacuagacccuaguaacuagagauuccuguuuuuuuuauaaucagucuguaguucuuucauauuuaggucuucuuuacuccaccuggauuggaguguauguguuugaugcuaaggugggaguccugucauacucuccuuucaaugguauaaauguuuauugaaaaucugcuaccauuguuuguuuaugcauggauauguuucagagguuucuauuuauguacuucucugcuaugaucuaaauauuugugcuauccuccaguuuguauguugaagccauguaauccugaugugacauaggacuuuauguucaauuuauuauagcuguccugacagacucacuucuuuagcucauuuucuuugcuccuuuuuguauauauaaauuauguauuuguuuguuuaguuagagacaaggucucuggaacucaauauguggaccaggcuggccuugaacucacagagauuggcuugccucugccucucaagugcugggaucaaaggugugugccaccacauaugccaguucuuaguagcaagcugugaucugaucuuccuuuuucauauuugacuugcugcucuuaucgcuaaaagucauccaaagaggaauaguuaaauacuaaauacaucuaucaauuuuuucugcauuuuaguuuucuagguccugugaaaaauacuguugcaaucuugcuuuuaaaagaauauggaucuugguccgggacccgccgaacuuaggaaauuagucugaacaggugagagggugcgccagagaaccugacagcuucuggaacagacagaagcacagaggcgcugaggcagcacccugugugggccggggacagccggccaccuuccggaccggaggacaggugcccacccagcuggggaggcggccuaagccacagcagcagcagucgccaucuugguccgggacccgccgaacuuaggaaauuagucugaacaggugagagggugcgccagagaaccugacagccucuggaacaggcagaagcacagaggggcugaggcagcacccugugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacacugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccaaauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcgccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuacacucacuaaagggcacagggacaaaauccuaauuaacaaaaucagaaaugaaaagggagacauaacaacagauccugaagaaauccaaaacacaaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucauaauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaacagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggacggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauggcauuggaaauguaaaugagcuaaauaccuaauaaaaaaaaaugaaaaaaaaaaaaaagaauauguaaauaucucccuuucacuaagaaaguaaugggugaagauuugugaaauacaguuauauuuuaaagccaucugcauugccaucacccaaaugucacuguuguaagcaucugcaauucuuaaagauuuggaacuauaggaauaauuuuuuuguauguaaauaaggauagauaaauuauauaauuguauuuauauugcuguuaaaugcugggaaaaaaaccucaagaaaccaauacuuaaccuuaggaaaagaagcagguugugaacugagcaguuauuacacagggcucugaugcugaugguacuuuuuauuguagacaguuuuaauauuugaguugugacaaauggacauaugaccuguuuaaucauuuuaugauuuaagccauguuuuggcaccacacaaauuuagacuuuaaauuuuuaacuacuggccuacagcggaauaucucuaacauaguauacaaaaucauuacuuuucuuuauaggaucaucauuucccagacaagcuucauaauuuauauuuuagaaaguuguuguguaguucuucugcauacaacacuauuacauaguuuuauuucauguguaucuucuucauauuuaucucagagaaucaguuugugacuucucaaggaagcuaucuuaagauuuugcaagauuaaguuagguuuuugacuaucuuguguaguuuucuaucaucacucuuaccauacuguauucaaugauuuauuucuuuauugucauugcacauagccaccaaaaaaugccuuagucuaguguuuuggaaaauauuuuuuacauauagaagaggugucauauuauaaauagccuacaguguuuaauagagauagacaugcaggaaaacaguauaauaaaugaggugauauauaauaggcaaggguucuaaguuucaaaggaagucuuugauaugaguaguggugauggacuuggagccuaucuugauggaagcauuuuaacaggucuugcuuaaagcagcaaauacuguaagauguagagaauuuaugacuugugaacaugagagaaaaggaggaacagagacagauugugucaggucuacgugggaaaguuaaauauuaccgucuagggugaguuaggcuuucaaaugcuuuugaacaaagauucaauaugaucagcucagugcaaaaugauaacuuuuaugcuuugcguaguguuuauugggaaagagggagauaagagaugagggaccuguuaagauauuuuguaucaauaccuuauuaucuaaaauacucauuuugucuaggcauguuggcacaggcagaugggucucuguguguuugaggccaugcuggucuauauugugaauuccaggacagcuguguagguauguagagaaacccugucuuaaaaauaaacaaaaagauauuuugugcugaaaaguacaguguuaagguaucaaauauagaucagccagccauauuuuaaacauguuugucuauauauuucacuuagauuagauuuuguuguuacucuguuaauagaauuuuuaaucuuuugauaagguaauauauauauuaguggaauuauugacuaguucauuccaaguguaaaugacuaugucuuguucuagcugcauuggguuucuuuauuuuauaacuuuguucauacuuuccuaguuauacacccuugucuuuaacuugacaguugcuuccaccuggaaaucauugcuuuauacuguuugaucccucacauaauacuuacuauguuaucauugaucauuuucucuucucucucucucucucucucucucucucucucccuuucuucuuuccuuccuuuuguccuuccuuucuuucucucugucucuguccccccucucucugucucucucccucucccuuucccuucccuuuucccucucccucucccuccccccccucucauuuuaggccucaaggaacugauuguuuaucaguccugcuguuugucuauacuauaugauuaaauaaauuucauuggggcagauauuuaauuucuuauguguagcgaagcugguaauaucuuugaggcacugaguccuguaagagacaauaguggggcagcauggcaugaaagcuucauuuaaacucugguuuuugguuuuaguuucuuuaagcuauauuuuuaucuuuuauaaauugugaaaucucucaguauuuuuauguuuagauugucauaacaaaguauagacuagguguauaacagaagcuauuucucacaguucuggaagcugaaugcuugugaucgagauaccagcaggguagaguuugggggagaccauaguuccuugcuuuguuuucacacacugacaaaaacagaagagcacauuugguuguguuuaaucuuucacaggcccuacuucuaucacauggaccuuauucucaugaauaagguccucucccaaagacuuuccaaauauaucacacugaggauaaggacuucaauauauaaacuuugggacagacacauucauuguacaacacugucuuacguuaccuuuauaguaauuuauggaaaggauuccacacugugucucaaacagaaaaaguaauucaaucaguuuguuuuaauuauuucuccuuggcauaaauuuugcuucugugauacuggaagaaaaaaaaucuuuugauagugagucuguguagcauuaguuaagaaggggaauauuggaagaagagcaagguugcagauguggucuugagagguuuucuucauguaucaguugacuuacagauauguaucauguagauacaugucuacaaauauuguaaauuuauuuuaauggacuuagaacaguucuacauuagauauauuuagauuuuuuaaacuagcgcauaugaucuguuccuacuucuagucuuugcaucuauacuuucuguucucuaaguuagucaaaggcugauuuuauuagccucucuggaacugugaagaaucucuauucuuucauauuuggcaauaauugucuucacauuuacuuuauagagucuucuuugguggaaccuacaggcggagaggaagcacaggauucauaagauggcgggcgggugagugauugagaaauugggguagaacuugguagugguucuuuuuuauaauaguaggaguaaaacauuuggacauuaaaauugucugagugaaaacuaaaagaacaguagaugguauuaaggcuuuuaaaugcacguuuacauggaaaaccuaguuugcuacguaugcuaugauuuucuugcauuucguagugauuuagcauagagccaauaguuuggagcaucagugagcaaauacuauuuaccaaaguagauguucuguuggugaugguggucaaagauauaucauuuuauugggguuugggcuuuucuguuucaauaaaaauuuaguucuguagcaaaaauucaguucuuuuaagcaaauaaguuucuagaaccagaauucaagcuagacuaaaagaaaauacuaaagucuuuaauuuauaugaacauaaaauaaucaugauauuucauuuagaaggaaagugaucaacuuuucuauguuauacaauauauaaguugaaaagggauuuuggacaguaauccaaccuuagagcaauaauauaaacaaaggggaaaagacaguccuggaaggagagcccgcccaugggcuagagugacagcucuagcaggccagcugugguggauagucuaguaggccugcuuguucacauaacuugaaacacucccgguuuacucaugaguuucugcuuuguuuuuuguuuuuguuuuacuucacagggugguucuuuuguaaaauggagcugauuguaauacugaaaaagaaaauguuucuagccauuuuuccaaacuaaaccuugcuccuuuuuuuucuccucuuuuucuguuuuguuauaaacauaaacauccucccuuuuuuucuguuuuguuauaaacauaauagagcccuaguaacuuuguaaaggugaguaagcacacuagaacaugaaauuauuuuacauuuaauuggaguucuugaaaugcaaacaauuugcacacguaaaaucuaaacacugacuucucuugguuacuggguacauuauuuuagagaaguuuuuugaguauaacccuugacgcaaaccuauugccauguaggaaagaaauuaacauugcuauaguccucuuaaacauauuagugacuguaucucuaaaacuuuuuauucagagucagcuugugaguuucagcaucuuuuuaaauuuuuauuuuauuuuuuuacuuguucacuuuacauccuacucacugccuucccuccuggucauccccucccauaauccucccaucuucucuccucuucuucucagagcugguuagccaccccccuugcccuaguaucccucuaccuggcacuucaaguuucuuggaagcuaggcacuuccucucccacugaggccagacaaggccgcccagcuagaagaacauaucucacuugcagguaacagcuuuuaggauagccccuguucuaguuguuugagacccacauaaagaccaagccacacaccugcuacauauggucagggaggucuaugucuagcccguguauguucuuugguuggugcuucagacucugagagcuccagggguccagcuuaguugacucuuguuggucuuccuguggaguuccuauucccuuuggguccuacaauucuuccuccuauuuuuuuuucauuagaguccccaagcuccacccacuguuuggcuguggguguuugagcagcugcugggugguggagcggcucaaaagacagccaugguccugucugcaagcaguaucauuaauagugucagggauuggugcuugccaaugggaugggucucaaguugggccaguuauugguuggccauucccucaguaucugcuccauccccugggccuacauuucuuguagacaggauaaauuuuggguugcugcuugcuucuucccuccccuccccuccccucuccuccccuuuccccuccccuccccucucuuccccuccccuccccuccccucccccucccuccccucccccccuucccuccccuccccucuccucuccuuuuguucuuuugugcuuuuguucuucuuagaaggagaacaaaauacucacaggaacaaauauggagauaaaauguagagcagagacugaaggaaaggcuauccagaaaggacugaaggagcugaaggaagaauaauauuaucaaccaaccagaccccucagagcucccagggacuaagccaucaacaaaggaguacacauggcuccagcugcauauguagcaaaggauggccuuguccagcaucaauggaaggagagguccuugguccugugagggcuuucuagaugccccaguauaggagaauccagggcugggauguggguuugggugguuggguggaagaacaccuucauagaagcagggagagggaagaugggauagggggauuccaggagagggaaccaggaaagaggauaacauuugaaauguaaauaaaggaaauauacaauaaaaagcaaaaaauaagaaaagaaaauguuggugccuauauucauuuagaaaacuuaguaauuuucuuuucuuuuuuuuuuuuuuuuuguuccauccuucucugguuuggauaucuuuauaauacuuguuuuuagacugaguuugguaccauucuuccacuucuuguuuuauggaauagucugaagaagacuugggguuaguucuuuuaaagaucuugcagaauugacaauccaucuaguacugucuuucuuuuguggaagauguuauucaucuaguugcucauuauagauagaucugcuuucaaguuucugguuuaauuuuuguaaguuguguauauguagaaauuucuccauuuuuuucuuuuagauuuuccuguuuuggagauaggauuuugaacuauuuccuaaagaaccuuaagauuuaauuucaucuuguaauaugccuauuuucaccauuaguuuuauuaauuuaguuuuauuuguuucuuuuucauuguuuugguuagaggcuuguggaucucaaauguuuuaguaaguuauauuuugauuuuauucuggggauuucuaaauauuuucuuccuaacuuuaaaaaaugauuuauugauauaucagaauuauauuauucaaucuccauaucuuuguauacuuucuguaguuucuuucugauuucuaguuuuauuccauugugaucugauaugacccaggaaauauucugauuugcuuuauauuuguuuaaguuuguuucguccccuuaagauaauggucuguucuaguaaaggucauugggcuucugaaaaaaaauauauacuguaauuggauggaauauucuauagaugucaguuaagaccauuugaucuauaguauaguugaucucucaaguugcuuuguuaauuuguuuuguacaggugaacuaucuauugauuauaauuaaaauuaccugucauuacuguuucugaacuugucugucauguuaguuuugucuaguaguguuuguuuuaugcaguaggguguaccaaugacuguuguauacauacuugcaaucaguuuauuauuucuguauuaauguguaaugaccuuuauuuucuuauuuuuuccuuauuuuaaaaauguuguauccaugugcacauguaugcauggguacaugccuguggagaguagaggagagcgggcucuucuuccauggaucugccugauucccuuggugcagcaucucccacuagcucacagaguuuggcuagacugguaacuaguaagauccaguuucuccucacagcccacucuuccuccccagcacugacguuccagguuacguggaugcuagagaucucaacuuaggacaguugugcucauacaggaaucacuuuuagccacugagccaucucucuagccucuucuuuauuucuuuugacuaauuuugagauaacuuuugccagguaugaggauagucacccaugcuugucagcguccauuugcuugauauagugggauuuaguuuucuaccuucacucuugguauuucuuugccaauaaaguaugauuauuguaaacaauaaauagaaauaguuuuaagauacucuauuauuuuuaauuaauugauuauuauauuuuuuguguguuugugcaugcacacacaggugucuugcucaugcauguaugugcuaccacauaccagugggagacagggaaugggauuugggaguuuauuuucuccuuguacuguaugagccuugaauaucaaacucagaucaucaggcuaagugccaggaaccuuugccaccugaaccauuuugcuggccuggauuuuguuuuaauccagugaguuaauccagaaauaggcagcauuuauagguuauuguugagauguuugucaguucccucaauuuuuuuuugcgcucuucuuuuguucuauucuuucuccucuggucauauaagaaguuuucugguucagggaguugggcauuauucauuccuagugcucauuuacuauuccauuucuuucauuauuucauuuuuauucguuccuugcaucucuuuuggggaagggcugccuucucuauguauuggauucuuguauguguugucugagcuccuggcuuaguagcuuggaauugcuuuacuuuaagccuuuccucagaugaucuuuauuucaauuuuaaaggagaauuuugcuagauacaguaguucuggucaacaguuuacuuucaagacuugaaauaaaaaaguuauuuuuugauggcuuuuaggauauuugcugaaaaauugauguuauucugaugaguuugccuucauaagugaguucucauuuucgcaucgcuuuucauauuauaucuuugcuucaauauucuuagcauuguggagagguuuuuuagccgcagucucuuaagaguuaauaaaugcuucuugugcuuggaugcuauuucuuuuccuagacuuggugaacucucuauuacaaucucacugaagaguuuuuuaaagauagcuuuaguucuuauuuugauucuuuuugcaguuccauagauucuuagguaaaguucgcucugucagacaucugcuguauuucauugucuuuggauuggcuuauauugaaggccugugacuuuuucuuuuuaggacucaucuugccuugcuuuuucauguucccagugaugcugaguuggaauuuucacaucuguuggauggcuaucuucaguuuauuuugagaauauucuuauugaguaggcuucucuuaguggcucaguuccuuguaccacucacacacagaugagaaaacaauuuguaagagccucaucaucaaaucaaaacacauacagaaauauauauggagucaguugauuacagagggaaaacaacagaacuaaaguaagguauguuguugaugauuaauuuuuuuuuaaaggacagagguagggaaaaagaagaaggaagaucacacagaagggaaaaagaaaugagaaggaucuuagauaguuggugaaaaaggaggguugucuaaaacccccuaacugcccaauaaaguaaaccaaaccaaggaguguuaacaaggucagcauuccuguacucauucuaggaacuucucuuucagggugccaggagcugcugcuagccuugccucccuagagaaccugggcucuacagagauuguccccuucugcaggucccuauuacacucuggguggcuaauccuuaaaacagacugauguuauaccaguuugcagucccaccaacaauggaggaguguuucucuuuuuccacauccucaccauugucacccguguuuuugaacuuagcuguucugacuggugugagguggaauuucaggguuuugauuuucauuuuccugaugacuaaggauauguugaacauuucuuuaaaugccucucagccauucaagauuccucacuuguaggguugguaaagaucauuucccaaucgguugguugcgcuuuuguccuauuuacagggucucuugccucacagaagcuuuucaauuuugugagguccuuuuuuuuuuucuuccaguucugaccugucacagugaaggcauuguuacaccaccucucccagugggauuuaagccuugugcuaacuuugggccucucuuauggaaagagcuguuaggcucuucauuggauuaccucauauaagagguuugguuugacuucaaugcccuuucuguggaacuggggcucuguccuugggaaucuauuuuucuuucccucucccccaagccccaaucccucccuguauuccuguuuuacuuuguuucuccucccucccucuugcaaccugggcuggccuggaaauuugggcaaccuuccuucuccagccucucaagugcugaaguggaggccugagcuagcacacagccugccuuguccuuguguucauucuuucucauuguucuaucaccucucuugugaccuguacuucucuuuaucuagggagaggaugaaaaacucagaaaucaacggugguaauugcacaauuuugggaauguauuaaaaucaugaaugauuguauucuuuaaagaauguaaauugguucuuaaacagugauuuggaacuuaacucaaaacuacuuguaauagucuugugauagaacgaguucugugggaagacacagguuuacauucugcucuacaguuggguuugaaaggagauuucuugauauauauaauauuuaggcaaaaaacuguuaagaaugauuuggaguaacucaggugaauuaacugggacgaauacaauuauagguaccagcuaaaaugcagucagcucugacaggugcuuccuuuugucacuacauguaaagacuuugcuuagguaggccaguggguucucaaccuguggguugcggccccuuggggguguguuuaacagccuuuucacagggucaucuaagaccaugggaaaacagauauuugcauugugauucauaacaguagcaaaauuaaaguuaggaaguugcagugaaaaugauuuuaugguugaggucaucacaauacaggggacuuauuaaagggccacagcuuuaggaaaguugagaaccacugcuaaggacaauuaaaguaacacaauaacaguuauuauuaaaaaagccuaauuuuuguggggaaaagagauuuuuuuguauuucauaguuagauuauauauuuuuuuuauauuuuguauauaauauuuuauaauuuaaauauuucaugaaaccagaauuaaauucuauuacuuguuuacauagccuuuuuuuuuccugcuuauuuauuuuauaagucaguuuuucaacuuuucacuauguagagagucuuguguuuaauuccuuuuggcaaccugagguuaauaaccauagaacuuuguagauacuaucuguuguaucuguuuguuguuagguugaaaacccauuuacuaaaaaaacauucaaacaaauacuuuagaaaaagaggagaguagacccagagcccaugccgucacugccaguuuccuaacuaacauggguuaguuccuggccacucuuacuuuaucuucauagauucuuacuucuuuugccuauuuuccaucuaaucacugacacauauucauauggaaauuuuauuucucuucauaugacaaaaauuuuaaaaauaugcuacguugaucauucuuuaagcauuaaacuuuuaaaaugaaaauauuuuuuaaaagcuauagguaaaagugaaguuauuaaugaacuccuaauuuuuuacguauguauuucucuauauauuaaguaugcuuauagaauaaauuauguaacaucaauuauaauguaaacaaaaugcuagaagaaaauaguuuaugcauucuuuuucuuacuccaaauacucauuuuguaacuaauaauaauuuacuaggaccuuauaauuuuauguuuuuguuuacuuguucccuacugaaauauauaccuuacuugacuuccucauauuuuccauuccagaugcaucucuucauuggagugcuauuuuauugacuuucuuagcuacuauaagauaugaagagagcccuuucucacucaauucugagcugcuuuggcugucuguaaauucuuggcuuuucugcuguuugaauauacauuuugccuaugaaucagugaauuccaacuauuucuucaaguguaguguguuacuuuacaucacuguaacaaaauacaugaagcacuuacaaagagaaagaacuuaucauaaauccuauauaggaggaagguuguagugagacugaguuaaucacauucauuuucccaucugaucaggguguccuacaugaugaaaaaggcugcacaggaaacuguuuaccuggaaaaguagagaacaacgagaaugugacuagaauuccacagucuccugugagaacacauaccccauugaccuaaggacuugucauuaggcuccuagagcuugcuagcacuuaccaguagugccaccuggggacaagcccuguaaaacauggucuuuuguggcauucaguaaucaaacugcaguucccaauacagaaacuaacuucuuuaaguguucugguguaauauuuaaagcuuuuuuaugacugucucauggucauuauaaauuuacauccucaaaacagaaacugucuuuuuuugguuaauguauucuuuucugucuuuccugugauaagucgcuaggcuucuuuaggucacugugcuagaaaugcccagaucuucugauuucuaagcaugugguauucuuuugugcuguuaauuuuauaaaugugugugucuguuuguuuguuuguuuguuuuuaccaauucuaggaauuuuucucccaaggaaacuuacaaccucauguuggcuauauauuucucucucugauucuauaaacccauguauuuucugcagucaagacaagguaguuacuguuccuuucuuaaucuaaaccagauauucacuguaacacagcaggaucuuaauaaauacuuacuaaauuugaaugggcacuuguuuccuuccucaguugaaaacaguacacacacauacauacuauacagaucauuucugaacuguaaauuuugauucugcuauauugauagcuacuauacugauauuucugaaguuucacuuuugcuauugaaaauauaaucagauucuuuuuuuugccagacuugauagguucggggauuucaaagagaaauaaggcaucauuuucuaguuaaaagaauuguuuuauauuagguguauaaguguuucuugugggcaugcagugugcacaguggcuagguaagaacaucacaucuggaacgugggugguaggaacagagcucaggucuucuguaugugcucuuaacugcugagccuucuuucucucucauuuccccauuucuguauuuaaaagauggaauuaggaauuguaaagaagcagacaucuucuuuugcuuuuuggagaggccauuaaaaacuucauaaaggauaucugauauuucuaaaguucauuuuaaaauuuuaauuuggaaaaguuuauuuacugacuauaugugcauauguauauauauaugcauauuguagugugcaugugaagaccgucacaggacaacuaaugggaauagguucuuuccuucuaucauguggaucccugggggauggaccuuacgcugucaagcuuggcucagguguucuccacugagccaucuugcuaucccucuaagagucuucuccauuaaaaaauagugcauaucacuguacuuuuaccuggguagcugcacaaaggaagagaauuaucagcaaggaauuauugacaguuuaugaggcugucuuauucugauuaauuugaacauucacuuuagucagaauagugaaauuuaauuuuaauacuuuuuaaaguagaaauuauuuuuagauuauauauuacuuugcuaccugaaauaauugaaaggaacauucaguuauuuauuuauuuuuuuuuugugaggccuuacagaagauaaggcaaguuuuguagucuaugcccuucaauuuaaaggaaucaguggguguuagcaguuaacaguaaauauuuuauauaauuuaucauuuacuauaagagcaaagauuugugaaacacauucauugcucauauguacuuaauuacuagcaaacagugaaaauugauuagaaucccacagucuauaauacuuucagaaugaacucacaaggaacaauugauaggcuuaacaauguauuuuauauacauugauggaaaugaaagugacuuuacauguuugaugguagccuaacuuugguuuaggaucaaucaggauggaguguuuuuuuuuaguuugauggcuaauggguauauuaugaaaauacuuuuuucuuagacucuuaguucuuucuaucacugguaguuuauuauaaagucugucacauaccucauacauaguauaggguuuuucaaucuucauuuuaaaaucauugagaucauuauuacuguaagucaucuaaacugauauuacaggaauuuauuguuuuguuuaagagaacaugaacauuucugguuauuuucuucuuuacuacagcuguaaaaugaugguuuuuaaaccuuaguuuuacuuuguaaaaccaccaaauaaauaugugccaagaauagauauaaguguaaaugaauuuacauuauucaaaauucuagaauuagacaucugucuaaugaaugcuguucuaaauguugcuaaaugauuaauaguaauuaaaagguuaaauacaagcugaagaaagcuuugaauuuugaaauguuugcaacagcuagaaaucugacugaugcagacguuuuugucaaaguugaaaaaguuagagcuaauuaauuucuugggagacauaugaugaaauuguaggugugauagcauauuugaggaacauauggugguugggggcaccuuucuaaugacugagcagccaguuacauagagacuuugcucucucuuuucucucauuuccauucuuuguuuccauguguguuaaaacugcuuuuguuuuccagaggucaguuuucaggauuuaacaguuuguauuuaaaauguuuauuaugaacaucuauuccucuucuaaguggacauacauucuagcuacauuuuuaaaaaaauacauuuacuccaguguaugcauauauuuuaguuagugguuuuaaauaaaucaaaugaguggagacuuguacugaccaguucauccugaucacccuugagugagaacuaaaaaugguacccaagaaagacagcauagacauauugaucuuucuuaggcauuaacuuuuucccuuuaguguauaauaauuucauauguauguucuuuaagcauuacuaccuaagguucuugaauacuucuugauaaaccagauuuggggauugaaguuauuuugggcauuuguuuauugaaaugcuauucuauucuguuuauauuuuguagaauguauuuugaaacaagacuuaugcaauuaaagucuaccuaacagugacauauagcuuauauauauauauuuuuuauuuuuuaaagguuguauuuuuaccaaaauacuacauuuguaaaguggcauaugaauuuucuauuauucaaugaugccaaaaguaaaguaagaguuaagaguacaagaagucuauaggugcugcagagccagcuauuggaggauucuauucacuucucaauauuaugcugcuaagguugauaaaaugaaaaaggaagcaaagguuauaaacuucuaagucuucugaaaugaaucaaagcaaaaguagcauuuguauuuaaaauaaauaaaaaugaacagaaauaaaaauaaucuuaaacuuuaaaggaaagugauggguaaauucuauaauuaguacauauaaaacaauuucaguuuugcucaaaccuaauguuaaaauauuauuguauuuuaaaauauauuuaaaauauuugccuauaguuaugaaauucuagucaagucuagaagugcccccaauuggucuauuuuuuuguaccacauaauuguuuuuauuuaaauuuaauauccugucaagaauuuugauaugaacaucuauuguauucuauucuuauucuagauauguugcaagauauuccccugucaguugaugugcuuuuagccagugagguccuggugaaauaguguaaccuagcauggugugaacucaagucuguagauaaaugacauggcgaacuuucagauguaacuuucaguuacaguaaagcaucagcaguagucacuuagugauacaauuuguaaaguucagaucaucaauuaauaucugagaacucaguuuuaaauauagcagaauucucugauguaauagauuaucaguucaaaaauuaacuuuggagacuuauucuggagcugaagacuuuaaauaauuuuaaaaugauaagauugauaaugauaagaaucuucugagacaaaaaucuugaacaggcuuguuuauuuugcagaacuuaacaaguauuuaaauagagcaaaauagaacuauagagcuacaguagcuuucauuaucaagcuauaaguuggaucauuuuuuucccuuaaaguauggcauuuuuuccuuuugcauggcuaacagguggcauuaaaugaagaaugggagaugacuuuuauucauuaacauaguuuaauuuugaguuaguuuugaaauuuauaagucuugaaugaacuuaugccugaaaaauaaggauuugaaaaauaaaaaggguuugagaucaagugugcuugacugccuuacuaauagguggagaaguccauuuucuucccauggagcuuuauacauccugucacauagaaacaguuugucacauguguuuguagccaguuuuagacagaucauugauuauauaucauucaggcauaaaagauaauucugacauccuucuuuguuccuuaaauaccuugccucuauaaaauggcauauauauuagcuugaucagaucauuauaaacaagugccaaggaggcaauuaaaauuuaguaaacucacugucuaugauuucauuuuaauauuugugguugacaugaaaaguuuuaagaacagaugauccacagucuaguuugagaauaaaugauuauuuuucccucuaggaaugaaagauugauuugaauaaacauauuguagguuuauccauuucacaugauucaaaugcaugccagaauaucucaaaauucagauuuguuaugaagauacuaaauauucuuuagaaauauaggaguaaaauauaggagugacuaauugauuuuauucauuucuaguugccagguaaucugagauaaaauguuugauuuuauaaaaauuucuuaggguuguaauuuuuucuuuuucucuuccuucuuuugagagaggguguuacugugcagcccuggcugacuuggaacuugcuuuguagaccacauuggucuuguauucauagagauaaacaugucugccuccuaagcgcugacauuaaagacaugcaucaccacauccgucuguagaccuaguuucuuaaggaacaguuuugagauuuguauuaaagucaguaguugagucaacaagagagacuccaggauaaagaaauuaaaauucuccuaacuuuugcuuuaacaaaagaauacuuacuaguuucuuaaaaugcuuucauaauguauucuuuuaaggauuuuaauauuguuuuccaaaguagaugaaauaucuuuaagcuaacugauaccucuuccuagguagcauuuaguuuuuaauuguguaucaggcagagcuguaugcuuagcaugaaaaauuguauuuaagugguuacguugaaucagaguauuuuuccuuugguuguccuauauuuuauagguucauccaaaugugguguuuaugucagaaguucacuuuuagggcagaauggugguauguacauguacuguuuguuguuguuauucauucauucauucauucauucauucaugucuuagauuuacaugaaaaguuauuuauuuagcuugaauauuugaaguuucuuuuuucaaguagagaguucuaugacagucuuuacuuuguuaaucccacacaagcugucauuccuuuaccuuuguguuugcacugcaugacuaagaugcauguuagcguguccuguauuugggagauaauauccuauuccuuagcuucuuuaagauguucuuuguuuuuuuuuaaacuugaaguguguuuguguuucuuuuccuuuuuccucucuuucccuuuucauuucauuuagguuucguguuuguuagugauauuuauacaugucuuucauugauccaggaaauucuuugcuacuaacacuucugauguauucuuucugauauuguauaacgaggcaauuaaaaacuugggaaaaaaucuuuuguguauauacuuuacaauuuaugacuuaauguuguuguugaugauauuuuuaugcuucuuuaguuuuucucuuuuuucugguuguuugaugugguacuagaguucucugucaauucuuuacauguguuuuugaguucucaauuguuguugucuuucauauugcuuacuuauuugauuuguguguuuugggggacacaguuuacaugagcaauucagaggacaaauuuugguuaguaagaggaucuguucucuccugccaccuuguggguccuaaggaucagacucagguuuucagcccuguuccaaagugccuguaccugcugagcuguguugucagaccucauguuauuuacaguuuucucuuuuacugaugaaaacuccaaguuagaucuuuagcuucauuaacauaagauaagcacacucauguuuagcuuauacucugucugaugacugugacccucugaaaucuuugaaagugcacuguuuucaugguuuguuauuucuguuucucaucuugcuucugggguccuggcuccuaagguaccaguuuuaaaugcugcugauucuuguuacucauuuaucaguguuguaaaaacuccacaugcaugcugaagcauugcuucuagaaggaauuucaggggacagguuccuucagauuucuuuuuauguuuuugucaguugaucauauauaacauuacuaccuguuuguuuccuuuuaaagacuccuuauuuaguaaguauuauuuucaugacauugaauuuauagccaccaauacuuuaaagucaugacugaaugaagcuuuuuuuaaacauguauuuuauaacagcuuucuugcacagagaaacauuuuuauuacuuaaacuuguauuuguggggacucuuuuagacaauuaagucacugagagaaagcaaaacugugaagaguguggcacuaaccauacuucacaacagcauugguuauaguaaauaaaugaaagcaagccugagugauaccuuauccauccacaucugggaauacagggguuauuaugcuuucagaguauuugcuuuuuuacauguaaaagaugacucuuagaacagcuagaauguuacugaauuuuggauuauaaaacguuuuaauguguugaugacuuugcaaaugcagaauccuggaaagaagacuggcucugugugcuaggcaugguaauagaaaaccauauguagauuuauaugcuuugaguuagguuaccucccccuucucuccacacuuggaaagaagcuugauuuuauaucuuuauuauaacuugaaggcauuaaaauucuggaaacagaagcugaggggguuggguagauugggcaggcaugaggacuugaguucuauucucaaaacucacauaaaaugcugugugugaugguguucccuugcaauccaaaugcuggguuagcacacaugggaauaucucuggaucuugcuuuauuuaugagcuucaggccaacgagagucccuuucucucauuguguagguggauaguguuccuuagaaugauuuucagggguguucucuaacccucauaucacauuugcacauugacacagaaacacacacaaacacacacacacacacacacacacacacacacacacaauccuagaaguacuaaaauccaagcucaaggguugaugucuuugcuaacuuaaaugaugugaaauuuaugcuacaaaaucuuguuuauuuuuuguuuauuuuuagcgccaauaaaauacauuuguaauacuugugugggaguugguuugucagaaucaucuuaccuagcauuuuaaguugcucuuaguggacugugccucugaacagccuacugaaauacucuauaaaacuuguuauuuugauauauucuuuagacuuacacuaagauaugaccuuuugacucuguuacuaauaggagaaauaaauuugcugauuuuuaaaagaaacuuauucauccucauagagaccaugguacucuucccccucccccaucccaggucucuggcagauauccuagagauugccccucacuguuuuccauucuuucccuugcacuccauacaucaaacuucccucacagccuacuccccuccucagccccuuuccuacccagucccuuuauccacuucugauaucuauuucauaaauauauaaguguaaauaaacuuguguuuuuuuuaaguacaaaaaucguacuuaaaaaagcagacaucggacguguuucugcccucccuuuuuuucugacucuuugagccuuucuaccuguuucccucauucccuuucucccagccauaaccaccaugucacuuuggaaaaguaugaugcaauauaugcuugcuuuuuaaaauacaauuauuuagaagaauuauuuuauauauacaugaguacacaugaguaagggccugcagaagcuauagacuuugaaucuaccacagcuguaguggugagcuuccugauguagguauugggaacugaacuuagauccucugcaaaagcagaaugacucuuaaugcuuauaucaucaaaguugugagaaguaauaaugcaucuugaguuuugguuuauccacugucauauauagcaagcuauucugggaauauugugaauuaaaacagucaguauccuugcccuccggagggaguuccucaucuuccucccccuuuuaaugguuuauuuuauuuuauguguauugaguguuuugccugcauguaugucugucuguguauagugccauauguguacagagcccagaagagggcauccggucuccuuaaacuagagugagcaggugauuaugaacugccauguguuuccugggagcuaagcuccaguccccuguaagagcagcaaguguucuuaaccacugaaccauguauccagccccaugaaauaauuucuuaaucuuagcacuugaacagaauaaggaggcuguuuuguagacuuugauauaucucuguuuccuccuucguccagcugcagaaacaaaaauacauggaaauacugcuagcuguccauugagugugaaaagcaaaaucaucacucuuggccauguauugcucuugacaguacaaugaaaucagauacauaaauucaacaacuaauguaauucuuacuaauuauaauaauuaaaaauuugauaaaacuuaaaccaaaugaauuuggaauucaaauagauaaauuuuuuauugaauauacuuuaaauauuugauguuagaagaaauggaagaaauuauucccuuuaaggucaugcaagugauaauacacuauacagguuagcaccuucuuuauaguguaagacuucagcuuuaauaaauaccauuggacaauagucagaaauaaggcaauucuuacaaaaggaccuacauagucuauuucuauaauuccacugaaguggaagggucaagaacaacauauaaguacagagacaauaaaucaagacaaauuguaaauuaacuguuaugcuuuugacauaagaagacucauuguuacacugacauugauaaccccguggcaucuucaucuuaguuuuagagggucucuguagugccucagcauuccuguugugauagcacagucagcugccuaagccucuggcuguugaagagcuggagcuuguggaguggacagcagagucagugggguucuugagaagucggacugcauggcgaagcauucauacgcucuacaaggaaccauucacuucuguucaaucuuguuaacguaacaagauugguuuacaaaagaacaacaaucaaacacacaacguuaaauggcaugucucccucagaucuuuccccucagagcucaaggaacuccauagaaaguguuagagccagaggggauggaggaccccaggggaacacuucccucuuuugagagucaguacauccaggaaaagggaaggaaagaaauugcacagaagugaaaaguuacugcuuuugggucugcuucuguagaguuccuuccaguucaguguuuuacuuuguauucuugacuuucauuucaauaaaucuucuugaauuuauucaaguuaagcaagauauuuuauuuuuuaucuuuucacccauuccuuuaaagcaguuugcauucuuguugucugcugagaucagggaguaguaaguuuucacauguaugugcauuugggcaaauuaaggcugaccaaaguagcaugauaaaguggaagaaauaggaggaacuugaaacuggcauaaauaaaacauaauuuuaaagaggagauauauugaaggaucuguuggggaacaaggaagaaugccaaaggucccaccuugguuaguuaguaccuccuugauuguuaggccuagauauagagguaaguuagccaaccaugguuagaaauguuaaccgaguuuagugaaaguuugugacacugucuucaaauuucacaacaauuuagugcauaaugcuguggaacaaagcuuucagauuacccaggagcuaucagggaacuaaagaaacaugaacuaauuaaugugguucugacauuuaaaagguuacuguuuuauugagaaguuaaaaagcugaaaaugcugaaccugacuuguguugagguaauauuuagaaaauguggcaagugauuaauccuuaagaaauaauuguuuaggaauuaauuuaacagaucuaucacuuuaugaaauuuagauaaggaauguggguaguguaaaauuucuguaacauuuauaguaucgaucacaagaaagucuuacuuagugucaucaaauaaaaagacuguucauuucagugucaaagcuguuuagaaagcacaguucaugguuaccaaaguugaauuguuguuucagaaccuuuaaaaugucugugucauaacacuuuaccucucauugcauaaaugcucaauuuuagauguauucaguuauuuauguuuuuauauuuuccagaucuguuaauaaugugucaaccagugauuauugguauuguaccuaagguaaaagauaucuucagucauguuaaaucuuuuaaaaaacauccaaaaaguuuuuuuuuucagaccuauacacaguaccaagucaucucaacugugauaggcuaagcagacaccugucuucacuggaguuagugaaggguugguugggugaauuguagauugacuaaucaaagucaguuuauuacguaauacuagagcugaaguuucuggggccacauaaccucuggagauuccauaaaacagcuuuguuacugcuugagcuguuuccuuguccuugucucuacucuauagagaguaguguguucaaagucaggauuuucaaggaauagcaagauuuggaaaauaaggacaguaggcuugcucugcuucugaaauacuaugcguguauaggagaguuuggggaagguaauaagaggacuaagaaguuugcagacuauaaauuugggcuaaauggauagggaaauuaagugucacgcgcuaaaugagcuacuuucuuuaaaaaaggcaucaccuguaguuuacuaaaguauguauggauacuauauuugauucaggcuauguaaggagaaggcagaggagucuuuuuuuguuucuuguuuuuuuuuuguuuuucgagacaggguuucucuguauagcccuggcuguccuggaacucacuuuguagaccaggcuggccucgaacucagagauccacuugccucugccuccugagugcugggauuaaaggcgugcgccaccacgccuggcuaaggcagaggagucuuaaaggagcuagaaagaacaggaacaauuacugugcacuuucaaagccaagagagaaagaaaacaucucaauuugagaagaguguaaagagaacacuaaugauaaguuuauugguaacuucuaaccaaucauugucaauuaaauuguagugauaaaaagaaaauugucagugauucaagaaagaaggaguauuaaagaaaugguaaaagcauagauucaucuuugcacugauuuugguaagaggaaagaaaguagauugcaguaguucagagagauuuuuugagguggaaacauguugaacauguucauagauuauggagcaggcauccagauacagagggaaauuuugaauauucaagaaaaaaagauacaaguaaauuuagagaaagaaaaaaaaaaaaacuggauaccugaaagggcgcuagcucuugaaauggccuuugaucuaggcaaagauguauucugaauaggcuuucaaacagugagcugagaccuugaaccuugacguuaccuacauuuauuuauaaacauugcccuuguuuccuaauaguuaaggaggaugaaguaugggggagaagauaauaauuguauugugucaacuagaaaugauaaacaauuuaccagaguugcaugaauuacaguagacucauuuggcuuagguuucaugacuuaauagaguuaccuucagaagaaauauacagaaaauaguuuaugaaauagggcagagaaugauaaaauguguacagugaaagaaaagguaaauuauaaaauauggguugauccuagauucuguacagaacuagauaaauggaaaaaaacauaaagcuugaaaaaauaaagagaaaacagaauacuagagguguugagaaaaugaagcagaaguuuagaauucaugaagaaauaggaaugcuuaaaauaucaaaguagaauacauaaugaacaacauugcucuaucugcaaguaauguacuaccaguugccaauuuaccacuagaugucacucugacucauaugguuaagugcagccuggacuuaagaggcaggguguugaaaaucagacaaguacagugugcgcagauaccccugguggccuguaaggacuguucuacucaguuucucaugcgggcguuuuagucaaacagcugcuuuggagaggauagugucuuuauaacaaagcaaaccauuaaaucuggauauuuuguaugauuaaaugcugucuuuauguugauuuuuuuuuuguuuuacuguguuaaucacauuaauuuuuuugaccuguguacuuuaaaaaguuuaaaauuaugcaugaaaaucuauaaagauauuuucucucaauauuuaauuauuuguuugcuaaauuuuuuaugguuuuacauggaguaauagcuguuuauugguacuaacaaaaguguuuauuuguaaguggucaugauuaagcauguugacacuaagccugcaaauguaaaacuugaauucucucaauuuucuaguagaacaaacacuaauaaaacuaaaggagugauguuuagaaaguaugucagauuugucaccuacccacaacuuuuuucagcugcuucuuucaaagucucgaacuauuuggaaagcuuugcaauaugauuauuuucaaauauaaaaauacacaaaagcaaguauuaauauaucuccagaauaacaguauucagguacacuauguagauuauaaaauacauuuauguuguucuuuucugcuuauuaauauuuucccuuugauagagaguaguuauaaaauuauuuuacacuacuagaauugcugaauugcagaguauaugguagaaaauaaacugucacagguuuuugccugugauuuaccuaaugauauauuucauuguuuccuuacaguccucuuuuuauugguaagauaucacaguuacguaagaaauugugaucuguuacuauauuaaauaauuuuuagguguguuagcaaaacaacauuccuuguuguaaguaaggcaucuuauacuaucucucuuaaguuuuaguagguuuaguuuaucaggaaagcccuuugcacaaguacagacucuguggcagagauugguaagacacaaggaaagaaaaacauaccuucuuuagaguaacugagcugaaaauagacugaagauaccuuugauauucaacauaaaauugcuuauuauacucgcugauuaggaacuuaauuguaaauuguguguuaggacaaaauucuagguacuaguuuaguauugugcucuauggagauauccuccuuuaagcucuucauuuucucuggguugguggagaugauuuugccuuugggacugacugugagcuugcugcacugguugagcuaugagaguguaaugguaaagcaacaggacaaaagccaguugaacuuucccaccagcgcucugaauucugcuucuguaaaauuguguugaagcagucauuaugaaaucuaugauucugauuuuaaaagagcauuuucuauaucaauacucaguauugguaaauaagaugugaaagugcuuuuuaaauuaacucuugaaauuauucuaauaucuuuuuagccuuaaauucaucuugccauguaacuuucaaaaugacguuuuuguuauuguuuuuuuuuuuaacaaggaaaaaguauucguuuuauuucuuuagaauuuuacaguuaaacuauuauaucuuccuuuuuacaguauuuguccuuguugugccaggagcagugaguuagauaguacuagcugucuauguccucugucucucaucucuaagggcuuucaccuuuauuaggaacaaaucuagauuucuuuuuguuguuuguuuguuuguuugcuugcuugcuugcuugcuugcuugaaauggcuuccugggaauguaaaaaccccuuugacauuauuauuuagggccuccuauccucccagugcacuuauagucuuaacacaaaaacuuugcagcuggugaacucccgaagccccuuuugaugauuguuguuuaacucagcauggcagcuugcuauaguuccuguccuauacuggcucacuucaccucauguucagacuccucaugacaaagaagucuccagagguaaaacacagggcgagauuucagaugcugcuuugucacuguucucuggcucauuuucacuuuaacauuaagcauauucacaaaguuuacugacacagucaagggaaagagcacccucuccacuguucugauaaacuucucauauuuuuacaaaaccaaaucaaacuguugacaguccaaaaaaaaaaaaucaaauaugcagaaaugguaugguaccucaucuucauggagaguaugcuaguaguuuacuauaaacccaagccagagguucaacccacacuucugccucugaccuacuacuucaaauuuuggaauuuuucgucucuuauacuucguucucuaugaauaaaagugagaauaugucuaauacagauaauagaaauuauugaccuaguaacuuaacaaacugguugacaaguuuucuuugaauuuauuuauuuuaacuuuaguucuuuuuaaaaaucaaauauagguuugcuuuagucuuacuuacaugaaaacuauuucucaagauaaacauguuuauugaaaucuaaauauggaauccauuuucauuuaucagcuaaguaggauaugauauaauuggugcugcaugcuugcuuaauauaauagcuacaucuugauuuaauugaauuuaaaauuaaaaacacaauauaguacauuuuuuguaugguaaaacuugcauuuuuagagccaaagguuaaacggacagaagacucucuaaaaaagaauaauucucauucuagaguuuugagguacuaauauuccccauuaccagcuaguuuugugacccuggaagaauacuuaucuguuguuugcuuucuaaaaugagaaggucacuaaaaucucuuuaaguuuugguaagcaguauuguguuuaaauuaauauuuuaagggucauauuuuauuuucuguuuucucauuggaaauuuuuuuucacacaauacauucugauuaugguuccccuucuccugacucuucccagauccuccucacaguccucccaaaucucuaucaccucaaaggccagagagagaaaaagaauaagauaaaguuagaacaaacuucauaagauaaaacaaaugaacagaaaaacaaaggccaauaaaaagugcaagauacauacauacauaguuaguuacauagguacauacauagauacauaguuguagagauacauuuauuggcaugcauaaaaauccccuaaacacaaaacuggaaaccauaauaugaaagcaaaagacuuuuagggaaagaaaaaaaauauccaaaucauuauaugaccaaaaaccuucccaaaaagccauugaauucuuuuuguguuggccaucuacugcuuaagaauggugaggccagccuggucuacaaagugaguuccaggacagccaggacuucacagagaaacccugucuugaaaaacaaaaaacaacaacaacaaaaagaaugguguuuauucccaguaagauuccauuagagaaaaccaaauuuuucauuuguaagcaguuagggaacuuguguccacuuccacucugggagcugggaucacaucagguccagacgugucaggucuugagcacguugucacaguuucuuugaguuacguguguugauccuguuuagaaggcuuuguuucuuugguguucuccauucccguugguucuuacaauuuuucugucucuuuuucagcagaguucccugagggaaggguuuugauagagagauccuauuuaggaccaaguuucccaagguaucuugcucucugcacccugugcaauuaucucuugauuuauucccauuuacugcaggaggaagcucuugcagugcaagacauugaucucuaaguauagaagaauaucagaaguuauuuugucgcuguguucuuuuaagaacaguaguguuugguuuucuccuagguucucgaccuaucuacucucagguuuagccacccaaacaguguccaguauggauucuaucuuagggaguaggccuuagaucaaaucagauauugguugguuacuccuauaguuuugaaucauuauugcacaguaucuugcaugcaggacaccauuguaacucaaaggauuuguaacuggguugauguuuacaguuuuucccuuuuguugcagaauacguuccaguuccaugaacacuacuagucaguaaggaugacggcuguguguguaggaaucagcuuuacuucuccauguucauugaguuuuuaccucuucuucaauaguaggguuuuacuaucaguuuguagauagcaaccaauagucuugucaguagccuggguuguuuaggguuucccaugggaccauuuugacaacaccuugauuagauguaaccuauuacuggguuugguagcuucauuuguugauaguagaugcccuguuagggcucugucucccccauuauuugauuggcgaguccauucagauaacauuuguauauguauauauuuuaggaagcuucuaauauauuagguugccauacacucacucucucaaaugguucuuaguuuuagcuguuccuuccuauauucccuccuuuuuacccugacuuaccuuccacuucaguuugaugcucucacuccagucccagugucuuccaucuacaacuauccuauuuuccuuccuagggugaucuuguucuaccccaaauccuuuaaccuauaccuaacaaccuagcugcuuaucaaagauagaacagcuuguauccauauauaagcaaauauaugucauauuuguuuuucauaauuuauuuucuuaggaacugaugugcuucacacuuuucagaacuaaauaacuguugacaaauaacacaaguauuaagagucaaguuguagacgguugguacacugcuuccuaagcauacauaaggcccuccauuccauccuaugugcuaucaucuccuuguaggauaggggugggaggcaugaaauuuaaaacuuccugcuauaugcaaaagaacauccuuuugaggaauuuuuuaaaaaauuuauuaaauauuuucuucauuuacauuucaaaugcuaucccaaaaguuuccuauacccucucccugcccugcuccccuacccacucacucccacuucuuggcccuggcauuccccuguacuggggcguguaaaguuugcaagaccaagggaccucucuucccaaugauggccaacuaggccaucuucugcuacauaugcagcuagagacacgagcucuggggguacugguuaguucauauuguuguuccaccuauaggguugcagaccccuucagcuccuuggguacuuucucuagcuccuccauugggggcccuauguuccauccaauagaugacugugagcauccacuucuguauuugccaggcacuggcauagccucacaagagacagcuauaucaggguccuuucagcaaaaucuugcugauauaugcaauagugucugcauuuggcugauuaugggauggaccccuggguggggcagucucuggaugguccauccuuucguccuuugaggaauuuauaaaggcacacuuugugcugggcauugguggcauacagcuuuaaucccaggacuugggaggcagaggcagguggauuucugaguucgagggcagccugcucuacagagugaguuccaggacagccagggcgacacagagaaacccuguccugaaaaaccaaaaauaaaauaaaauaaaauaaaauaaaauaaaauaaaauaaaggcacacuuuuguuuaagcaaggguagugaguaccuuauuauaaaugauguauuuugaauuuuuuuguuuuaaggugguguaguucaggauugccuagaucccaauauuauccugccuuagcauuuuaggagcuggaauugcaggugcaugguucauugauacugucuuuuuaaaccuacauucaccuuaugacuaauaaaauugagcauguuuucauucauuuaguacuuccuugguguguugacaauuguaugacaauugaaauaaacaugaacaaucuugggcuggguguguagcacugugauaguauguuacacacacacacacacacacacacacacacacacacacacacuuacacacacacacacacacacacacacacacacauucacgcaugcguggacacacauacucacaccuuucucaugaucagaaagaagauuuuaaauaaaggcccauuggacuugcaaaauaugccccaguacaggggaacgccagggccaaaaagggggaguggguggguagagaaguggggggguggguaugggggacuuuugggauagcauugggaaauguaaaugaggaaaauaccuaauaaaaauaaagauauuaucuaaaccauuugacauaucuucuagagcuauauuugaugaauucugaaauauuuuuuauacuuuuuauuuuuaauuuuuguauuuuauuuauuuauuuacauuccagauuuuaacccccccccccuccaguccacccuccaaguguuccaccaucucauaucuccuccccaaugccuugucuccucgaggaugcccucacccaaccagaucucuaaacucccuggggccuccagucuuuugagaguuaggugcuucuucucugauugaacccagacucugcaguccucugcuggauauguguugggugaccucauaucaucuggugaauacugccuguuuugugguccaguaucugagagaucucagggguccagguuaauugagacugcugguccuccuacaggguccccuccuccucagcuucuuacagccauaggggucuguagcuucuguccauuggucugcugcaaauaucagacucagcuguuuguuggguucuuuggagggcagucgugauaggucucucuuugugaacgcuucauagccucaguaauagugucaggccuuggaccuccccuugagcuggaucccacuuugggccugucucuggaccuucuuuuccucaggcuccucugcauuuccaucccugcaguucuuucagacaggaacaauuaugggucagaguuuugacugugggauagcaacccccucccucacuugauguacugucuuccugcuggagguggacucuauaaguucccucucccuacuguuugacauuucaucuaaggucccucccuuugaguccugagagucucucaucucccaggucucuugcauucuggaggguccucccaaccuccuaccuccugaaguugccuguuuccauucuuucugcuggcccucagggcuucaguccuuuucucucccucccuccuccuugugauuguuuucuucccccucccauuugggacugagguguccugacuugggcccuucagcuauuugaccuuugugaguucuguggacuauauauuagguguucuguacuucuuuuuucucucuucuuucuuucuuucuuucuuucuuucuuucuuucuuucuuucuuucuuccuuuuuuucuaauaucuacuuauuagugaguacauaugaugcguguccuuuugggucugaguuaccucagucaggaugauauuuucuaguuccaucuauuagccugcaaagcucaggauguucacguucuucauagcugaguacuauuccgcuguguaaaugaaccaccuuuucuguauccauucuucugucaugggacaucuggguuguuuccagcuucuggcuaucacaaacaaggucgcugugaacauaguggaacaugugcccauguggcauggugggacaucuguuggguauauuccuaagagugguauagcuggaucuucagguagaucuauuuccauuuuucgaggaacuuccagauugauuuccagagugguugugcaaguuugcaaucucaccagcaauggaggagaauuccucuuuuuuccacauccucaccaacauguguugucaccugaggguuuaaucuuagccauucugaaugcagcuauucuuuauauuucaaacaguauuaaugucaaugaccuuaugugcuacuaagauuagguauucauaugugauuugaagaaaagcuaacaauguauuuuaaacaaaugacaacucuuuuccuacuagaaaaaaauagacauuguagaucauguuuuaaaagaugaugugccuaacuaauuuauugguucuggucaauuucaaacguaugucuuaacaguuucagauuuccuugggcagcauuguugaccuauguuucugguguaaaagcucacauucccauuugcucuuaucuuuucuagcuucuuauguaauggagcaugaaugguagcacuagcuucugaucaagggcugugugaauacacauaucguguggcacuuggcagcauuuaaagcugguguaccuucucccugacaucuugcacagugaacuuguuaguauuccagcagucaugacuaagugaccuacuauaguuucauuucuuuaaaggaucuaugauauauuuuugaaaggauacccuagagcccuuaaaauuauguugugcccaugauuucuugugauuagaguccuuaagggguaggguuugaagaauauccuuaggaggaggaguagaucugugaaaauaagaaaaaggucagcaguuugauugcuauauuagcuaaagagaaauauccaauauguaucugauuauuaaagauuauauuuagucuuuaugaaaucucauaguuuucauaacuaauguaguuuuaacugugaauuugccuuuuaauuauucuugguuuagaagauuaucaguuucagugaggcaugugacguagacuucagaggauuauuaaguaacaauaauuuaccaaauuguguugguaaauauuuuuugaacauugagaccgagaguucagcccaauugacaugaaagauacuuaagaaagggaaguuccuuuuauuuuacaauuucucuuuuuaguacuuuuucuaaaauauuaguguuuaaaaauuuaauuuguguuuuuucuugucuuaauuuuguucuagaaagaaaugacagaaccuaaaauaaacugaguuaguaauaaaguaagaaguagcuuauguugcaucauagcugcuacuucccuuauacuaaggcauuuaaccaacuguaguagaaaacauugaaaugugagauuguuagcauuuaaaacggugacugaauagggcaaaauugguuaagaaguugaaauaaacaugaauauaugaugaguacgggggauacuggcugugggugauuugcaaagccccaaaaauuauugaugaaaguaauaugcagcaccuucauuuucugucuauuguacgaauugguugguuggguuauuaacuucccugucauuauuaacaagugguuauuuacuuguaaguuuuucuuguuguugguuuuuugcuuguuuguuucuguuuugaguuaagggcugacuaggcagcccaggcuggccugaaacucaagaucuuguuuccucauaaugcucaguacagguaugugccaccaugcccaguuugagucuuauuuuuagggaaaaauaauugaaguauaugucauagaauuaucacuauuuaaaaaaaucagagaauuuuaauguaagaaaaaagaauguauuuuaguaaauauuaaauucaugcuuguguaaaugguugauccgguacauuugcauaauauugguucauuuguuuugagggaaagauacagaaacauaaaagaaacaaauauugguuucaaagacuaacaacacuucuacaaguaugcaaguuuauguuauacaguagaccaacaugaaauacuaagucucugaagaacuaagcuggaguuuaucgugcucguucucuuuaggacuauuagaaacauguaguuagauaugugauaaaguuaacauuauugauagaaauuucucugaugaagagauaagauuugcuuuaagaacacauuuuuagagcuggaacaggcauuugacugagacgguuucucuugaauuuuguaucuuagaacuuaacauuaaacaugcacagagggcauucauagaaguauugggguucccgaaagauugcuggccuucuaaaagacuauuaaguacaauaugaagaguaaagauggagcucagaaggcauuugcccucucuuugcucugcaugccugaaaaagcauauagucuagaacccuauaugguuuauauuugcuuccauacuuaccuaccaucaaguuuaacuaugaaauuuagaauaguaaaagaguagugacgguaacgaaaacuagaccauuucuaauaauguacagugguauguaaacauggugucuuucccauaaaauacccacuuaaagugucuaucaauguuccugugauaaugggaugcgucugaugagauaaauuuaaaguaaaaugacuauuagagaaauuacaagcauuaggcuauugaaggauuacuugaauacagguacucugauaccacagcaauguaacuaccaacugagacagcuaccaaguaucugaugggucuauagugugaauacaauggggaaagaaaaggacgguucauauccuggguuucugaagcagaugguggaagauuucaucaugcuaaucagaacagaacaaaauuuaucaacucuuuauuucuuuuugauaugccagacuguuacugaccaugggccacugaaacugcauggaacgugaaaccauguguaagggcaucagcuguacuucaauaacaguuaaauuggagguuuuagugugagagccaagucaccuguugaauugcagaauuaggcagucucuccagcacauuucaggcuauucgagcaggguaauagaauagaguacaaagauugguaauuaccuuugcaaauaauaugguuuuuaaaugaaauugcagcuacucgucucucugacugcugugcaagaaaauagccauggacaguaugcagaguaaaggugugucuguguuccaguaagacuuuaccuagaaagaaguuuccagguucuagcaguuuacugugcccuucauacuggaggaauggcaauuuuuuuccuacaauucauuccuuucaaaaggaagaaaagacuuucauaucaagauauuuuuuuccaaauuuauuccccagaauuagaaugaguaaaggcauaggaaucuggaaugaaacgacucuucuuauguagaguagggagagagcuuuccuuaguaguuacugaggaaguuucucugaucaucaucaagagcacggauuaugcucuuccuguggccuguaggaguaggagcauaaugcuauuuuuguacugaacauuucaacuuugaguuucaaugcugugguaauuuggcaguuucccuuguguguaguuuauuuuuaguuaagugauaguaaaacauauagugaacuuuuaggaagaaauuacaagaaggaaaaauugaaccuccaaacucuaaagcagaguuaaagcauaguaaacaaauccauagaaguugaauugacauugggcaugucaacaagagacagauuaauucucagugacaaugcuucucuuccugguacuuguggucacauguucagcacacuaaaagaagcugagaucauuuguaagauugauucaguuaugaguaccuagagaaugcuuuuccccacucucauaaaagcauggaugugguacugagcaagaauaacauaguuccugaccuuccaaagagauaacuaguauguuaucuaucuaagagagugguuucuaaacuaagagcuaaagaaugagcuggcucuggccuguugauagagacagguaagaggagaguuauguggaaccgacaguaaaaaagggcaggguggacagagcucaucaugacccagcucuggaagaaacauuguauaaagaggaaaugugcagcuauugaagcuggaaaaggaagauuuccuaugcuaggagaucuuaaguguuugaauuuugccaggagauuaauggaaaguagugaaaaaucuuuuaaguuguaagguaauguaaguaauguuuacuuguaaguauguugagacugguuuggaagaggaguauuaaagagccauauuguccagcaagggaguuaugagcuaaccaguguggcuaagaaauaauuuuagauuuuauuuuaaaauuuucuaauuuaaaaauuggaacaaguuaaaaauauauuuccauuugaauaguuuuugaguagguugacauguuucaucggaugcuggaaauuuucuaucugagguaggcugugcuguaaguguaaaaggcacaauagauuuugaguucauugugugaaaaaaguaaaauauuuuucugugagugcuuguugaagucauauuuuguauauauuugauuaaacaugacucaauuuaaucucaucugacaccuuuugcuagcucaaauaucucuggcuuuuagaagcuuugaaauuauguuuaucuuugacaguauauauugguagccagcagucaucuuagaagcuuucccaagaggccaguaagguagcauuauguuccaugcaggggcuguggcagcuggguaaggaagauuucuaagagaaccaucaaggaacuaaaauugauaagaugugacauuuaaguaagagaauuacugcucaauuggugguauggaagaaaacagcagccucaguucucuaaaauaugaggaaaugaauaguaacugaauagaaaauucaaauguguaagcaaaaguuauaaacaucacauuucauugacaauuugugcucagaaguucaauaauuauacaacuggacuuuauuuugaguuuuguucacaauugcuauguggaaguacuuucuauuacuugguucuuuaguuauguaauuuuccauuuuuuuagauuguaggugaucagcagauuuacaauuuaaugguuuauugucuguuucuuugucacuauuuauucaccuccuuuaaguaaauaguaggguuggaggucuuuaauaauaugggaucuauaucuaccuauauuuuuauuugagauuaaacuuauuucuguuuaaaagagaggguacucuguuuuuauaugauuuauuagauccuuauuuaaaguugaaucucugagguaucugaugcugguugaauguuuaguacuuuguguugucaaccuaagaaaugagaugcuucacucucugcaauuucuagucuuuuaagcuuauaaaaguagucaagacaguuuguugacccccaaggagaccuuuuagucuuuggcuuguuagacaacaaggccuguacucuucauuggcauucagaucacaggcagccauugggcucaguucacagccaagcacagcuuugggauuuagacaaagccacccuggcaaaggaacccaguugucaggguagcuggcuggauuguaaggacuguugcauaauggagagaccaaguagaacuauuaggaugcaaaugugaaaaaaaugguggugcuaaccugcaaaaacaaacauuucuuuuuuuuggugaagaguauucauuguugcuuucuucuguuuaacuucucugggccuuagauguaguuggaguguauuaguuuaucuuaaucucuguccauaaugcuaaucuacauuuagaaucaacagcuaauuugugugaagagaccaaaggacuucacuguuuguguucuuuucauaauauacaaauauguccugggccaguuuuauauguuguuuauucuagguugggaaaagaaaucaauccuuuuugcuguugauauuguuauauuuauaacaaguuauuuguaucauuuccaccuuguaauuucugaugguggccucuuaguugucuuauacauaguguagcaucaugauagauguuaggaauaaugcuauuaaauucuuaguacaguaagacaauuuuauuuuaauacuauuugaaggaaauaugcccuuucucacuucucaguuuuguuccuuucuguauugauugccagcuuugcuuuccuuuuuuuuccucccuaccucuuuaucuucaggaaaauauaaugcuaucugugcuuugguaaaugcuguguuagaaaauugggaaugugaaaaaugggaaagguguuuuuuaaagccagagucagagaacagcaguaguggccaugcuuuauugaauaguuguguguuacuuuguaaauuuucucauuugacuccuaagcacugccuuaugagguauagaucgagcccccauuuuacaaaugaguauacugagucaaagagaagcaaaaugguuuguucaagcuuacaguuuuguuuacaagaaaaccaagaaaaacuuugaggaucuuggaauguuaaucugauugaaaggaaauagucuuggagaaaugugaaugagagcaggaccaaaggacaggacagcacaaagggaaucccacaccugccugaaagacuggggaggccacugcuguguguucagauaguuuccauaugcuguucaguuguucauaaguucauugacuuggcucaucuaaagggucuuggagguugauuuaaaaguagaugaauuuuuaguauuugauaccucuuugguuucagguggucagaucuuugacguucuuuuagaaguuacacuucuauuucuuugucuuagcuuuuaugcuuuucaaggcuucuaccuuauuaaaaguugucuuguauuacuguuuuuucuuuuuuuuaaguugaaauugugguuauuuuuauuauauguacaguuucugagucacuggaacauuuuuaucccuccaauuaucuccuuuauaccuauuuuucauaucccuuccacagcgucggccccagagagccucuuaugucuuacucuuaugucuguaguuuucgauccucugaaaguuccauacucacauaaccacacccacugugugaucuuauacacugcacacuugcaggaaucgcuuuuuuucuucuucugagugauaggccauauuacugguauaccacuuacuguuuuuucuauccuuguucugcuuagcugucaaaacaccuuugaccaaaaaaugcuaucacuguugguuuuccagaaagucaaauacuagcugcuauuugaagcuuuuuguuuuguuugguuuuucuuugacaugaguuuauugaaagcugauucaggugauaugaaagaaaaauggggaggagcuugaguuuguguguguggggucaaaacaugauagaaagaaaagagggauaaauaaugcugaagauauuugaaaaagccacagugaaucauaugauuuuauguuuaucaagaauuacauauaauauauguguuuauuuaugcauauaguuuaaaugaaguuauaauacauggaugaugauaucacacccaagggucauagguuaucuaacaaacucaggaccaggaaugggaaaucuccuuucgaguuguuggucagaggaguccaagagccacugugagcaauauaggcuguugcuguuacccaugauugcuucccaaaaauuggaggugcuuuccuauuacugaagacaacauacacuuuguacacaggacucagaggaauuaagcuggggaucuuaccuuaaggugcuaugcaagcuaccaaggauggaaagcaaucacuaccuaguugugguacccuugaaucacaaaagugaccccgcauggcaagauaucccuaaagguacaauaaugacacucauaucuuggugguaacuugugguaauuaaugggauucaaggccagcucaacagaaggaaaucaugguacuggaaauuuagacaacuauucaugccuagugagauuauagauuucauaggagaaccuacuugggagaaaagguggaaagagcgcaagagccagaggaccaggaaaucugcugugagacuguuucuugaauaaacaacaaggacacuguacccaugaggccucaagaacauagcugccuaaaccagaccugaauaaggacaccauuaacagaaaugcuaacauggaagagagcacucucauggacuccuccccagaugaggagcuacaggcauuagcuacagacuguucagagaaggaaaauaaguuuucuuuauggaugagccucccaauuacuuaucuaauaccaaguggucagcccuggaauaauauaauuagguacacacaagugacacuaaauggacucagcaaguuuuguguguguguauguauguauguauguguauguguguguacaauauggagcaauaagggucauuaggaguuagaggaaagggaagugacaaagauguaauuauauuuuaauuuaaaaauugcaaauauauaaaaaguuugauauuuaaaaauguuuuuaagugauugaauaacaugaucuuuuuuuaaaagaacuugcuaaguucuuuuuuuggguaaauaauaauauaggguuuugguuuacuuaugaucuuuguuguauaugccuucagucacuuauguauucaugaauauuuuuguugauaaaauacucucaagugcuggcuagguacagaugauacaguggcacacagagcugacaaaguccuggucuuagggucuugacaguaugucugucacuggauuggauucaugaguuucaauucugcuguauuuuacagauauuuauacuuuuuagguuguauauuaaugcauuagaaaaucuuugugguagaauuuauguuuguggucauauagaaaauucauuuggguacuuauauuuguuuguuaugguuagcuguuauacuuaaguguucuaaaauaaaccuuuauuucauucagcaguaugcuuucugcccuauccaugcuauguaauuauagugauaguuacugacaugccaugccuuuuaauugcuauaucuuguuucguuugauaaccaguaccucauuuacucaauacuauagaacuuaaacauauuuuuccuucaauucagucaacuacaauaauuucugucucuuccaaggcuauauaaaaccaauucuagaaaagcuuuaucuuuugacucaucaaugcaugguuuaaaaucaaaggucccaguuuuuccuucgguaauuuugauuugacuguuugcagaagguucuuguugaauuagaguugaguuggcuguuuucuuuugucauaccauaagauguaagucccaaccuggucauuuuacuuggaguguguggcuuggcauagcacaguagugaacagguaaaagcaaacaaaaguguaggaaagcagcuaauuauaguaauugcagcugguuucagaguacuccuaacaguuugugcaugcugcuugcuugaaagcaucaaaugggugcuaguugugaaauagaacaccuguuuguuguugagcauguguuuaugcagaugauuguuguugucaaagcaccuugauguagaguaguccuguuuacauuuacauucuccccaaaggauuaacaguguucucucaauaaauuugcagucuauucuccucucaaaggcugcuguuuggaggguggugugaaagaggcaacaagugcuugcuaaucacuugaauauacauaauuagcuacagucuggugcacuggagucuuuguaggacuccauaacaauauugauuggcaaaugcacagaacaauagcuguggcaucauauaguuguugagaguagugauugucuucuuauugguauuuauucuuuaauucauuugaacuuacauuuauuucauuauaagccccuuuuaugcuuuuuaaugaaccagcgugagauaucuagcaacucuguaaagucaccguuaauaauaauguuucauauuuauuuacuagggucugagauuguuauucaaaaacauauuugacauauuugguaauuccaaauaucgagagcuaucaaacuuguuggauaauucaacuuaauuccuagugaaaacuugcuuccuuucucacucugaccacacccauccauucaggcagcugucuugcucccauuaaaguuucaggcugaugguuccuaacuuacuugacuuucuacaaguuuaagugugguuuucuguuuucugaaaaacacccugauugcacugucagaccucagaaauucugaaauggcaguguuaguagagaggacaguuucuauacauagaaaaaaagccuguuuccuuuagcuuccaguauugcugacuaguuugccugagaauucugcaugaggcuggccacauucuuguuuauaaaacccaggugcagugugguauuuaucagaaugugacauuuaucagaaugugacauuugagauucuauaggacacaugaggggacaaauaaauggacaugacaugggguauaguuugugacugccaaguucaauaacauuguauucucucucuuuuuuuuuugaaaacugacucauauuuaaaugacgacugcuuuuuaucacaacuuuucuuuuccuuuuuauuuguuauuuauuuauuuuuauucuuuacucuuuuuuuuuuuuuuucaguucagacuuuauuccccuccagguccacacuccaacuguuccacauaccauaccuccccccaccuccaagaggauguccucacccccaccagaccuccccacuuccuggggccccaagucucuugaggguuaggugcaucuucucugacugaguccagaccaggcaguccucugcuguauauguguugggggcuucauaucagcugauguaugcuucaugguugguggcuuagugucugagagaucacagggguacagguuaguugagacugcuagucuuccuaugggcucgcccuccuccucagcuucuuucaacuuuuuccuaauucaaccauggaggacggagggcugucaccaguuucuguccauugguugguuguaaauaucugcaucugacguuuucagcugcuuguugggccuuauuuuuaugcauuagaggagaaaucuacacagaccaccaaaacgacagucuguucagagcuugcauagggcagguaucaggaaacagcuuucccuauauuugaguuucagaaguccacagaugagaaagcuugacuguguggcaagggaauaccucauauguacucugugauuggaggcugugggcauggggcaggagaaauccuuaacuuucucucugaugaguucugaguugaaagcaugagcaagaucuaggaaagcuggcaguuuugcuuaggccuccaucaguuuaaacccuuugcucucuagugcuuguacuuugacugguucccagcugguugaguuuaaagggaugagugccugaaacaagcacuagcugcuugcuaggacauaggacaggugcacucuugugcuuucauuuuggcuugcaguggguaguuuuuaauguucugaagacuuaaauauaaaaauguaugcuaucaaaagaaauaauaccaagauguuuuuauuucucagacaaaucuguaaugcucucauucucacugagaaaacugaaaauaucuaugaagaaaauuauguuuuacauucaggauaagucauuaaugauuuuauuucuccaacuuuaguguguguauauaguuuugcauuuuugaaaucaaauauuuuguacugagaaccgaagucugguuuaaggucuaucauuacuuugugugugcauguguguguacauuuauauuugcuugaagaucauguugcaguucaggagucaaagaauuuuauaaacucuugauaauguucaggaaauguuugauggauguuuccagaaguuucuacaaugaacagucaaaucauuugcugggguuauauguucugaaacaguaaaguuguauugauauauacaguaaguuguucagggauuuaauaguuucagucuaccguguucaaacugugauuucccuuaaacuguugauauuauagaaugauauaucaccauguuaagauggaauuucacaacuuuuauuaaagaaauugaguugaguuccaugaccuagauuaacuuuguggcuaacaaauccguauuggaauuuuuaaaauuucguuugugugucuaugguuguuggaguagggauguauucacaugccuauauacaugaagugauggagccagaaaaggauguuggguauuuauuaauuuagucauacuccuuugagacagggucucucacugaaccuagaguguauguaguggccagaaaacuaguagucacucuaucuccagacuugggguuauaggcaaauauggucaggccccccuuuuauuaacauaggugaguggcauccaaacucagggccuccugcuuguguaacuuuuuucuccaccacucuagccccaucgcauucauucucuccuuacaccagaugcggauagauuuugaguuugauauuuauacauuucuuaggauauauuuuuuuaauuuucuaaaaauaccaugaaauacaaggguagcaguucuuuuuuuuuuuguggaugaaaaagaaguugagagcuucauaaguucugaauauuucuacacuguucuuugaagaauagaguuuucaaauuuaaucuuuugauguauguuauaaauaaaucacgaauacuuauacuaauaaaccuaauguuacaaucuugccuugauuugauauugguagaauguguugaagaauguuaaauguuuggguaaagcagauucuuuuuaaauucuguuucuaugucuaaugcauauuuaucccuauuuucauaaggauuucccagcggauuuccuaccuuuaagagcugggugaaauaucauuauauaaaagagcaugguuuuggccgggugaugguggcacacaccuuuaaucccagcacaugggaggcagaggcaggcggauuucugaguucgaggccagccuggucuacagagugaguuccaggacagucagagcuauacagagaaacccugucucgaaaaaauaaaaaaacaaaaaagaaaagaaaugaaacgaaaaagaaaagaaagagcugagugaauaacaagggaggacuaauaagacuuuuuagaccuugcccccuaguuuuuuuucuucucauuuauuuugguaacucuuuggcuauaggauuguuaggcuuggguugagaaagagaauauugguugauaagacuggaaaaccacaguauguuucuuaauaaauugaagcucauuauuuugagaaauuauacuuguaaauuauaaaaauugaacuuagauagaacuaaguaaccauauugaauaaaugacauauuuuuagguugcuauauguuuuuuuuaaacuucuuuuucuuuuuaaaguuuuauuuauauuuauuuauuuauuauauguaaguacauuguagcugucuucagacacaccagaagagggcaucagaucucauuacgggugguugugagccaccaugugcuugcugagauuugaacuucagaccuucggaagagcagucgggugcucuuacccacugagccaucucaccagccccagguugcuauauguguugaguuuauauuuguaaaacauuucuagguuuaguacuuguuugaaaugauuuuaaaaauuauacacaguuuuuaaaaauuauuauauuuaacuuaauuaucaucuaauaugaacauaaucaguaccugccugauauugcucuguuuaaucacacauaaccaccuuucuuuuugcauugauccuaagacuuugaaaauuauauacuuacggguuuuuaguauuuguaaaauuauuuaaauaaaauaagccaaauuuuuagguaaacauauacuuaaaaauauuuaaauaagaaaagcuuuucauaauaaauagguacugccucuucacauucuuuaaaccaguuuugaaauauuucuuuuagcuguauuauauggucccuuuuauuaauauugcuaaaucauauaggucaguuacuuauuuauauuacuuuuaaaaaggggacuuuggaagaauuacauauauuugagcuucauauucagaaaugcacaaugcucuucaaaaggaaggcacagauacaugaucucuucacugucucauuuaguugucauggaauacccagcuucuuuggucaugucuucacucguaacccuuagaaauuccaugugcuguuaguaauguccuugcuguagggugucauucuucucucugaaguguagauaaaacuaacugagguucacugagcuguuaaucuaauaggcacaucaccuuuucucaaagaauggcauggcacuucuuuccccuaucccuucaaaaguagcacuaugcguccauggauuuaacugauagaguauucuuucccaucuucagaagguaguucacuaguuuugauuuguccccucaggaaaagaagaguucccuauggaacauuguuagcauuuuaucagaaguuuucuuagcacuccaguuuugcgacuuguguccaugacugccuuuccuguuauaaaaauaacuuagaguaguacuuguuucucaucccgcuccaagcaugaccagagcauaguugaaugaguuuuaucuugaacccucuagaauauuauuagcuaauauuuucagcucgggauaauggaaggugagcauaaguaaucuuagucauuuauauaaaaauuugucucaauuuauuauagaaaugaguaaugauguauuuuaguugagaggaauuuauuuauaauuguuaaaaauagaauaauuuuucauaaaauauagaaaaguauccauuucuauaucaagacugauaaccucugaaaauuaccauauugauuuucauuuuuuuuuuuuuuuuugcuugauuacugaucgguuuaaauaagaauuuucuaugcauuaggccuacaaaacuaagaaauacaaucagcaggacuuguaacuuuuuuguaaaguauaaagaaguaguaaucugcauauucaauaaaggguuagauuuauuguuguuugaauuuccuccccuuccucaauuuuuucuugaaauuucuugucguuuguauugccuuagguuuugcuucuucccaguccuacugagaugcugaguacaaaccaaaagccuugcauauauuaggcaaauacucuuccacugucuuacuugcuuuguuuaccguguguaaaucugugguggguaucagggcccaauuucccucuccugucugacugagcaguaucacaaugaugcagaaaaauguucuuacauacaauaauguuuagaauuacuuacauguuuuaaaacuguuuuggauacuuggaaaauaagggauuauuuuacucuuucuauaaguguugaugagucucuacuuuuaaguauagggaucaaauccuuaaguuaauagaauuucaagaugagauauuuaaugcaauauagugaaugaguaagaauuucuguagaaaauuuaaucuggauucuucgaucuggagauggggggggcacugacugccuucuauuaaaacauagaaaagauaggcuuaaaucgaccuacaaccccuccuuccuuucuuugucaagaugugacagccaucuaugaauacugaugaauucaagaaaacuccuaagcuagacauuaucuugacaguugguggacagaugcuccuuauuugagugugagacugagguauucaaaaagcacuucaaaacacuccuaugccagccaacauuauuuucccuauauuaggauuuuuaagcuacuguguaauaguaauuauugauaaagcaccuaguuauagcuggauaaauuauuuagggcauuuuuuuguguguaugucuuuuuuuuuauuacaaauuuucuuuauuuacauuucaaaugucauuuccuucccuaguuuccccucugaaaaacccugucccuuccccccaaccccuugcucaccaacccacccagucccacuuccugaaccuucacaggaccaagggccucuccucccauugaugagagacuaggccauccucugcuacauaugcagcuggagcuaugaguccuaccauguguuuucuuugauuggugguuuagucccagggagcucuggggguacugguuaguucauauuauuguuccuccuauggggcugcaaaccccuucagccccuuggauacuuucucuaguuccaucauugggggcacugugcucuguccaauggauggcuaugagccuccacuucuguauuugucaggcacuggcagagccucucaggagacagcuguaucaggcuacugucagcagucucuuguuggcauccacaguauugucuggguuuggugguuguauaugagaugaauacccagguggggcagucucuggauggucauuccuucagucucugcuccacacuuugucucuguaacuccuuccauggguauuuuguucccccuucuaagaaggaccgacuuauccacacuuuagucuuccuuuuucuugaguuucauguguuuugcaaauuguaucuuggguauucugagcuucugggcugucuuagucaggguuucuauuccugcacaaacaucaugaccaagaaacaaguuggggaggaaagggauuauucaagcuugcauugccauacugcuauucaacaccaaggaagucaggacuggaacucaagcaggucagaaagcaggagcugaugcagaggccauggagggauguucuuuacugacuugcuuccccuggcuuucucagccugcuuucuuacagaaccaagacuaccagcccagggauggucccacccacaaggggccauucccccuugaucacuaauugagaaaaugccuuacagcuggaucucguggaggcauuuccucaagggaggcuccuuucucugugauaacuccagcuugugucaaguugacacaaaaccagccaguacaugggcuaauauccacuuaucagugagugcauaucauguguguucuuuugugauugggaugcucacucaagaugauauccuccagaucuauccauuugucuaagaauuucauaaauucauuguuuuuaauagcuguguaguacuccauuguguaaauauaccacguuuucuguauccauuccucuguugagggacaucuggguucuuuccagcuucuggcuauuauaaauaagauugcucugaacuuaguggagcauguguccuuauuacauguuggagcaucuucuggguauaugcccaggaauaaugguauugcuggauccuccaguaguacuauauccaauuuucugaggaacugccaaacugauuuucagaguggcuguaccagcuugcaaucccaucagcaauggaggaguguuccucuuucuccacacccuugccagcauuugcugucacuugaguuuuugaucuuagccauucugacugguuguuuugauuugcauuucucugaucacuaaggacuuuaacauuucuuuagguguuucucagccauucaggauucuucuguugggaauucuuggcuuaguucuauaccccauuuuugauuggguuguuugguuauuuguugguuagcuucuugaguuguuuguguauauuggauauuagcccccuauuggauuuaugauugguaaagaucuuuucucaaucuuuugguugccuuuuugucuuauugacaguguccuuugccuuacagaagcuucacaauuuuaugaggucuuauuuguuaauucuugaucuuacaguacaagucauugguauucuguucaggauuuuuuccccuguguccauccauaucuuagaggcucuuccccacuuucuccucuauacauuucagugucucugguuuuauguggaguuccuugauccacuuagauccgagcuuuguacaaggagauaagaaugaaucaauucgaauuuuucuauaagcuagccaccaguugagccagcaccauuuguugaauaugcugguuccccuuuuagcuccuuugucaaagaucaagugaccauagguguguggguucauuucugggucuucaauucuauuccauugaucuaccugucugucacuguaccaguaccauguaguuuuuaucacaauugcucuguaguacagcuugaggucagggauggugauuccaccagagguucuuuuauccuugagaauaguuuuugcuauucuagguuuuuuguuauuccaaaugaaucugcaaauugcccuuucuaaaucugugaagaauugaguuggaauuuugauggggauugcauucaaucuguuuauugcuuucagcaagauagccauuuuuacuauaauuaauccugccaauccaugagcaugggagaucuuuccaccuucugagaucuucuucgauuucuuucuucagagacuggaccaacauguaguuaccuuugaaaaguuucuuuagaucuuaaaacuaagaaacuaauaguuuacuuuuuaagaaaauagagggaauauauaucuuaaauauuuuccaauacauacuuuaaaugaaaauaacaaauguugaauaaaaaguaguuuugauaauuuugaaaauaguuacccaaggcuugggauguaggucccaugguaguauacuuggccagcauguaagaaacccugggcucaauuccguguaccauauuagugauggcauacaacuaugaucccugcacuugggagguacaagaugcaggaagaucccaaguucaaggucaucuucagcuauauagcauauucaaggcuagguuguaguacaggaaacacuuauuucuuucuuuuccauaugagaggacaaugaaaacaguuguccaaauuuaaucuuuucuacuacuuaggauauuuccucuuuaacuuagguuauaaacaauuccuuuauuauugcucacaucuaauguaauaagauauuagagguggcuugccauauuugucugucuguauaucugucuuucuuuuuuucuuuuucauuuuucgagacaggguuucucuguguaguccugacuguccuggaacucacucugcagaccaggcuggccuugaauuuagaaauccaccuaccucugccucccaagugcuaggauuaaaggcgugcaccaccacugccuggcccauacuugucugucuuagucaaagguuuauugaaggaaaaaaaucuuuacauaauauuucuauauuuagaaagauaguuuucuagugagauugggaaggucuucuaggguuguccauuuuguaauaucucugugugugggggggugagugugggugcgcgcaugugcgcguaagcgcacauguucccacauuguuuuacugaagugguuuguuauuacuguuuguaguaugaagacuuucuuugccuuuauugcauuucuuuauaugcacauguugugucaugugucuacaaagggacaugucugccacauuguguauauggaggucagaggacagcuuguagcauuuaauucucuccuuccaccacgugguuucugggaaucaauuucaagcugagaggccuggugacaaguacucuucccuccugggccaugcuuggcuguagguucuagucuaggaacauugcaaguuccugaaacuauuuaacauuacagguuuugagaggauauuuucuguaaaccaaauuuugguaauuauguuguaacaugaauauagacagaaaaugugccaaaauauaauaaaguucuuaauguuaaacauuuggcucaugagaauaacauaagaccugaccuuuuaaacuaugaaaauuuaaugacuagaaaauuaaaauuauuaauuauaaaaauguguuuagaaauuaguuaaaauguuuaauguuuagcuucuuagugauuuuaaguugaaaauugaaauuuauagacugccaagguuaccuuugucuggaaucuuuuuuuaaucauucauucauucauuuauuuauuuucacuaaagguuauauuccucucacugucuacccucugacaauuccacauccuauaccucuccugcuuccccccacauuuccaugaagauguccccagcccccacccaacuagaccucuaaaagccuuggggccuccagucucuuaagggguuaggugcaucuuuucugacugaacccagaccuggcaguucucugcuggauauguguugggggccucauaucaucagcugguguaugcuaccuguuugguggugcagugucugagagaucucagggguccagguuaauugagacuacugguccuccuacaggguccccuccuccucagcuucuuccagccuuucccuaauacagccauaggggucagcagcuucuguccauugguugggugcaaauaucagacucuuucagcugcuuguuggguccuuuggagggcagucgugauaggucccuuuuugugagugucccauagccucaguaauagugucaggccuuucgaccuccccuugagcuggaucccacuuugagccugucacuggaucuucuuuuccucaggcuccucugcauuuccaucccugcaguucuuucagacaggcacaauuaugggucagaguuuugacuaugggauggcaacccccucccucacuugaugcccugucuuccugcuggagguagacucuauaaauuuccucucccuacuguugggcauuucaucuaaggucccucccuuuguguccugagaguuucucaccucccaggucucugguguauucuagagaguuucccccaacacccuaccuccugaaguugccuguuuccauucuuucugcuagcccucagggcuuuaguccuuuugucuccccccuuccccaugugauuguuuucuucucccucccaugugggacugaguaauccugacuuggacccuucugcugguugaccuuugagaguucuguggacuguauaauggguauucugucuuuuuuuuuuuuuucuaauaucuacuuaugagugaguauauaugaugcauguccuuuugguucugaguuaccucagucaggaugauauuuucuaguuccaucuauuugccugcaaaacuuaugauguccuaguucuucauagcuggguacuauuccacuguguaaaugaacuacauguucuuuauccauucuucugucaugggacaucuagguuguuuccuccucugguuauaacaaacaaggcugcuaugaacauaguggaacaugugccccuguguccugguggggaaucuguaaucuuauuuuugauuuucuuuguccaacaucaacugaauauuuauguaauauuauacuaauaucuaugacuguaucauauaacucuaauacuauuugauucuaugaauauagauguaguuauagaaugucaucaaacggauacaacuagaauaauacaauuuacaagacuauucucuuacucuaauuugaggaauaauaaaaaguucaaauuauaagaguauugcuuaugagaauauuguugguaauuguauccauuuuaauagauuauuguaaauaccuuacgaauuuauaugcucacuuucugagauauagaccaauguuuuagaaauggcugaaacaacugggagguuauaaaaaguaaagaaggaaugacaggggcuauuagcaguuugauugguuccaaaucgccuuacccugucauguuuaucuguguuguaacuuucaaggauauucauacuuagaaauaguaucucuuuaguugguuucauuuuuaaauuaaggcaguuuuaugauuauuuccaaauccguaguuuuacgucaaguccgauugggacucuaggauaaaaauauuguuaaauuuuauguaauauuguaaaaaaugauuauauuuaauuuuauaucuguuuugacauuaaugauuuaauacuuauauugaaauuucuuuuuaauaguuacuuuauguauaaauuuugucuguaguagaaauauuuagaagagacuguucuuucucucucucucccugcuucccuccuaaauaugcguaacacaaaauauaucauuuuaguauguuuuaaacauacagcugcuuuuauuucuuauuugucauaaagaaauuaagaaugagucuagagacuuacaguuuauauuaguauagccaggauugccuagucauucacuaaguccauuuguaucaacuauuuuacuuuaaaaccuuacuuuuucacaguuuaugcuaucuuccaggcauugggaaguuauaguuguuaugcugaguuguagcuacugaaaauugagcaaagauaauagauauuuccucuaaucuuggcucauaggcaacucccauguuuaauucucuuuguauuuuucccuucugaaugcaaucagaaaacuaaggagauguuggagccucuaagaaggucaaguguauguacucugagucauuaugugggguacaugauggcucacugaacaggaugaucuguuuucaccucaccugagccaaaaauuugugcuaaaccacuaagguguuuuguuagucagacuuugucacuguaacacuuaccugaaagaacaacuuagcggguaaaacauuuaauauaucucacuuuuuaagaggcuuucuuaguccauggcuaaaugaaugcauugcucuuggccccaugugaaacagaauacuauggcaggagcaugaaguagaggguguuucuucaugacacauauacagguagcaaggagaagaaaggacacuuauaagauagacuuuuucaguguauaccgcaaggcuuguuuaaguagccccaccucuuaaggcucaaauucugccaguaaugaaugccauuauaauauauauauuuugaaaagaauuagaccauugauaaagucugagccacucacuuccuaagacccaucacguggcagccaaguccacuguacuugaucuucuuuaaacacauuuaauauucaaucauaauacucaugauuuaacuccuuuagcagcuggcauucacuucauuaauucauucaacaguacuuagaaaaaaaauacauuacucaaaaguaguuuuuacauguuuagaauggaauguagaauugagaaaacaaauuugaauuaggaaguaagaaauuguguguggccccauuaauaggaggagucaaguggaaguuaaugacaaaaaaugaaggauagugagaaaaaguuguaugcugugcugaagaauugguuuuagaaaaccuuagaaguaaugagugcuguacacucauaggagaacaauauuuuagaguugauaaggugggauauuaugaauaaaaaucuagucucuaagaauuauauagauuuuauacacuuggcucuuaaauuuggaauuugucauauucuacauaaaauuugcaagaauaaguuuugcuuauuaugaugacaaugagcacauuugugauacucggaaaauauggaauggcugauggguaaaggaacagagcuguaaucccggaguguaggcugaaauuucgucucauuacuagaguuauuucucuauucagcuauucuucaagguaaaugaaugaguuccaauuacuguuuuauauguauauaaaguagaauagcuugcauucuuaugccauaacauaggcaguauuuaucuuguauuuugaauauauaaaauauucaaaagaguauuuaaaaauuaaucagcuuauuuugcuaguauuauuauugaaguuuauagaauuuaaacuuuugggccucagaauuggauuuuaucaaauauuaaaaguggaaaaauaaaacguuguauguuagguugcuuuuaagaaaaaaagcaaauuuguaaauuuggguuuguaauuuuguaaacucagaaguuuugaugcaauaaugauggaauaauuuugcuaaccaaaauuuaaauacuuggcaaaauuauuguaaaucaaguauaugugaacguuugggauugcuauuuuuugucagguggagucauucuucccacuuccaguauucuaauaggcuuuuuucuuugaaaauugaaauucauacauacuuuuaaggucuccagugggucccauaccucgccugagcagcacaguagagcugacccugguauguguuaggcaaggugagccaaccccacagcacacuggauagcuggcucccuccuguccuuccuagugugagagagugcaggauaaugagagugcuggccccaccacucaccugggcaaagcuagagagcugccucugcugccacaggcauaggaaaguuggccagcugaccaacucagcuuccaccuaggcccagauucaggucucugaguagguccaccucuauacuuaccccaucucugaacugcuagagcacauaaagggacuaguccuacagauccaaagcugcaguaacuccaugacacagggcaacaggacauccaaggugaguuccagugauaaucaaguauugaaaguguguuagaaucaauaugaacuaaccaguaccaccagagcucccugggacuaaaccaccaaccaaagaaaacacauggagggacucacggcucuagcugcauauguagcggaggauggccuaguuggucaucaaugggaggagaggcccuugguccuaugaugguucuaugccccaguguaggggaaugccaggggccaggaagcgggaguguguggguuggggagcagggggaggaagaggggauaggagauuuuuggaggggaaacuaggaaagggguuaacauuuaaaauguaaauaaagaaaauaucuuaaaaaaaaaaaaagaaaggaaagaaagaaaauguuagaagccagaggccucaaacaggagcaaugacucauugcaauaaacauuugcaauaaggcuguuuggguaaaaaaaaggauacugugugggacacugcaacauaccacagcuuccauggaaaaauuuauuuuuuauuuuuaauuuuuugguuuuuuuagggggauugcaaggaccaaggauggauauaaaggaccagauagacgagugagauuggggauaugaugugaaauucacaaaaaucaauaaaaaguuaaacaaauagaccagauucuucuuacaaauguauaguacuguuaacaguaagauuauaaaauaaauuguaauuauauugcaaucacuuguauacuacuucuacaauauuaauguuuuuuucugaacauuuuaugugaagaacucagaaguacaaaagacauguuauauuuuagaauaaugaaugauauacucaaauuuguccugcuuggaugcuuuaguaguucucaugaaacacauauaguugggccuuuguuacuaauacaguuaaugauuuauguggcaaagccuuuuuauuaguaguaaauuuuccaacugcuaagaugaacccaauaacacaacuagaaaucuguucaaucccuuuucccauaauuuuuacauuucuucuaauuccaacugucccaccccuuuucuuuuuuucuuuuuuuuuucuuuuuuucuuagauauuuuuuucauuuacauuucaaaugcuauccugaaaguccccuauacucucccccugcccugcuccccaaccuacccacuccugcuuccuggcccuggcauuccccuguacuggggcauaugaucuucccaagaccaaggacgucuccucccauugauauccgacuaggccauccucugcuacauaugcaacuagagacacaguucugugggguacugguuaguucagauuguugauccuucuaugggguugccgaccccuucagcuccuuggguauuuucucuagcugcuucuuuaggggcccuguguuucauccaauagaugacugugagccuccacuucuguauuugccaggcacuggcauagccucagaagagagggcuauaucaggaucuggucagcaaaaucuugcugacauaaguaauagugucuggguuugucccaucccuuuucuuaccuguguaucuuugauuugucagugauuauugcuucauucaagcuuagcccuuucuaggggaaguuggcuaacuuacuaguccugugauuuagguagauuugucugucccuagacaaacugaaccauagacaauugacccaacaacucucggaaggacggguguguagaacacuaaaguagcuuagagaagaaguaaaacuagcauuuuggguaggauuuccagaagggucagacaaucauuuaaugauggaauaaaaaccucagagcaaguuuggaguugguggugaagagcuugugacuagagaauucauggacagaugcaacuggccugggggacgaaugagagacagacaaggaaagugauggacaucagaucucacagagccccagagaagacaaugggaucuuuucuaucacuuuccauaucucacuuacaggaaguuggcucuauacugccacauagugcaucccauuccuugaguaguguguuuccuuacaaugaauagcucaucauugcuaucuguggucaucaucaguagcuauuguuguuaguccacauccuccuccuccucaugaucaaaaguacugaaagagcaguaagguuaaaggcaaaacaggguagaucucugauaagaggccggccagcuuugggcacuguuuacguuggacuuuuuucuucucguuaguuuaugucauauuauacuaagcuuuuuuuugacuucugagucuuucaguaugagaguuugugauagauaugcuaauugcuuaauuugccucuuaauaaaagguaaacauuuuuaguauacugguaccuuguucaaaauucuacucuggaagucagugugaauguuaacuuucuugcauuacaaagccuuacauaugcauuuaucaauauuguuaacaaaccaauagaccacugcauucuuaccuaaguacuuugucacagugaggaacaaauauuuuaagaguaguaccccacauauuauaaauuguguuuggauuuguacaccacaugaagacuuuauuuauauuuaauaugagcucuuagguauacauuaagguaagucaaaauuaaaauguuuuuuauaguuauguccuuugaaaauuucucucaacauuguucuuuauaauguuuguccuccuuuaucccugugguaaagggugucacacauuucuuacaugaagggcacauucuccuuaaaauguuaucuggucucuugacaaacauuuagcaaaagcuuugaaaguagacaaugaaauuuggaaguuuuugucauucucaaaauguaaaacagcuuuagguaguuuagaaauggauagauuuaccuacaaaccuuugaucagauucuggagccucaguguuucagaagccauacucaucauuaucccauuaaaauuucagagcuggcuuucaauuuagguuuuauaccuaauuggagcuuucagccuuuaaauauacuccuaaccugacuuuuuuuaaaaaaaaaguuaagccaaacucuugcuuuuuaucucuaugugggugaugagaucagucacuuuuuauuacaaggauauuuuuauuauggaaaauggacaaaauuacgucguaugucucuuucauauauacaaagauaaacuugggcuagugagaugaccuagugaguuaaagagcuuaccaccaaaccugauagccugugaaaacagaacuuauuauuuauuuccacauguuguuuucuguccaccacacgcuaccccaaaguaaauaaguauaagauaaauuaaacaaacaaaaaagccuuuacaaaaaaaauguaaccucaaaacaaaaugcuuucaacuuauauaguagaagauauuuuuuaauuauuuauuuacuuuuuuuuucuuuuuuacacuccagauuauauuccucucccgauccacccgguccacccucucccacuguugcacaucucauaccuccucccaccacccccugucucuucaaggauguccacacccuccagcccucucugaaccgaaccagaccucuaaaacucccuggggccuccagucucuugaggguuaggugcaucuucucugacugaacccaaacucugcaguccucugcugaauauguguugagggcuucauaucagcugguauauauugccuguuuggugguccaguguuugagagaucucagggguccagguuaauugagacugcugguccuccuacaggguccccuccuucucagcuucuuccagcauuucccuaauacagccauaggggucagcagcuucuguccauugguugaaugcaaauaucagacucuuucagcugcuuauugaguccuucagagggcaguugugauaggucucuuuuugugagcacuccauaaccucaguaauagugucaggccuuggaccuccccgugagcuagaucccacuuugggccuguugcuggaucuucuuuuacucagacucuucuccauuuccaucccugcaguucuuucagacaggcacaauuaugggucagaguuuugacugugggauggcaacccccucccuuacccgaugugcugucuuccugcuggaagugagcucuauaaguuccuucuacccacuguagggcauuuaacauguuuuuuaaaacaagguuauucauuuuucugacauucaauuauacuagauuaguuauuauauaauguuucuuuguauauuuuuagaaaggaagucauuuuaucccuuuaguggauuuauaccuuuuuuguauaauaccaaauacugucuugaucuuguuacuguaauuguauuuaccaauauagaaaauauacaggaucacaaauguugcuggugaguauuuuccaaacaaaacaacaaaccagugguaauccaacauaaugaacuuuuaagauuuauucauauuugacaguguuuaauaaacuguaaagcaauauacagagaugauuguaugacccaguaauaguaucauuaagggaagcuacuauacaguaguaaaggauaaauuuuaugucuuuuaagccaagguagaaaugcauuauagaaauugauuguugguauuugcuggauggaguuccuuguuucuucugacuauaauuaugucuaauuucuagaauaggccaaaucuucuagaguguugggauaguauuaucacugauaaauauauuucaaaguguagucuaguuagaguuuuuuggggaggagguuuguuggaauaauguuucuuuaaaaauuuuacuuuaaaugucccccacauugaucagaaggauacuugcagcaaauuguagucgcuuagacggcugcuuuuacuucccuagaaacuuugaggauucccaugaguucuaguugaauaguauguguuuagaacauagaugauaguaguuagguaaacacacuaucugaagaggaacauugaucccauuaaaguaaauuuaccaguguuuaaaccaguaaacuaauggaacauaauuuucuagguuuuuauuuuuuuugucaaaagaaaaguuggauguuagagcuugauaacaguuuauuaaugcuguuaaagucuuuuuuuuuuaagcagugagauguuaaagaauuuugaaguggacaaaaauauuagaguguaucuauaucuaagcauaaauaugcuuauuuauauuuuuauaguuuauacauaucaagcauaaauuauauauguauuugugugugugugugugagugagugagugagugagugagugagugagaaaacuauucuauacuguauuuugucagucuagaacagugcuuggcacaguacuauguaauagcagaauuucuaacaaaacaaaacaguucuagggcacauagaaggaaguguuucuucuagguuuacuaauauguaugagugagaguucuaugugcauuaaugaaauuaaacagaugagauuaguaaaaggucauucucauggaggccuuaucucugagguugcuguagaaaucuuauccacuaucauacuuuauuuuguuggaauuuucugaauuacuaacaacuuaaaaacacuucaaugaacuuguauuuguuaaguuuuuuuuuuuuaagaguuaagaaagacacuuuacaaaguggacucauuguuuaauuuuguuuugcauuuuacuagauugcugugcuaggccaauaaauuaaaccuaggcaguucuguugcuaauuacacaaaacuucucuugguaucagauauucaaauccauuuuaugaauaugguagagagaauaacaacuguaaaacaaagcaguaugcauguaagugacuguuagcgugcauuucagaaaggauaaaugcucaccauaugguacaauuacuguguccaaguuuucaaauuagcuucucucauccuccuuauuacugucuuuaaaaagagaggaaaaaaacccaacaugauuuaucuacucugcaacagaacucuugacgcaaaacagcagcccaguucuguccaguuuuuuuuuuuccuuagcauaauagaggcugucggacuuuuuuuuuauacuaauuacugugugagccucagaugaaccccuucaauucacagggcuuuguuaagggaggagcugucaaugugucugcccguuugcagcugugcuguggcuuuagcuugcuuaacauuaugcugcuuuuuagacuugacagaagggauuuuuuuuuuuuauuaaggcaaagcagccuuguaacgaaaugguuuaagcagcugcauuguagggaagcacaaagaaguuauuauugugucuguuuuggggggggggcgguaaagggggagauauucggcugcuguugaugccgauuguugacuugccaucugccagauagggagaagaaaaaaaugacagcuccagcaggguguucaagagguuguuuggagagacgcauaaacaugugcagaugucgaacugaauaauagcuagagcuggagacgguuuaugaugcugcugauguuugugcauauacagaaugaauguaugugugcauuugguuaaccaaggguacauacuaauuaucauuguuuuccugcaugucccccuccucugauuuuguuaauuaguuuaggaguguaauacuuccucuuccuucucuuguucacgucuaagcuuuaaaaaaaaacuuucuuaaauggcaauauaaacuuucuuacuuuucuacaaagacaguagaaaacccaguucauuaauguuugaugugaauuucuaacugguaacaaaaacuuuugauuaguaaucuuuuaguucaguuaccaucuucuuaaugauuccacugacaauuuaacugggcagcacuuaaaacuaucauuugaaaguggguugauuuauucuauaguuuacuacuagaguaacuuaauuaacuuaauaucacauuuauuuucuugaguaauucuauaaaacuuuaaacccagauguucccugugcugcaagaaagagagagagagagagagagagagagagagagagagagaggcagagagacagagagagaggaggugugaguuacauuggccuuauuuuuaaaaauaauauucuuucucuuuguuuuugugucuuuuaauggcuggaauccucaucaagcauuaaugaguugauuuuuuuuccccccuuggccuuuuguggcauuaggucuuagauuuuugaauaucuagaauccucuuagguacauauguagaaguaaguguauuuauucaaauguuuuccuuucaucucagauaauugaaugauacagugauguuauauagagguuuuccaaguuuuuuuuuuuuuuuuaagaauacuucaguuuuugguaaaaguugaauagcaguaugaaugaaaugacuaaaagagagagccucaguuuuuaaauuuccccuuuaaaacucuguaggaauuuuuaauuaaaaaagaaacugcuagaagaauuaauaagaaagauugcuuauuuugaguuuugguauacucucgccauuuuaaacauguaaggucuuguugcauauuuguuaaguaaaaaugccugaagugugguugaaaggccggcauccugauagcuuuagguccaugauaauguuuuucugaaaggguuauuuucuacuccucauaaagaagucaagucuggucuuucuagggggaaaauguauuuuauuuucaguuucuucuccaacaacucuaaucugugcuugcugagaaagcauagucacccguuucacuggaccucuccuuugccuuuguauuucauuaggaaauguagaauuaugcacauauuauuuguaguuucacacucaguccugagacccuuccuaacuuugggacaagcaacugacauuuuucacauagaguuuuuguuaaauugagagugugauuugccagaggucaguauguuaaugagcagcugacuaaagcaagcuugaggaaagcaaacuugucuguccaugcuguaguagucacuuauuugcucauuucuucagagccauguaacaaaccuuaauacaggccaguacacauagagacgugauugaaauaguaaaggcagauuaauuuugaaguuaaagggacuagauuuaaauaucacuuagauaugugagcuuauaaaagucacuuaaacuguuugaauuuagucuacaaaggaaacaauagcugucauugcaggaacuugaaaagacuaagugaaauaguacaguuagcauuucgggaacaaauucaggaguggcuguuaguaugauuuuauuuucauuagguguuaaugaaagucuagagaucauagauacagcagucaaaguauuaaaguguuuuaugggaaguaaguacacaaauuucuagaggcuauguuaagggaguagucacagguaggagauuuuuaucuuggaauccaguguuuagugacuuauuguuguuccauaaaucuggagggaaauaaucuguuuaaagagaauguggagaaaacuguuaaacguaauauuuuagagauguauuguucacugauaguuucauaauuuauauauuauagucacuugccuauuuaaaaauaaguaugcauuuguuaaaauacauuaaauuacaacgucuuuaauaguaaucuuaaauuauuuuggggguauguuuuugucugcuauugcaaauacuagaacugaacaaauaacacuaacaauauuguuuuaucuccugaggaaguuuaaaacauuauuugauuguccaaacuuuuuauuuuguaaaugaaaaaagcugucagcccccacuccccccuugaacagaaguguuuccuuggaggaauuaagaagaaaugcuuuuauugagcuaauggagucagugaauucccuagaguaugaguaauccccacacagauguaggugguguuuuuaagcuuuucuuuucaaaauguuguuuuucuuaagcuuauagucuauaaaguaugagugaguaaaauuggaugaugacugaagcaaggugugaugugcucuggagacugccuuaaucagcagagauuaagauuagagauugcuucauaggaguagagaaguugagaguggagaauuucaaacaagaaauugguugcacuaggaaaaguggcauaugccauuaauccucauaaucaggacggugaggcagaagcagguugauacuaugaguuugaggccagccugggcugcauagcaaguuccaggacagccagagcuacaaagagagacccuguuucuaaaacccauuaauuaauuaauuaauuaauuaauuauuaauaauaaugacuaugaugaugcuuuacugacaugacacuuguuuaaaaugcuaguuacuugaaguaauuuacauaaaaagaaaugggacugcccacgugugcgaacuguuguauaacagaugaagaagaauccacuuaaaaauaacaguauuuuuauaaaugaguauaauuguacuuuguaaugguuuauuuugagaacaacuaaaagaagauuuaggaucuucuagcguauuugauuuaugaauguauuugaauuacaccuuaagaaaaugcuacaugaauaguaauuuuuuaaaauauuggccaguauguugaaaacaauauuucacuaucugacauacucuuuaagguaucuugcaaaauguuuuggcuuaaaauuuuuaaugaguuuuuacucucaagaauaucugauaaaagauguugcuaaguaagcuugaugaugcauuagaacagaggauguuuacauuaaaguaggaaaggcaucaacuuauaaguaguuugauggccugccggccugccugccugccugcuuuccuuccuuccuuuuuccuuccuuccuuuuuuccuuccuuccuuuuuuuccuuccuuccuuuuuuccuuccuuccuuccuuccuuccuuccuuccuuccuuccuuccuuccuuccuuccuuccuuccguuuguuuauugacuaugcgagucacuuauuugagacuggaauauaacacauggaauagcagcuguugcuuccucgcaucuuuaugaaaagauguuagcgugugcaugugugugugcuuguguguauguugguguacaugugcacaggcccaugaguauaugugugugugcacauguguguauguguucaagugugugugcauguguguauauguuuguguguauguguguacaugugugcaugcaagugugugugcaugcacauggguguguaugcacauguguguaggccaugagaguguuugugugcaugcucauuuguguguguauguaugugcgugugcaugugugugugugagagagaaagacagacagagagagagagagagagagagagagagagagagagagagagaauauuauaaaaugaccauuauuuccuucuuucuauuugccauguauucaacauacaagguagucacacaauucaaucucaggcuacuuuucauuuuaguuaaaagguauuggaauuuaauuuuaacuuuuuuauuuacccuaaaacauucauagaauuguguaguuucaaggcaauguaauuguuuaauuuuacuuauauaacuguuaaaaccuaguuuuuuucaaauuuagaaaaaaaaagauaguuccuaauugagaauuauaccuuaaguuacagggaaaaaaaggggcuuuucuuacaaguacauguaaaaucuacauaaaaacccacuucuuuuuuauuugagcauauaacaacugauuggcuguauaaaauaaauuuucuguuacccgcuguaguaauuuuuaucucccuucaguacgccaguuuuuaaaagcuaggauuuuuccacuuuauguaguguguguguguguguguguguguguguguguguauucauguuaguggugugaaguuuaggcauggauaauaaucaauuaccucauacaucaagcagugauaguaagauuagcacuuuuauuaagcuaaauaaaagcucuuucacaccauuggaauuuucaggguuaagucuuuuaucaaagugaucaguaaauaaaugaucacauaauauacuuuguaaggaaaaguggagcaucuguagugugacgaccucguguauuagaggcauuuuacacuucuagcauuaguuaugaaaauucugagcuuugauucuacacuauuaacuuaccuuuguauuauauuuuauuauuauugagugauuuuuaacaaaagcuuauugacugcuguuuucaagaaaucaagagauuuggggauuuaucuuaguuguuaaucugugaauuaguuuauuccuuugaauguauguugacucuuaauuuaaaaaauauuauaaaaccacugaucuacagagaauagcaugauaggauauacauguuuacauaguacugagccauuauauuauuuuaaaaauauuuuuggugacuuuuauaugagacuugcaaacauuuuucuuacugguaucaugguuuuguaaaaaguuaaaacaagcauuucaaaacaaucauuuugaugucuaaguauagaugaugauaaagauaaaauuacuaauaugugaugagcaaaauuugcucauuucuaaauuuuaaauuagauauuuauuagaaugguauguaauugcucuuuccugaaauuucugacuuuguguuauguaauacugcccucagagggccaagguaaguaaauucauuuuuaauauugagaaguggcuuuccugguauuuauucaauguuacaagcuugauuuaugaaggggaauaagucuauuugaauaguugagugguguuuuauuucucauugcauuucuuugauuuguucuuucuuuuuaaacauguuaaagauaucugggcauuucaauuugaugaccacauuuaagcacaguucucucuugaaaaaguauuuaacaguugaccgaauacaaauugcuauauuaauauauauauaaauaggauaagaaaaucacccaccuggaaaagucaaagugauuuuacuuguguguguuacuuuuuuauguauuuaacuauagcuauuaaaguauuuaaauuauuuguauuuauaguaauuugcaucccuacauuuggaucuguauauauaacauuauacauugaaauggaagcauauuucucucucaaucaaaacuauaaacauauuuaaaauuuuaaucaaauaaauauaagauaaaaauaacacacacacacacacacacacacacacacacauauauauauauaauaucagcaguuagaaauguacuuuuuuccaaguaauuuuaaaagccaaguaugacagguaguuuaauguguuucagaauucagagugggaauagacuguccuguaacagaggaagcacaggaaaggaauaaugucaaaggaaugagguacagccuuuccuuuguacuuucuaaugacauuagaaagaaaugaaauguuuaauaauauauccaauuuauugccuuuucagggucuugcgauauugaauuuaaaaaggauuucuaugagaguauuggcagcaauuuuuuguuauuuuuuauuagauauuuucuuuauauacauuucaaauuucaaaugcuaucccgaaaguuccccauaccgcccccccccacuccccuacccacccacucccacuucuuggcccuugcauuccccuguacugaggcauauaaaauuugcaagaccaaugggccucucuucccaaugauggccgacuaggccaucuucugauacauaugcagcuagagacacaugcuccgggguuacugguuaguucauaauguuguuccaccuauaggguugcagaccccuucagcuccuuggguacuuucucuagcuccucuauugggggcccugugauccauccaauagcugacugugagcauccacuucuguguuugccaggaacuggcauagccucacaagagacagcuguaucaggguccuuucagcaaaaucuugcuaguguaugcaauggugucagcguuuggaagcugauuaugggauggaucccuggauauggcagucucuagaugguucauccuuuugaaacagcuccaaauuuugucucuguaacuccuuccauggguguuuuuucccaauucuaagaaggggcaaaguguccacacuuuggucuucguucuucuugaguuucaugcguuuagcaaauuguaccuuauaucuuggguauucuaaauuuucaaaaucauuguuagugaggaugguagaucaaaacaggaccaaguacaguaaauaaugaaauggaaguuuuuuucauauaucguguugugugaauguguggaugucagggggucuuuguccaucacucuccaugauguuaauuuuugaggucuagguaacucauugggaguucacaugauuagcuagguugacuggucugugagccccagggaucacuugucucugcuucccaaggacuggaacaccagcuuguacauccugcccagcuuuugugaagguuuugggaauuguaccuaagucuucauguuucuguggcaaaaacuuuaucacuaucauccuaaucccuaaauuuuuuuauuugccuuuauaaagaauugaagacaugacuaucauguaucuucauauccuucccuuuccuaaguuuuuuugcauugguuuucuuuuuuuauaccauaagccauuuuaguuuauuagcaaacaauuuuauuuuuguuucuguuuuugguuuuuuuuuuguggguuuuuuuguguguguguguguguguguguguguguguguuuugguuuuucgagacaggguuucucuguguaguccuggcuguaauggaacuuuguagaccaggcuggccucgaacacagaaaucagccugccucugccucccaagugcagggauuaaaggcgugugccaccaccacccggcagcaaacaauuuuauaauucuuacugugagcagauguucuguguguauuauaaauauuaaucuauuuuucuauuacugcuguccccauuuuacagaagagggaacuaaggcaugaagggugauaugcccaguuugucacucccauacuuaguguaauaaguagcauaacugucacuugaaucugaacaguuguauucacauccacugugaggaagaagauaaaaggauguuauuuguguagcugucuguucaagcaucaucuauguccucuacaggcuucccucuguguggcucaguuuccuguuagcugucugugcagugaggagacugcagugcucaucccuuguuugugugaagggaucccuuggagugaaaccuaaauacagacagggcuuagcugaggauuuuuaagcaaagucaagcuuucuuguaaccugaucacaauggacauaauagauuauuguuuaaggaaagcaagaauuuugaagggcaugaauuuacccuuaaaaugauuagaugucuugaguuuagugauauguccuuuucagggucccacaccacuagagguugaucauuggagagaucuuuaggugaagggguaagauaaagugcuauacuucccacuaauuuuauaaagcagaggugaaaugacagcaggauaaacuaguuugacagugcacccuguccuugcccagcacagacuuccugauuagcaagcucuccaguuguguaguacuuaaacaguagagaccaaagggguggaagggagugaucucaggguuuuuuuuuuuuuuuuuuauucugagauauucuaaguuuuuaugccaugaguguggcgggauagugauaaguuguguacuuauacaauuaauaguucuuccuuugccugaucuguucuagguguugaacagacauggugaguagguuugcauuaugcuuacauugcuuccauauuugauuuuauuaaggcuauuuccuaaaauuauauguaagauuuaaauaugcagagaguaugaggugcuaaaaauagaaaauguuacaguauggauguuaauuuuuucuaaugaaacuauauguuuaaauaagucaguuucuuugcagaaguuuuuucuuauuguguuguuuugaggcaaggucucuuuuuguagcccuggcuguccuggaacucauuauguaguccaggcuggccuugaacucacagagaucugcuuuccucugcauuugcaguacuucuagcauuuccacauuauuaaaauaguauguaaaugacuucauauuuaaaugagguaugguguagaaauggagaauuuuugcaguaauguagaaaaagacagcucugcuuucacaauguacaagggcguaagugaaagcaaaauaauaauuuagcucacauuuaacccagcaggaagcuuaguacagauugaguaauucuccacaacauaucuucuucuauguaaacuaaucucaugguuuauucuucauuaaauugccaggaugcuauuuucuguuggcgagauugugugcagcauugaguguucuccacucccccuugauuuuucugaauuagauuugauacuauaauaccguuaggauguuguuuuguuuaaaagaaugauuaaauguauuauuucuugguguaaaguugccugaaaaccauagguuucaggguuuaauaagcuggguaucauuaaacaaauaccagaaugcuuaaagguaaggugguaauuguuaacgauuauggaacauuuuaaauaaaaugcugauaaugcacuuccuuagagaaguuaaaguugcccuucuaacaucuuacaacaguagccuuaacauucuaaguaaugcagccuuuacuauaguuccacauauugugguggccuccaaccacaaaauuauuuuuauugguacuucauaacuaguuuuguuacuguuaugaaucauaauuuaaauaucuguguuuucugauggccuucagagauccaugugaaaggguuguucauccucacccacaagggucacaacccacagguugagaaacacugcuuuacaguauuuggugcauagguuguuuuuuuuuuaauuucuucauggagucuaaccuuccuuaggaagcaggcaugaaaacuauacuuaaacgacaaguucaugcauuaugcaguggaaggaaaauuucuugacuauaauauauuucucaaaauaaucaugaaggaacauauggaaaagcagaaauguggguacaucuggaaagcuuuuaaggcaucuugaucauacauugcagguuuaccaaaauuguaaacaacuucugugucgccaguugcauugguaauauugucaguccaggauuagacugaccucugaaagaggagagcaggcagucccuccucauuuuagaaucuacagagaagcaacagaaucuugaaauguugaaagauuguguauugaauaugccacagacaacaaauaguaauuacuacccuuucucuaggagcauguauagguauuuggaaaugacagagagucacagauguuguauuacauaauaugguuaaggacauugcguugauacccuaguucagcacugauuaguuaaaggacauuacuuauuugaaggaaucaauaaaggaaaaugauacaaccaucguucaucagaagugaguaaagacaauuuuauuuagaaaacuagauuuugcguaugucuguauccuaaacuguuauguccaagcugauuucaagguucuggaaucaagggauccucuuucuuccgccuccugaauaucugggacugcagauaugugccaguguucagguuuauauaucccuaaaauuuucucaccucuucagauucgauauuucauuccucacacuucuuacuauguaggcuuauauuucuuaaaacuuacuuuuaauaaagguucucaaauacuuugacguccccucacccaccgccuccuucuagcccacuguccaaagguaggggagaaaagaugguaaauaggacaaggggauaugaaccuguuuagaagacguugcguggggcuauuccaaucucuguuagucaggacaccaguaguccaguccaguaaugucaggauagcaaacaggaaucagagguggcuagaucuaacagaaacugccaggccucugacacaucgugucuguugucuccuauuuauacuuucuccaaacaucacauguccucccaugggucuugccucagcaauacaccacgugagucgaccucaccaugugagucuguaucagcaagacacgguuugagucuguauuacuugacauauccagaaacuuccacuucuuuucuagaauuaauauuuuaugaggguuggauuauaccugcauaauccauuuauauuuuaaguacuuguauguauuucaacacuaaauuauuuaaaaaguuuuaagacuuuauuuucuguguuuuggugcuuugucugcauguaugucuguccaucucaaguacagaggucaaaagagggcauuaaauugucuaaaaguggaguuuaguugugagguacugcaaaguguugggaucugaaccuggguucuuuggaagaacagucagcacucuuaaccacugagccaucaucccuccagccucaagugcacaaguaugaauaugggcacacauguaugcaggugaacauacauuaugugcauaugaguguguaugaauaugggcacacauguaugcaggugaacauacauuaugugcauaugaguguguaugaauaugggcacacauguaugcaggugaacauacauuaugugcauaugaguguguaugaauaugggcacagauguaugcaggugaacauacauuaugugcauaugaguguggaggcaaagguugaagucaggugccuucauuuaucgcuguccaccuuauuuacugaggcaggauuuuucacuugaacccagagccuuacauuguacuggcuuagccauaucauuccagggaucuacugucuuugccuugccuguauugggaucacaggcuagcauuuuuuguggguucuuuggaucugacucugauggucagguuugcagaacaagugcuuuugcuugcagagccaucuccucagcuccuagaaauucuuaaauucauaauaauuguucauaaacuaggugagaugugacuagugccugggggggcuaaagccuaagggauuacuugagcucaguuccagaugaaucuggacaguacacggacaucccaucaauagaagaaaagaaguucuaaaagcucugagacuucuguuuacuuuucuguaccuuuauauuugucuuaaagauagcauaugauuuuaacuaaugcuguauuuagauauugcauaauuuuuacauuucuuuaguaaaaacaaguauuuccaggcuacagagagcggaguacuguggugaaaagcaaguacugcucuucaaaggacucaagugugguuuccagcacccaugucaugauguucacaacuuuuguuuuucacuccagggaaccuaaacucucuucuagacucugggcguaccugcaauaacuauguagugcccucuccacauauguauuaaaauaauacaaauaaauauuaaaaagaaaaguuucaaaggccucucuccagcuuaaaagacuguuuuugauuuaugauacacauuuauuguuuucuaauuauauaaauauuccuagauaaguacaauguugauuauaaauugcauuaauuagcaaugguuccauuuaauaacaaaaucuaguaccuaauauuaugccaugcagaauuuuuaagagcuucuauauuguguccguacauaauuuguguaggcacuaugauaauucucauuuucuaguugggguguggaggagggcaaguuccuuuaguuaagcaguggcauaaucaugauucacauauaagcuuugugccccagagucuugcuccaagccaucacauuacauuguaauguaacucagaauggaaucaaacacacaauccugccucagccuccaggguaugaucugcaggugugugccaccaugccuggccacugagagaauuaugaaguagaguauuuaaaaaaaaauucaaaaaaaccccaucaaaccuaguuugcaaagguuggguaucuuuuuaaaucuguaagacaucaacuaggagucgcuacugguaacuuaaacaucaguaucaugauuauaucuuaauaauuuaaguuuauuuacuguuacuaaucagggucuuuaauuuucuauggggaaauaggaaucuaaucucaugugcuauccuauguuauaggagcauauuuuaguaugauuuuuauaauuguguucuaaauaguugauuuaugagauuugugaaaauuagugcuauaucaaaucaguugaacuagguugugucuguguuaauaaggccaaauuuauuuuaccuauuuguuauugcuauauauuuuuagccuagcccauguuagcauaagggugaggguagguuucuaguuuaugaguaugaaugcaguguucuccacugguucaucuuucaucuugcuucuaacuuuaucuuuuuuucuuuuuuuuuaaagauaaagcuucuuccauaagacuuaacuuuaagacagaauuggauauuuagcaccacaauucaccuuuaagaguagaagccuggauuguuuaagcauauuuucuaguuagauaucugaagaaauguggacauauccagucaaauacagaucagagccuguugggacauuuaaucugcauuuggucuagacauauaggccccuaauucuuacuaugguacuuuuugaugucuucaucagaaaguuuuaaaaacuauagugucaauucuuaaugaaguauuaaugaauaauggaauaaaguuuuuauauguagacugacuuaaaaugaagacauuaaacaacguaauuugacccgagaugaacaacuucaggagacccggaguugacugucuaucacuccacucccgauaugauccacuugaauaggcugggaaacauuuuaggcuuuagccaaaacaaaauuaucauuugugacuuuuucuguaauaguaguaaucuccucagaaccauugggauuguuuguuguaauauaggaagugaauuauuaauuaaaaggaaaguuggccaagaccccaacucuagaauuauaaccuaguagagcucagaacugauagaaagaaaacauuuucuuacaaaccuacaguucacaaauagauucucuacugcuuauuaaaacgguuugacguuuuuccuucgcauuuacaagaaauugacugaguacagcuguaucuauccuuuucucucaugcuaaaugauaauggaucauuagauuuauuuuugugguuguuguauaaauaagucuuugggagcuggagagauggcucagugguuaagagcacugacugcucauccagaggcccugaguucaauucccagugaccacaugguggcucacaaccaucuguaaugggauucaaugcccuauacugaugugucugaagacagcgacaguauacucauacaugaaauaaauaaaugaauaaaucuuugaauaagucuuugauaacaguauauauaaaagcugucuuucauuucuuaggguggguauaguaaacaacuacaaugaugccuuauagcaacuaauauaucacagucauggcaaccacaacagaaaacaagacaugagcaagguuacucuuccuucaaaagcuuucagagaaaaucuguucuuuauucuuauuugugguagaucaaguuuuuuuuuaguuuguacuaaaucuucugccauuguuuccaugguuaccugcuuccuuccuuucuucauaugucauguuuacuuuuuuaucaaaucuacuauuuuaaguguauuuuaaauuuauauggggcuagcuguucuaaaaucagugaccuccuugccucucuugcaaacugugaugauacucucuuuuauaggauaagcugauuccagagagugggguuuguacuucuuuugaaggucuaucauuuaguaauuacuuuacuccaaaaugccagaauccuuuuggggaaaguaaaagaccauacauggagugguggucccauaauaauugauuauagagcugagaaauuauauagucauuauaaaauucauuacuuaugugguuguggugauuuuaauguaaacaaauuuuuagagcugguugugcaaagauaugucauaauuauauagugaauaguacuugauaaugauuugauugguauuggcuuacauauuuucuauacgaugcuuucagucauuauuuagagucacuucuacuuaauuaaaaaauguacacgguaagauagugcccuuuguuuggacacuaguaacuuguguuuauuuaucuugguuuuugguuacaucauuucuccuuggucuugauuuaaucuuaauauuguucauuguaacccuaggagcaauagguuauacacauacacuacagacacaggcaaggggauuaccuaugugguggcuguaugaucuagauuuauucaguaauguuugcauagugacaggauugccuaaggacauacaacuggggacaacucugacaauaagcaaagccugacuauucauuuuggaaacacuggauuuuauaguguauauaccuucucaucaaagaggguaaggaagaagaaacgcaaguuauaguagaugauaaguuaggaaaagguugugcuggccacuuuauccaguuguuccuacaaugauuguugaaauuuaauauuagcuuugaugcaaguacuaucuuuaaaaauagaauuaugggggcuguggaauggcuuagucucuacaauacuugaugcacaaguauaagaacuugagaucagauccucagcacccauguuaaaagcugggugcagugguucagaccugaaaucucaguauuugagaugcagaaagaucccaaagcuccucuacucugcucaugugcaugugcaugagcacauugcagcaucacaacuaaaagcaacauggcugguuguuauugguuuaucuuaaugacugauuguuugaauuuuucuuguuauucugggcauauaggcccauaaaaucuaggauuuuuuuuuuguuuguuucuacucauagaacagacuuaugacaucaucuuuucuugagcucucauugcuggaauuacugcauuaguggcagaacuauuuagauaauuuuucaugaucacuuggaaaaggcccaguugggacuucuuaaucuauagagacaguucuacccuagcagugcuuaguauucacuguccucagugccaugccagggaguuagucaugaaaaaguuauguucuacguaguuucaggcuaggaaaguuuaccccuauauugggccuagggaaacaacaagagacaccaccauuucuguuguucacucacuugcagccuuuaugcccuauguaaggaucauucuucagaggcaaacacauucauuccaucuguggaaauggaaaagguauauuuaauaaagccagcacaccaugcugaaauauuuuuuuucuucagaauuuuuguagaaacauauaaaaagguucuuuguccucugccccccacuuucaccugaagaaaauauuuaguaccuuucuccagaugcuaacuaggcauaucugaacucuggaggaauacuggaaaaagcuccaugaaguuagagauuuggucuuuuuuauuuugguugguggggaagggguuacaacuuguguucccagcaccuuuaacuaagugacugacugacugacagacugacugacuaaaugacugaaugacugacugaaugaaugaauauauugcaagguccuuuauguuguagauguuaaaugacaaaaaaacaaaaacaaaaucuucauugaaaaauugacacucaguuuaacugugcugaccaacucaauugcugaguauaugaaucaauucaaaauuauuaaaaauauauucaauaauauugcuaauuuuucauuuaguggaacagaaauuuucuguuucuccuuuuuuuuuuccuuuggaggaaauaaguucaccccugucugguuguugugcauuuuucuuaagggauauauaauagacuaauuuucacagaacuuuugacagcucuaauuuuuaauucacuaucaaucugaacauggaaauauuuaagaugcuaaagaaaaauucgguuuagaaauuaaauuuugauuuuaauuuuacauuuucugaaagaauguguucacuucuauuuacauaagaaaaauauucuaauuaugauguggucuuuauacuuuucaagugaguuuguuucauuuuaucuuuauaugauugugaaauuaucacuugcuguucaucuugacagacauguaacuguaucaguauaaaucugcucuuguuaacaacagccuuuggaaccuaaaugcuaccucauugauuagauauuggcaccuaacaauauaaaauuauauaguaacacauaauuaaauaggaaagaauuaaauaauaauggcagucaacacaggaacaaaguuuuggaguugaauaagaacugugaacuuaaguaaauauuaugugauugccaagaaugaauuuugucuuaauaaaaguagauaaggcaucagguauauguguguugaaauuuaucuaccuauaugcacgugugaaauauuuacauuugcuuaucucuuuuauuuauuuacuaugacuaucaaucaagugauaggcaguuuaaguacaggguacuagaguauuucgaugcaagucaacaaagaaugucaguaguugcugagaugauaaaaaaugagcuccaaggacaaagaguagaaguuuggaaaccauguuugcuaucauagcuuuacaagcuucucaguacuuuaaaagaguuuuuuuuuaaaugaaauugauuaauuauaacaaaacuauguaaaguguuucagcugugagaguugaacuguuuaaucaguaaaccaguaucuguaugacuaauacaugauuuuuaaaacuguguacaguaugcaagauuuauucaagauacaaucugaguaagcuaacagcuauuugaauaggcguccuucuucaguuauccacuugaguuuuauucucuucuuauauuucaaucuucuaauaauucaguuucaauacucuaauagauugaauguauuaacagaaaagaaaguccagcuauuuguguuuagguguagguagaaaugcuauacaaugaugcugcuuuuuuacuaagaggucagguguaguauuaacuugucguccuuugccuuugccuuccuagugcuaggguuacaugccaccaugcugcucaggaaaaaacuauguaugcauauaucauguauaaacaugauacauauauguaaauauauguuacauuaaauguaguaaguuugcuuuuuugguuuuguuuguuuguuuguuuguuuucugagacaggaucuuaccuuguagccuuggccggccuagaguucacucuauagaccaagauuggccuugaauucagagggauccaccugucucuguccccugagaguugcugcacaugcccaucagguuguuuuaguguaaaaauauguuagagcaggaugaggggaaaagcaauggagucuacacucugauaagauuaaucuggaggugauuuguuaguagaagcuguggugagguuuggggaaagcaauugagaacauuaacaggcuggauguaaagcaguaaugggucaguuagguaaggcugucagggagcuacuaaggaaguucugacuuacuacuaguaguauaaggcaugccagaagucaagugcuagguugaaacuuggccgaaagaaaagcugcuuuguaucaaauguaaaaauuucagauuuuuguaguucuaaaauucagcacuuccuaauagcagaagaccacaugguucccuccuccccuucagcauuuuuuucuuuuucuuccacccuucuuccuuccucccuugcuaaugcacuuacuccaaaacccuccauccccaaaucuugguuuggagcucagcaugaccuggcauucauggcggcuccugcuuuagccuccucuaguccugagaaagcaggugugaacugcuaugccucgcuugccauugagcuauuaaggcgcugcugguucaaauugggucuauuuugguaguuagguggagcucauauggaaaucuaauaaaaugcauauuuauacagaguuagucaugcuuuauaacuauacuguauugcauuuuuuucuguauguaacuguggugugcuuuugagcuuuauuaacucauguucuuucaguuuugugacuggucacagcauugugugaaagguuauuuuccuagaaagaggaaguuaaggucaagauuaacaaggaaauacguccuauaauaauccuagaggcugaggcuagacgauugaguuugagguaauccugugagaccuugucuuacaaaaagguaaaggaguuagcuucuuuccccuuguuuggaaaacaaaagccaaaaaggaguauuauugaucaugaaaguggaacauguauuucacacucugcuuaugaucuguuuucccugcaauucauaaauacuguucauggaauuacuagggccuuauaaaauggccaaaaauaugcuuuaacagucaacugauaaauuggaaaacugaagaaaauguguguucagaagaaugauucucugaaggaauaacaguccaaaugaauaaucaaaguauggaaucauuaaaaacaaagugucugggguuuauuaaauuuaauuguagacuuauuuucuuuuguaagucaaguuaaaagaaaauuacaucauuaaaauuuugcaggucaguguuaaugggauguguuauaccauaauuucuuuucuuaccuaaacauuacuucguuuuuggcauuaacauguguguucuuccauguaggagaauauauaaaaaacuggaggccaagauacuuccuuuugaagacagauggcucauucauaggcuauaaggagaaaccucaagauguggacuuaccuuauccccucaacaacuucucaguggcaaguaagugauuaacaauuguuaauucacuguggguucauuuaucugcaugauguuauguggcagguguguguauggaucugagaaaccagcaugaaaguuuaucuacacuugauggaaagaaaugaucaacucuguaagaaauuucaacuccuuaugacagggacuuauaaucuuaugcagugcaauauaguuuacuguuuuucguauuuagaguugaauguaauauauuaaauauaauugcccacguacacaacuuaaguuuuuuuauauaaaauguaaauaaggaccuaugaucuggguuguaagauguuauccuccuuucugcauuaucucacaggauucccugucacaguguuugguuguuugucuuauuauauaaauguuugucuauuagaaaucauuuccugagauuauuuuauauuuuuaguuauauucauauuucuuaagacuaucuaaaaaaugcucauaguuuacuuagaaauguugucuuuguugaauuugcuuaauuaaaagguguccuugaugauaauaacgauuauuuucauuuucauauuugaccaagcuuuaaaugguuuauaccuacuuaucuaaguaaaagauccuccuguguuuauccagaacuagagcaguuucaaguucaaauuggcauagagaagaacuaggugcagucuguucuauggggucaaaauuugucauuagaugacucuuuuaguuggaugagauauguuggagaaagaagggagggggaauugaugcuugugaacauaauuaaauaaccaaaagauccaggaaagaaaacauuucuuaaguauuauaaaauucauuuuaucacaaaagaauuucaaacuuuauuuucaguuuuuaaaguaaagcuaaaagaauauggaauuacaaauaaucgaggaaggauacuauuuuucuaaaauuuuauccaaauuuuuaucaaaacaaauuuuauaugcaacauauuuugaucuuuaccauccuggauacuucucugagaacuuccuugggaacuaauuuaaaaaccuucugcauucauaucuguuauuucuuguguagagaacuuuuauuuuugaaaugaaaacuucuuaucauuauauguuauaaauacauauaugugcauacauauguguguauuaagaaaaacaguuuuucucuaucaaaacauguucauuauauauuagugguucuuguaaguaagaaauuaaucacuuugacaacaggaauacuauauuaaauuuuuaaauugcuuuaagacauuucaggcuaaaggaauugugguugaacauuugcuuauuaacgugguagaaauuaccuuuuaaacaguugucauguccuacuaaagaaauguccauuuuaccagcaauucuauugguuuuucugaaauaauuuauaaaagaacagaaaaaucucuaucugcugaucaaaaugcagcauuuuuugaccuuaugaaauuucacaccccaacaaguuuuaaagacauacuguaugucacagucugccaacaucugcucuaacacuuccacuggcagaggcugaaauaaauguguacuuguggagagagauccuauuuagugacugacagcuucuccauaagauaaauagcaguugacaucuguaauuuuuacuugcauaaccaaauacuuacugguacuugccucuugcagguaaaguaguaguugaauaccuaauuuucaggaguauuaccuuagauccuaccaugaguccauuaaguaaauaggaagcuaauucaaacaaaggaggagguauuauaggcagaagaugacaaugcuuauaugagggaucaauggaagaaaccggcauggccuguuuucuucgucuggcaguuagucccccacuugccuuggcccccuauggaauauuauucuuuaagaggcuggcgagauggcucagcaguuuacugcuaauggugguuuacagcauggguaauccugguuccaggggaucugacacccucuucuggccucucuggguaucuucaugcacauguuacacauauggacaagcagaugcacacacauauauauacauaaaaauaaaauuuaaaaauuaaaagaauuugaauagccuuuaaaauuacuacaagguuauguuaaauauuauauaucccauugauagcuacaauuugaggccucuauuuuucugcuaauuaaaaauguuccuauaucggcuggcuucuaagauugcuccauuuggcucucugcuuccuguggugauacaaguucuugaguuuggcuguccagcaaccauauaaaauaagugcaggagaucaugacuuuauuccuagucucuaguagcagagaaagacuaaaucacggagcucauggcuuagccagcacaguauaaucuguaaacucuagguucauugagagccuaccucacagggcaggguggagagugauugaggaaggugacaccuggcuucacacacaugugcacauauaaguacuaauguguauauguguguggucauacaugaacaguauacuuguauauggacuuuaauaaaauuuccaagagauagccuuuuuacucauuuggaaaaauuaugauaugaaccagaaggauuuuaaaauuuauuucccaauauucauuauauugauuuuucuucacuucuuaauaacauuguccaggcuagggguagaguauaugcuuagcaugcaugguuucagacugcaguaccagggagggaaaaaaaacccaaagcuuuuuauacucacuaaauauaccacuuaacuacuauuugauugaaacuacuuuugaugauuucucuaguggccaccucauauuuaguggugauggaaagucaacauuuuuuucuuccuaugucagcaucauggcuaaggacauuauaaacaaaagaaaauauauguagacaucugucuagcauuaauuuuauuuaauuuagacuuuggaaacuaagacucaaagacuuacauguuuuugugcuguagguacucccaccaaaguuucauuuuauaguccugagugaccuggaacaugucauauaggcuggcuucaaccuaacagagaccuuccuacuucaucaucccccaugaugacauuuaugacauguguauuaauguaaaaguagauaaucaugggaaaauaugauagguaauauggguaauauaaugguaauaggcuggaaaggacugaacauggccuguuaguugagaacuuucucuugaaaccuucagaguucaagauuguuucagaaauaggaaagacauuugucaaaggagagacuaagaccugcuuuaaaggaaagucagaaagucuuuacuagauuuaguccuggcucaggggaaacaagcaagaaaacauugaaaauggccuucuugcuuuuacguuuuccucaaaugccaagguaacacauuuggcuaaaauccuuuguuaagcucagcuuuaauuuguuuucuggauuggcuuugaguugcauuucauucuacugaccaaacuuuuggaaugguguugcccucugugcugucagguuccucuguguucuuauuugcaggaaguauaauuugguauuuaauaaacaucuagccaaggacuucacacuuuguacauuacgccugaaucuacaggauuauauuguuuauaaaaccuuaguuacaaacugugugccuuauucccacuuuuucauguauucagaccaggcugcucuccugagaauugugucauauuaauuucacugaaaauuauugccacccuauguguuuuuuagccuuuacuuuuccuaggcugaccucaagacaguugccuauuuuccuuuguucaguguuugaguucugucucugcuugaguagaaaucuuggucuguucccucucuuuugcuuuccuuuacaucuuuaccacacucucaauccauuccuaguucugcugauuuuauucuuauguucgaaccuauuauguaugccucgaacuauuuuccuggaaugacucacucucuuagucuuugaugcauacucuuaacuagauuucugcgucucgucugugccacucauguucuuucacuugucugucagaaggaucuuucuaaaauuacaucuuaacuaugccauucuccccaggaaaacucugccuuggaucuucauugccuacuggauggcauccagcuuccuuaauguuucauacuaggaucucuucaaucuggccgcuccuuucagcuccugcuccaugucucuucggcucugcaguucugcuucggcagugcugagcuguuuauaacuccgugaaaacuuugcugcucuucugcucuuugucuuggcuucugguuggcagguccucaucuucuauuugccuguguaauuuucuuuugucuaauuaauuuuaaaauuucuuuuccucauugauucauuuaaaacuauucuucugcuuuccucaaacugggguuuggugcauauguguguauguuuaucaccuuguuucuugguuaucugguucaugaauaauaugucuuacuuauucgucugaguuauucaagguaaaauaguuuaaucuuauagagucuacauguuaugacuuuaauaauuauucuugaauaucugaacgcauacuauguaaauuucuccuuuuuagauaagaaaaugaagccuuuggagucggugauuuguuuaagguuaucuuccuagauaaugguauuuaaauaccaggauuaaaacuaugugauucaaggcugaagagauggcucaguauuuaagacugcauacauacugaccugaguucaacuccaagcaccuaugucaggugacucauuccugcuuauaacuccaacucagggagagugacacaucuggcauccaugaguacuugcauucacuggaacauacccuccauacacauaauuaaaaagaaugauucuuuuauauaaaaaaaaaaucuugcaguacucugcugucauuuaaauguuauucuuuucccucccaucauacuaggaucuuauguuagucagugcauuauauacuuguccuguugugaaaacaugcauaaaagaagccacugaaggcagaaagauuuauuuuugcuccuaguuugagggguuuccugcauuagagguuaaucuuuuugcuuugagcucauagugagguacugguuuauggugaaaaaguagcacaguaaaauguuuuuucucaugaccagggaacaaaaggagaaaggaccagguucuuauaacaaucuucagggauaugguaccaauaaccaaaagacacaggucacaucucaugaaguuucuaccaucucccaagagcuccagacuaaaugccaaacauuuaaaaugugucuuuggagaauauuuaaaaucuaugcaagcauaccguuuucaucuucaauuuucauugauuuagaauauaaaaaucauuacuuacauuguugaguagccauugcauguagaauggaaauuuauaaaguacuaagggauguggauaacaacauuugaccuuuauucuaauuuguguuuaucagaucaaauauggacucugaaugaaguuaucuucaaaaagcagugaaauagaaauguaauuuaggaauuauuuuuaaggaugguauaaccauaacuaaaaauuaaaaguuaccaugacucauuucuguuagucauagauugagaagacauuguugagaaauacaugcacauugaguugaaaaauaccacuacaaacacauacugucacaugguacuuugaguaaaguaguuuuucuguccauuagccauggucucugauauuuuauaucuuuuuacugaauucuuagauuauuaaacuucaaagagggaaaaauucuucuauggaagagugaauaacugcccagaugucuuuagguucauccuguguuugcaaggucccuacuuauucuguauggugagaagcaggguaugccagcaccugucucaagaaacuccuccuacaagucugccuuaugugcugcaaauauuggucuauccugaaauugucucuuuuccaaaacuuuucuuuauucucuuuuauaaaugauaggauuucuacacuccuagcugccccucuuuuaaaugaauguuuccuaucuaaccuauuuuuuacucacauugaaaauagaaaauuaugguucuuaaaaccacccaaaugaucuuuauggcugaaguuagagucagauuucagauuuggagacaaauaaguucauggguuaaaucaaaacauauggagagagaaauuuagauuuagcauuuaucuuauauaucuagaagggucauuaacugucuagauagauaugaauuaugaaaauucagaauaauuaaauuuuaaaagucuguugaucauuuaguaucuaacaugguaccuagaggauuauaucauaguuuuuuuauauaggaauuugacauagacacuguauaguaucauuggauacauaguagaugaagagaaaaauggguuuaguggccaaaaugaauauuuuauuagauaguuucuuuauuuacauuucaaauguuauccccuuuccuggcuuccccuuugaaaaccuucuaucccaucucuauccuccugcuucuaugaggguguucucccucccacccauuccucccucccugcccuggcauuccccuacacuggagcauugaaccuucacaggaccaagggcuucuucucccauugauacccgacaaugccauccucugcuacauauguggcuggagccaaggguccauccauguguaaucuuugguuggugguuuaggucccugggagcucuagggggucugguugguugauauuguuguucuuucuaugggguuguaaaccccuucagcuccuucagucauuucucuaacuccuccauuggggaccccaugcucaguccaauaguugguuccaagcauccaccucucuauuugucaggcucuggcagagccucucaggagacaacuauaucaggcuccugucagcaugcacuuauuagcauucacaguaauguccauguuuggccacuguauaugggauuggauccccagguggggcagucucuggauggccauuccuucagccucugcucuuuacuuuauccccauauuugcuccugugaguauuuuggucuucuuucuugagcuucauguggucugugaauuuuaucuuguguauucuaagcuuuuaggcuaauauccacuuaucaaugagugcauaccauguguguucuuuugugauuggguucggaugauauuuuuuuaguuccauccauuugccuaaaaauuucaugaauucauuguuuuuaauagcugaguaguccuuuguguaaauguaccacauuuucuauauccaucccucuauuaaaggacaucugauucuuuccagcuucuggcuauuauaauuaaggcugcuaugaauacaguagagcauguguccuuguuauauguuggagcaucuuuugaguaugugcccagaaguaccugggucuucagguagugcuauauccaauuuucugaggaaucaccagacugauuuucagagugguuauaccagcuucaaaucccaccaacaauggaggaguguuccucuuuuuacacauccucaccagcaucugcugucuccugaguuuuugauauuagccauucugacuggugugaaguagaaucucaagguuguuuugauuugcauuucccugaugacuaaggauguugaauauuucuuuagguacuucuugaccauuugauauucuucaguugagaauuuuuuguuuagcucuauaccccauuuuuaacaggguuauuugauucucuggagucuucuugaguucuuuguauauauuggauauuagcccuuuauuggauugauaaagaucuuugcccacucuguugguugccguuuuguccuauugacaguguccuuugccuuauagaagcuuugcaauuuuaugagaucccauuugucuauuguuaucuuagagcauaagccauuggucuucuguucaggaaaauuccuccauaugaggcucuuccccacucucucuuauuaguuucacuguaucugguuuuuuauguggagguccuugauccacuuggacuugagcuuuguacaaagagauaagaauggaucaauuuguauucuucuacaugcuaaccucugguugaaccagugccauuuguugaaagugcugucuuuuuuccucuggaagaauuuuuauagaaaguaaaugccauggaacuuguacaagaagcaguauguaauaguuaucugguuauauucuguggugguagguguauaucuucaaacaaacaagcuaucagucagcucuuccugauaccagcuagcucaggucuucauuaauucuuccuggauuauguuaacagucuccuaauugguuucuuauguucagaaauucuuuucucugaaauacuuggaauaaaugcauauauaugucaaaaccaaguuguccaaauaccauuccuuuucucagacaaagaaaucuuagaguugaucuaucauuuuuaauauggggaagcggaauuauuuuuuuuuacuuauccauaaacauuuguacaaaauuuaaaaauuauaucuauguucguauauguacaccucauaucuuuucaguauuucuuuguauggcuuaauauucuauauuuuuguuuugguaguguuagagauggaaaccuugaugacgagcuacaccuaacucuccgugauguuuuauguaaauugcuacauucuguuaaguucaguacuaugcacauuuauaaguguuuuugcucugaguaacuuccuagaauacuuuauauacuuaaucuuuugaagauuggaugcauuuuuacuuguaguucugaggaaaauuuuagauagaugggaaauuaagucuaauaauagguuuaucucacuauaaguaguagaugccuauuugaaaauaaaacagaaaaugacaguguaaauuuagucaaauggcuuuugaagaagcaagucucuguuggauaaggacugugcauguuuuaacuguugcccuguauagucagaaguuccccuuuucuuuuuauaaucuuccagugucuuucugaagaaacucuugcuuacuauccauuggggagauacaaaaguaaguuguguuuuaaaucaccacuucuuaaaaaggggagacaaugugguaagaguuuuaagagaaagcaggccaggauugauaagcuccaggagcuuaugaucaaacauaccagaauggaagcaaacccuagcagaaguaguuuccuguauaccugcucuucucuaccacugagcuaggucgaucaaguacgaccaucuauugccugucuauaauagauggucugucuauaauuguucugaauuacuuucaaguacuuuuuaaaaaaauuauugguuauuuuauuuauuuacauuuuaaauguuauuccccuucccgguuuccccuccacaaaccuccuauccuauucccccuacccccugcuucuaugagggugccccucuugccucacugcccuagcauucccauaugcuggggcaucgaaccuucacaggaccaagggccucccauucaguugaugccagacaaggccauccuuugcuacuuauggggcugaagccaugggucccuccauguguacuauuugguuggugcuuuaguuccugugagcucucgggcugucugguugguuauuguuguucuuccuauggggcugcaaacaucauucaauccuucaguccuucuaauuucuccauuguggucccugugcucaguuugaugguuggcugcaagaaucugcaucuuuauugguaaggcccuggcagagccucucaggagaaaacuauaucaggcucuuguucucaagcauuucuuggcaucagcaauagugucuggguuuugugucugcacauggcauggauccccaggaggggcaaucucuggaugaccuuucuuucagucucugcuccacucuuugucccuguauuuuuuuuacacaggaauaauucugaguuaauauuuuugagauggguggguagacccaucccucauccaggggcugugccuaaccuuuggauauggucucuacagguucucucuccccuuuguuggguauuucagcuaaugucaucccuguuagguucugaggccucuugcuucccuggcuucugggacuuucuggugacuacccccaguuuaacuuaacuuuuuccuuguuuucucuucuuguguuccuagauagcaaccugguauauauacucuuugaaagugccuaucaugugugauaacauaauugacuuauauaugaaguuaaguuuaucauguguaguuagucuuuauagaaacagaaccgagagauugaaaaaaauauguguguguguguguguauacacacauauaaauaaauauuagaguagcuuucaggcuuuaauccagguagucauuagaacaauagcugacucacaauggauagccaaaaaucugguaguuguucaguacaugagacuggaugucucagguucccaaucuguugcaggagucccagagaaauccuagagaauugcaaggucuucagucuacauugaaaucuugaaccagagaaggagugucucagcaacaagaaagaugaacuuccuagugaaagugacggcaagcaggcccccccccccaaaaaaaagcuucuuuuuuccauggccuuuucugugggugucacuaaaaguuguggcccagguuuaggguagaucuuuccaccuuaaaugguccaguuaagaaaaaucccuccuaugugugcccagcugcucaguuuacuugauuucaaauguagacaaguugaaaaaucaagauuagccauaauccuuaagcucuagugaauauuuagaaaguuuuuauugagaguauuauauucucaacauuguaccuaguacccaaagaauuaaaaauggaagaaaccaaucuuuaaaaaguuguuaguaugugccauacccuuucagauacuguuaucucauucacuuguuacaggaaugcugugaguuaaauauuuuguuuccuauuuugaaaaggcucagaaaauugugugauauguuucuugguaguuguuagagccagaaauuaacuauaugaguagcaauacaaacaacaaauuauuuucauuuuaucauuccacagauaauagucaguggaucugaagaauuuguaauauaguagcaaaaauacuuugugacacuuggaauugguacuugacauguuucaugauuaaauucuggaguaaguuuuacaauuaaaauacaaauuuuaggaaaggggagauucauuagaaacuagaguaucgagaaaauccucucuggagauucagauucuuuagagaaauaguaauauuuuaaaagacaggcuggauucuaggcaaaaauacuauucuuuuuuuuuuuuuuuuugguacuuucuucauucacaucuccagugcuaucccaaaagucccccacacccuuccccccacccacucccacuucucggcucuggcgguccccugcacugaggcauauaaagucugcacgaccaaugggccucucuuuccacugauggcugaccaggccauccuaugauacauaugcagcuagagacacgagcgcggggggcacugguuaguucauauuguuguuccacccauaggguugcaguuccccucagcuccuuggguacuuucucuaccuccuccauugggggcccugugauccauccaauagcugacugugagcauccacuucuguguuugccaggccccagcguagucucauaagagacagcuauaucaggguccuuucagcaaaaucccgcuaguguaugcaauggugucagcguuuggaggcugauuaugggauggauucccggauauggcagucucuagacgguccaccccuucgucucagcuccaaacuucgucucugcaacuaaaaaauuaucagaaacucgggcugaauaucuucccuuuugaauaaauagguaugaaauucucaggaaugaaucagagcucaaugguaugucauuuccuguaaucuauuggaaaacuauuggagaaaaguguaucuuaguacaguuucuguguugaagcauaaugaccaaaagcaacuuggggaggaaaggcaucauuucacucacaguuacaggucaaaagcagugaggcaggagcucaaucagggcuggaaucaacacaggagcugaugcagaggcuauggaggaaugcugccuauuggcuugcuccucauggcuuguucagcuugcuuucuucuagaacccaggacuaagaucccaggaguggcacuacucacaaaaagcugggcccucccacaucaaccauuaauuaagaaaaugccuuauaggcuugccuacagaccagccuuaugggggcauuuucucaauuggguuucccucuucucagguuacucuagacugugucaaguagacauaaaauuagcccucacagaggaauaccugaaagaaagaaacgugccccuugaaaauaguuaaaggacugcuucagucaucccagauauuuguuuucccaaagucaguauuaggcccuaggaauuccauuaguuuaucuuguggauuuuguuuguuuauuuguuuguuucuguaaugucauugcuauuuauugugucauuuauuaacuuauaaaauaauuuuauugacacagauaaauguugcauuucaaaucccaccauaaagguagugcuuuuagaguaagcacuauuuuucagguguaguuuuuagcuuggaacagauauguaucucuugaaauguuucauuaauaaaacaaagcaaaucuuuuucuguaggguggugcuguaacauggguagagagaggaugggcguuguucaucaucuaaacugauauauaaaccaccagauaccaagucaacuuugauguauagcuaaggguccugguucuauuuucuuaucuuacuacuaauccuugucuugucuucugugaugcccuuucauauuugaaugcaaaaccgauucugcuuguugcuuuccaucucuaaucaguuaugaucugauaaaauuuauagaaaauguuugguugaacauauauacuuuuacaugauuuagucuuugaccauuucuuuucuguaaauuacuuugcaacuuaaaauuuuaguuucuagauaguagaggacuguguaugguuuuaaaaaugauaauuagagucuugauuagaugcccauuguaauuggugcuuuaaucccauuuuaaaauuuaauaauagggaacugggagauugaugggaguaaggaaagagcugacauuuaaaaaccuacuauguaucaauuguuuuacuuuuuauaauuauauuuaccauaagaaacaugacuuaaauauuauucucccccuaggagauaauaauaaagcagaucuauagagauuaaaauguucuuagaguuucaaagcaaguaacuguggucuaaugcuuagcuugaaaucaucuugauuauauauugaguuaagauuccucagguaaagaguagucaauacacacagaaaaauaugaucuugcagaucugauacaugguacauucacacauacauguucucaaaguauauuuugaguauggugagccuguuuaggauauauaagguaaaugccaauauaacaaucaggucuauugauuuuauauauauauauauauagcuuaauuugagcaaaugauauaacuguccugcaucagaauuuugacacaugcagaauaaagcagaggcuuuaaguccagugcuuguucuagucuuccuccuuacuucagcuugucuacugcuuagggcuucagggugacagcuuuuuccaguggggaauucaggaaagaagugcuuacaaucuucuuaacuaguuugucaguguuauugaucaauucuuagcauucucaucuaguauauaaagauacaucucagaguuggggaccacuucuaccugaggaaagaguaauggugaagaaaaguuacuaguuuguacagcuuucagcauugaucuucaaauuauaauggaagccacagcacagacaauaaguuuuagaggaaauaucaccuggauauucuugauaaauuauauaguucaacauuuuggcaaauuguauuugaguuucacauguuuguugcuucuccugaacuauuagugcuaaaucacugccuuagugucccccaaucccauaucugucuugauuugaaagaauuuguuauauuucuaguaauguuaaaugaggccuaaggccagagugaaaggaggggccuuucaaccucaggauuuagaaauaauauagagcaauuguuuuggguuggaaauaauacauaaucaagcagaugcuaaugggaaaaugcaaugcaggggaagagaaaagagauuggggugcuguuuggaaguuccauagaggagaguacauugccccuuuauuauaacaauguuucugcacuauaauaaggccuuucacugcaaguucagccuuuuucauucauuuguuuugugcucugcuuccucuguuacuaauugucagcacaauagucuuccaacuaugaagucucaguguccuuuuggaccaauuugucauugucuuuuucucucaccccaacccaugcacucagaaucuauuaccauaguugcauuuuuagauauuuuguauguuuuaaaauggcagugcuuuugaaacaugccaaaauaguucaugguaauugaaucaucgaacuagcaacaguuacugcuuccaaaugcauacugauagauucucuuucuauaggcuauucuuauaacuuaaaauaugcauauaauacauuuaaagcaauauuuaagucauuuugaacuucauuauagucuauauuauuugcagauuuaucguuuacauuauaaaucagucuauguuuuuguuacuuuacaaaauuuuaugucauuucaccaucaauaauuuuauuguuauagauaauuuuauuuugacaaaggaauaaacaaaauugucauagacugacagagcugaauagauucuucuauaaauuuuaaaaguaguuuauuugguagacuucuauccuagaauucacaaagccugagguucagccccaaaaccuuauaaaacugaguaugaugguacagggcuauauucucaacacucaagaugaucagaaguucaaggucauuuucagcuaaaaacuguuugaggccagccugggguacaugagaccuuauuguaaggaggaaaaaaagauauuaaacagaaaaaguacugaagguacuaaguugcauuuuguuauaucaucaaacuauacacuuaaacucauuguagauuacuuguuauauauauuaccacauuuuaaaguccagagcuaguauauuaaaaugaauaaauacagaguuauuguucccaauuccuuauuuuguaucuauuaaaugcuuguaacuauauuaaaauucuuucaguaaaggguugcacuuuacuuuuguguuugaauuauuauuucacaguaaauacaguucauuuuuauuagcaauuucaugugugcagaaaaagguuacuguggaacaccuaauacauguauuuauuucaugaaagguaggauauggugaaaaaauguuaguggugaaaaugcugccucucaaaauaugcuuugaguaaauagugauuuccauggcaaccauauacauuaaaaaauauuuggagagguuuaugauuuaaagcuucaaauagugucgguaccaaaguaguauucuaaaaugucagauuuugaaauacagaucauaaaagugaagaacaucuacaagaauagaaaaauuauauuaguauccugaucauaggcuccuaauuauuaacuuuguuaagcaauaaagaaugagaauuuauuuuauuuucuauuucuuugcauggaaaaauguauguugcuuuuguguaauguuuuuggcucaggaacaguaacuagaaaugugguucuggguguaggccauuuugggaaucaguuauucaucauuaguaaauaaacauguuuauuaugcaacguuauucaucauaaguaaacauguuuauuauguaauguaauuguuaauguauagcaugaauuccagcccugagaagaauccagagaggcugagucuuucuccuuggcuggaccuaaccugagaaacaaucaguaccaucaaccaagauucugcaagagaauguuccuucucuauucuuaccugugcagggcuagagccaggagcagauauccaaccucucuuuucugcaguaagguuagcaggcaaaaguucuuuucuuuguaaugaaaagguaucauagauggagagcaaccaagcucagagaaggaguaggaggggcaacaaaauggacuagaucuagucuuguuuucacauauuacucaguuuucauagacaaauuuucuagcacuuuuuuuuuuuucagaagaucuuagaauuuggauucagauacuauugagguauguguucaaacaguuucacgcaagcugugcauuuugaacaaauuuuuagauaguuugagccuuauagaugugcucauuuacaaaauggaggguaauuauacuguuuauguuuuugcuuuaagguggaaacauuuuagaaaccagacugcaacauuuggcacaauggucauuuaaugguuguucuggaauugauaucuauuggccacagacuuuaccuaucuucaguauauuacaacaaguacuuuuagaaugggauuguaauuagacaucauuucuuuauuuauuuaguggagagagguggugucaauauauagcccuggguauccugcaacuccuuauguagaccaagcuagccucaaacucauagagccccaacuaccacugguucuugaguaauagagguaaagauaugugccaccaugccaagccuuaguagaauauuuuuaaaaggauaaaaguaguauuuaaagauuaaaaagguugaaauacaauuuuaaaccuuuaaauaaaaacugaacagaugauuuauuguaauucccuuuggaaauauguacauauacauguuaauuggcuuucaaguuugcagaaaaauuagaauuucgaacaaacucaaucaucugugggucagaaugguguccaguaagcagaguguuugaaauucagcuuguaguugguuacucuggagagcuucacuaauguaguguaacugcuuaauguaagagccaguuuaacagagauuugaaaguggacgcucccugucuugggagaguacgauggacagugcuaaggaggacacccagugaccauuucugugcugcccagaucacagaggcacagucuaaugcaugugucauauauaccaugcauccacagugcuggccacaaaaauaaucugaaaaguuaguauuuuauggcauaagauuguuauuuuacagagcucugggagugcugcuuucauuuagguuaaauuuguuuuagguaggaugacuugucuauagauuggacaucuccauauauuuauuaguauuucaggaccuaugugaccuuuuauguuggucaguauuucaugaaauuaggaggccuaacauuuuauauguucauauuuauaauuauuuuaucuucuugauaaauuauucuuauuuaauguauaguggcuuucucuuuaucuuuuuugucuauuuuuaccaugaaguauacuucauccagcuaucagaauagcuauggcagcuugguuuuuuuuuucuguuugcuugguagauugucuuuuaccuuuugacucagucuuuggguccuuuuaccaguaagauguauuucuuggaaacaacagauagcuagauuuaguuuuucaauccugucuaccaaacugugucucuuuauugaugaguugagauuauuuauauuuuaaauuaauauuaagagauauuuauucauugugauaauuuugucaguuguuuuucugauuaguuggacuguuccuugaccuuuucucucccuuguuaauaaugggauguguugguuuacugcacugaacaugaugaugaguucuuuucuguugugaacuuugcuuuuuccaugcucuuaugauugagauggucuuucuguguuccauauucaugugaaaaccuccaguaguuucugcuggcuuaguggccaugaacugcucucagguguuugucuuuaaaugucucuucgucaaucuucacagcuaucuuugcugaauauagcaacauuccaugguucuuaacuuuuaaggauacuaauaagagaucugauauuauucuaaauucuaacauguuugugaguuggagguuuuuucccauaaagauuuuaauauuuuuuucuugaauugggauuuuuuuuuucucauuuugacuuuauuguguucugaagagauagauacccaugucugucugggguuuuaaacauuacucguauuuggauaucugucucuauagacuuacgaaaaacauuuuuaauuucuuaaauguuuaucucagagcuuucuuguucugaguuaauagauuugccccuugcuuacuucucaggauucugugaagcugugguguuuccguuuguuuaccuuuccuuauugacuuuaguuguaguucuuuguugacuuagcugcuuauaucuaauuugucuuacucugucuuuggcuugguuaggucuauuauugauagugcuuucugcucuuucuuucuuucuuucuuucuuucuuucuuucuuucuuucuuucuuucuuccuuuuuuccuuccuuccuuccuuccuuccuuccuuccuuccuuccuuccuuccugaauguuuuuaaaaccaguauuguugauuauuucccuccauuuuccuguucuuuuuguuuuuauuuuuauuuuucuuccuauguugcugacuuuacuuucugguuucaaaguuggauuugucugcuuguuuuuaauccucuuucauguuuuuauuuuuacugauaaucuuuuaaaaauuucauguuauauuuuuauauuuuaauauaguuugguaguugguguguuucuaauuguguugaggaaucuugauaccuuaagauuuuucauauuucuuauaauuugcuugucucuugguauggcuuucuguuaccuuuuuggggggcaaggagccgccccccccccccaaaaaaaagaggcagauacuggaaaugaugcaagcuuuugaaaccaaaagcccagcucuagcacaccucuuccaacaaggccauaccuucuaagucuucccaacugaggaccaagcauucuaagaagugaacauauggggacuaugcucaucaaaccaaucaggaacaggaugggcagaaacaggaaaagcaagauuaaauaaauucacaggggauugaaaagaauguuaugaagggauagaaaugaggagagauuaaaguugaaaaaaaaaaaggaaagaguaacgagugaugacauuuucauaaacaagauuauuuaaaugaacgauaggaaauaaagaagaaauuaaaaauguguuuguuaaucuaaugcauuaaaacaguauuaaaugggaaguggaagaauccugagaaagcaaaagaaaagaaggaaaaaaagagugaccaccaaugaauacauaaaaauuagauuaacauauaaaaaggaaugacaaauaacaugauauaaaauccacuagaaguauuauuaaaaguuuaguaaaaaugaaaaguaguauacaaagauuaaaagaaaaggugaaguauuggauggagcuccucucuguguagugagccaggugcauauauugggaggguuuguugaacuugaagacuuuugucuuuuucucuuguugaugcuguugcugauacuggaaaaguaucugaugucugcuagaacuaucuucacuucacuagcauccauccuuguucacgcacuaggaccucugcauaccguacuuaagugcagucuguggggcuaggcagguaauccuuuuauggagauacuaccugcuuccugguuuguaugcuucagggguggcuaauuaucuagcuagugaaugauuuauaaauguguuauaacuugaaaucugcucuaauacuggccuguguacaggcagaaugccugcuuuuguacuuucuagauagguggcuugugaguucucucugccugcugaccugcagccuggagcucuuaggcucucuagggugauucucaguuuaggagaucuggccagcacuuccucauuugauuagagcccuugcugcaucugcccuucuaauugccaguguugacauucacugcucaguacaacagcuuuaggccuuacccugggguuaaggccagucaaauuaagacucccuggucuauguuugcuuccuguguguugucucccuagaggaacucaacuuuuugguuuuaugcuuuguuuugccgaucuuuuaacaauuuauucucuuucaugaugguucuuuguuacugcccuucuagucauacagagcaauacaauggcacuucucucucccucugacccaucaccugaagaaaucacugucuuaucaagcccauaauugaauuuucacuugugagggaggguuacaggaucuuacuaagggcacccaugucuuacuuagcuuauuacuguuuacaaguggcuucugauuccuuucccuugugagagagacauugaacucuaauucauaccaucaaaauuagacaugugcuuugacaucuucauagauauucccuaacagaaucuaaucagguccuggcugacugauucuagugacuguguuuacuuaagaauuacaaacaguuuguugcuugagaagaucucacagugauaaaagcuacccuuuaaagauguuugauacuauaaaacaaugucuggugaacaagaaggggcauacuaauaaauaagugaaacuauagacauggaaaaaacaagucugugcucaaaaguaaacaaaacauuuauggaaugauuaugauuugauuuagacuuuaaaggauugguauugcuaugacaguuggugcuuuaaaauauaaaggguuaaaauaaauagguguuucugauaguaaaaguagagaagcaaaaguuaaagauacaggaaggaacaaggcuuguuuggggaaaacugaagagucugguuuagcagguugaaccagucagacugaagaugggcuccaaagaaauacugaggucagguugugaauaaccuugaacacauauuuguggaaagcuauuaaguugcuauguauuuuguuuagaauaauacuguguaguugucaacuauuuauuuaauaguuuaaguacuuguguauuuaaagagauacuuaauuuuauuuauagaaugucaguuaaugaaaacagaacgaccaaagccaaauacauuuauuaucagaugucuucaguggaccacuguuauagagagaacauuucauguagauacaccagaggaaagguaagagacuuguucauucuuauuauguuaaaacaauaguguaaagauguauuuguaucuggauucauuauuuguaauuagauauaaauauauuugcaauguguuacacuuuauuguucuguuucuguugucuugcauguuuaacuagggcuggaaaaugauaaaucacccuuggacuacuuuaaaauaaaguucuucugagaaaacgguacacaaauauuuuuuuaauugaacacauuuuauauacaagcuauauugugcuuaugugugaaauucaggauagaaugugguaguaaaauguuuccaguaaacugccuguaugcauguuaguuucagauaccaaaugggaaggguucugagauuuuugucuaaacuuuagaauauuaguaaauaauaggauugauuaguguaacuaaucaaucuucugugacucaugaacaacauuaugauacugaucagcucugugacauccaugaggcuauauuuccagucuugauaggcuguuuuuguaccuauuuugccacuuucuacuucuaucuuaauauucuuuuaucugauggccugguaaugaguuaggucuauuauuuuccuacagauguuauuauauuuuaucauaaucaacaacuuaguagaauauuaauagccuucuuuucuaaaugaauaacuuauucuaucaugcuucucuaagacuuuaaugaaagcaaaauaauccuuuaaaauccgaauaaaaugaacaaacacaaaaguuuuuguuuuauuuugaaauacucucuagggcuuuuuacaugcuaggcgagugcucuaucacugagcugcagaccuagcccucgccuuuuuaauccuaaaauauuauuuuaauaauacuuuugaucaauaaauugugauguauuuuaggaauauagaaaaaaauaacaguguggcauuaauaauauuuuauuuucuauacuugcaguauucuuuguuuugaaguguauacaggcuaguguguacaccuuucucaugccuaacucucauucaucuacccuaggcuuucggcacacugaguucuucauucacaacggagaccucaaccuagagcuguggucauaauagcucuugugucuuugaggucucagugucaaacagcaaguucccccaguacuuacccugauuuugauaggcuagguagauccucuggcuacacauuuauauagcuuuauuccuuuuuuuuuuucauuuuauguauauguauguuuugccagcauguuauauccauguaccguguuguauacuucccauagaaaucugaagaaaauuucagaucuccuggaacuugauuuagagacagaagguuguuagauccccuaggaguucuaggaaucaaaccuggguucucuggaagagcaggcccugcccuuaccacugagcaaucccuccagccccuuccccccagcuuuugaaauaaguguaucauuucuauuacuuuuguuugcuuuuuguaaacuucuugacagcaaagaucaauaucuuguuuuguuuuguuuuguuuuaaaaucuugaguucacaguccaggaugugaugacaagguguuuauuaggugauagauuaaugcagcgcucccugucguuggauuucuuugaagaauguuauuauaaauggauuuuuaacauuuacugaagcuugauugaguuugcccauuuuuacucccaaaguuggauauaagccauaucuuuuugauacgagguagaagggcuuagacaguaucucgcucugcaguccagguuggccugacacuuacuaugucacucuuguguccguccuucugcuuugacuccugagggcugagaugaaucugagaugugugguagacgacaucuacgccagcucuugagccucuaaaggccuuugacuuuccuucccuaacugucuacucaucugaagaaucaauuuucucucauuuauuuuuuuuuuaauuuuuuuauuuuuuuuaagaaaauggaaauuaacccauugaguuuacuguuagaguauguguuucuggagacuucauagagcucccaucuagugucaguaaggacuuagaggugucucaauucaaauccucucuaauguucuggccccgcucugaaauuuuuuugugugauaaacuagauggauucuuccuaugugugcuacuuuauuugaauggauaauuuaagauugggacauuuuuaaaaaguggugagucuaaugucucagaucguacuaacuuguuuuuccuucacaaucauuaaauuaugaaugugugggugugcaugcauaugugcuuguucauguguaugccugggugugcgugugcuuaugcaugcaugugugugugcaugccuguaugugcucaugugugugcacguguguguguaggauuuuagauuuuuauuuuguuuuuugacuuuauauuuucuauuguucuuaauaguaauacugguuuuaauuagaaaaacuuuauuaaauuuuuaacuugaagcaguuuccuguauuaccuuuuuuaaaaaaaaauguguuuagauauuuuacugcauuuguuuuuaaaauuaaauuuauguuaacuuauaguugaaaacauaaaauacacauauuaguggauaccaugucauauuuuaauauauguauaaauuauauuuaucuccucaaacuuuuauuuaagguaauuauuacaauugcauaguauguugcuaucuguggucuccugacuguacaguagcacaauguaauuuuuugcucccauccaauuguacucauauucacuaaucagucuuuaacuauccauuucuccccucuuacagucucuguagccuuuggccaucacugucuucuucaaacuuagaagaucaacacuuauauuccccauaugcaugagauaguaugguucuuucugugccuagcuuucuuagcauaaugaucucuaguuccuuucauguuguccuaaaugacagaguucuuuucuuuuuuaagagugagaaagauucuacuguguguauauguuacauauucuuuauucauucaucaguugauaaauacuucuguuauuucuaccucuagacugugugaauaguacuacaauagacauggucaaguuauugccuuuuugaaugguuaauuuaauucuuuuggguacaugcccagaaaugggauggcuggaucgugggguaguuuuaaaauuuuugaaagaucugccauacuccuuuucacagcaccuacuacugguaguaucauuaacaccugccaucaucuguuuucuuuuuuaauuggauauuuucuuuauuuacauuucaaauauuauccccuuuccugguuucucucccuccuacaggcacccuaucacauccucccuccccuugcuucuaugaagguguuccucuacccccgcacucccacauccccgcccucgauuccccuacacuggggcaucuauagagccuucauaggaccaaguaccucuccuuccauugaugcaugaacaucauuuauuuucuaaugucuuuaguagcuaggagugagguguugccucacuguggucugugacuuucauuugccugaguauggaaaugcugagaacaaucuuuuguucauuuuuaauuggauugcuugguuguauguuuuuugguuauugaguuguagugguuccuuaucacaaauuaggaacuaacuucuuuuacauccuuugugggggaagggugcauaaagauacagagcuucauuuugucaggguguauuucuagcuagccauugaacucuuaaggacuuugagagaaugagggaaaaauuuaaauuaaugguuucugaaauuuuucuaaauaucuaaagauacaaaacccaauaucagaaguucuauaacuugcaagugggaaaaguacaaaaaaaauuucuaugccaguaagauuguuaaauaucaaaagugaaugaaaaaaauaaagcuuuuuuucucaagggagcaacagacagagcaaaagguaacauaauagaaaaaaaaugauaugagaaaacauugaguaaaauaauaauuggggguaauggacuaauguacuuaacaugcugaaaccaaguaagugccacaaaacaagaauauguuccaagaauaaaaguacaauuaaauuuauuuuuaguuugaggcaucauugagauggcucaguagguaaaguuauuaaaaauacuuccuuaaaaaaaggaggcaucaaauuuuagggaaauaauuuuauccauagguaggaugugugcaaauaaaauuuaauugugguuucaauagcuuuuaacugaauuuuuauuuuuccauauuuucuuuuuauaaaauuuuauuuauuuauuuauuuauuuaacacuccagauuucauuccccucccgguccacccuccaacuguuccacaucccauaucuccuccccagcccaucuccacaaggauguuccagcaaucccgcagccccuaugccaccauaccuuuccacucucuggugccuccagauucuugaggguuaggagcaucuuuuuugauugaacccagaaccaacaguccucugcuggauauguguugggggcuucaugucagcugguguaugcugccuggcccaaugucugagagaucucagggguccacguuaaugagacugcuuuucccaaauucaaccacaggggucagcagcuucuguccauugguugggugcaaauagcuacaucugacucuuugggcuguuuguugggucuuccugacagaaguuaugauaggucccuguuagugaguacuacauggccucaguaacagugucaggccuccagagcucccuuugagcuggagcuggaucccacugugggccugucgcugaaccuucuuuuccucaggcuccucucuauuuccaucccugcaguucuuucagacaggagugcuccucuuucuucacauccucuccaacauguguugucuccugagguuuugaucuuagccuuucugauugauguaagguggaaucucaggguuguuuuguuuuguauuuuucugaucacuaaggacuuugaacauuucuuuagaugcuucucagccauucgagauuccucuguugugaauucuugguuuaguucuauaccccauuuuuugauuggguuguuugguuuuuuuggugguuaguuucuugcguucuuuauauauuuuguauaucagccccuaauguaugggggguuagugaaguuuuuucccaaucuguagguugcugauaucauuaauauuuuuaagauaauaguuuaauuauauuuaugagaauuuaguauauauauuuuaaucuuuugcuuuuuauucccaaucuguaaguugcugauaucauuaauauuuuaagauaauaguuuaauuauauuuaugagaauuuaguauauauauuuuaaucuuuugcuuuuuauucaucuacauaacuccucucagaucuaaucucccucuuccauacucaccucuauuuuguguacccucuuuucuuuagaagauaguauauagcaguaaauguccugauccucuggcuccuauagucauccaccuccuuuuuccaugauucccccugagccuauguagaaggguuguguugaaaauguauuaauugggguugggcacacacugauucguuuucuggauuuugacugauuguggcuuucauuaauagucuuuaucuguugcaaauggaaguguuuuugauaagggagacgugagagcacacuuaccuguuauuuuuaaggaugacuguuuagaaugcaguagaaguuauacugguuuaggaaaguaacaguaguagauucucuuguaagguucaggaccucaccagccacaaguaguuuguugaguuuacaauaccaggcacaaacuuaacuccuaaugaaugaaacuuaugucaauugguugucuguugguaaccacuacacugcuacuauuacaccuuucagaauauauucuucugguuguuauuguggaccguaggcauuacagcuagauaggaccauugcuuucuugcuuggcagcucacguagcuccuucuaguucugugggagguaguucucagggggugggcuuucauggcagaaugugaucgauuaccccaaacacuaugucuuaaguguguggugucuucacuaugguuuuaccuuccgcuguuguugggaugucucuuggacucuccuaccaauaguucaaaggagcuuuuccaugucuggcauucaagguuuuuguugauagucuaugggguuuuuuuggggggaggguuauuguuaccccaaaacagcuucaauuaaauuauguggguguguuuauuugaguguguagacaaacacauuaugugcauuauuaagugagcauaaaauaauacaguucccguguaaaugcuacuucugacacuaggauuuuagauuaucuuuagggauguuggaagagacuguggcuaugcaguagacauuauuugcauucaucccaaauuuuuugacagguuuaaaguaacuuguugucuucuguuaaugagaaauugaacucauuuuuauagagaagaguggacggaagcuauccaagccguagccgaccgauugcagaggcaagaggaggagaggaugaauuguagcccaaccucacagauugauaauauaggagaagaagagauggaugcgucuacaacccaucauaaaagaaagguagauaauaaugaugacuuguucucccaaguaaacucuuauaugcugaaagccauguuugagagagacaucagccaacuuucauauuguauguauaacuuugugaaccuaaagugccuguugcuuacaacagaguaauugaccagcacuuugguccaggauguuugugggacuuaggaaggagugguaacugauguacuuuauuaaauaacauuuuaccuuguugguaacagcauuuuggaaacuuggaaaucuuugcaaccccauaggaagaacaacaauaucaacgaacuagaccccucagagcucccagggacuaaaccaccaaccaaacaguacacauggagcgaaccauggcuccagcugcauauguagcagaggauggccuuauugggcauaaugggaggaggaggcccuuuuuccugugaaggcuccaugacccaguauaggggaaugccaaggcagggaggcaggaguggaugguugggugggugggggagcacccucauagaaacaggggggagggagaugggguaggggguuucugaagggggaacugggaaaggggauaacauuugaaauguaaauaaagaaaauauccaauaaaauaaaagaaaaaagcaagcaaaaaagaaaaacuucaucuaaacuacaaaacuuccuuaagggagacaguguaagaaaaucaggaccuuguuacuugguucuccuuugugaaaaauaauuuacguacaugacuacaaagaucacuuggcugguguaauucaaacuuguaaauaaaaggacuuuaaaaaaaaaaaggaaaaauggcucugugauuucugaccugugcuuucaaccuuaacgaaagcuaccuagaaagugagaagucuauaaauaccuuuucuuuuaauugcugcucaugagccaaugaagaagacaaacauaaccuuuuuccccucagugcucuagauuaguauauaauuuuauaggaauuguaaauaauauuuuucauuauuacaaaguuuuaaaauaauuuuuauguaauauaugauauuuaaaacuagucuaagggguugcguauuugaaaauucugacauaauaagaaaaaauggccagaagcugcccagucuguaaccugauaauugguaguaagucacaacaucauugacaugugcguguugaauauauauuugcuauuuacuuaguaguuuauauucagguaggggguaaaaacuugcuuaaaaaguauuaucaauuauguuuugugaguuuuguuuaauuaguuaauuuugcaguauuggaauuuugaauuuaggaguauguuaaaugcuccuaugccgccaaauuccaccacuugauguuaguguaguggucagaauuccuuucaaguuaaauugccuggguucaaaaccuuucucuuuuuauuaaucauuuuauucauuuacauuucauaugauauccuccuuuccaguuaccccuucuccaacccccaucccauccaccuuucccccccuccccuuugccucaaugagggugcuccucuacugcucuagcaucuccuaugcuggggcaucaagccuccacaggaccaagggccucccccacauugauaaggccauccucugcuacauauguaucuggauuccuggcucccuccauguauacuacucugguuggugguuuagucccuggaagcucuagguuguccaguuaauugauaucguauaugggguugcaauucccuucagcuccuuucguccuuccccuaucucuuccauuggggcccgguugccugugaguaucugcaucuguauugguccagugcugguagaaccucucagggaacagccauuccagcaaaugcuaucuugacaucagcaauaguguggggguuuggugucugcagacaggaugaaucccuaggugggguggucucuggauggccuuuccuucggucucuguuccauucuuugccccugucuuucuuuuagacaggaacauuucuggguuaaaauuuuugagauguguguucuucacaugcugucagugguuuuagugaaaugauauagucacaacuuugagaauuaauucacuaugugaaguuuuuucuuuaauuaaaauaucauucuguacuugaugcuuaugaacacuuucugucuuuuuauuuuuaauuuuccugcacuuuauuuuguaugcaauauauauauaucuccuuugaauagauacaucuucucucuuguggugguugauuggaguagcugagucauuauuaauugcuuucucagucaggaagaugaacauaaccuaucuuuacccauuuauucacaugagaaauuuucuuuugcauagauaauaucuaacuugaagauugagugugauaguaaauaugaaucaaauuccccuuuaucucauccuuuagguggaacaacaauaugaacuacccaguaccccccagagcuugugucucuagcugcauauguagcagaagauggccuaguuggccaucaguggaaagagaggccucuuggucuugcaaaacuuuauaugccccaguacaggggaacaccagggccaagaagugggaguggguggguaggggagugguggggaggguauggggaacuuuugggauagcauuggaaauguaaaugaagaaaauaccuaauaaaaaaaaagauaaaaaaauaaauaaauaaaaggcaagcuauaccagcucuguucugucuaauuuucuggaauucuaaauauaugcuuaacagaucaguaagauauuguuaaaccaggaguugaaaaugguauguuaguaacauuguaacuuaaucuacuacaucugauggaugggaggauauuaaauauaaguauagacauuaaucaucaaaaagaaugaauagagaugcauuuuagcaauauacaauagugaaaauauauaaaccuauuuuuuuguaaagacugauuauaaauguuaauaacugaaucauauuuuuccuuuuuauaauuacuaaguugaaaguaauucaucauuaucacuaauugccauuaguaagcaucuauuuuaugcuuuuuuaugguagacuuugagcaguacuuuugcacuuaccauuuaaaagucaucugagguaugucuacuaaugugcacuuuuauaguugagugaucugauaaaguuaaauaucuuacucaaauauccaagucuuuuaauuguacauuauguauaacuucacuguguacacuauguaguauuucuuuaguucauauaucaguagaagguuaacauuguaaaauaguaguagaaugugaaauuccugaguuaauaccuggguagaauuucugacucauccuuuagcuuccucauuaccaaaauggggauaauuacaguaucuaacucauaggguugugaguccuaaacugaggggcauauuuuguauuuauguauacuaaauauagaaucaguuuugaugguuauaguuagcauccugcuuugucccauaaaacuaacuaagcaucuuucuacagguugucuuagaauuauuuacuaaaacuugauuuuaaaaauaaaguuuaggaccucacacuuguuaugugaauccucaacuuaguccccaucaaaauuuuagauauguucgaaguugucucgaguauccuugaacccaugcuguuauccauauuggcuuuaacucagaaaacuccugacuuagcuucacaaguacuugagaguacaugucuccauuacagacugaucugauagaaauauuuucaauauauuugugauuugaggucuuaaccauauauaauuuccauacgugugugugugugugugugugugugugugugugugugugugugugugaauaauuuuagauguaugugguaauugaaaauacuuuuaaauuacaggaguauauagaagguguuuauaccaagggcugcucuauaaugauuccagugauuuaaagugguucaguauaaaguggucuuuguaugugacaaccacauuuagaacauuuuggguaugugacaugucauuuuuagugcuuuuagauaaaaaauaaagaggguacuuauauauaccauguugaacaagaaaaucaauuuauggccuaauuaugagccuuuuaccuauuuauuguuauagaaguacuagaaacaauagcagcaugcuauuucuuaugguuuuguugcuagcuguacuauucugcaguucuuacauagaucuucaaauacauuauuuuaggcugcccauguucuggcccugaaaaauccaaagaaaacuuucuguuaugucucaggguuugguguuuucuuuugcacuugguaccuaucuaugugguucugcacaguuucucugugcaugugauuuauuugccagggucucaguacauagucuuucccucccacaagguagccuuagcuuccacacagaaagaaagcugucucuugagaguuccuaagagagagaaaacauuaauccccaggccuaaaggguaguucuauagacauuuaaucaaagacaauuuaagaauugugcaucugaaagaaaauggaagauugagauaagguacuaggaagaagaaagggaauggggaaaauuauguauuuauaaucuuucuuuaaaauuuauuaaaaaugccacccagauagaaauugagagugggggagggagaaagggagagaaaggguaggugugagacagacuacuacuuacugggaaucagacagccaucuuuggagucucuuacguugguccuuaacaucugaguuuuuaaagcuguuaguggaauuaaaugucuaguuaucuauuauuuuucuaaauuacuguauuuguaacucuucuacaugugggcagcuauaugccugaauuuuaguugaauuaauaaguauacauuacuuauaucuuuuugacauuuacuuuuuccuuugaacuacauauguuaagauguuauaauuugacauuuggauaaauuaucaaaauuuuuggcaagagguauuaaaauuucauguaggcauucauuuaugaaauauuuaaaauuuuguaaguagguacaugaagggcaauuaacuguaguuuuacugcaauaucuuugucugguuuuaauaucauagugugaauugaacaguauuucucccauuucaguuuucaggaagagcuuguguagaauuggugccuuuuuucucgaaaugguauaggcuuuuccuuauuguaaaaauguaauauaaauucagcucuuacacggagcuguucagcuuacuuaauacuuccucagagagcuuuuguaguuugaggguugcucauuucaucucaguguuccucacuaccauagagcuguuuguucucucauggucucuuuaaugccuguagauucuguacugaugucaccuuucucaguucacguugauaaguuuuaucuuuguguuuaucuuccugaccaguuuaccugcauguuuacagguuuuucuuguuguuagguugauuuauuuuuacuccuuucuccuauuuuuucgaaaacuuuuuuaguuauauuuaaaacuguguuuuugaauaucacuuuuucugagguagcaccacuuaaagcaagaaaaccugagaacuugaaaauauuguaauuuuaaaaaaaaucuccugucacuuuacuaauaguguaacugauggagaaauucuagguucaaaauaaauucuauaaacucugaaaauuacauaaauuauuuuugguaucccagauugcugaagagacagucaauggaaguauguuuugguuuguuuugguuuuuuucucauuggaaauuggucuagaaauugguaggaacaguaucaaguguauggugcaaguuuauacagcaaguaauauucaacuauuucaucaugguuuucuaauuuauauuuuucagacgaugaaugauuuugacuauuugaaacuacuagguaaaggcacuuuugggaaaguuauuuugguucgagagaaggcaaguggaaaauacuaugcuaugaagauucugaagaaagaagucauuauugcaaagguaacugauuguaaaagccagugaauuaauuuuucuguagugugaaccugcauucauucuuauaaguggcgguauagguauuccaugaaauaaucaagguauugauuauaaacuaucaauuuuaagguuuucaguauaguguuauguaaauuauggugaaacuguuauucucuugugaaaauauuuucauuguaaauuuagaggaguuuuuaaacgauacauuugugauccacauuacuauuuuuucauaguguauaugugccauauuuucauuaucuguucauaaguugaaggauauuuagcuguuuccauuuccaggcuguuaugaauagaacagaaaaugaaccuggcugaagaauaucuguggaaugggcuguugaguccuuuguacacauaauaagaaaugguuuauguggaucauaugguagguuaguuaauuuuuagcuuucugaggacucucccauaaugauuuccaaagaggcucuguccauuuacaaucccaccaacuaugagugucuccccuaugcucauguucccuccagaauuuaucuguuggcuuguugaucuuugccauuuugauugggguuccaugaaaucucaaaacuguuuagauuugucuuucccuaauugauagggacugacaaaauaucuuaacauuuugaaccaucuuagacacuuuugucuuauuuugagaacacuuuuuuagaggucagguccauuuuucuuuugaauggaucauuuguuuuuggauagauugauuuuuauuucuuuaugcauucuaguuauuaauccucugucagcuguauagcuagcaaagauuccaauuuguggcccccucuuaaccugauugauuguuucuuuaguuaugcagcagcuucucaauuuaaugaacucccacuuauuaauugauggcuuuaauucuuggauagagggaguccuauucaggaaguccuuuccuguaccuguaucuacauuuaccuuuuucuuauaccaguuucauuguuucagguuucacauuuaaguuugugaaccauuuggagauaguuuuuguacuaauugcaaucuucugcguguggacauccaguuuccccagcaauauuuaaugaagauuuauuauuuccuagagcauguauuugucaucuuugucaaaauuaaaugacugaauuuacacauacucaucuguuuguguucuuaauccuguuucaaugaucuauauauuuguuuuugugccagaagcguauugcuuuuaaauauuuuauuuccuuugaggcugcugugagaguauauccaugaccuuguucucuguauacuugugguugguguacagaaaagcaauugaucuguacaaguugauucuuuauccuucaucauugcugaacuuguuuauuauuucuaguggguuucugguagaauuuuugguauuucuuauacaguauuaugcugugugcaaagaagaauguauuagacauuuuuuuuuaauuuuggaucuuuaauuuucuuuucuugccuuacugcugcagcuaauacuucaagcauaguguugagaaagaguggggcaaguucauaucucagugucauuccugccuguagugguguaaccucaaauuugucuccacuuaggacauuauuggcuguggguuuuuuauuuacagcucucuuagucggaguuacuauugcuaugaugaaaugccauggccaaauugcagauuggggggaagaacagaauggggaaacaucauaguccauccaugaacaaaaucaggacaggaacuccagcaagacuggaaccuggagacaagggcugauggagaggccauggaggauggcugccuuauugguuuuuccacauggcugcucagccugcuuccuuuuagaccccagcacuauauauagcggaaggguggccucacccacagugggcugggcccucucacaaaaaucacuaauuaagaaaaugcucuacaggcuugccuacugccugaucuuagggaagcauuuucucaaucgucucugaugacuaacuuauaucagauugacacaaaacuaagccaggacaguagcuuuuauuauuauguugaaguacguuaccucagguccuaguuuuucuaggacuuuaauuauggagucauguuggauuugaugagaggccuuuuugcaucuuuugagauaauuguggauguguuuuuguccuuaaguccauuuaugagguuuuuaaauuuccuuuuuaaaaaaaaaaaaaauugguguuuuuagacaagguuucucuuuguuagccuuggcuguccuggauuuuacuuuguagaucuugaacucagagaucuaccucacuagucguguaccugugucuauugacuacauuuauugacuuguguuacgugcaacuaucccuacuucucaaaggcaacgugcuaauaguugauaaucuucuugacuuucaaguguguauuugguuuguaaauagauuauugagcuuuuuaaaaaucuauucauuagggauguuggucucuaguguuugcggggauuugcugauauuuuucuuugcuugguuuugauacuagagucauauggucacauagaagaagcuuggaguguuccuucuguuucuauguguuuuaauaauuuaaggauuccuuauauaucuuugauaguagaucuauauaauagaauuccucuauccgugaauccgggccugggccuagacauuuuuaguugaaagccuuuuuguuacuauuuuaaucuucucauguguuguggauuuguuuagguuguuuacuucuugcuuuaauuuuggugguuugguugaaucuagaaagucauccauuucuuuuagguuuuccaacuuaaugaaaugcuguuuuuaaaaauauucccuuaucuuauuaaauuccuugguaacucuuuaauguuuucauguucauuuuugauucuauuaauuuggguuuccuuccuuccuucuuuccuuccuuccuuccuuccuuccuuccuuccuuccuuccuuccuuccuuccuuccuuugguuaguugguccagaggucuguccauuuuuccuaucuucucaaagaaccgguuuuuagauucauugauucuuuguauuauguuauuucuauuuuuaaguuucuccuuuuuuucucccuuauuucugauugucuacugcguuuugauuugguuugguuuuguuuuucuaaauuacugaguuguauccuuacgucauuguuuucugagcucugacuuuuuaauguuggcccuuuugggcuauuucucugacaggguugcuucuagugaguacuagagguauccuguuguauuuucacuuucuuuuaggucccgaauaauuuuuuucuuccuugauuuuuccuuauuggaucauuuuaucuuucaguaauugguuguuuaaucucugaguuuguguauagagauuuguuugguguaugucacacaagauacauggaguuaguccaguuuuucugaguauauaaauacuuguuuuguacaucaguguguagucugucuuagagaagcuucugugugcugcugaggagaauucauauucuuuaaucucuuucuuuauuucuuccuugaucaaaguaucauugagcagaguguuauucagcuuucucgagaauguuggcuuucuauauuuauguuauugaagaucagccuuaguccauggugaucugauaggauacaugagacaauuucaauauuuuuguaucucuagaggccuguuuugugaccaauuauauggucaguuuuggagaagguacugagaagaagguauauccuuuugcuuuaggauaaaauguucuguagauaucuguuaaauccauuucucucauaacuuguguuaguuucaaugugucuauguuuaguuuuuguuuccaggaucuguccaaugaugagaguggagugcucaagucucccacuauuauugugugaggugcaauaugugcuuugagcuuuacuaaaguuucuuuaauaacuguggcugcccuugcuuuuggagcauagauauucagaauugagaguucaucuugggagauuuuaccuuugaugagcaugaagugugccccuccuugucuuuuuugauaacuuugaguuggaagucgauuuuauucgauauuagaaucgcuacuccagcuuuuuucuucggaccaugugcuuggaaaauuguuuuccagccuuuuacucugagguagugucugucuuugucccugagguggguuuccuguguacagcaaaauauuggguccuguuuguguagccggucuauuagucuaugucuuuuuauuggggaauugaguccauugauauuaagagauauuaaggaaaaguaaucauugcuuccuguuauuuuuguuguuagaguugggguucuguucuugcggcugucuucuuuuagguuuguugaagaauuauuuucuugcuuuuucuagggcguaauuucuguccuuguguuggaauuuucccuuuauuguucuuugaagggcuagauucguggaaagauguugugugaauuugguuuugucauggaauaccuugguuucuccaucuaugguaauugagaguuuugcugguauaguagccugggcuggcauuuguguucucuuagggucuguauaacaucuguccaggcucuucuggcuuucauagucucuggugagaagucugguguaauucuaguaggucugccuuuauauguuacuugaccuuuuccccuuacugcuuuuaauauucugucuuuauuuagugcauuuguuguucugauuauuaugugucaggaggaauuucuuuucugguccagucuauuuggaguccuguaggcuucuuguauguucaugggcaucucuuucuuuagguuagggaaguuuucuucuauaauuuuguugaagauauuuacuggccccugaaguugaaaaucuucauucucaucuacuccuauuaucuguagguuuggucuucucauuguguccuggacuuccuggauguuuugaguuaggaucuuuuuuggauuuugcacuuucuuucuuuguuguguccaugcuuucuauggaaucuucugcaucugagauucucucguccauuaucccgagcuuuuguccccgcuggcaagaacacacucaggacaaccggaaucuucuguggcaaagcuuuauugcuuacuucucaggaagaccccaaccccagaaaauggagucgcuuauauagccgccaacgugacguuucagcaccugauguggcgugacagcuccugauucguugcucgcccaucaccccauuacuacgcccugagaugggcagugacuaggagugaguucacacucacaccugcguacaaggcuuguuuacuaguuaggcacagcugaggcuagcgccaucuuauaauggugauugcucacggcucgcaauugcuugcagcacggcucuccacagucuaucuguuauauucuguugcugaugcucgcaucuaugguuccugauuucuuuccuaggauuucuaucuccagaguugucucccuuuggguuuucuuuauuguuucuacuuccauauuuagaucuuggauaguuuuguucaauuccauuaccuguuugguuguguuuuccuuuaauucuuuaagggauuuuuguguuuccucuuuaaggacuucuacuuguuuagcaguguuuuccuguaauucuuuaaaggcuuccaccuguuucgcaguguucuccuguguuucuuuaagugaguuauuaaaauaacuccuaaagucuucugccaccaucaugagauaugauuuuaaaucugagucuugcuuuuuggguguguuggcauauucaggacuugcugugguggccguacugaguucugauggugcccaguggucuugguuucuguuaguaauauucucacgcuugccuuucacugucugguaaucucugguguuagaugaucgagcugucucuggcuggagcuuguuccuccugugauucuguguaucagcacuacugggaguccgacucucaccugggucccaguggucagagcacucucugcaggaaagcucuccucuugcagggaagguaaccagaagucuggagcucagauccacuuuuugaguacugggcucaaagcccucccuguaggccgacucuccuuugucaaggaaggugcccuggggucugggucucagcucugccuccuggcugaggaugaaggucagaagggauccuguccaagaagcucuguugcuucugccaccuacgugcucucaagggauccaaagguccuggguaugcuaggggcccugagguguggagaguccucuggggaccuuggacccuccgcuggguuugcucugaagauggcuuggggcuggcccugacuggaaugaauccuagccucugcucaggcaggguuccuuuguccauguuccuacuggcacaagacccuccgggauucuuuggaacuaugauccggaggcccuggguguguuagagguccugugguguggagaguccuuuguggaccuugggagccuccaccagguucgggccuccuuugaguuuucuaguugguuuacuaggcuuuucuagcccaucuuuauuacagcauaaguccucuucaauguuucuguaguuuuauuaaauuuccuuuaaaaagucuggauuguuuuuguguuuucuaccagccuucuauuuguguuuuccugggcaucacucauguauucuuuaaguucuuucucuuuaaauucauugagcuacuucuuuguaucuucuguaaguuccuuaaauauuuaaauaaguguaugacuguucuuuuaaguucuguguccuccagguaagccucauugagacauacauaaccuuuuuauuuaaaaaaaaaaacaaaaaacaacaaaaaaaaaaaccuccuaaaguagguuuaaaaaaucuugagaggaggaauuaagaauuaauaaaaaaaagagaaagggaagaaauauuacaaauuggauuggaaucuaguuccuuacccaaacuuucaggagggugagguuagggccaugguuuaagagcuguaaaaguauaauacgccuacaucagaagcaagcaggcaagugggacuagguugcuaauacauggcauguggagaugauaaucuuuggaaguuacugugcuuuauuuaaaacugugugaguucugcccuccugcucuuccguccauacuuacuucaucuccuucagucucauuugcugccgugcugggaaagaggaaguaaaugcuuucagacacuguauaucuuuuuuuugggggugggggggaguucaagacagggcuucucuguguagccuagacacuguauaucuuaaugccggcuagaugugauagaauuaaucaccagaccuauugucaauaugcagaaaaccaugaauagaacaaggagcuauuugaugauagaaggcagucuugugaaauagaaaugacaauuauuauuggagcuagauaugaauuauuaauacucuuucaucugugcuugagaaauuauauucugugaacuucaauuuacuaagauaauucauaauccuaaacccaagugucaccuuugggucuuuguuaauaguguaaacauguuuuccuguuuuguuuuuacuuaaugugcuauuuuuguuuuucuauuucucaguagaaacagaacugucauaaaacagugagcaaauuaaggcagaagguuaggucauauaucuuggagggugagugauaagauuagagagaaugauugcccuccccccacccccgcccgacuucaggaaauagucuaccucugaagcuucuuugaacggaauuugacuuaaagaguccuuaguuaguauuucaggguggcugaauauauggaagucuauauuucaaaggcaauuuuaucagaacguuauucuucagaaucuuaggauuucuaaaauucuccauuuguaaucaucauuagcaaauaauuuuuaaauaagcauuucauuguuuuagccauaaaauuuucucacuguuauuuuuaauuucuuguuuugacaugcuauuuuuaacuguaauuaaaaauuauuggcaucuguguuuauuucuuagcuuauauguaccauaucuucauagaaaaacuaauuaguaugugaaguacaauaccauuaaauuugcauuaauggaaaauuuucugaccuuaaauauaaauuaugauagaaaauacauuuuaauguauuaaagauugaucuagcuuauuaccucuuauuuauaugaucauaacaaauaauuuucuuaccucuuaucucuauauuucuuugcuuggcucuguacauguuaaauugauugaagaauuuaaaggagggaaagucacaaaauuucauaaaauuuacaaauuuauguaauacuauguggaauauuacgugaaauauuauguggaauguggcuauaguaccaaaacagaaugaaauauuacccauuuuccuaaaguaccagauuauaauuuuccaauguuaaauugguuugcuguuugcuacuguuuuaauauuuuucuaguuacagacucagauuacuuacccacagcagguguuugcccuucaggaaauaucuuucuugcugcauauaaagacauauuucuuuugauuuaccuuuuuaauuaaggcauguaauuuuuagaauauuucaguuccuuuuaaaccuaaaaauaucucaaaucaccccauuggucaauggcaucuugacuuuaucuuggguccuuugaugguccucuaagguuucuuuguguuuuacuguacauaccaggggaguacuaguaaacuggacaggucagguuccaucaugugaaccaccauucccugccaaacuuacauuuuucaguagcauugauuuuuuuuuuuccuuuucugucucauuuauaauagcauauaaccccaaauugguuaguuauuuaucuucuucacuagccugugaaaucugugaacaaagaaaucuuuuuguaauaaagcagccuuauaccuguaauaucauuagcuuuuuuucuuuuaaaaauuauuuauuuauguuccagccauugcacucuccucccagaccucccacccccaucccacaauccucaucccacuccucugcccccuugccucugagaggguguucccaucaccagaguucccccuucccuggggccucaagucucuuaaggauuaugcucaucuuguccuacugaggcuagaccaggcaguucucugcuauauaugugccagggagccucaaaccagcccaugugagcuccuggguauucucuagggcucagucucugggagcucccugugguccagguuaauugagacugcuggucuucccaaggggucgcccuccccuucagcuucuucaauccuuucccuaauuaagccauagguguccccgacuucaguucagugguugaguguagauaucugcuuuugucucagucagcggcuggcugagccucucagaggacagucaugcuaggcuccugucuucauucuauucuccauuuuuguuccuguaguucuuuuagacaggaacaguucuaggucagaaauuuugaccauggguugguaacccugucuuuccucaggaggcccugucuauccuagguauuuuguacuuuuuggcuaauauccauuuaucagugaguacauaccaugcauguccuuuuuggucuggguuaccucguucaggaugauauuuuguagguccauccauuugccugcaaaaaucauggugucuuuuuuuuuuuuuuuuuaaauagcugaauaguauuccauuguguaaaugaacuacauuuucuguauccauugagguugagggacaucuggguuguuuccaguuucugacuauuacagauacagcuguaaugagcauaguggagcacuuguccuuguguuauggugguauacucuuuuuuggguauaugcccaagagugguauaguucgaccuucagguagaacuaugucuagcuuucugaggaaccaucagauugauuuccagagugguuuucaccaguuugcaaucucacccaaaauggaggaguguuacucuuucuccacauucuugccagcauguguuguuaucugagggucauuuugauuugcauuucccugaugacuaaggacuaaaguguuucuuggccauucgagauucuucuguuguaaauucuuuguuuagcucuauaccccauuuuuaauuguuuuuuuuaauuuggagguuaacuucuugaauucuuuaauaucuuuaauguuagcccucuguuggauauaggguuagugaaugauuuucccaaucuguagguugccaguuuguucuauugguggugucuuuugccuuacguaaguuuuuuuaguuuccaugaggucccauuuaucaguuguugauaguaagauccugagccauugguauucugcauaggaaacuucguucugugccaaagagucccaggcucuuuuccacuuucucuucuguuaguuucaguguaucuggcuuuauguugagguccuugauccacuuauacuuuguggaaggccauaaauauggaucuauuuucauucuucuauauaaagacagccacuuagaccagcaccauuuauugaagaugcuuucuuuuuuccacuguauguuuuuggcuucuuugucaaagaucaaguauccguagguguguggguuuauuucugaaucuucgauucuauuccauugguugaccugucuuucucuguaccaauaccaugcagucuuuaucacuguugcucuguagaacagcuuuacaucagggacggagauuccccccagcauaucuuuuauuguugagaauuguuucacgauccuguauuuuuuuguuuucccauaugaaguugaaaauugcucuuuccaugucugugaagaauuguguuggaauuuugauggguauuauauugaaucuguggauugcuuuuugguaagauggccauuuuuacuauguuagucauaccaauccaugaucaugggagaacuuuccaucuacugaggucuuuuuaauuucuuucuucaggaauuugaaguucuugucauacagaucuuucacuuguuugguaagauauuuuauacuguuugugacuauuguugaaggguguuguuucucuaauuuauuucucagccuguuuauuauuuguauaaaggaaggcuacugauuuguuugaguuaaauuuauauccugccacuuugucagcuguagcaguucucugguggaauuuugugggguugcuuauguauacuaucauaccauucaaauagugacguuuugacuucuuccuuuccaauuuguaucuguuugaucuccuuuuguguuuuaauugcucuagcagaacuucaaguacugcauugaauagaugguuugagagugggcaacuuugucuuguacccaauuuuagugugauuucuucuaguuugucucccuuuaauuugaugugggcuguugguuugcuauauaauacuuuuauuauguuuaguuauguguaugugccaugaauuccugaucucuccaagacuuuuaacaugaagggguguaauguuuugucaaugacuuuuuuuucagcaucuaaugagaugaucaugugauuuuuuuucuuggaguuuguuuauauaguugauuauguuaaugaauuuucauauauuguaucaaucuuguaucccugggaugaagccuacuuggcuguggugaaugauaguuugauguguucuuggacucaguuugcaagaauuuuauugaguauuuuugcaucaauauucauaagugaaauugaccugaaggucucuuucucuuucggcguauuugcaugguuuauguaucagaauaacugauaacuguggcuucauagaaugaauuagguaauguuuguucuguuucuauuucauagaguaguuugaggaguauugguauuagcucuucuuugaaggucugcuagaauucugcacuaaaaccaucuggcuccugagcuuuuuuuuuuuuuuugguugggagguuuuuuuuaaugccuauuuccuuagggguuauuagacuguuuagauaguuuaccugaucuugagauucauccauuucaucuagauuuuccaguuguguugagcuuaggcuuuuguaguagguuuugaugauuuguugaauuuccuuaguuucuguuguuauaucucccuuuucauuucuguuguuauuaauuugcauaaucucucuguuccuuguuguuagauuggcuaaggguuuaucuaucuuguuuauuuucucaaagaauugggucuugguuuuguugauucuuuggaucauucucuuuguuuaaaacuggauguuuuccacccugaguuugacuauuuuuuuuccaucuauuccuuuuggguguguuuguuucuuucuguuauacagcuuuugugggugcugcuaaguugccuguguggaaucucuccaauaucuuuaugcaaguacucagugcugugaauuuuccucaacuuucauugugucccguaaguuuggguauguugaaucuucauuuuuauugaauucuaaaaagucuuugauuucuuucuuuauuucuuccuuaaguuauuguugagcagauuuuuauuucaguuugcauaacuaugcgggcuuucuguuguuucuguuguugaagucuagcauuagucuguggcgaucugauagaaugaaugggauuauuucaaucuucuuguaucuguugagucuuguuuuguguacaauuuuaugcuaaaauuuggagaaaguuccaugaggugcugagaagaaugcauauucucuuguuuuggggugaaguguucuguagauauuuguuaaauccauuugguuccaugccuuuguuuaauuuuuguuucaaggaccuguccauuggugagagugguauguugaagucucccacaauuaaugugugaguuucaauauguguuuuaagauuuaguagaguuucuuuuacaaauauggguucccuugcauguucagaauugagacuuccucuugguggauuuuuuuccuuugaugaauaugaaauguccuuccccaucuguuuugauucuuuuuggguaaaggucuauuuuauuguauauuagaauggcaacugcugcuuguuucuugggaccauuuguuugaaaaacuuuuuuccagccguuuacaaugagguagugucugucuuugccacugaaguauguuucuugcuaugcagcaagaugcuggaucuaguuuacauauccugucuguuagccugugucuuuuuauuggggaguuuuuaguccauuaauguugagaaauauuaaagacagaugauuguucauuccuguuauuguuauuuuuguuacugaagaugguaguguguguguguucgcgcgcacgugugugugccugcauuucucuucuuauggguuuacuuuaggauguuuaauuucuugguugcugucgcccuccuuguguuggaguuuucuuuccaguaucuucuguagggcugaauuacuagagagauacuguuuaaauuuagguuuuuuuucauggaauaucuugguuucucauucaauggugaaugagaguuuugcugaguauaguagccugggcugccauuugugcucucuuuggucugaaugacuucuguccagggucuucuggcuuuuagagucuccguggaaaagccugguauaauucugauauaucugccuacauaucuuacuuggccuuuuucccuuccagcuuuuaauauucuuucuuugcucugugcauuuaauguuuugauuauuaugugacaguagauuuucuuuucuguccaauuuauuugcuguuucggcuucuugaauauuuauggccaucucuuuauuuagguuagggaacuucuaugauuuuguugaagaugcuuucuggccauuugagcugggacucuugccccucuucuauuccuauuauucuuagauuugaucuucucacuguuucuugaauuuccugguauuugacguuaggagcuuuuuacacuuuuguugguaaugcuugcaucuguaucuccugaucuuuuuccuagguuuuccaucucuagaguugccucuaucuguguuuucuuuauuguuuauacuuucgguuuuaagucucaggccuuuuuguucaguuccuucaccugcuuuuuuguauuuuuaauuuguuuaaaagauuuauuuguuuccuuuuucagggcuucuaauugcccguguuuuccuguauuucuuuaacggaguuacuuauauuaagggccucuuuuaucuucaugagaugggauuuuaguuuagaaucuuguuuuucagauguguuaggguauccaggacaugcucugauaggagaacuggguucugaugauggcaaauugcauuuggaucuguuacuuauuuucuugagcuugcauaugguucucucugguguugacuggccugggugccucugacuggaacuggccucuggaggcagguagagcucugugaccuggguuagagccagucuucuggaaggcagucagugcugucucugguuaggaggggccuccuguaucucugguuagagcagaacuccuguguuccuagucagggcaaaccuccugggagacaaggaggcucagggcuucaggggcaggaucuaacccauuuguagauggagguacaaacuggaaggacuaugacccugguuaaggcagaccuucugugucucugguuacugcagaccuccugugucucugauuacugcagaccuccugggagucagaaacauuguagggugugggaggguaucaugcuccugaucuggucuggguggggaaagaccagaaagaagguggagcuuaucagggcagacagguccuuugucagcugggcucuguggaugucccagcuggcuugggcaggagggacuuucaccuguguugcugguuucuauggaccuccugagaggcagacaggcuguaggguaugggaguguaucaagccacugaucuggcucggguugggaaacugccauggacauuuuuuaagugcacuguguggaauuuuuaaaugaauugguuuaguucuauguuaucacuugcuuaauuauguauuucauguaauucauauuuuauaugaugcuuauuaucgaauaccuauauggcuuuguccauuaauacugaucacuguuugacugauuagaaugaaaguuccaugagaacagagaaauucucuauuucuuuauccaaggcccugucuccaguguguaaauuagaccuagauaauucugcauaguuguugcaguaaugguugaaagaaugagcuuuugacuuuaugacauccaguucaaacauuaaguacuuguuguaugguaaccguuaugcuauguacuaauggguauaaaaucuauaaguuuuuguguuauuucugcuuuuauuuacuaaaguguuaauuaugauugacugagacauaacaguguacuguagcaaugacuuuaaaauuguuugaacaguaaaacuuggcuucuauaaaauaagacugaaaugauuugcuuauccuuagcuuaauuugcauuaaaugcuacauuguuaauucacuuuucuuuuuguucauaaucaguugguagccgcuugccaaaauggccuuagaauauuagcuucuuugauaaaucuguuucucauuuuucuucuagguauaaacuaaagucaaauauuuuuguaagauaauaaauacaauucaaagcacugauguuauauucuccaccucuuugguaaugaccuaacuuuuauuugccaacaguguuguugauguagcaaggcauuugugguaaacaaacaauagagauuccauuaucuuccucccuccaucuuuaagaugauggccuuugaaguuugaaacauguuccaagauuuuuauaaguuaaaagaaaaucccuuuuagcuaguucacuuucuacaaaucaagaugagauuuaugaguaaaauuagggaaauacauucuuuuaaugagaugcacucacauuuuaaaacucauuugaagcuagcagcuuaaggcaugcuuuugcacacucuugcuuucuguuuugaaauguuuaauuuagaacaaacgugugugcuuugugguuccucuuaaaauaacucacuguggagaguuuauuuuacggccaucaguaaauuguaucuuuauaucucccugaauaaaauauauuauaacuaugaagauaccaacuaaauugugcuuuaguguuagaugauaaguuguuuguuuuaaggggaaaggccuuaauuauuuuccaucuuaaauacuucuuuuuaaguuuauuuauuuuauguaugugacuacacugucuucagacacaccagaagacauuacagauagggaagccacauggugacuauugggaauugaacucaggaccucuggaagaacagucacugcucuuaaccauggagccaucucucuagcacuuuaaauacuuuucauuguuaauuuuaugucauuauugauaaacuuagaucaaauaugagugaguuacuuaauuuauaucuucuaccgcucagagcuaaacuuguaacuugauuuuuggguguagugauggaggggaagcuaagcaacauaggagguguaccaguguauuuuaaugcccuuuucuaucuguaagcacuguucucugauuucugaaaaauggugaaauuuuuguauuauuaguacuuacaacauguaguuauaguuugucuuuucuuuuuaggaugaaguggcacacacucuuacugaaagcagaguacuaaagaacaccagacauccauuuuuaacaguaagugcuuagaggacugcuauuaggacauuuuaaauuuagugggguuuuagcauagaaugaaacaaugacuguuucaaguaacauuuacuugucauuuuuauggcagacuguaacugacagacuguaacugacagacuguaacugacagacuguucaguuucuuugaacuguugagaguuguauauucuuuaugauauguauuuauaaucccccuauuaucuauguacaacuuuuuagaaaucuuucucuuuccucccauguaucucccugacuuuaaauauguccacagugcaagaaggccauuucuggaauuuuaaggaauucauuaauaaaaugguagacauuuaaaguuuauuuuuauuguucagcuaauaaugccguacaggcauaauguuucaugauuguguuacaguauugaggagucugugacaggaggcucuccgcauguuugaggccaaccuggguucucuagugaauccuagagcuaccugaauuacagugucagaauuaucugaaaggaaaaaagugaauggccacacagcuucaguuucgaaggucaaaauuuuaaaugaacagacuucauaaaaacaagaacuuucaugauggaaauacaggaauguaaaauuguuaagugcagaaguccuucuaucuuuuuaucauuacaaaaaguauaaacagugacuuaauguaugcgaaauguuuucagacaggcuauuuuccauccagucugguuaucugugugcuagauaguaauuauaaaguuuauuuuucuuguuuguaccaagcauauuaagauuaaaaagaacuacaguuuaagauuggaauccuuuauuaauagucuacgauuaucuagacauuuucggaaccaucaguauauaccuggucuuuguuaaagugcuuuaugucuauuuuacaggguaauaagaacauuuuaguaucuucuugagacuugaaaacacacuagggccuaccucauugagucuugcuguuuuagccuuaguauauacaaaguaacacugaaacuauuuuagacauaguuaauaagagcaacuaugcuccugaggaacuuugacuauaauucccuguagagauugcagaaauuaaaacuagcacacuggguacugguagucagucucaggugacgcaguauauugaaagugcucaucacaacuaccaaauauacuuuuguuuaucauauucuuagaaagccuacuaugaaguaaauguaaucauauggaacaguuucauuuuaucauuuauguuaacuguuucuaaguguuuuauuuuugguaccauuauauaaucuuuuaagaauauaggauuauaauuaacauugcuuucuuuuucauuucaaguccuugaaauauuccuuccagacaaaagaccguuuguguuuugugauggaauauguuaauggcggagaggugagucaggaagucaauccagcauuugcauggacuauuucaaugaaaguauuacauguagugugcguuaugauacuucucagcuccacagcaggucugcauaguucuuccuguugaguagacaaagauggcuaauagaguguuuuuaucauauauuagcaaaucauauucucuauuuuacuuuacuuuugaaagauaaacaugguuuaucacaauuugauuuuuagagggaauauaauccccuuuacuuacugauuuuuuguuuguuuguuuguuuugguuugauuuuuugagacaggguuucucuguguaccccuggcuguccuggaacucacucuguagaccaggcuggccucgaacucagaaauccaccugccucugccuuccaagugcugggauuacaggcaugcaacaccacuacccggcucugaauuuuuuuuuuaagauuuauuuuauguaugcguguuuugccuucgugugugccugaguagcaugugugugcuugcuguccaauaaggucagcaaagggcaucaaaucuucuggaacuagagugaaagauguuuuuaggcagucuuugagugcugggaaaugaacuugaguucuguaaaaacaaguucucuuaaacauuaaaacauuucuccaguucccacaguaugauuucugaaauuaguuaauuauauuucagauaacuuuucaaacaaguuuucugugaaccuuguaaaacuuuuuuacaucccauaccucuucacgaccccaccccaucuccauguggauuccccccaccccaccugaccuuuaaacucccuggggccuccagucucuugaggguuaggugcaucaucucugaaugaacacagacccggaaguccucuacuguguguguguugggggcucauaucugcugguguaugcugucuguuuggugguccaguguuugcaagaucuuggggguccagauuaauuaagaccacugguccuccuacaggauuucccuucuccucagcuuccuucagucuucccuaauucaacaacaggcgucagcugcuucuguccauugguugggugcaaauaacugcaucugacucuuucagcugcuuguugggucuuucgaagcagacaugauugaucccuuuuugugagggcuccauagccucaguaauagacuuugggaccuccccuugggaggaugggugugaaggggcaaggaauggaauauggacugcaaaaaaugaauuacaaaauuaaauuuacaaaaacuuuuuagaaccuauuuugaacucagccaaccgucuucuauagauauauuuuagcugaugcauuguuugcccuuccuuguauauauuaguagugaaggagaagauaaugaagaaauuuaagagaucuuaaagcuuugaauagaaauuaaaucacuucuaguauuuuuccuuuaucuuuuuccuauuuugaacaaaaucaaugugaaauagaaauguaauguauagaaauagcaaccggaaauacuuuaaauaucuaacuuucugaaauguacaauguagaagcuugaauuucauagacuuuuaaauauucuuauuuuccaaucuaaauauauaacugauauugaauauuuuugaaaaagguaucugauauuuagaaauuauguuaucuaaaauuuccuucacucaugugauauuuguaucuugaauguagagguaguacagcuuuuuuugaguguauuaaaacaucgccucugcuacaaaggaguauguuguuucuauugugagcauauuacauuuagaaugucuaauccucaaauaaaaauaaauuaauaaaagacaauucuucauuaaagauagauuuuugaguccacuuuuauuaguguacugaguaauuuaaaguggcaguucaaauagagaugauagugugcaaccaguggaugagcacaaaacaaagaaaacuugagcauuagaagaagaauauccuaagcauagagaaugaugagcuucagucagauguucauggauaugaagaugauggauugcuuggcacuguggaacugacaucuuaagagcugguuuguuuauauggguaaaaaaagacuauugcaaagauucacacguagcuuauuguugaucaugugaaauuauuggauauacucaaguuaugaaaaaaauuuuucagagcaagacuauaguguuaauuuuuaugaaguuuuuacuaucauuuugaagaacuauguguugaauuagaauaguaaaggagaacagauuugggagauauucaccuaaagauuauaaauuuguccauagagaugaaaaugaaauuaauggaauuuccauguugguaccugucagaauuuaaaauacacauuuucuuggaaucuguucucaacuugaugagauguagaaucuugagagaugggcuucuggacaugucuguggaaguuaucuaagguaacugagguggcaagacauacccucuauaaguagcacugucccugaaaacaugagugacuagaagcauucaucagcuuugacauggaacugugguuguagugugaccagcagcuucaggcucauguaacuuccccaccaugccugguucuaaccuugaacugugagccagaauaaacccucuauaucuuuagucgcuuuuguuggcauuuuuaucccagcaacaggaaagcacucagcaauuuuuuuccaguaauuauaaucccaugaaauaaaaguauauggccaaauaguauauggauaaacacauuuuuauacaaguaugguaccuugagugaacauucaguaagugucugcuuuaauauauaaaaugcuguaagaugagagaguacaaagcauguuaguuacuauuaugcugagagagauauaaaucaugaacacaugcacaugccuuucucuguuagagaauuucucauugucuacuggaauuuagaaugggcuuugugacucaguacaggguggaagaaaagcuuuccaccuguguauucuuuuuuagguuguggauugcaugcagauauuuuauacuuuauauuuagaaauaagcaaauggaaggaugacuagggaagagaauuauagagaugaaauagaacucuauagccaaaacuuagaugaucauugaaugccgugcaggccacaaaucaagaucuauauaauuaacuuguaaagucuaaaaauguaagaaaucacauuguuacuaauaugcuaaagucaugaucaguaauuuaggugauauuaaauuuaauaagaaguggaaaaguauugcagaaauguaauaucugaaaacuaaaauaauuucaaauuugguugaagaagucuccucuuaaaccuuuugccaaauugucuucagcucuauacauuuuaaaacguacaaauugaccuucugugaucucucacaggcucaaauuucaugaaagauuucaugauaugguagaaugcugugaaucugacccauucuuacuguuccuucuguagguacuaaguagccuaccaugucuagaauugacuacucagguuuguuaguacugcacacaguuguauuaaugucuuugauaaaauucauuuuaguuuuugcauaugacuuucaguuacaugucauucuugaaauccucucuuacuuauucaaauuucucauuauuuggcuggcauuuucucuuccgugaacuaaaaucaucucauuuuaaauucacauaagacagaagugcaggcagucagcauuugaauucuacuuacuaauuuguggaggugugauuugggugauuuuuaaguuaaaaguauuucagauucaugggggugcuuuuaaaacuugauauuuuacuaaauuugugguucuauaaauaucuuuauuaccagaaaucugaguuauuaagcuuuauguagguuauuucagaauucuauugcuuucacucaagucuuuuuuuaaaauucucaagccaagaaaacuacauuauaauaaucauauuaacaucuaaaguucaaggcaaaaugagcuuuauuuuauauuccauuuuaugauauaauuuuauaguauuucaaggcuaguuuuguaaauuaucguaggacugcaguuaaaguuaagagaagacaugucucauugucuaauacagugagcugcuuagaacuaugagcagugaccaggcagcucucaauugucaugauuucugugcagggggcuacagugcugauuggcaauuucauggaaacuagacuuguuaacaguugcuuaccccagagugauccuacuaagaaacuucaaauaggacuaugcacaaacacgagcacgugcacacacacucucacacacugaaaaaaaaaacaaaaacaaaaaaacaggaagaugacaaaaauaauagguaaauauuuaaaaccaugaucccaaaacaguacauaaucuuuuguauuauuuuguaucuuuuauguacuaaaauaauuuuacaauucuuuaugaugcuugaguuauuccauugcaaucauguuucucaguguuuguagcuagcuguaagauauacaucagaguucuuuuuaguuuggaguuauuagauauuguacauagcauagcuuggguaauauagccauuuaaaauauuaauucuguuuauucacaaauucuguuuauucucuucuaaugucuuuaauuuauucagcuuuuuaaaguuuucauuguacaaauguuuacuuccugucuggauuuauuauuccuaggaaauguucuuguuuuggcuuuugagaaugacauuauuuucuggucaacauuuuuguuacuuguguauuagaaagcuagugauuuuuguuuguugauuuggaucccgcucgaaguauuuaucagacuuaagaguauuuuaauuggguuuuauaguuuuguaaguauagucuagaaacagauaaauaguguucuuuucugcucauaucuguuauuuauuuguacugccuuauugcucuaggugagaaaucaaagacuacauaaauaugagaauagugaauagacagucuuauucuuuauuuuaaaggaaauauuauaauucuugcacauuugauguacaguugcauauacauuuguuuugaauugccuuuuuaugugaugguauuauacuuuauuccuaauuucuccaggauucacaucauaaugggauauugaacuuugucaaagcuuuuucugccuguguugaaaugauugugugauuuccacuuuuucuucucuuuaugcaucuuuuaauauucuuugcauaucuugaacuugaacuuauguaucacuuuuuauuuauugauuuggauauguugaacuauccuugaauaucuggaauaaaaccugcuucaucauaauguagaauuucuuuaauauguuuucaaauacuuuauuaagcacuuuugcaucuuuauucauuagggauggcauauaacuuucuguguuuuucuauucuauuuuguauuuuugaugaagguaacgcugguuuaccagauggauuuuguuagcauuccuuuucuauuuuguagaaccuuucaagaauauuacuguugucucuggaaaaugugauagaauuuggaaguaaauuguuuugggcuggagcuuugggggggggggggaaauguuaccuauuuucuagaaguuuuuauggcuagccaaaaacauguguuucacagcaguugauuggaauaucauacagauaauaucuuuuuaagugugaaguuucuugcuuccuuuuuuuuuuuuuuuuuuuuuuguggagguagguuuaaaaaggaugucugcauuucuuacuuuugcaacauuuggaccuagcuuuaauacccaguacuauuugcuuugugaaauugaucauguccaugaggucucuuuuuauuauugugcaguaacuccuuauaucucuuaagacuaaguugaaccugaaucuacauuguuagaaguauaguugcucuugcuugccccuguuucaauuaacuugguauccauuggugguuuuuguuuuguuuucucuuuguuuauuuguuuuuuaacauucauacacuuuuaguauuuguuuuacuuuuauugaaaugucuuucuugaagacauccagcaguuggcucuugcuuuauaaucuagccugcuugucugccucuuuugauuggacauuuaagaccacuaacauuuaacauaaugauugagagauauuugccauaauuuaaaaauauauauuuguuacuuuucuucuuuucuguguacguuccccuuuacauaucaugaaaaugcuggcuuaucaguuguuaauuauuucacuuuguauauuuuuggaauaucuuuaauuuucauuaaguaaaacagacauuacuauauuaaucuucauugguaguuguaguaguuugaauuauauugcugugauaagcugcaugaccaaaaccaucagagagaugaaagaguuauuuaacuuggaaguuguaauuauuguuggggaagucagggcaugaagucaggucaggaacuuggcggcaggaauugaaacacaggcuguggagggguguugauuacugccuugcuuucgauggccuggucagccuauauucuuauacaaucuaagaucauuugcuaaaguguggcuggguucuuccacaucaauaauuaaucaggaaaauguuccccccaaauuuuucuaccuauaggccaaucuaguggaggcaguuuuucaucugauguucccuauucccagauuaaccuaacuuguguuaagacacaaaacuacaaaaacaacagcaacaaaacuccaaccaaccaaugaaacuagcuaguagucguuuacugccacagcuugaaaugauguuuucauguuuuccuggcuuuuacagcuuuuccuaagacauuauuuuauauagguuagauuuuuuucuugucucuuuuaauauugucucuuuguuugguguucauagucauguuuauuauagauauagauacguguguguauacauauauuauauauaaugcuuuuugagauaauuagccuuuuccucauuucccuuuucuguuuucucuuuccaagccuccuugcuguugaaaaaauucaugaccucuuuuuaauuaauuguuguuccacacacacacacacacacacacacacacacacacacacacacacaacuauguaagcaccaccugcucagucugcacgaugcugcuuguguguguguuuucaggcugacccuggugugcucuuuccugggaaugacuguuucuccuguucucagccuuccgaguugccuaucguucuuuguguagguuugaacauugcaaaaggagcacaaagacuguaagagccaaaagacgagggaguuugcugugagaugaugucuccuagacacaccagaagcuacucccaagacuuucgcaaacaugacagcccaaauacaagaagagcaaggacaagagcaauauuuguagucuuauagcaggauguggaaaaggucuuuuuuuuuuuaauccacuuuaguuuuaagugccucccaugcucuaaugccugugucuuuuucugauuugggaaucuugugcuccaacuucauuggauagauuuuuuaauaccauugcuccugugucccuaucaccaauuuuuuuccucuauauuguuuucagcaacaucuacucagccagccacaagaaaaccucaacaucauugaucucucccuugguccaaauuccucuggaguacugauucuucugaagggugcuuauggucuccuuagcuguuggcccucagaagcacucgucgagauccaacauaccuucugguguucccaaacacacacauucuuccaaagccuuuuauaguacuugccaugucucagcacagugucauguccuguggguuagugcuuuuccuuucaugucugaaaguuucuauaguaggcaguacuaauaggugaugaguaacuuuuguggaauuuuagaaauuauuuaccugagcauaucuucagauucuuuuauuacuuacuugucuaucuaauaauaguuuuaagaguaugaucuuuuugugugcaaaauuuuuaacacuccuuaucuacauaauagaauccagcuauaccaagguagacaacaucauuaacaucauaaauaagcugggccucucuccaucucucccuucaucccaucccaucccaucccaucccaucccaucccaucccaucccaucccaucccaucccaucucaucucucuucucucuuuucuccucuuuucuuuucccucccucccucccuccccuccauccuucccucugucccuccuuuucucugucuuuccuucauucuaaauguauauuauucuuuagccacauaacuccauguucucugcuaauauuuguauuuugugggaacuuguggauuuuguaaagggaaauuggagaauaacaaggagauccaggaaugcgagggaagaugaggaugguugggaaugaucaaaagcacacguaacuauaaaaaaaucacagugcaaagccauuguucuauauaguggguaugcaccauaaaaaaugacugcuuucuacaaaugauuaauuuucccuuacuguguauggugcugugcuagguuacaaagaaauacaaagauggauacauucuaaguaguaaccuuuuauuucucuugaguuuuccuuuggugaaaaguccuaucuuucacaauuuaggugaacuuuaucuguggcauaucccuaaacauccuauguaccaauguguuguuaauaaccauaucacaaaauauauuacugccggcuguuucugugaauauacaugcaucuuccucauuaagguagaauuccuuaacaguggggauuaugucugcuuucugucauuuuguugagguuugauugcuacauggaagguuauagguaguuacugaguuuagagaagagcccauagguagagcuguaaauaagggaguaugcguguugccccagcgaagauggauacuagagggcugaggcaggaugggggagcaccuuccuagagguaaagaggagggggcauaggauagggggcuuguagaggggagaucaggaaggggacaacauuuggaauguaaauaaauaaaauaauguuuuuaaaaagaaagaguuauuauaucgcucuuuuuucuuguccuagugcacuacaguuacuuucuauuaauugauggucauuaaugaauauuagaucaacauguugguuuaacagcaggguagacaaugauaaucuagaaaguuagggcauuggugaagaaagcuguuaaaccacagccaagaaagagaauaaaggcaguguacuaaccucuaaaacaagacggggaauaaauuauaaauagaccauuggauuuugcaauuguagaucacugcuugucuuuacacgagugaauuccauaaagaagcaaaaguagacaucauauggcaaugaguucuaaaauacagaguucuuccucuuaauuauaaaacuugagcugauauuuuuauggaagcuggcuggcagacaaacuguagcuguaucaucuauauaaagaccuagaauccugaauacauuauauuaauuuagagagccucuauaucucuuuugucaguagauagccagugguagaauugauuuuuuuuuuucuaaagaaaccuaaagacuuaaaggacuauugcagcaacauugugaccauagcagccgucaacaccauuggcauguuagacucagcuuggcagauaccauauuuuucauaauuuuuuuugauuaucuguucuucagaaauaaaacaucaaugccaucucagcauggugucccagauuugacaaaacaugguaacaaaguagggagcaucguaguuuauauaugucucccaaauuguuugcuacuaauauaaguaauuuuuuuuuuaguaagauuuagcaauaucaaaauucuucccugucuuuacuugacucagugaucacagaguugucuuaaaagugauuuaaguagagauagguguaggaagaaggagugaaggcaugauaauucuagguuacucagcaucacuguuuuauguugaacaagccuugguaaggcauaacucuuagcaguucauuaugaguuagugaucuuuauggaaauaucuauauucugaccuuacaguugaaggcguauuuuuucugauugaguuuucuuaaucccagguguguuuugcgugcccauugugacaucuuaguaguuuuuucgggacuaaacagccuuucauucuugccacauuacuucuuuuccuccauuugguauuuguccuucauuucuacagaaauccuuugaauuuuguaaacuauauacugauguuuaucaccagcacuacauaauuugacuuuaugagcacauauauuuuauuauaauucauauuuuaaucucuuaauuguauuaaauauguauuguacaaacacaaaaaucaaacuuguugugcuuauauuuauauaggauggagcuauuuuagauuagcaauuuggcagauuuccuaauguauauuaguucaacaaagauugacuaucaguuacagauccucagacugguuucuugaugccuguuguucuaagaaauuagauguuuuuaugauuugcuuaguguuguuuguuuagcuuuuugugguacugggaauggaacacagggccuugcaaauguuaggccaacacugucacucugaacuguucccucugcugagaaauaagauauagauguuaauuacugagugauaggacuuagaguuucauaaagcuagaauugaguuuguggugacaguaagagcccaauagauauuuuuugacuauuggcauaccuuuaaucaauuaggaaaugaauggguuuauaccuacaagaucacagauuacaguuaaaaaugaaaauaaaaggauuauacuuuacaaaccauaucaggggugauggaggccucuuagcccaguuuuagcacuguaaacauaaaacuuuaaagucuugaaaauucuuauuucagcaaguguuauuucaaacuuugaaagcauuucuagaaauauggaaaauaacaauuuagacuaugacuagcuuauauaauugaguuugaguaaguccauacauauuuuuccuugaaaucaaauauaacuuaaauaaaaacaccaaucugugcuuguauuaauuuauuuugauaaugucaauauauauuccuuguaagaguggaacaacaguauacuuagaaggaaaugcaaucuaaugaugcauacuuuuuccucugguaccugaagguuaaauggguagcaagcagaaugccuuaaacaagauugguauauugauuaaaacgcugauuuaacagcucgcaguuuccccuuggaaaccugcaaaagauaagccagcugcugucuuagagugcucaguguccacugagaguacacuaucuaucaucacaauauggugaugagagguguuuuauguuuguguuaauuucccccacuaaaucaguaauuauuacaauccugucccugcuguuuacccugcagcuguuuuuccauuugucgagagagcgaguguucucugaggaccgcacacguuucuauggugcagaaauugucucugcuuuggacuaucuacauucuggaaagauuguguaccgugaucucaagguaaaaaaaaaaaguaaugaaaauugguuuuuugcagagacuguagggacaaacgaaguaauuacaaaguuacacaguuuugagacaaguacuuaggaauguuguuugcuguaguuggucugaaauuucacucacuuauacguaaguggcuuuuuaaugauugugguuuuugcuauauaaaaguucucuugacuauguaacacaaauuuaccaagaguaguuuuuuuucuguaaaugcccuaauuauagaaauggagucauuauuauaugagaaaugcaagcucauuauuauuugcaaacauuauaaaauguuuauggaaaagcuucaauaacaagguuauugggaggaaaauaucuauuuucauuguaguguuaccuuuuugaugggaucguuuuccucaauuauuuaucuauaaacuugguaguuugcuuaguuuuucguuugucagaacccaguauugguuguauugguaaaagaagccuggccaucucugagcucuugugaguaccccuuaggagagccagaauccccugaaaggccacgugauaaacacuuuagucuguucugccugucgagguauuuauuggaaccauacugcucugccauugaaagguaaaggcagcccuagucauuauguaagccaauauguguggcuuaugucuacaaaucuuuacuuaagaagcagucagugguuuagauuugguuuauauacuauaguuuacugcucccuucaggagauccuguaagcaaaucguaauucucaugauacagucaugaguaagguugacuuuguuaaggauucugaucauggcauauuuucaaaaacagauucuuauuauagcaucuucuuuaaaauguaaauucuagggcugggaacacagcucagugacaggcacuugcccaguuuaagucugacacccaguuccaucucaggacauaggcagcuaguucugggguuaggauagggaagcuugaaguggcaguccaccugucuucccacccacuugaaacagucagcauauuuguuuuuuauuagguucuuauaucucugucuccuuccuaauccuuaucccacccugaucucuuccaacacucagcauuacauaggagggaaaggauagaguggaaaggggauguagaccucuguaggccugccccacucccagcaucucauuggcucucagguagccagaugugaugcugucuuuuucucauuggcucacuccauugccugauccagcuucaguggucucuggccaugcaggcagauucuagguuggcuaagggaggaaguagcaguagugcauugcagcugggcuacuuggcuaaguuccuccuacagaaaccaaaacucucacuauagaacacugaaguauaaucacagaugugaggcugcccuaggcaauguagugagacucugccucaaaauauaaauauagaacuggaagcuagcucuauggauaaagugcuugcugugcaagcaagagaacuugaguucugacuucaguaacacauaaaauccaaggguggucacagaugucuguacaucuagcacucacagugaagacaagugggcccugggggguuucuggccggcaguuuaacccaaauggcaagguuuaaguucagugaugucucauaaaguagguuggagaagugauugagguagaaaucccaguaucagucagucucuggcuucaacauguucucacagguacacuaaguacaaauuaaccaagugauuauauuuagauugguuacucuuagaccuugaaaugguagaauucagcuucuuaauaggagucuccccauaacaaacauguguucauacauauacugcaugcaaauaccaaauguaugacuuuuaaccuaguuggcuugcuuacuauggguugaaacaucaguacuuauggaaaaauuaaaaucauaugguaaugcucaccuguuaaaauuugaugauugccauauugaucacauaccuaguucuuuuaaaauauaauuugauuauuaaaaaaucaaguaauuaaaauuuuuauggaauuccauuuuauaugaaauuagauauauaucuaagaaaucaugauuauccccuuauuccugucuuauucauaugaaaccauuuguaacucuuaauuuuuaucuaauuauguaagcagguaccuagcuuguuuaaaaauguuccuaucacucuuuuuuuuauuuuuuaaacaguccaguuguuaccuaccucccagucuacccucuggcuuuuccucaucccaugccucuuuucucccaccccugucuccaagaggauguccccaucccacuagaccuccccacucccuggggccucaagucucuucucucacugaggccagacuaggcaguccucugcuauauauauauguugggggccuuauaucagcugguguaugcugucuaauugucuagaugugucugagggaucuaggcgguccagguuaguugagacugcuggucuuccuaugggaucaccccccuccucagcuucuuccagcuuuucucuaauucaaccacaggggucccaggcuuuaguccauugguugguuguaaguaucuguaucugacucuuucagcugcuuguugggccucucagagggcauccaugcuaggcuccugucuauaagcacaccauagcaaauagugucaggccuuggagccuccccuugaacugaauuccaauuugggccagucacugaaccuucuuuuccauuagucugcucuuuucuuuucuuuucuuuucuuuucuuuucuuuucuuuucuuuucucuuuucuuuucuuuucuuuucuuuucuuuucuuucucucucuuucucuucuuucucucuccccccucucuucccccucuuucucccccaucucccuccucccccucuucccucucuccucccccucuccccucccaucucccccucuucccucuccucuccccugucccccucuccccucucccucucccuaucuccucuucuucucccuccccucuccccucuccuucucuccccucucccucucuccucucucccucucuccucuuucccucucuccuuucucccucucuccucucucccucucuccucucccucuccucucccuuuuccucuccccucccucuccucuccccccucuccccucuccucuccucccccuccccucucccccucuccucucccccucuccucucuccucuccucucuccucuccucucucucccucuccucucccuccccccuccccccuacccccuacccccucuccucucccucccucuccucucucccucuccucuccuccucucucucccuccccuccccccuuuccuucucucccccgccccuccccuccucuccucucccucccccaugcaugucccuuugggucugaguuaccucacucaggaugauacauucuaguuccauucauuugccugcaaaacucaugauguccuuauuccuaauagcugaguaguauucuauuauguaacugaaccauauuuucuguauccauucuuccauugugggacaucuggguuguuuccagcuuuugacuauuacaaguaaggucacuaagaacauaauggaacacacaccccugugguaugauagggcaucuuuuggauauaugcccaagaauggucuagcuguaucacucuuguauauguuuaaguaaauguuuuaaagaauaacuuuuauaaaauauuauuucauacaauaaugauaaaauguauauauuuuuguauagucaauuaaguuacaaaugaaggauuagaguacuauacuuaaaaauaaugagcuauucagcuauaaaacaucuacuucagggaugauuaaaugucugagugccaaaaugaauacaacucaaccaaaugauuauauuuagcuuauuuuggaauuacaaauuugacauaauucaucaucuuuacaucuaucucuauauugaguauagaugcuuuaaaaagucuaauuagauggcauuauuauaaauacuaauuuucuaaauauacuuagaaauuguuaacuaucucuccugagugugcucaugcuucugaauccugcaugaggaaguaagaaggcagacgcccggaggaaagggaaggagcggagucuugaaauuccuagguaaaucccuguuaguggggauacauagaauuacucauuuauagagaucuaaagaagacucuucauuugaaugaugcuaucgauguuaaauauaacagucaaaagggucuuguuuaguauugucuccaaacauuuugaaucaaaugaauuauuauuaaaguuuuguucccauauaauuggugaggaaauuagaucuaacucauugaaauguaagcaaauacuuuaugugugaauguccauaauguagucaugauacaaagucucuuaacuuuaccagacauuuaaauguucuggguacucucaaauuuuacuccccuuuaaauguugcauuaauuuaaacuuugaaauacauguauaguauaugauagaaagcauaugacuauauaucacaagauacauauaauuaagaaagcaaaauuuaaaauugauaugcguguuauuugcaucugcaguucauaaaguggugcgugacagaauggggucauuaagguaggaucacaauaauucaaagcugggguauauauuugagacaauguucugcaagccuaaaaacauuaccuccuuaagguaacagacuaaauugacacaaguaagauuauuggaacauggauauguuagucauuuuucugauaaugauaauauacuaaagagaaaagggauuuauuuuagcccauaguuuuagugacuccauuccuuuccaagaccagguggacccuuugcuuuuagacacacucugauuugaagaugucacauagcaauacaggaagcacgugguagaagacccugauuuaauucaucagugaaaaagcaaagaagaaaaaggccacuccugccuuccacuagggcucucaccagaccccaauuuccuaaaggcccuauaaguguauacaagcaacuuuuauucaucagauauaauugucaucucagaggcuuacugcugauaaacucacccuuuugaguucuuucugaacucucccuggcugauucgacucagcuuuucuggcucaauccccucuccaagcugacugauucgaucugacuucucugagcuucucauugaauugcuuggcuuggccucaaaccagcccugguaacauguucuaaucuucugacucagcuuauucuuuggguucaacugccuugcugacaagcacugaacugcaagaaaucacuuacaaacuccacuccacugcacaguacucacacccaauugacucucucccugcacugcccuuuaagucagcucuauuuccuguccuuucucuggagaguuggguguaugcuaucugacucacuuugucagcucuuccucugauuugucuuuuuuuuuucugccccucaguuaaaugucauuuucagauacagcuacuucccucaacaaauuuacuuuaccuucauuguuugggauuaaagguguguacugagggugugugugcauuucagucagaucacacagaccuagaucuuuggauguuauuucuugcuagagcagccacaaguacccuuucucuucucuccuagcagcaccauucugaacaugaagccuuuaaaagucagcuaaggugcaaaguacaguaccacaaucauauuuccuagucuaaugugcuuuugcuuauaacauucuuccuagagucaaaaugacaucuagaugagaaaaugcaaaugcauugaauuaugccuaguuauuuaaaaaaucucugugauguguguauguggauuuaguguaucuauguacaugugugcaugucaugguauaccuuuggaagucagagcacaucaccugugugucaguccucaccuuccaccuuuuuugagacaaggucuccuuuuauuacugccugugccaggcuagauggcucuugugauuccacagauuuuguuugcacuucccauaguaguguggggccccugagauuauacuuuccuuggaucccugggauccacacuuggauuccaagccuuguaccaacuaaaccauuuucccagcccuuguauuuauuuuuaaauuuaauuuuuuuauuugugugugucugucuauuucugugccugugaaugcccacaaagaccagaaacugaacuucaagcguuuaaaagaauaguggguacugcuaaauucugagccaucucuccaguccccaaacccuuagauuuuuauaaaucuaaaaguuuaaaaucuaaaacaaucugaaauaaaugaaaaucuaaaauaaaucuaaaauauuugaaugacuguuuuagguaccaaauaguuuaaaaauugcaucaucaaaaccugauuuaggaccaaguguggcgcacaccuguaauccaggaggguuugauuucauucaggaggcagaguccaguggaucucugaguuuagugucagcccugcucuccauaguaaguucuaggccaggcagagcuacaaagagagacccuauuuuuaaaaagaccuacccuucuccccacgauuuagguacucauuuugaucaguuugaguagacucugaucuuauaaugaauuuguaaacuuuuauaugcaaauuaaucugagacaccuacaguagcuggacuucuuuuuaaaaaauuaagauucauuuagaaagugauugcagggaaagagagaaggugaguguuggcauccuguggaaaucagaagacaccuugugggaaucaguucuuucucucuaccucaagagcuccagcaaucaagugccuuuacacacuugcugucucuguuccuggagucccuucuuaaacagggcugacaccaguuuguagugucucauucagcacugggaacaaagccugauggcacauuaauuuagaaaguuuuauugauucuuguuugguuucauugucacaaauaauuauugaagcuuuuguuauguuuucagaaaguaacuuuguucaaauuauuaauauaagucauuauaugaaauuccauuuuauuaaggaucuccuuaauaaauacauguauugcuuaauaaaaauugauauaauuucaguauaccauaaaaauuuaaagauaucucuuucaagacucuuacagugcucucaaauacaauauuuauuuguaaugaucgucguuguccauguccagacacccuuacucuauacucuucuaaccuuugcccuaugcuucauuucauucuucaucuauuaauaugugauaugaaucucagaugagauauaaaggcauaaaauuuggugcaauucaaaaaauuuaaaaauagauuuuacccaugauuuauaagaauguuuauuuuauuuuuguaccuagcaauucagaauacuuuuucaaaugcagagaaauaauguuauauuucucuuuuucagacaacuuucugaugcauauaaaucacaugaacaaaauugguguaauauacaaaaauauaaauuauagugggguuuauaguauggaauauuuauccaguguuuucuuauuguuauuauuauuugagcuuuuacagaaaccauacaguuuacaugugaguguauagaauauguaaagauugauaaucuguuaacuacaaccacgucucuuuccaguacccgauuaaucacuuuucaaaacuguucucuuguuaaagcuuauagaauaaauuaugcuguuuucacacacaguuggagaauuugaugcuagauaaggauggccauauaaaaauuacggauuuugggcuuugcaaagaagggaucacagaugcagcuaccaugaagacauucuguggcacaccagaguaccuggcaccagagguaggcccaaggaaaaauaacaccaguguuucccaaaacuuugcaauauuuuugucauguagcaacauucacuauuuuuuaaacaagauuucaaccagaauaauuuaauugcuuuuaacuuagaugauggguauuuuaagaccacacacauaugaaaauauuuugcaguuuguaagcauguguuuuaauaaaguagauuggaucauacuuuuucuuucuauauauuuuauuuucugguucauugguuaaaauaggauaauggaguaacuucuguaagcauauuuauaguuuuauaaacuaucuuggacuuuaucuacaagcagagauuauagugacuguugguauuugauccuugacuacgggaaauuguuuuguugaagaaccugaaaaaaauuacuuacuuacauuuugaaguucauaagaaaggaugaagaggagguuucaaacccuuauucaaguauuuguuguguaucuucucuauguugaggguuuuguaauaugccaauauaggaauaagauggaaaugacuguacucucaaggaaauucuguuggagagagucuauguauguauaaaauauauauauguucuaucuguguguauaaacauuuauguguggguauaaaaaauguauaacauauauguauguauguauauguguauauauguauauauauguguauacauguauguauauguguauauauguguacauguguuuauauguguauacacauacacacaucauaaugcucuaagaaaaaugaaaguaagauaaaggaaaagauguccuuugguguaguaguuuucuuaaguauaccauuaagcauugcuguguaacaaccuacucagauauucagugaugaaacaauuuccuguaacccuuggcgcucuuuacaucaagaaugcacauguggccaaacaggugaauucuuucuguucuguucacaucugugaccuuagccaaaagacauaucaacaagauaacugcuuagagacuaaaguuaucuagaagugucuucgcuugucugugugcacugcugcuaggugcccagugaaagcuauucaaguuguugacagaagcacuuacagccucccuguggcuuaggugucuucaaaauggccaggguucuuuggccuagcaaguguccucggaacaaaugagaagcaaccuugugcucacucccuccuccccucucucccuuuuauuuucaauuuaguuaacuguuuaaaauucuauuuaaaaauuuauuuauauuuuaucauuuggauauaguucacaugucauauaaaauuuuaagucaacauuuacuuuuucaaauguuuaaaguugugcaacuaucgcuuguaauucuaacauguuuuaaucauuccaauuaugacuucacuuuuauuagcuucucauucuuucuuucuagcuauuguaaauuaucuuucucuuugaagcauuuucugaccauuucauguaaauaaaauuauaugauaaggagcuuuguagguccggcucuuucccuuagcagauuauaacucucaccuauauuguuguaccuauggcuugguuuucaugaaaaauacugcuaagaucauucauaugucaucucauuuccuggccuuuuuucauaagcuccacaucgcuuuggucauaugcuuauuucuugaaacagauguaacccuucccagguuaaacuagcucuggcauagaguauuccucccacuguaaagaagugugugagauuggagucacugcagaagaauuugaguagcagaaucuuccacagagaggugauugaggaaagggacaauugcucagaucugagugcuaaggacgaggaaaccaacauggagaguuuugcacgcaaggcagccagaaggaacaggagccagacuaauggggcaccccucagagugaagcaaggcacugugguugauguuauugagagccuucuuagaugagcaggacuucugucaucaagcaucacuuuguuuguuccugugguauuugggauaauaauaugaaacagugaaauucauuuucauuuuaauaauccauauacaguuagaaggugauaugggguacaguagugcagcauucugucuuugucucucucugucucucucucugucucucucugucucucucucccucucugucucugucucucucucaauuauucuuugagaguuucaucuauguaaauaauauguugugauaugauacuacuccucuguacucccuaggaauauuaagauucuaauuaggguuugguagcucauaaagccuaccucuucaucuauaaucguaugaacgauggcccaacaggaaacaguaaucaaagaaauuagaaacuagaauaaauuauguauguauuaucauguugccuuacaguguuuuuuaaacuaggaguuaaauuaacauuucaaaaggcuuaguaauuauaaauaagugcuaauauuuaaaguauauuuccaaguauuguugucuugccaaacauguaauuuucucuguuauagaugcuagaguuuaaaauucucuguuuucauuacagaguacauaaaauuuuagaaauuauguuuuauuuauucaaauauaagaucauauuuucuggacaaguuuuguuuuuuugugaaugucgugguaaacaaugucuuuguuucucuggcauucaguugcccuugcuauacauuuguaaugaaugauggcauuccauauuuagaauacccaaauuaguuauaucacaauuagaaggaauuauucugaagaggauaaaaacacauuccagaagcagaugaucuucuaagaaacaaagauacuguuuucugugcagacauuaucaacugaaugacaaacuaggcacugaaugcaaagacuucugucauuucuaagaguuuacaguauucaagagauuauccauuuuuuaaaacucauuaagcagucauuuuuacauauuuaaaaauguauuccauuuaauuauuguauguauauauauuggugaauauaagcauugugagugcauuuguacacaaugccaugugcauguguggcagucagugaacagccuuguuggaaugcagagguuugaauucugugggaaaaggggucccugugaauugcaagccagagguuauaauagagugggauuuacaagcucaguuagugagagauuaucucacgcugaaacuacccuuuuucuuuacuuucagaagauguuugucccuuuuugaaccuuucauuucugcucuguaccauuaucaguguugauauuuccuugauaagaggucagacaucagucagaccuaggaugcauccuugacuacugcucuuguguaugacucgcaucacugugcuuccuucugcucuuugaacacuuucugaacagacuggaguguggagcagccuccauucccacuagcuugcucuuucaccucucuuuuacuuuuguuuacagugguuuguuauuuaaagggagaugcuauacauauugaagauuccucagaaaggauaugagaugucaucuaaaaccaguuuauuaaauguccuauauguccuauaugucagacuuaugguuuauuuuuaaaugcuuacauuuacauggacuccccuuauuuugugguaaauaccaccagaaaauuuacuucucaguaaaauaacauuagcugaaaaaaagaacaucaaaauaaauuuuaucucuuuaccugcuuuaugaauaaugaaaaaguguaauaccuuuaguggcaguuuacugauaggaaaaaaaauauuuuagguuaaguuuugauggaccuguaaacuagacauuucacgugcagcaucucugaaaccgcauugauuuguacagcuuuaagugaguucauguuucuuguuguaauucaaggaaauaaaaccaauccauuaaaaaauuauggaccagaagaugucuugaacuuucuauuuuuguagucugugcuuuguuuuaacaccuuuaacuuauagaagaauuuaaaaauuacauagaaacucuuuuaaauuugauuauuuaguuuggauccuauuaaauccagaugauuuuaugcagugcuaauuauuuggagucucagcuuugcuuuugaguuagcaguaccugcucaacuuuccaacuguaaaacaguuugaaaaucaaauguagcuuacaugcaagacccaacaaaauuaaaaguguuaagugcguuuuggcaguucacuuuuauugugcccaguccucaaaugcaccggcagauaaucaucugaauguuaguuaucuuucacaugcuuaugugaucacacaaaaaguacaugcuaaaaagaagcagauggugacagaugggcaagguugaggaaggugguuugggaaacccauagaaauacacuucuguaauagcauaaaaauaaaacuauuugauaaccaacuuacaaaaaaacauuuagauuauagaaugaguugguuuuugagaaauauauuauaucagccgugguuacuguugaaaauggaaguauucacguuuauuuuaucuaaaugcaaaaagugggcccuggugacaaaaagugcaguuaauucucucuucuugguuuucagagcccauuucuaaagcauuuauuguuagaacucuauauaauuguuuuugaaaucuguuuaauaucugaaauaacuuuuaaaaaauaucugaaaugcauuugaauauugguaacuuuugguaaagaaaucuuuuauugugauaaaucaauacaaaugaaaauuuaacuacauaaaaauuuaaaaucagaaauauacacuaacuuaauaagaaguagguagagucaugggaguagaugaguaugagguaauuaauguaggugaagggaacagauagaaauaacccugaugaaauuuugauuaaugaggauuaaaugugaggauagcauccagucgacucuuuaaguauugucuuuaggagcucaucgugaaaaugaauguggcccguuacaugugcaucuauagucugcaggcaaaaccaguaauguccauagucacguucaaaguagcccuugaauaaaaucugcuguauuucuacaaauugugaaauuagucuuagacuccuaagcuucaugaaaaagaguuacuuagcuaacauuguuuugaacgcuaacauuuuauuuaauuacgaauaauuuuucaacaccugcccuuuucucuuucugguagucugaaaauaugucauccuaguauuaaagggaaguuaaguaaauuuaagucucaucaggggcacaguaauuaguucuaguuguugucugccucauaguuagaauucauauuuaagaaccucuaucagauggguugccuuguuacuugauuuaauuuauuucuuuacuaugcaccuauuaugaguaacauuaacaguuaucacaauuuguccaauaauugaauauuguuuaaaagugaaguaaaacagaauaaaugcccuccaacuuuuacaccuagugccauuuacuaguuuagaaguugugaguuuuuaugcuagcuauauuucauguaagcuucuucuuaaugugaugaaucagacuauuugguaggauuuuaauugaagcacaaaauauaauuguaaauccucugaaugcugaggauauaaaacaauaaccuugagugggaauacuaacgaugccgauuuuuacuugaaucacauggcccaguuuuuuagaauuccuuaaugucuguugcuguaugauaaacaggcaguauagagaacuauaggaagauauauucaugcaugaugaauuucugauauuguauaugcuuagauuuuuuucuuaagggauuuuccuguucugacuuugguuugcuuuuggaauugugauguuagcugcauuccgucaauuuuacaugaaaggagguaacaaaaaacauaaaacagaaaaaauugcauauuauaucuacagauauuguaucuuaagaauuaaaauaguaggucaauaauuauaauguuauauaaaauagcaauaugaaaaauauugacaaaccauggaucauaugaauuauaugcuccucuuuaaacuauaaucucuuaaaaucuuaauaagaaaacuugucauuuuaucaaauaccauugaugugaacauauaaaaagucuuuauaaagaaugaauuauagauacauaucucuauauaacauauauauuaguuaccugaaaagugaggauaccaaaaaaauugaaaaaguaguaaauugguucauccaaguucacaguuuacuuucacaacauagguguguagacaguuuguuuagauguuugauuuuucucccaucuguucugucaggauuauugauugagcagcagccacugcagggcaugccuugcuuucuuauagcugcuagccuugggugcaaacugauaaagguaugcuuucacucuuccaaguccuucuugguaaaguaagacuggagugaaaugccuuugaaaauuucuauuauauuaauauggaaacacuuaauagauguugucauucagaauuaccaguuacuuaaugucaucuuucaaaauuaguaauuaagagcauauuuguagauuaaaaauugggauugauguuguuguuugcuuguuuguuuacuuaccaggcuuuuaaaaaugagugcaaguauuuucaucagauguuaccgaauguuugauguuaauuuaccuguuugaauauuagggguuuuuuuguuuuugcuuuuguuuuuguuuucuaaugucugcguguucuuuccugaaguuugagcuguuugaguuguacuugauguggucuuuccccacuuaguggacugcuuucgucccuuguaucugggaauuuuguggaguggauaggcuaucgaacuuuacuaaggugaggauguaagucagcacuagaugucuucauuccugcuuguguuuggaauuuuggguaaaggucuauauugcuuuaagguaaaagacacuuaggucauuuucaagauuacucuuuuacugauuucuucucucagaguauguucucaucugcaguuacaaacuaauaguaugauagaugaaguugaaugagguagaauuagguugcccuaucaguuugccuuuagaccacugucugugauaccuucucaccuccacagugaucaugaaauugaugagcugguuugcuauggaaagccuucauuagaagaaauggagagauuuuuuaacaauuagguuaaaaagcacaaauuuuacuagaauuuuagaaaaagaaguacuuugaguaagaaagaaaauuuuuguccaaaaaauaauacaaaggacuuauauuuuagaauaaugaacuugauuuugaaaauugagacuguuucacagaacugcauuuuaaaaucauucuauauaagagagaaaauaggugaauagugaacguguuugacauugugugucugugcauauaaugcaacggucauuuuuauuucuacuucuuguacaucucaccucauaacuuauauaaaauguuuguaguugauagaaaagccucuuacgacuggcugugcuuuuacauucucagcaaugcaaagucugcauguuaguaacagagugcauuacgucaguauuguugaccacaaagaaauaccgcagacaguccaaguuucguccaaauguaucucucugucagugacgguccacgcgucagacgcaaaacugucuguauugaggaucaguguuuauuguacagagcuaacaaaaauuauuuaguuuuaucacauagauuuucuuacaguccaguucugauuuguaguugccuuuucucuucagaugaaaaccuucauuuuauguacuccuacccgucuggcugaaaaccaggcauuuaaacaaaaauaaaggauugccaguuuugccagcuggggaugagaacccggcuggugaaauguggguucagaaggcaguuaauccagcuuuuaugcuuuuuaugguuuuaugaaaaaaagagguuaaaaaccacauuuggcuccuuuucauguaugccacuguuuuguugguguuguaggaaugcaguuaaagauuaguuagaguuuuguuuuauuauuggguaaaauucuguauagguuagguaacuguccaggaaacaauacaccucacuaaugagcuauucaacagucaguguuacuuuaaaagguacaggcuguauuuccucuaagaaaugagaggguuccuuacgcuuccugacccuauuccuuaguuuucuucucuucucuuuucguuuuuucuuuuuucuuuuuguccccacucauauuacuuacucagauacaaaaauaugugaaugcuuuuucuauuuaaaauucuccaaauguuucucuuccagagaauauuuucuuuacucacaguaacuagauuugugaucuuagguuacagaguauuuucuuagguucuuggaugcaauaaaacaaugauuugauuugaguuuuugaaauucucuccauaaucuuuaaauauucaugccugucauaguauuuauagguaacuuuaaugugacugucagaaauaucuaaaaaaaucuacaaaauauuugauuaauucaaaauaugaauuuuaauugaugaaauucauaugcuagaacagguuuccucaaagcugaggaaagggucaaauaaacugagguuuaguaucaacucuaauguaguuauguaauuaaaguaggaugaggaauauuccaucaagcaagaaucacauuugcauuugagggugugguuuaguggcaaaacacgugcauaaggccuuggguucuaguugcagcuccauagguugucauuggugauaguaaauuuacuucuuuugaauaaugcuuuaaaaguuaauguacauggguuggacauggcaguccagaggcauacagacagaucucuaugaauucaaagccaggcuagucuacauagcaaguuccaggccagucaagaauauauaguaaagcuagaugaugaugauaagaauauauaguaaagcuaucugaugaugacgaugacgacaagggggaggagcgagaggaggaggaggaagaagaagagccaagacuauaauagugaaguugcugcugcugcugcugcuguuguguuguuguaaaaauuugucauuuuucugguuuuacuucuagguauuagaagauaaugacuauggccgagccguggacugguggggcuuagguguugucauguaugaaaugauguguggaagguugccuuucuacaaccaggaucaugagaaacucuuugaauuaauacuaauggaagacauuaaauucccccgaacacucucuucagaugcaaaaucauugcuuucagggcucuugauaaaggauccaaauaaacgguaagcuucaaugaugguccauaaguuacugaugaauugguuagagugauuugugaaauuaauucaaauaugccugauuucuggaagcauuguauuugguauaaacauuuuuccacugagaaacuugucuuauuuaugaaugcauaguacaaaacaguuuaaaaauucaucagcucuuuuuuaacuugaaaguauuauacaaacuuaccauauuagaggguuuuuuuaaauagaaauucuuuauuuguacuaugaaaaaacaauuuuuucauuaucuuaaaucuugcuccuuugggauaggaaguucccuuuucuccuuugagucucuagggcuuccuauuccuacugacucacaucaaagaaagaaaagucguuuccacucuccuccucccacuaaacuguuaacauuccuaucuuuuguuauuuaaaauuuaaccuaauacggauaaaaaauugauuuuaaaagcaagauaaccauaauuuuuucuuaaagaaagcauuuacugcccagucacucuauuuuguucaguuuaucaauucuuaauauacucacagguuacaugucaaaugucuucugaauacaaaguaccccauaaugucagagagacauauuuuauauauuuuuuucaaugagggguggagggaaggauggagaaagggagggagggggaaggagagaagaagagaggagaggagaggagaggagaggagaggagaggagaggagaggagaggagagggaaauucuuucacucuuucccccuaaguaucagaacuuuuuugaaaguucauuaaaauccaggcaucuagaggauagacaacuucauauguuuuugauugucaagaauaccuuaccuaauguuuugauacaguguauugugguucauguuuaacauauauuugagagauucaguuagugagugaaagaaauacgugaauucuuagaauuagacuuugucuauuuuaguaguaguugccacuguagguaucuaauuuuaaauuguuaagaaaggaacuguagcgaugguguaagugguucagugacuagcugcuuuggcagaggaucuggauuuggcacacacacacacacacacacacacacacacacacacacacuccaguuuccaaggcuccugcaccuucuucugaccuccugagacaccaaacaugcacaugauaaacaugcaugugugcagguaaaacacucauacacauaacauaaaaaguaaguuuaaagacaauauguuuuuaagagugugucacugcuuucagcagaauuacucacauuguuuagccuuuacuagcucuugguguugucaggaaccauucaaaaaucauacugagcauucuuagugacucuuauguuuccuuagacuuauaaaaugucucugaccaucccccugcauccagguacuuucuugugauuugcuuugcucuuucagugcuuuccagaguagaucaaguagauaauacaagcauuucauguacacaagugauuuguccauggucucacugaaaauccauguggaauaaggaauagaaaaccaauuucccggugugugcauuauguuuuuuuaugcaucuuauguacaccaacuucucagaauagguuuuucauuuaagaugauucugucaccguuauguaaugagcagcauuugcuggaaaguuguauuuaagcagagcuaugccuaccaguucaucuuuuugacuuggggagaaucuagucuuugacuuguuuucaagggcaaugaauuuuuauccuaucuuauucuaacucuuccaucuaucuuuagucacucuuucuuaugugguugucucuauaagugacgaaauaaaguuuugcuuguguuuucuaugucucauucauuuagcuacuauggggcauucccauucuacagauaacacauaguugggaacuuuugaauauauguuagauacauuucaagaauguaggggcccugguacauacuuucuccuuucugagauugaaaacaugauacaggcuuaugaagccccuuuguguaaaguacagagcagucagaccucugugcugcuauguuacaucaaaguaucaagagcucaaagauaaauaauaacaugaacaagucuuuuuagacacuuauagacaaagggcacaaaacuuacacuucauauucucaggccaaacuauauacaaaugcucuagaaaucauagccuugacuaggagacguugagagccugagcuggcucuuggaggccucgagaucugcagugccauuuaggcaucuuuugccugggaauauagcuagaaucucaccugaacauggucucugagaaguucagugacuaggcugcagaauaugagcaggugacauugaaagaugaagcaggugcauuagaucauaaggaucauauguuucuuagaaaauaaacuuuagucagggaaggaugagaagccaggcaaaugcuguaaagagagagauggugucaugagaugcaugugguaaggagacaacacuggcaguuguggauuagaagaguaaagggcagcaaggcagaacacuuuacaaagccuccauggcaaauacauaacuuaggaugcugaggcaggaggauuuaagauuugaggccagccugagcaacauagagagucguaucuuuaaaauaaguaacacaaaaaauucuagauagcaaaguagguucuuuuugagccaagguuuuaaacaauguauacaguuuugagaguaaguagaaacaguaaggaaguugauguauggaaucugacauauggagcaggagcaaaggcagaggcuuguagugauggaugcugagaguaaccaaauaaaccaaaucuggguuucucugggaaaccuagauagaaaugucaaguaaggaucaggaggaaaugaaaccagugcuuaagagccacaggagccagcuguggauuuguguguccauugacaucaagcggaagcuagaggcagaaaaauagcaagaaaaaacgugagaagaggagggcccaggacagaaagcugggaaaccuaacagucuaggaagcaaauaaagucagccucagacuccagaacacauaagcagacagugugacuuccuccguucauugauggaggcuacuucaagugaugccuaaaguuuuccuuuaccgaacugcuuugaguuccuccaaaggaucagccaucacugggcuugauuucuuucucuguuacucugcauggcuuacuuuuaucccugugugcaaauuacauaaaaagcaucacuucauggugggugcagcucuauaggaaauggcacuucugugauguuccucauaguuaagaacacauggaagcuaaagguuuauuuggcauucugauguugggaguuuaguaauuguaagcauaaauaagucaguucagagcauauuuugacaucauuuugaagucuuuaaguuguauauuaaggagccauugacauugaaauuuuugacagcuucacacuuugaagaagcuugugcuaauagauuucagcuucuaaaauucacccuacaacuguaaucucaggcauagcgugaguucacaggcaguauauaauguauuuugacaaacaugguagcuacauccuaagccaaccuauugcaaaaguacugagauuuuacccaaaaaugaauaacugaaucuggauugauauauauauuuuuaaacuuguagaauggcugcuucucuccuuuauauauccucucaaguauacauccagugcaaacaguauuguaaacuauaaacuaaacuguguaggaaaauagaguucugauuuuuaugcauauugguuuuauuuguacuuugaaauaucaaauucuuuucagcaaaaaaacauuuugguguuuucugcuuuucuugucucuuaagcaaagcuuagaaugacuguugauccaguacugaucucugcccuccugugaguuggcagccuaccaggggaaagcugcauaauuggaagaacagugagugugggggucagagguuaaaccuuaaauaaaaucaccagacugaagguuccagauaugaacucugcuacaauauuauacaaccuaguguccaucucuggaguggaguuuaagaguuuauuuaaagaauccuguguagauucuagagaaagcuuucuugcaauuaacaccaaagcuaaucauguauuuacugauuacuucaggguucauccugacuaugucggaagagcuagguccaucuuagacaugaauuccuuacaucugguagccaguauuccaaagauuugguccuuauguacuuucucuagcuauuuguuuuguuuuuucuuuaccuagugacauguuaauauugguaugcgucaaaucaccagaacuagcuguuaaauuuccacagauguugagcuauacauuuuauuagucacucauuuuuaucaaauuaugcaaaucaagaauagugaaagcaaaguacgaagucacacuuuaucacucuaaugauuuuguuccaugucauuguuauuuuguuuuucugaguuguguccauguggaaacaauauauagugauuugauuuucaacuauguuauuuugaaauugggccuuaaggguaucauuccuacuaccaaaguuggccaguccucgaagucaguguuugauuggugcuuugauucuuuagaauuaagaaaauguagggggagccgggcagugguggcgcacaccuuuaauccuagcacuugggaggcagaggcaggcggauuucugaguuugaggacagccagggcuauacacagaaaccuugucucggaaaaaaaagaaaggaaggaaagaaagagaaagaaaaaagaaagaaaauaaaugugggggaaagguuaauaguguaaacucauuugaagagcuuuugguuucuguggcauugcaaaagcagcgagguagguaaggugguguucacuguacaaagucucucagcagucagugcucacuguugcuguuucucaggucauuuucuucucugccuuaacagaaacaaaacaaacauuccacaacuaauuaguaaucauagucauuuauaguugaauuuggaauugagcauacauuaauguuuacugugagaauuuuguaucugauuaauaauauaaacauucuauacuuuuuguauauauuauacuuuacaucccuuauaaaaguaaaaacuauaauaagcucaaucauguauaugcaccuaugcaugacuaaguccaaagaaaauucccuguguuagauccaauuucaguguguuccuucauuuuuuucucuuuuuuuguuacccuccuuccauucuuauuuuucauauguauuuucuuuuaaauaaauauauacuaaauugaaccauagaagccagaaaacacuuguuuuuucuuaucaagucacauuguuuagauaaaaacaacuuuuaacuuaggguguaauuuuaacuuuuaguuuuauauucugaauuguauaguaaauuggacuaugaggauauuucauagauaauaauacuguuucuguaucauucuuuugaaauacaaauacaaccugugagauuuuuauaugggauggugaugucagagagaguuuuauuguuuuucuuugugggacacucauggucuuggucuuuuucuguagcccuggcuguucuggaacucacuuuguagaccagguugucuuugaacuuacuguguagaccaggcugccuucaaacucagauaugugccugccucgaccuccccaguauugugaauaacuacacuagacucagaucauuuucuaaccauuuauuuacuucagaauuuacauuaacaaaagaacauuuucacugacuaaaaaaggagcagugguagaagcaccccuugcuuauacguggugcugccauguauuaaaucuuggcgcccacaaaggggugcagugucuaccaugcaguuggagcugcucgccuguugcuuacccagucccucucucaaaggccaaagucccuugccucuucaggccucucucuaaagccuuugucucuuaccuucgucuaaggguaguauuacguaguagcauuauuuaauuuuuauuuucauggcuaugcauuucaaaaauuauuuaaacacacuaaauuuuaccuacauaaaacuuauuguuugacuuauauaacuuauauaaauguuuuauacuuguuuaauguuuuuucuuauccuuacagccuugguggagggccagaugaugcaaaagaaaucaugaggcauaguuuuuuuucuggaguaaacuggcaagauguauaugacaaaaagguaagcugucucuaagguucucuacaccuuagaaauuuaccucaguaaacuugaaugauacgacgauauuuucuguuuugcuuuggaauugaaguuauguuuaaaaaaauuaaagaaaaaauuuuguuauuuaacaaacaaaucuaugauucuauuuaucucuauuacuuguaaaauauuauuucccauagaaugauugcuaccaauuauguuuccucacucuuuuuuuuuuuuugguuuuucgagacaggguuucucuguguagcccuggcuguccuggaauucacucuguaaaccaggcuggccucgaacucagaaaucugucugccucugccucccaagugcugagauuaaaggcguucgccgccgccaccgcccggcuuguuuccucacuuuuguuguacaguguguuuuucuugugggcguuuguucauuuuuuuuuuuuuuuagacugaguuacacuuaguucagccuguuucuggaauuugcuguguguucuugggccacccucaggcauaaugguucucuaaugugggucacagcacuggacuccagauuaccgcauaagccugccuuuuccaguuuuguacucuacuuugccuuuggacauucuucauacaaauauugauuuagauuuuuaaaugcuugcauaauuuuuaugugugcauguauagggggugggggcauggaauugaagucagauguauacuaccaucucuuucccugaaccuggagcucacagaucaggcugaucuggccgggcagagagcuccagggaucugcuugucucucucccuuagcugagaggaaccgcauguagcuuuuuacauagguucuggaaauaugaacucacauucugauguuuaugagccauguacuuugccuaaugagauagcucuccugcccuuucuauaaaauuuuaaugugaaaaguugaugaaauacaguaauuuacuuagaaauuuuaucuaauuauuuugucuaaucuagccauuuuacauguccuuauuuuuaucugaaacauuauuuguuuuguuccaaguauuuuuuuucuuugagccccuuuggaguaucacaguacaaaugauaugggagaugacugguauuucauuuuuauauaauauuguugccagugggaaauaugauuuuucuccccaguccuguaacuaagcaauaaaauaauuguccauuuaaacacuuuguucaaagcuccccuuccacccuccucacauauagaguuucucacgugugaaagcacuguggugugugcuagguccuucccagccucugugaggcucaggggcauucugaaaugcuguaauagauaauugcguccacuuuauaucgauggugguguuccucaugagagcaugugugccuaaaaaggcuucuguaagcucugcccugccuuuaucacaacucuccaccacgaaagaacuggaaguagugcauggucagggacucuccuugacauaaaaugcuauacagugcaacuucauaucccucgaacagcugggcgugguggcgcacaccuuucaucccagcacucaggagguagaggcaggcagauuucugaguucgagaccagccuggucuacaaagugaguuccaggacagccagggcuauacagagaaacccugucuugaaaaagaaaaaaaaaaaaaaaucccuccaacauacccuguccaugaaguacucuuucauaagaacaagagggcagggugugugguucaguggcagggcucuugcuuggcaugugugggugccugcauuccaucccuugcaccauacacacaaagugaguaaaaauaauuggcacuagaaagaagaaaggaaauauuccuuuaaaagacaaugguaaggaugcauuauuacacuucuaaccuacagaaggagagcauggcuuuccuuaguguuuagauggucacacgaaauggcuguuggcgauacugaagaaagauaaaaggguucauauagcacaaauaaguaaaacacuaacucucagaucuucugauaacaguagcaauuuuaacaaaguuaguaagaagucuggaauuuuggaaauaugaaucaugaaauaaacugugaaauuggaaaauuugcagggucuuuauauuuuuaaaauguguaacuuugacuagugagauggcucagugaguaaaaggcacuuguccccaagccugggagccucauucugucccuaugaugcacauggugaaaggggacgaccuacuccugaagguuguccuucacaugugagcugugccacaugcagacccuucugcacaugcucaaauaaguaaauguaauaaaauauuaaaacggguuggcauuuuguuacuugccaauaaacuuuguguguuuauuauuucauaaauuaguccuuaauuaaugccuguuuucuaauuaauuucuuuucagacagggucucacuguguaucccuggguaaccuagaacggacugugaaaaucagacuggccuugaacucauaaagauccaccucacucuuuuucuaaauuuuugugguaaaauagagaugacauauuuaguaucuuuaaacuacaucuaaaccauucucuguaaaagaaaaaauagaaaauuaacuaauuuuagaggaauacaaaaacaaaguuagaagagcuggucaucuauucuggacucuuaucuugcccccuuuuguagaaagggacaagccacaugaaucauagaagacugauaaucuuaggacccuuaagccgggagacuuuucuggaaggguguuugcuaguaugacuuugucgacacacccuuuccuccuguuuaagacagggucuuccugugcaugcucuccucccucagacucaaaauccucccuccucagccuccuggguaauuguuuauagguauuuuacuuuauuuacguauuuuaauuuuuuaagaaucauuuuuucuaugcauuuauugcuugcauguguuuguacuguguguguguguguguguguguguguguguguggugugugugugguguguguguguguguggugugugugagugugugugugugguguguguauguguguguguguaugugugguguguguauguguguguguguguguguguguguguguguguaugugugugugugugugugugugguguguguguguguguguguguguggugugugugugugugugugagugugugugugugguguguguguguguguguguggugugugugugugugugugugugugugugugugugugugguguguguguguguggugugugugugugugugugugguguguguggugguuacagagguuauaaugcuacaugccauguggcuucuggagccugggaaucaaacuucaguucucucuaagaacagcuucagauuuuaaaggaugaaauuaauuuggauuuuuauugauuucuguuucuggguuugugaucuuacuuguuuacugcacaugugucuccaucugucuguaugguggcgggcaggccuucugugcucggccacugcugcacuacuagccucauuuaucauucaucagucaacuguucugaguuuacuucgaugcucuccccagaguuucuuuaaguugaaacaauaauuauuguugugagacaguguuguuauuguugcuguucuuaccaacucaccacucaguuggguccagagcuuuucucuagggcagugguucuuagccguggggugccaccccuuuggggguugaacaacucuuucacagaggugacucuuucacagaggucacguacaaccauuggaagacaaagauaucuacauuacaauucaaaacaauagcaaaauuucaguuacgaaguagcaaugaaauaauuuuaugguuggggucagcacuauaacagaaaaucuauaaaaggaucacagcauugcaagguugagagccacugcaccagggacuguucagccgguuucuuugguuuuaaaaugcagucuaauuuaaaaauauuuuaaauauuuuauuuauauaauguggggaaaagagagaaagaacaacuaaauaauaggagccgaggaagaaccaaaugacuguucugaauuuaaaaguuuauugagcuuucuuugcaucuugguuaauuucuauugugugacuuuuuuuaauaauaaaguuuuuuuauaaaaugaaaaguuuaaauuaucagggacagaggggggaggaggagaaaacacagauucugcuuuuccucuauaacauguuuuuaccaagaugcgucuauggauaugggacacauguucugugaagauggcagauggugugguucaugucgucagcauccuucuguguacugguacuaucaguuacugacaagcaguuguugaaaucuucagccacgaguguaaacaucuuuuuaauuuugcauuucuuuuuugguuuuguuuacuuuuucauuuuuuucagugauccuccuccucaagcucagugcuuuauacaugcgaggccggggcucugcagcuuguugcagucgagcccccacucucuguauuuugagcuguuggcuguauguacacuugaauuuaagauuguuucaucuuggggaauuuaccccuuagcccuuagguuauuuauugauuuucuuuuauuaaguauacaaucuguguguguguguguguaauaugucuuuucucaucauuuuuauucaaauuauaaauaaguagauucuguuuuaacauacaauucauucuuuuuuuucuuauucacuggauaacaugagaauaaaaugugauguauagcuaucuucauuuaauucauuuauugacauaguuaucugucugauuuuuagauuauccuuuuuugccuuucucuuugcacaccucuuuugugauuuguucaguauuucugguuccauuuuuuuuuucuguuauaaucuuacuagcuguaucuguuguucucuuggaagucguauguagacugcaaugucuggcucacucccggucugcucucagcuggaguuaugucauguagagcagcagacuuuuccucccuuugccauuucugugcugccauuuuguaagaguuuuuuucuuucauacaauaaauauuacaguauaugguaaguauacuuuuugcuuauagauaacuguucugaucuuugcagcucuagggauuaaacucaggcugcaugcuugcuagguaagcucuucaccacagggcugcagcacugaacucucaauaauacugucuaaaaguggucacaaaggcucucaauucauuuccuucagauccacgugucaaccugauggugugucuccugugcguuuuucuuuagucaacacucuaaggcugacuuuggugcuacacuucaggcacugaccuuucuugcuuugaaaacauucauaggcagaaagauuaaaggaaauauaauacugaaaaucauggaaauaccacauuuaagaaagggaagcgguaaagggauaaagcaguaaagcauggcaggccugaccucagaggccaacagcggcgaggggccugcuaacgugcugcaugcuccgaacaggguugcuucuggguuugguggaaggaaauaggguguguagugcgaagaccuuccuaagucuucuugguauagcaguagggagaagaaucuagaaaagaauccaguuacaagucugcuucacugaucugugcuaacuuucaggggccucauagaacagauugaaggcaccaaggaagcaaaagggaguguggagugagucugucugucugucugucugccugucugucuauagauaaccuaaagaaauaggcagugguuuuagacuaaaaauacaaagagaaagacaauagaggacuuuucauuuuaauucaaaaagaaauuguccaaggaaccgauauuugagugagagcaggaaagaaugcaagugucuggagucagaggcuggagcuggaggauggucuccucuccagaaaacaaggaugauaacguuggugggaaaugcaaguuuggaguguaguauaagaauauagaugagugguucuaaacauugagaacaugcaugaucgggaguggaguuugauuggagaacacguaauugccacaucuaccuaacugguggaaugucauacaaauguuauugugcagcuuuucauucugagucaggcagggacagucuacuaccccauuagaaucuucacuugaaaaguugagggauugauagcaguuguacagauguuacuggcuaugauuggcuucagguaagcuaaagauaggucucuagguauugucaaguugguguuuuucuuaccacacuuauuuuaaaauguuauucaaagaaagauguauuccaaaugugugcuagacauucugacauucugauggcuaacaucacaguugcugcugucuuuugaucaugaggcauuuuacauaggauaugaaagaccagacaguuaucaaaauuaacauugguuauuucauaagauauagcuuaagcuuuaagaaauguucauagauagauagauagauucauucuuaaaagaaacucaccuaaaaaucugggggaaaaaaucauagugaauagaagcauuuagugaccaaguauuagagcagcaccaaagguagucuugcuguggcucucaguagaugugacaaaugacuugugucagauagaaaugccaggaguacaaucuucagugaaaacauacuuugcacuaaauuacagcaucuuuaucacaagaaacacuuaaaauacaauagacgugcauuuauuuaacacacauaaaaauauccuguuucauuauuuaaaagauucagcuuugcuuuuacuuucuugguugucuauuuuauaguucauugauuucugcuauaauuuuuuuuuguucuaucuugauuuuaacuugugugcaaugccuacuuuggugguuuuaauuuauggcauauaaauauuuaugguguauaaauaugguauagaccuugauuccuuuuauauguuuuacauaggauugaggucagauauguaaacuucaauuaaauuauaugguuacagaaaaaaaauagacuuauuucaaauuucuaguucuaugucaagaaugcauugaaagcaucgauauaauuuacauauaaagcuuuacauauaacauaguuaaacaguauaugacauuguuggauucauuuuauguauacauuuuauauauuccuucuauuuccaguauauauacacauguguguauauacauauauauguguguauauauauguguguguguauauauauauguauauauacacauauacauauauacauauauauacacagaacauuaagaguuuuuaaaaugaaaaacggggauaaaauaaaccagaauuccacauaagaguaacuacuagauccuguugauuuaaagagauaaauuuauaguaccagauuacugaaucuaaggguacuaaacauucuuuugcaaaugucuauguccuaguguuuugauucuuauauacuaacacauaauaauugagauuggcacagguuguaaggcaacuaagacacuauaaucacagccugucacaggaagagccaacaaauacucuguuucuuaaacaucucagcuuuaaaauagaaaacaaaacaaacaaacaaaaaacuaaacuuacaggucauaagugauucggcugauuagggaagucuaggaagacuuacuuucaaagaucuuaguacuacauucauguugcauucccagccguaauagaaauauggauugugauuuacucuugggaauuuaagaaaaccaucuuucuguauuccuguacuuaauacuguaaacaaauauuucucuuuagaaagauagugaauauuaguauaugaugauuugaugaaagggcaauguggaaggaauaugaggaauuguaauuuuuccuacuugaaaggugauuuuugcacaaguagaccuaauuuuaaacaugccuuuucgaucaacugaaguuaauaucuugaacaggcuagcucacuaucacaauagcaaaauaaucaagauaauccacacagaaagaggacaggauuauuugacacaccauuuuagaaguuuuuacauaugacuggcugauuccauuccuguugggcuuguggugugacagauggcacagccugguaggaagcucauggucgaacaagcugcucacuuauagcagcaaaggagaaacaaaaggaaggaaccuuaguuucauggucaccuucaagaucacagucuucagugauaucaaacaaagcuaggcccaucucuuaaaagucaccaccuuucugaaaucaaguuuaucauaugacuucaguggacauucuagaguuauacuguaguagcccagaaucuuaauugacuguuucagucauuuagaacauuuucuaaaaucacaauuacuuucaaagaaaguucuguuugaagugaaaggcauuaguuaagaaaauauaucaaguuuacacuuaaugauacaguugcuauuuauugaguuagcacauaaaggcuaacagauguauaguuagguauuccugauuugcuaguaccugcccuuuuuuaagggggggggcgucuauacuguuacaccugauacaggaaugccuuaaaagaggugucuagagaaaaauaaagauggugugauaauauuggcuaaaggcauuuuuuuaaauuuuuuuaaaaauuuauuuacucacuuuacauaccaauaucagccccccuccucccaguacccccucaaauagauccucccccaaccccuuuuuacuuuuuuacuaauuauuuuauguauuuauauucuaaauguuuccacccuuccugguuuccccuccaagaguucuuuaccugauccuucuucccuggggcaucaaguuucuacaggauaaaguacauccuuucccacugagcccagacaaggcaagcacccacuacaucuggagcaagcccacagaccagcccauguaugcucuucaguugguagcuuagccucuggaaacucaggggucuggguuagucgauacuguuguuaaaguugauaugggguugcaaucgaugucaacucuuucaguccuuccccuaacucuuccauggggguucugaccucaguccagugcuuggcuguaguuaucugcaucuaucucagccagcuacugguagagccucucagaggacagccaugccaggcuccuaucugcaagcacaacaguaauaguguuggguuuuggugccugugaaugggauggaucacaaguggagcugcucccugacccuuccuucugucucugcuucguuuuugucccugcauuuccuuuacacaggaacaguucugggucaagaauuuugaagauggguggguagccccaugccucaaauggggauuaugucuaucuacuggagguggucucgccagguuccaucuucccacuguugggcauuucagccaaggucauccccauuagguccugggagacuugcacaucccugguaucugggacuuuccagagcccccaccccaccaccgcgcgcaugcacacacacacauacacacacacacacacacacacacacacacacacacacacacacacacacacacacacacugcugcauauuuccauucacucuccuggccauccgggccuguccccugucucccugcguaccuugucuccccuuuucuuacuccucucccacccagguccaccucuccaucccucuguucucccuucuaagugggauugaaguauccacuggggccuuccuuccugucaugcugcauauggucucugaauuguaucacggcuaauauccacuuaucagugaauauauaccuaacucacucaggauauuuucuaguucuauccauuuguaaagacaaaaaauuaaaacaucauauaguacuacuauacuaggguuaccauaacaaaaugccacagaauaggagggugugugucucuccucucccucucccucucccucucccucucuccccucucucccaccucucuguucccccucugccucuuucccccccuucccuccucccccuccccuccccucuccucucuccucuuuuuuuuuuuuuuuuuuugcugguguuggaagucaaagaucaaagcuuaguucuuugguaucuuucuuuggcucacaauugguccucuuucccuagguuuuauagugucuuucuuuuaaguucauguauuucguuguuugucucucuuuuuauagacacuccggagugggugaaaggcacuuuuuaauguuuuuaacucucugaaagcucuauuuaaauacagucaaauaagauccccauauguguguguguguguguguguguauacacacacacacauauauguaggggaagaauaaaauuuauuucuuaauaauaaagaauuaaaauuuauuccacugucuuuuuuuuuuuuuuuugagacaaguuuucucuguguaacccuggcuguccuggaacucacuuuguagaccaggcuggccucgaacucagaaauccgccugccucugccuuccgagugcuaggauuaaaggugugugccaccacgccuggcuccacugucuuuuaaaguaaaugaaaauacugaauauuuguaaucaacuccagagacuuagcuuuacugcugauugcuguggaaguacaucugaugaaauauuguagcaaaauuuuauaaguccagccuuccccauauacaugaugugaagcuugcuucuccccagauguuuauauuucacuguauuuuuccugauaccacggugagguggggugccaugccucuuauugugaaugucuugacuuugauuuuugacuaauauugguuaagacuacuuauuuauuuuuauuucuuugagauagauagggugucucugcauagcuaagaauggccuggaacuugcuuuguagcccagacuggccuuaggcucacaguccuccugcuucugucuccagaugcugggauuauaggugugcaccacuaaaucuguucagauggucauuguguuauuuacuuuugcugugcuugagaacagauuccauuuuccaacuuuuaaaaauagaaucugucuagagaauaaacauuuuaacauagauuuagugccagugagaagggggaaacauauuucuauuaauccaagaauccaaguguguuucuuucuguuagauuuuggcaaaacaugccaauuucuucauccuguuuguuauuuucuuaucccuguaaaacuuauauucuguucugaugagaaucacaaguccuggggcugagcaucuuuuauucaaaaggaaacccaugugucucucuccuacccucaacucaaggcuaguaugaggcuucccucccacccugcucuugcuuugagccacuccagcccucagcccagcauaauuaauugagccuccuucaggacacgucccccugugagggagggagggagggaaagcuguggaugcaguuugucacaaacuucaaggauugcugagaauucugauucuaaggcaagagcagacauugguacuuguucaccaaaacagaauaaaacagauuuuuuuguuguuguguuuuacaauaaaggugcaguguggucugugguuacagagcagguguauuaaguugccuuuagcuuuucuuuguugguuucugaagucccacugggccaaggagcauugugauccuccuguaucaaccuucugagugcugaaaucagaucaugggagugcaucaccauucccugcuaaguuauauauuuaauauuaaccauugagccagguaccaggaaagagggagaagaaaacaagcaagcuuagauuguugcugccauaagaagaaccacauucucgcuugguauccagccugugguggucccucuacuccugcuaucauuuuauguuuaucagaaagccgugcacccugucugccuuacacaggacgcaccuucuaguuguugggaccauucauuucacuauuugcuugcuaauuaaucuuaaaagguaaguuuuccugaguugaaauccauugacacuauuauuuucuucuuauagcuuguaccuccuuuuaagccucaaguaacaucugaaacagacacccgauauuuugaugaagaauuuacagcucagacuauuacaauaacaccaccugaaaaguguaagugaacaugcagcaguugauggcacucugaaggaguugggcacagucuucuacagagugauugacggcaucacagaugacauuguccugggauucuuacuccauuucugugagaauuugcacugccuaugagggcagagcugagcagcaggaacagacuuuucuggguagaacuugaggccacauuccagccuugcugcaccccacugcugucuuagcagcucugugcuaccugugggcaugucucaaguaggagcauucccuagucccagacucuuguucccacucaucacagcuucagagccucacuagcucugccuccuccuuauguagucauuuaacuuuacuuuuaaaauagcuuuuccuuaaauaguaguaucuuuaagggcaauugaguuugcuauuaauuuucauguauauacuuuccauuaagaaugcacuaggcuguguguucacacaccaucucaugucauuucauaugcacuaauacaugccucauacuccaagagaugucauacauaaguagguuuugaugaaggaggauaggguacaauuuugaggugauauuuggaaagcucaaagaauuccaaguauaggugugcacuguccuuuagcaucucuucccuucuuuuccuuguuuuaacauuuucucuacuguuguugauacugcuuauacacacugaauaucugugagacaaaaaaagaaaaugaaaugcuaucccuguaguggucaugguuacguaauuuuauuguugaaaccuaagcugggacucaucuggagucaguggcccugcauccgagagagugcaugcccccagggaaaaugucuguguacauguaugcacuucuuguucuuuuaugccuucacauugacaagaagugcuuaauuuuuauaaggaaagauguugaagcccgguaucacauacagcuagagcagggucaccagcacagcugggauaccagccaggcucugagaugccugaaugccaaagggagcugcauauauuauugguagacuuucaguaucacuaagaaguuagagacuguuaaaacuccuguggaguugugggcaaguaguuaaaggguuaucugaauagaaauuaugggcauagauaggccuuggccucuggucucagcagaaaagguagcuacugggaauacugggaaaugccagugaguagcugaacagaccaagaaaggugccuaccccaaguucuugcugggcucugucgcuuggaucaaaggcugguugcaugccaaccauccuuccaggguacagcucuccagugguuuccauuuuuaguauauauccauguucucacccagagaaccaccauugauguccaaggaauagugcagucugaccacacuccguucuacugugacacuucuguauugacgaugcuuuaacuugcuauuuuuugucagauaacaugauauuacugaaucucaugacauaaugacucuuugucuuagucccugauagauacugucucgacaaguauuuauuaaaugagugaacauaaaaggugaccagagccugggaggguuugggucaggaggaagcccugcucuuagcacagcacagcuguccuugggagucuggacugccuuuauguguuggaccuccacccaggcauccauaguacacuuuaggauggaagaucuugggaucuuuuuggaaaauagguuggagggacucuuauuagccuagcuucuucuggacucacaggauccuuuaugccauaaccuccugaauguagaaauaacacaucugagucuucucacccagcuugauucaugacaugccucuguccccagggucagccucuuuaauaugauuccuugaacacaaguuuugacauuugauucuucuuaagagagcugaaugcaugauuuuggaaacaaaauagaauagguagagcuuaggaacaaagagucaccucagaaagguaaaagugaaauccugauuuucaggauagaaaauagaaaagcacagauugcaagccuggagccugcuucaugcuucaucucuggcacuuaguuguucugagacauggugccucaacugccugccagggaggcacagggacucugggauaaucucaagcccaugcuucucuagggugugcuuaacaggccagcuccuaaagaaagguuccagagcauucuaagcuugaguggccugauuagcugguccuuaggauugacaugaaaagugagcuauauaauauaaauagcuccaguauaaaaguccccagcuaaguggaaugagcaugaaagucaguagcauaaacaguuuaagacucuaccaagucucaaacaagugaaguuagaagcuauuaaacguacucuugugguuauucagcugcuguuucaugauuagcuuacacuccuagccucgggagucaaggaccaggaaggacauccucacuucuccugucuuccuauuugugacucagacuuauggcagcuguccugagaauuuuuaugacuauuucucaguuccuaagaccucugaaaugauacuaagaugaugacuaggagauucuucauguacauuuaaguuuaauuucuuuccuuaucugcauuaaucaacacaagugggucagguugcauaaggcucagugucuuugaaagaugacagguucauuucuggaguuacacagcaucuauaaagcaagcccuuagguuagcauaauuaccaaaguaggagcuaucagccugugggaaucugacuucuguggacaucagaaguacaguaugaccuugcucugcggcugggcccuagacaguacagcaccaagaguccaaccagucugguauaugcccuacagggugugccacagacuagaacuaaggauagucuacagcuugggcuccucucuccuugcucaggaucucuuggauggaaaggcaagugaaagggucucuguccuagcuucuguugaaggggagaagucacaggaaaugcaguucuugguuucuaagaccaagggaagggcuuuugcuucagcaguucacagauucuaaguuuacccuaugggaagagaaaagaggcaacgaaccauuacuauacugagaguagcuuuuuucugguagccuugaaaacauuguuacucaaaacccaggcaucaagauuugauuccaaagugcacaggaugacauuuguuggcaguugucuuccuaguugccaccuugguuuuauaaaucaaaaauuuuaaauuauuuuuuaaagaauaaaucaguacuuaagaaagaaagcaaaauguuccauuuucugcaaacagcugcagcaauguuccagauuguccuaacugguguuaauuaauugagcagauuuuagaauguguugucuuucacuaccuccaucaauggcccuaugcuuuccucucacagaaaggaaauuuucuuugagagcgagcugaucauuuuugcuacugucuaauuacaucuguuaaauguucugagacaagcaggcaccaggggcugugugaugcagagauucaaauacagagcuguagucuguaauuuugggucauguaaauguauauucacaacugcugucauugugccugcaugguccuccagaggacgaccagauucacagauagugacuagguacccuguuuccuaguucccuucgcugcagccccugccaggauagcagugaaguacccaaguacccagggagcugcugcccucaauuggacauagucagagaacaagccccauuguaaccaacccugaggagguagucaagagcuggagugggcggcuuugaggaaagauaggccugugugggccucauaaccagacuguagauucagauuuguuccuguucagaauuguggugcuauugaagcaacaguggaggcugucuuaauucucuggagacucccacaaguucacccucucucuccaaggcaagacuaagaccugucauguaaagcccuucuaggucuaggacaaggucugguuacagccaggagccagagcagucccugucaucucucugggguagaaaaagcacacaacuuucuuacguagagcaucuggacucgcuguagguuugcugcacagaaacacucagaggaaccaagcucuuaaugggaaaguguuucugagagguaauugacaugugucagaguuggaacauuacuacuucaauugacuuuucuauagagaguuuaugcugugugacucaaugguggauaccucaaacgcaucccagcuagagaauuugaucuauaagauguaugcuguuggcuuaguucugaacucauauuuucucaggaggcugaaauuuccaucugccucagcacuaccuaggauuccugcucagcugcugccaaggcagcugucucucuguagagggaaauuuguguaguguccuaugcuaacuguguguggauggagugugucuaccuaccgcaccaauaguuuuugaugcauuugagcugaaaaaguuagguaaugccaauacagccucacuucugaggucccugugaauuaagaagagaauauggaaaagauuuuaaaaaaucguuuuucagaugaaggcaaagccuuuucuauucaugaaauuaauccucccaacagaaccugggaaacaaaacaaaacaaaaaggaacuaccccacuuaauggauuuaaggaaauggaaauauuuugcuugaaaaaaaaaaagauuguaaagcuacagagagaugauggcuuaguaauuaaggacugcugcucuuauagggaaccuugguucaguuccuggccucacauuguggggcuuauaauguguaacuccaguuuccaagguguuuuaguuuguuuauauugcugugauuaaaaaccaugaugagaaguaacuuggagaagauuuauuugauuuacagcauccugaucacaguccaucaucaaagcaaguuaggagcuuaagacaggaaccuggaggcaggcucugauguagaggucaugcuugcuggauagcucccaauggcuugcucagccugccuuuuuauagaauccaggacccaggggugagaacacccagagugugauagaccuucucauaucagucauucaccuagaaaaauaccccugcagacuugccuacagugcagccugauagaggcauguucucaguuggagguccccucuucccagaugacugcaguuuacaucaagucuaugaaugugcaguguaaccagcacucaggggaucugaggccuccuccagacucugagggcacugacccucauagguuuuaaauaaacacacagacacacccucccucccucacacacacacacacacagacacacccuuccucucucucucucucucucucucucucacacacacacacacacacacacacacacacacacacacacaaauaaaaaaugaaaagaaaucauguuuuagaagguuguacugacuaguguaucccgauuauaggauagugugcaguggacuuuguagaugagcaagagugucuuggauggcucuuuauagugcuuggccacacccaaggaagagcuuuauaauugugaacugcagucauagaacacuuagggaagaaggggcuugguucauugugacccuucacauacaggggaaaagagauaagagagggcauuuauauauguuguccuacccucacagcuugcaaauucuuucuuguuuuccugaugaaccaggucuucaaaucugcccauugguuuuucaucuuuuuucuugauuucucuauucuagcuuaaauuuuuacuauaagaaaauaaaaaauagugagcuagucaauaguaaauguugacuaaaauugcuuaagaagaugaguuugcagucauaccuaggucaccaggaagaaaaacuacaagcacuguggaguccuaauggguucuguagaauucaaugacuuacaguuuagaacuuuaugcuuuccugaagugcaagauccuugaaaguaguauucugguuuuuuuuuuuuuucaguaacaguuuuccuaaaauauugaauaaugaaauuuugauuucuuagagaugguuuuauaauauucuuuguuuguagacagaccauguguauauagaaaucacaguccuuuaaacucaguuuuacugagaaguuaacgagauguacuguuucugaguguaggcagaguaacaguagaaacagaaaugacagcgcuguuugcugcccacagaugacgacgacggcauggacggcauggacaacgagcggcggccacacuucccucaguucuccuacucugcaagcggacgggaauaaguuccuuucagucuguuucuacacugucaucuuagacuuugccugagacugauuccuggacaucucuaccaguccucgcucuuacaguuagcaggggcaccuucugacaucccugaccagccaagggucuucacccucaccaccuuucacucacaugaaaccauauacacagacacuccaguuuuguuuuugcaugaaauuguaucucagucuaaggucucaugcuguugcugcuacugucuuacuauuauagcaaccuucagaaguaauuucacaaucuuugggagucaugagcccauuguucauuugugcaucaagugucaucuuuugguuuuugguuuucccuagcagugaaggcuaaaugagauacacugauucuagguacauuguuaacuuucuaggagauaaaucaagaacuaauuagacuaagaagauuuaguuuauauuucugaacaagcaauuguugaaggguggugguguguguauguaagaguuuagcaguguaugucugaccagcacaugaaguguguaucacugacauuuggcuggaaaaucuuaggaaacauugagaggacugaagggccaaugagauacacauuuuuuuuuuuuaaauccugcuggcuauuguggaggaagcccagugccacccauggaugcccagguuucaagggcaaauggacauuguucaaccaaguacugacggugcagaguccccuagagagucuuaggaucuacuuuguaccagagaguauuuuccccugggcuuggcaaccuuuuucccuucuuuauauuuaucaccucugauggcugaagaauguagacaguauaaugauccugcugucgccaaaaucuauacaccaaggugaacagguguuugccuuaccaguuuuggaguuuuuacuuucaguuauagguaaauuagcuuuuucucagauguuaaaaccuugaauguccuuuaugguuuuguuuauauuacaguaguauuuauuuuuuagugguaagaauuguguugucauguuagcaagcgcagcuccaauucacagaucauugccugcguuuucuuuugacccaugugcaaggaauguacacacccauuagaaucaugcacuuuuucuccuauguuaaaaacaaugguaaggcucugggacuguaucuguugguuagaaucuggcuagaaucucugggagaagagaugcugugauuuaaccccuuggagcugaaaugagagcauccccaacuacccagugccaagggauggaugugagaggauagucuggcagaaaguaauggagaaagcugagacccaaaugaugaugagaaaugaacucuacucggcaaaaugaacacaucacaaguauucacacaauaggaaguaaaggauaagaagcugauguguuuauucuuaucaagguacauucauuacugaaucaagccaucagggaaaacaacaaaacaaaacaccucuagcuuuuauuuuucuguacauauucaugucucccaacccaaacauuucucacugagaggggacauguaugcaaaccucaucuuucuccuucauuaaugaugaucuucagauuaacccuuuggugcuaggagcugacacuuuccaaagcagacuaugacguccaaggaucaaagccucucuugcagcaagcaagagcaacugcugcuccaaggcgugaucauggaaguggaagaccacagugugacacagugguacugcauugucuuuuucaguaggaagucauguucucaugcaagugucuuggccucuaggcucagacuuagagaagcagagccgcugcuggcaguggcuggccgcugggacugcugggguguaaagggcauuuuccuaaggcagcuaagacagacucagacauagauuuuuguccuaauuuuucauguuucuaccugggugaguuuacccucagugggaaguaggaaguuaaacagguguauucuuacaucugcugucuucuguuuuccuacauagaaguauguugaauguugcacauugacaaggaaguagauuagaugguaaguccuuuuaaguuacccugcauccauucuguaagaaaggaggaggagaggaagaaaagcaagcugagccuggccgauguucagaacauuuacucccucagagggagcagacacuguacacuaagcacacagcuucuuuuguuuugucucuccuuccaagucuuaagguaauuucaugaccuuggccaaggauacuuugugaagauuaaugaggggacauugacaaugccucaggcuggccacuccucacacuggcccuugguccccagccauucaagggguuacucaucccaucccugacuaccugagugucacuacagguggguucuuggcuuugaguucaagaauucuuuccuuacacccuccaccagaugucaguggaaaggcagaaguagaaccgaggugugggaggagauucuaaaagcuuguguugcccaggccucuagcuuaggguucuggcaauugagacggccugaaaccugacagcaucauguccgggcagcucuggcuuugugaguccagcuccuaccaacuccaccuugaccucuugucuccaugcagggcugucugggaggaaacuggccacuucugcucagacugcugccagcgcucucacagcuuugcucucuacacuaaugacauagauuauuccaguauuguucccauuucccaccugaccuccagcuucucggagcugacuucuugcaggggccacaugcuucuuucccucacuaacugcagggucuccaccacaccucaguguacacacuuugcugcuaccgucuguacugucuacaucacgguucccuuagcuugcuccugguagugcauuacaggcaagcaugaaauguaaaguauuuauuuaaauaaaaaggaaaccucugaauuggucaucgagucaccucccuguagauuuguagucugugacauauuucgacuuucuaguccugcuagauccauauaagaucuggucaucugguuaaggguuugaagcagacauagcuaugaacccggaugguaucaucacugucacggcuggccacacuacagauguuuauguccuuacguuuaugacccacagggugugaaguaacuuccaagaaccugauuuuguacacuguccacucucaguaucucacacucucugauagggacacacauuacuuccuucguacagacagcuuaaauaaagcccuaugucaaucugcugcuucucuguuuguuguuguuggauauggcucuguaauuucagaaaacuaaauuuccuccuuuucuggaaaaaugauuauagccccagcuguuauuaaccaacccuguaugaaggugugauaggaaaagagguaaauuucucuuccauaaaacacauacgggguguuuuuacuugaccaagaugccaauagcaugcuuguacaaacugauaaagggcuagguguggagucacuggccaccagcaguagauuuuaaggcacaucuacuaggaugccagauaaagaguagauugcagacccuaaaggucuuaauaagaaagggugugggcccagaauccucaaggaaugcagcucaucacuaaugucuuccugauaacauacugugccacacccuuccuggcaagggugucuuuaacccuucaugucaauuugacuuagacaugaguaauugauggcuagaaugucuggauuacaugguuuuggacggggugucuuucugauuuuuaccucauaagcuacaauuguagaacuuggcuuugcucuugugaguucaacagagagaggaaugacuuuugggaccaguuaggcaugcauguguauuucucacagccaaauuuggggacauucuuacaugugcuguccucaaaaucaacugggguuggcagauacaugaggcugaaauaaagugaccucuacaacucucuaaaggugcuauuuuuagaauauuguauaauuuauuccugguauacauaaaacaauugaggacaguuaaaaccugugacagcuuuaugucuagcacauuugaugaaaccugaaacuucugacucggaaguugugcuguucuaggcuugcaccuuuggcaugccccagagaugaggauggcccaugugccaucaugcugccagcacaccauggccuaagcuguauguuugugaagggcaggcugagcauguggacaccaugccuccacugagagcccugggcugccgggcagccgggcagcugggcugcgggcagggagaggugaggucucacaugcaggcuugcccuuaguguuucaucccucccucagacgccaugaccaucucagcauccgggcuuuaucuccaucugucuguuugguuuuuguuuuuguuuguuuugugguacugggguaggaacccagggccucacacaugcugggcaagugcucugccaccgagcuacaccccagaccuuccaguguccauuuguauuccuuugaagcauuugagggcuugacuguauaguagaaauacuauuuuagacuaagaauaugaucuguguacagauauuugauauacuguuaaguaaauuuucuaauuucacauacauuuguuuuuaggcuccucucaaauacugcuauugaagacaaaaaucugacaccaucgagccaaagaugccuuuuuggggggaggggagggguuugcuuuguguuguucagagaaugggaagaaaaaugcagagugcuuccugagugcacacaguucgaugggaaauacuggaugcuggcuaaagguagacauggucaugagcgggaagaagcaguggccggcaggaggagggguggucuucaguccacguuggcugacuucaaacaugugccuuucaguguguuuugucauugcuacaaaaugaaaaggaaacggaacaacucaagucuuuaggaaggucauuuuauuaauccauguguauacuuuagagacaacguaaaucagugacuugaagcuguucugagcacacacucccaacgagcccuagccaguugaugcugaagcaagcacucccuguccauagcacagggacagaccauggcaugaggaccagcccccccugcagucccugguggugucucccuggggagguuucggugcacuguggcacauuaaguacaaaucagaugaauguaaauaucucuuuguaaaucauuuauuucacucuguuucauccaggucagcaaucagauuguggcaugcuggguaacuggaaaaaaaaugauaauaaaaaguaaguuuaaauagau

SEQ ID NO: 541 - RNA, 1233 nt, Mus musculus
agcaugaaaauuugcuuuuacuuuuaaaauguuauuuaaaaacuacauucuauaugauuuaucaguaaauacuuuguucauguauuuuauauacucauaugcucaaggucauguaaaaauuucucaggcauaaaagguuaguggaaaaaguauugagaaguccuuugaauccgugcuucaugucucaagauuuaaugaggugccaccucagcauccucaugugcagagucaccaggucacccucaagcagaaaggaccagucccaagagaaacggcaguccgaagcagugcaaguucuuggccagugaccagguagcccagggaguggugcuaccgcuuucagaaugaaucuucccuccuugguuaaacucacuccuucccacaagagacccagacucccaguuuauuauauacucucacagaaguacccagagacuugucuccuaggagauacaucagguugguggugaaagugaccaacacucauccaucuucuaguccaccgcccaaccugaccuucugcuuucuuucccaugggccaaauuauaauucauugggagguugggcugcucaggagucagaauaucaaaaacugggagccuggaauccuauaugaguuuuguuuccccaaguccccacgggaguggcagaguagucuggagcagaaauuagcugccgacacaugugaggcucagcugugcauccaucugagugaggacacacuuggaggaaugcuuccccucugguugcauggacaucucuuuguuuccuuuacauggcuccaagugccccaaacaccuccugcucaggaagguaacucagcagcucauuagaguccucugccuaacacauaucuugaagauaaaacauggacacguggugucuggcuuguccagaacaauccugagggaaguucuagaaugugcacagaagagaucugggcagcugugucagaaugacgaggaggagacgcgaggugaccuuacuccaccccaccagaaaccaaccuuugcaggccugcgccugucucucccguguuggcgcucugucucugguggacuccaccguaccagcccaagcugcagccaaugcccacagggagacucucccugggugaaguccagagcuugcaggagcugcucugucugguuuuuaagagagaggcaaacauguaacaggaaacaaggagacugucucagagcaggaucaaaggaaggguaagaggcggggaug

SEQ ID NO: 542 - RNA, 710 nt, Mus musculus
guuucuuucuuucuuucuuuuuuuuuuuuuuuuuuuuuugucauauagaacagcagacaccuuuauuacacuaucaugaggcucauuugccuuuccgggcuuugaucuuccgcagauagaacuccagcuccuugccuucgagcacauagcggucugcucugccacacuggccuggucuugaggcaauacaggcuagaagcuugcccugcuggaacugcuccaggagacugcugauuuuggcauucuuuuuccuuucgucguauuucuuuugaauuuucuuugaucauuuuuuguuuaaaaucucuuccuccucaggagucagcuuggcccccuucuugcagcccaggggcagugcauagugggacucguaccacuguccguaaggcgugcugucaauaagcacgauguaguucuucaccagggucuuggugcggacaagcucguuguuggaugcauuguagacagcaucaaugauccuugugcgaguacaacacucagagccccaggaaaaguuccccacauccaaucucagggcacgguacuucuuauuuguccucgaacucggacuauguauaugcggcgagggccaaucuucguguuggcagcagggucccagcucauacuuccgcuucuugugguaggguuuuugcuuaccgccggucuugcggcacuugugccaguuguacugagagaugcccgucgcucggcgc

SEQ ID NO: 543 - RNA, 1113 nt, Mus musculus
aaugucauacuucggccuggagacuuucaaugagaaccuaucuaaggaaaacuuggaugaagaaagugugauuuuaacgcugguccaauuuaaggagggggagccaaucacagucuaacuuacgcaaucaaauguuucuucuucaaccuuagaccacacaccaccagcucguucucuggugaggcaugcgggaaucaaacacccaaccagaaccauaccaagcaccuguccucugcccagccugccuccuauuagggacgugucccggaacacucuucgggaguggugucgguaucauaacuugaguacggauggcaagaaaguugaggucuauuugagacuucggagacacuccuauucuaaacaagaauguuauauucccaauacaucucgggaggccagaaugaagcagggucccaagaaauccaagauagucuaccgaggaaucgggccuccaagcaggugccaaaggagaaaggaggagagugguguccuggaaauucuaacuucaccuaaggaguccacauuugcagccugggcaaggauugccaugagagcagcucagucaaugucuaagaaucgauguccucuuccgucuaauguggaggccuuucugccacaagccacuggauccagaugguguguuguccauggcaggcagcuuccugcagauaagaaaggcuggguucgccugcaauuucuugcuggacagaccuggguuccagacacuccccaaaggaugaauuuucucuuccuguuaccggccuguauuaucccagaaccaggaguggaagauaauuugcuauguccugaauguguucacagcaacaagaagauccuaagaaacuuuaaaauuagaagccgugcaaagaaaaaugcucuacccccaaauaugccgccuuagacaagauuuuacucugaucuaaagggaauggaagaauauucugugaucccuauaauggcuaaaaacaaacaaacaaacaaaacaaacaaaaaaacuggcugucagucaucagaagccccuccuccugucucccagcagaguggagacucugcugacaaaucagcauccaucucucuaacagcccgcugcaucuuaacaucucugacagc

SEQ ID NO: 544 - RNA, 1113 nt, Mus musculus
gcugucagagauguuaagaugcagcgggcuguuagagagauggaugcugauuugucagcagagucuccacucugcugggagacaggaggaggggcuucugaugacugacagccaguuuuuuuguuuguuuuguuuguuuguuuguuuuuagccauuauagggaucacagaauauucuuccauucccuuuagaucagaguaaaaucuugucuaaggcggcauauuuggggguagagcauuuuucuuugcacggcuucuaauuuuaaaguuucuuaggaucuucuuguugcugugaacacauucaggacauagcaaauuaucuuccacuccugguucugggauaauacaggccgguaacaggaagagaaaauucauccuuuggggagugucuggaacccaggucuguccagcaagaaauugcaggcgaacccagccuuucuuaucugcaggaagcugccugccauggacaacacaccaucuggauccaguggcuuguggcagaaaggccuccacauuagacggaagaggacaucgauucuuagacauugacugagcugcucucauggcaauccuugcccaggcugcaaauguggacuccuuaggugaaguuagaauuuccaggacaccacucuccuccuuucuccuuuggcaccugcuuggaggcccgauuccucgguagacuaucuuggauuucuugggacccugcuucauucuggccucccgagauguauugggaauauaacauucuuguuuagaauaggagugucuccgaagucucaaauagaccucaacuuucuugccauccguacucaaguuaugauaccgacaccacucccgaagaguguuccgggacacgucccuaauaggaggcaggcugggcagaggacaggugcuugguaugguucugguuggguguuugauucccgcaugccucaccagagaacgagcuggugguguguggucuaagguugaagaagaaacauuugauugcguaaguuagacugugauuggcucccccuccuuaaauuggaccagcguuaaaaucacacuuucuucauccaaguuuuccuuagauagguucucauugaaagucuccaggccgaaguaugacauu

SEQ ID NO: 545 - RNA, 1286 nt, Mus musculus
ggaccaagggacagggagacgauucuggccuguguguaucaccagaaaguagugccagcuucauguugggaagugaagagacaggaugccuggggcccucucagcacaggaguagaaggucuguguuggaaaagagucuaguugagagaaaagaaagcacucuuuucccagaugucggcaccucagccacaacuaaacaagccucuuugucuguggcuggcaucuuguuugaugugauccuguaguuuucugaugcucugugaccaccagggcauccuucuccuuucuugccccgcccugagucaucuaccagcuucccccacacagagguuccaauccucucagcuaacaagugugugacuccaaccuuaacgagcaaacagacagacuccagagaggaacaggaguaggacauuccuauacuucuauguugagauggauaaccaaagcuaaccacaccagcagaaggugagcaacacauuaaacagaggggaaaggauaauaaaauaucgccugcuguuuaacaaucgccggguggaaacauuccgggaacugugcagcugccgcacuugauggcucauaaagccccuguaacguccgucaagggccuuuuuucuuggugaggggccauuuuuuuccaugcaguuaugauagcaucugguuccugucccuagaaguacagggaauccacaggcucgggcaguggcugccaggggaagaacugggcugcagaggcaucuggcuccuuggaugacuuugggggucacuucugaccuaaagggcauuaucacaaaaaugcagauuaggauucagugggaagucacugucaccuguugugugcuaggaaggcacuggguaguuuagcucguguauccccucuacugugaggucgccauucucaucacugcaaaaucagugucccaggcuggguaaaggacacaguuaggccacacuguuaacaagugacaggcugaguuccaaguggcgaauaaguguaaacugcucgaacuaugucacaucuugcugugucaucuuucugcgaagauggaggguacauggcauauggaaaaaaaaaaagucucugcauuugcuuagccuaccuggguaccuggguagauguguugaaaagaguauuuuuccugaauaauagacaucagugguggcagcccuaagcaugcgcugguuuccauuggguuccccagaccuacacccagaaguaaggaugccuauggaauaagaauguggucccuagggugugugagaacauuaaaugggaaauaaaaaua

SEQ ID NO: 546 - RNA, 2180 nt, Mus musculus
gaaaccugcuacacacacacacacacacacacacauacacacacacaaauuaaggacauacaaaaauaccacagugaagccugcuuucuaugccaagugaaaacaaauguuaacagucaguguaggggugggagagaugguucagcaguuaagagcacuggcugcucuuucagaggucccaacuucaauccccagcacuuagaacggcagcucacaaucgucugcaacuccaguuccaggagauacgaugcccucugaugcccucuucugaccaucaaggguuccaggcacucacguggugcacagacauaacaugcaggcagaugcuuacacagauaaaauaauuuuuaaaauuaacuguuuucuuuucaagugaauguagaauaaaaacuguaaggugcaucucugguucucugcuguucuuugugucuguguuuuugcuuaacuugcggguaaacuggcucccguuuuacugucacguuuuauaggucucuuuuaauucuacugcucucgcugugaauuuacaagaauucuuguuuauccuuuagucacuaauggguaaaaaggaaaggaaaaaaacacugaauuuuaguuguuuuaaaaauauauugcccuauucaucugagcucaguauauuaucucucuggggauauuaaagaugugagagaaccuugauuucuuuuuccuagcuucguauuuuucuauugaauacccuucuuuugcuuguacuaggccccagcguccacaucuaccuuucccugugucucuguuuagaauuaaaccugcucugaacuuuauggcuuccuguuguaguuguagaacacaugguccugcagcagagcuuuccaucaaaacaaugacaggguagacacagguaauuuuugaaacaguggagggguuuaagggcaggggaggaaaaucuaggcugauaugaagaugagagucuagauagauggcugacugccaaacuguccccaaaaguauuugucagugccacaaacucagacaucagaaguuuuccugggaaauguucagugucucugguuccugaacucccugagaugguuagacuagagaagauucuguccccguugcacucagaccccacacggcugaucauuugcugugaggagaaaugauuguucuauaacaaaugugcuaaaugaugaacgaaugucggggcuagaugagcuucuggucuggacagccaaacugguucaugcuuuaaagugauucaaaguugccccaagcaguaggcuucccagggcucugggaaaaauggauagagagccucacacaagccagcuaccacccaggccucagaaagcccagaagucauuauucaagguuaccaaauggccuuaccaugaaaaucaggauuucaagagcaaaaggaacuaaacaagagacaagaaaacaaacaggagaaacagacuuagguuuuauauacuagaaauaaguaaauuguaagauuuuggaaacuagagaauaauuucauaucauaaaagugggaggagaggggcucaugagcacccaccccuagcugaugaacuauugacaauuaauguccauuggacagggagagagagagcuaguuuucuuuaagaaugguaccugguagauugaucaugcuccaggugguacaugucuaagcacauggacagcacaaaucguacucagugggaaggaaagggaggcuuaaaguaggaagcagguggggacauggcagagacagaucuauggggaguuaagcagagaagugggauauguaucauggucaaauacaucauaugcaugcaugaauucucaaagaauucauuaaaaaguauacauuuuuaaaugauauccuauauuugaauaaccauacagagucuagaggugaaaacugcuugcugauauccuaggauauugcaauggauauccuaguuagaaaagaaaaguaaaagaaacaaguaugggccagaagacaguuuaaagucaucccuaguucagagagaggagcacagggaaaguauaguaaauaugagagaugggaguuauauaaacaagauccaagaauacaaagaaagaaggaugagaauucagaguccaaguugaacacacaagcuugcaaauuccuccauucugacggaagcauuagcccacaaauucgggagucuagugagccccaagcaugauga

SEQ ID NO: 547 - RNA, 563013 nt, Mus musculus
acgcaagcgcaggacgcaggcgcgcagucagaaaacacgagacucaagcugagggacgcaguucggaucugagguguggaucugaggaaggauggaggcacugaagguggaaaaguucacgacugccaaccggggaaacgggcugcgugcuguggcuccacugcgccccggggagcugcucuuccgcuccgaccccuuggcuuacacugugugcaaggggagucguggcguagucugugaucgcugccuacugggguacguacggaaccugagcccggggcgcguggcucugcgggugggggugggccucgagggcacagcucuguggggugucugcagcacccuaggcugcggugggaauugggggaggcaguggugcagaugaaggggaagcgucgggcagauaauuuugcuggggaacaaaaauauucaaagccugugcaacgagcuucauugguuguggaaaucagaaguggcaggggggugugagucugggaaggaguagggguguguacgucaggaucagaacugaggccccaccugaccugucuugcgggaggagcgagaagccugguguuuauguuguacuuugcuggucuggauuuuacguggcuuggguuuaggaagaugaaugagacaucccuaaggacuggagcaaaugagaauuaaccguguaacaaaagagcaaaauaagagaugcaaacagucuacucuaggagcguaggacucgcggugugcuuugcccucuagagauugugcggacaaauguaacucaccaccucuguguagaugcaacaguuuaugugacaguguuucgaagucuggaagcacggugucagcggagggugcuuuacuguuuauagaguuguguaacauauacacuuccguccgcacacaucggguucccaccaugcacugggauaaggacucugagguagguagguuccagacccaucccucuguguuugggguggguagagguggggagucuagcuuuacuauacauuccaggauacuccccucgcuccccucuccucccuccucaguccccgcccccucagacaggguuucucuguagcugcucuguagacuaggcuggccuucucugcgucccaaagucuugcuguuaccaacgcccggcuuccacaauauucuuguuuaguuuauaacugaagacuucgcuuugcauuuuaaaguuagcaaauaauaauguuaucuguuaucuucucaaguggugaucgaaaugacaugcacacaccugcacgcgauuuguugcugaaagagcagcgggaaguuugugggguuaaagcaauucacucccuucacaacucggccucgaaugccacgaacccccuucucacagacuaauuggagaaagcaggacucuuccuucauuguguuacauacuuuguaggcuauuuagaguguagauguaccucaccccauggcagagagcuuacugcuuaaguccuaaagcauuaagugguaaagaugauguaagccuccuugcagacauaguuugaaggcuguguugcucaguggguagagcaggugcauuuaaucauaaacaaugacaaauuaguaauggaaugaucagagauugucuuuugaacccaggugcucuggaagggcagccagugcucuuaaccacugaaccaucucuucaaccugagauguucuuuuuuguuuguuuguuuuuguuuuucgagacagaaaucugccugccucugccuccugagugcugggauuaaaggcaugcaccaccacaccuggcugagauguucuuuuuaaaaauuuugcuauauauauauauauauauauauauauauauauauauauauuuuaugaaguacuggaguucuguacaaauauugucuuggagcugauuuugagucauacguuagaaagaaucucccauuuuccagaauaaaguacacaaugagccugacuuuuaucauuuuucuuucgagaaccauggugauucaagaaccaaaaaaaaaaaaaaaaaaaaaauucuugaaagguuguuggggaacucucagcuuugcuuuaagggugggagaaaccuggaugugaagaugaacaggaaccaaaucagaacugcccuguaguggucgggcuguagucugggccgcauccuguugguagcacccuggacgagggacucugcugugcucuuugggaagcuaauugcucucuuucuuggauuagccgagcacaggccacugcuuaccuuaacugacaggugagaaaggauuguucuuuuuggcuaaaagguaggaggcagcccucaccucucaggguuauaaacaaaugccaggaauccaaacaagugcauccuucaggcuggcuaacagauacuugcuuauucguucuuuacacaaaacaguugauuuguguuugcuuuggguugucacgcuguauguaugcuggaauucacuugcguuauaauagcaagcccuucacagaacacacucguuucuaugguuguagggcucugagcugccuaguugagaaucauugcagccugaaaacuguauuagugaaaugcugguacauucuuaaugugguuucccaucaguaaugaugugcaucauuguggaauacauuuuccuguucuucuucuuguacguggaguuuguuuguuuguuuauuauucaccaucacuuauaaagugagaagaagguguuguauuguugaguuuuuguguucuaaugcagagcagacauagcucucauuuuguaauaugagugucuggcaggauuauuuugcaaacuuuuuuucuuuuucuuuuucuuuuuuuuuuugagacagugucucacuauuugcucugaacucacuauguacaccaggcuggcuucaaauucagagauccacuugucucugucuccuaaaugcugggauuaaaggcguuugcuaccauguucuguuaaccuuucugucuuuuuuuaaagauuuauuuauuuauuauauguaaguacacuguagcuguuuucagacacuuuuucuucuaauucuggucccgcuugcucugguccaaagauuuauuuauuuauuuaaugugaguguacuguagcagauaucauuauggaugguugugagccaccuugugguugcugggauugaauuuaggaccuucggaagagcagucagugcucuuaaccccugagccaucucuccagcccccaaccuuucugucuuuuauuugacuauuauauaauuaccuaauaaaacauggacuuugagcugggcauuguggcgcaugccuuuaaucccagcacucgggaagcagaggcaggcggauuucugaguucgaggucagccuggucuacaaagugaguuccaggacagccagggcuacacagagaaacccugucucgaaaaaccaaaaaaaaaaaaaaaaaaaaaaacccaacccaaaccaaaccaaccacaacaacaacaaaaacaacaaaaacauggacuuugcaacauuuauggggaagggauaaaaauagaacaaaugguuaccagguucuauuugcuuuuuuuuuugcauuugauuagugcuuugguuagcacuaauuuauaagucuaucugucuuauuuaaguauuuauaagucuaucuguuuguuuauuuuuagacaaaguuuucugauagcgcacuauggcuuguuguuagcuauguagcugaggauagaugacuucggcuccuuaucuugcuucuaacucccgagugcuggaauuauaggcauguucuagugugucugacacuuucuuuguuugcuuuauuugucaagacaguguuuuucuguguaguccuggcuguccuggaacucacucuguacaccaggcugaccucaaacuugaauauguuuccuaguaucucuuguucuucuccuuuaaggaauggcuucuggcuuuucauguagugaauggaaaagacaauaaagaggcugaggcuauggcucugagguagcgauugccuagcaacuugaaagaaaaagauaaacuugugacuugcaaucauguauacuguuuucccugcugucguacacauuuuuaguuugcugcugauacaaaagauugauuguacaaugaguuuuguuuacuuucagcuuauguugguuaaaugcagcaugugaaauuucacuguggggucuggagaaagaacccagagguaaagaguacuuucugcucuuccaggggacccagauuugaucccuagcaucuuugucguuuggcucacaaucacuuguaauuccagcuccaagaauucaugucuucagcucucugcagguaucuguucacacgagacacacauacacauagguacacauaagugaaaauguuaucacacaaggcacacguacacauaggugcuacacacaagugaaaauauaaaacuaacucuugacuguaucaccuugcauuuguaagucuccuuaccaugguacugaccaaagucuaaccuuucuauucuagcuuacaaggcacaccgcagauggaaauuguuuaugcuguaaagggccaguauuugggggaugguuuagaaagggccauguugccugcugcucuaucaauacugacuguggacaaacucuaaugauaguuccuucuauaagucaaagagcauuucauguguuacuaaggguuggagcuuugugccuuucaggagggaaguaggacuuggaagugggaaggucuuccugccuuuguggauuguggagagaagugugcgaauguagagaaugaccauguugucggaguuacaugcuccaaguggucuccucuggcugacauucugugguuauggggguguguuaaauggacugagggacagauaauaaugguacaguuugggucuucaucucuauacuuucuccucuuuauuugggaucuuuuuuccuuuuuuuuuuuuuuguagugcuggggauagaacccagggcuuuacacaugcuaggcaaacagucuaccaccaagccacacucccucacccccagcacuauaauuuagugucaugagaagagaaacucugcuugccauagcccaacagugguagaaggcaguggcuacacaggggagccucuggggcaagggauucugaaaugcucucagugagauggauggaggagguuagugaccgagggaagagcaggcaucaggacaagggacugugugauggggacccuuaagucaggacuguggacaccagggaugggagcaaaaugaugucccaagagacaagauggcaccaguccagcaagaacacaaggucaccacguuugaguugaaauguauaugucuucgccauaauggcacugcaggacgauggucuaguaagauagugaagucuuucuggaccuagacugcaggcaagggcaaacagcucugugugguguggugagauguggugugagagcaggcagcagcagugauuaaaauccaguucauuggcacaugccuuuaaucccagcauucaggagacagaggcagguagaucucugaguucaaggcuagccuggucuauguagcacauucuaagccagccauagugagaccccaugaguucuagaacacaccacaucauauucaggagagagauuacaaaaaacaaacacacaaaaccagaacauugaaacaagcauuacuuucauugcuagagaaauggcucagugguuaagggugccggcuacucuuugagagagucccgguuugauucucagcucccaugagacagcucacaacaguaacucugggcccagggaauccaauaccauccuggcuucugcaggggcacuugacgugugcaugugauauacagacauauguguaggcaacucccucccccggcuccccacauaaauacuuuuaaugugauacauagacauacgugcaggcaauccccccuccgcauaaaugcauuuaaauuuuuuuuuuaaaaaaggugugagacagccaaggaagugguugcuaagugacucagacuuagaagguucaaaauaguuuucuaggaaagaagagggaaucgccugcugaaacgugggcuucauguagaguguggcaggaccaguuaaaaccuguuguuuaaccucugaacacuuccuagugcagugcuuuucauucugccgcaguuggcagcugcuggcuggauugacccagauguuggguagcugugauggguggggagagcagaaggaacuugaggcuaggcuguaaauaagagcccacaggaugguuacagccucugagcuggggaugaggccaggaggaaaagaguagguuaugaaugugguggaauuacacaguuaaagguccuuuuaguuguuuaggacaggucucgugucacccggacugaccugaauuguauagccaagaguggcauuugacuucuggucuuccucccucugccuucuaccuccugaguccuaggauuauagggaugugccacugugccuggcuaaaggcccuucaaaaaaauauauguauguauguaugcaugcacauauauauauacacacacauauacgcacacauauguauguguauguauacacacauguauauauauguauauauuuauuuauuuuguguguguacauguuuauggauguauguacacauguguguggaugccagaagacaacucgacaacuucgaguggcaguaucucaggcacugccauugauugauugauugagugagugagugagugagugagugauagggucuuucacaggcccuggacuuaccaaguagacuaggcucccuagcuacuucucuugcucugagauaacaagaaugugcaucauuccuggcuucuguauagguagguccucagggacugaucuuagcucuuuacacuugcaaggcaagcacuuaaccaguuaagcuguucaacucaggcuagucuggaacuccagauauccuguagcugaccuugaccucccggaaggccugccucaucugaccccaacgccgugauugugauuauaggagucagccucaacagccuucucuucugagcuugguggucuuuguuuuuccuugccuaguuuuuguucgguugcugugaggcgauaccaagagcaagauaacucacacaaggaagcaguuaauuggggcuugcuuacaguuucagagcgcugguccaugaucauggcgaaaagcaggcaggcauggcccuguagcuguagcggacagguuuacauccugaucuguaggcagcaggccaagaagggagggauggggggcggggggaugggacagaggggaggaggaaggcagugagcagagacagauagacaaagccccucuccagugacacaccuccuucaacaaggccacuccuccuaguccuccacaaacaguucaucauccugagacuaaguacgugaguguaugagcccauggcgguggagggcggguauucgcauccaaaccaccauacuuuauugaagauuugauauugacaguuacaaauggucacagaauggauugacuugaagugcuaaucugcuuagcauuauaugucuuaggggcaugcauaacaguuagaggggaacaauuuuugaaaugaucacacaucugagagaucgagguguugggugaauuuucuaaauuaaguuaccaagaaagguagguauuguaaugaauaguuuaguuuagcaaaggucaauucucacacuggcuugcuaccccgaguggaaaucgugaaaccuggugccccugacuccuaaugaguaaaagacauucagagcgugcagugacugcucauugauugagaucacugguugcuccugcagaggaccuggguuugguucucagaccgauggagcagcuugcaacucccuguaacucacuuccaggguuucugacucucuucaccagguacaaauccauauuuguauggaaaacuacugagaauuaaaacacacacacacacacacacacacacacacacacagaaauguuaugugaauauguuuucauuucaaaucccaggugugggauauagggcugcuucaaauuguccacagcaggugacuaugauuugccucaugcucuagcagggguaugauauugccaacugaggauaguuuauguuuggaauucugggaacucuugagaggguacgacagagccccaagaaaggcggccgcugcuggaaaaacuuaaauaauagaaugaauauaucuaaaacuuauuuuaaaagaaacaucaggggcuggugagauggcucaacagguaagaacauccaacugcucuucugaagguccugaguucaaaucccggcaaccacaugguggcuuacaaccauccguaacgagaucugacucccucuucuggugugucugaagacagcuauaguguacuuacauauaauaaaaaauaaauaaaucuuaaaaaaaaagaaacaucgggcgugguggugcacaccuuuaaucccagcacuugggagacagaggcagguggauuucugaguucgaggccagccuggucuacagagugaguuccaggacagcuggggcuacacagagaaacccugucucgaaaaaaaaccaaaaaaaaaaaaucauuugaacaucauuugaguuuauaugauagcuaauuuugugaaguuuguuagugcugggcacaagccaguuacugacuucguauaaacuccuuuuccauaaggaagcccugaaggcagaggacugguagaaucauuucauaggcuauacuuguagcgcuguuuugaaaucauggcuuggguauuccuuguaauggcugauggguuuaucuggggguccgagaccugugaaggaaugagauggagugacuggugacuaguggguagaaaaggacacuguggacacgaaugacuuccaggcuuccuugcaggugacggucauaauuccuguuguuuugcuuauuuucuuuagcaaggugguuugggaaagggccgcguggcugagcucugagccugaaaacauuugauccaugugaaugccacagccgaggacauuguuaucagacaggaggaccugcucuguacacggcaguaagcuuuuuuccauuuccagacugcucgaugcuugcuccgggugcucaagaaggacaugggacaggggguagaggauggugccuggaaaucaguguccuacggacuucuccaguaguuaauuaauccugggcuugcaaauggugagacccccaggaccagccagcucccugcugucaguuuguauuuccucgccccugccauggagacaucagauuucuucccacuguucuguugcccacugcugcggucugugcugcuuugacuuaugacugcuauuggaaaucucugugagcagugccguucuuguucuccucuuucaugggauggcaguagccagcuaaugccugugguggcggcugcucuucuugugugcuguccuuugacauagccccuuuacaugcuggaaaauuuauuggaacagauuucguaggaagaugcugcugaguaguaaaaaaaaaaagcugcugagcacaguguuugauuuugagauaaggucuguggcccaggauggcuuggaaaucaccauguggucaagggugacuuugaacuacugauucugcuuccaccucccaaguguuggcaauccaggccgccuauaccaccauaucugguguaagagguuuuguuuaugucuauuaauauuuacagcauagagaaauaaaaacugauacauugcaaaacacuuauuaaaacauacuaauuugaaauaaacuuucuauuuauuuauuauugaaggaggguuuuaugugcuccaggcugucuucuaacuccuaacuagccgaggauagccuugaacucagauccuccugacuccaccuuucaaguucugggauaacagaugcaugcuaccaugcuuggauuacaaacuauguuuucuuguggcuagagagauggcucuggacugaagagucuuuguuccucuuguagagaccagaguuuguucccaguacccaaaugggauuaacacacaacagccuguaacacccacagucuccaggugauccaaagcugcuuucuggcuucugugugcgcaugcacacaugcauguauacacccaugcugucacaaaugcauaaauaaaaauaaaagguguuuucauaaagaaauaaacacaaacuguccuuuuucuuuuguuuuguacuuuugagauaggaucucuuuaugaagccuuaggugucuuggaacuugcuauguggaccugaucucucagagaucugccugccucuuccuccugagaccugggauuaaaguugugggcugccauuccuguccuauaaauguuaucucccgagccauaagagcuuuagugagagugagggagacgaagacaggauugcuggaguccuccaugcugagauccugucuugaaaggaagaaaaccgaggcagaguggguagcauuuaaugaagcauuccacaggagucagccguggugcacgucagggggaggaggagggggaaggggaggagggagagggggaggggguggggggagggggagggggagggggagggggagggggguuggguguggagaugauuaauccugcagguuugaguuggaugcuagccuucccugugugggaaccuggggaaggugguaagggaagcagaccaggaagaaaguaagacugaacaccuagugaguaaauaacaaaucagaauuaaaggaagcaggagacaacagggaaaggaaaagcugggcuugguggcaugugacuuuuauucugucacagggauucuccccugucaaaacucaaccuaccuaucuaccuaucuuaagaauuaaaaacucaggcuggagagauggcucagcgguuuagagcacugguugcucuuccagaauaucugaguucaauuccuagcaaccacauuguggcucaugcccauuuauaaaggggucugaugcccccuucuggccagcagguguacaugcagacagcacucauuaaaaauaaauaaauuaaaaaaaaaaaaacuagcuauuuaaucuugggauguagaugcagguaguuaucugacuuggagucagauggcuagcguugagaccauaucucuaaaauaaauaaauaaauaaauaaauaaauaaauaacacaaaaauauacagaaagauuugaaaaaccuaaacagaaacuugagcgaugaaaguuguaguucuugacaaaaguucuucccagagggccagauacuuaaugguauuuaguguagcauuuugguaggcggguuaaaccgguuuguuuggauuauggaauacuguuucacuguuaacacugaggcagagcugcuuguacagguguggcugacacacuacugaugaaucagguuguggaacagugcgugugcguguguguaauaaaaugucuggcgcucagaguguagcccaggggucgagcucagcacacacaggcucagucacagcacugaccaaguaaugaaagguagcaggcucugcaugguuuugaguuguacuuguguguuuagagugggccuugaagguacagcagaauucuuauuauuucucgagagugauuuuucagaggguuuggaagaaacuauuuuguacuuuuguguuuuaaggcauuugucacuuucuguaauuggccauuuaaauaaauuuagagaaagcuguaugugucucugugugacuguuuguugcugguggcagugacugaacccauggccucaugcauguuaggcaacacugccacugagccacagccccacccugugcucuuuuuccuugucggagguggggaugcagucuguagccucgauggaccuuaugaagucagaugcacuauuauccaacaagguccucugauacucacuguguauucuguauucuaagcugaccuuggacuugaaacagucuuuccaccuucagccucuugauuucugggcuuauagaugugaggccccacccuagcucaacucagguuggagcuagcacuuguguuuuagauuuuuaauucauuuuauuuuaauuuuugagacuagauuucauguagcccaaggucagucucaaacucuguagcugaggauguuuuuuuaaaaauuuuuauuuauuuauguauuuauguauuuauuuauguauuuauuuauuuauuuauuauauguaaguacacuguagcuguccucagauacuccagaagagggcaucagauuucguuaaggaugguugugagccaccaugugguuggugggauuugaacucaggaccuucggaagagcagcuggcacucuuaaccacugauccaucucgccagcccgcugaggauguuuuuaaccugacccuccugcgucuggcugcagcuccccacugcugggcucccaggccugugccgccacaggcuuggaacuaccagcucuggauucaaccuguggagucugggguuuacagauauaugcuaguuaggaagguggaucucugaugugcaaggccagccuggucuacagagugaauuucaggauagccagggcuacacagagaaauucugucucuggauggauuggugggguggggaagagaccagcacuguugaggugaaaucagggguguuuccucagagucagcacauagaagcugggcuccagggguucccuagguuguaccucaugcucacaacuggagucaguggugugagagucaccuggguagaacuguuuuuuaagaucugaaggaagggguuguggagaacagcugaagcauggcucuguguagccaggcuggaguccccgaagagagcccaggggaggcugcugugaaagugcagcccaguugcagcagaagacccaggauuuuggagaugccaguucuguggaauaacugccaaggacagcagcagccauggaguagagcccgccugagcuucagagacagcugugugugcugcagaggguggagcuggagaagugacccagguagcuuucguucaggcugagugucacacaauagaaacccuggcuuagacgggcaucgcaguuggcuguggugguaagucagauccuguccuuuugguuucuucccuguuuucagcuucguguugcagcuaagacuuuguguggaaagguuuuaagaugguucaacuagccugcucauuaagacuccccucgaaaauuagccgaggguaguucauugcuuaccgauuuccaacuguguugcuccccugcacuugacagcucagccuagcgcuccaccacagcaagagucuucucguguuuaguuauuuacaugcuuucacacaugcacuuacaaaucuacaggauucugcugcuguucacacgguucacacuuauuuucaucuuugucuuuuccuucuuuuccuuuucuguuuuuugagacauggucucuggcuguccuggaaauagcuauguagaccaggcuggccucaaacuuagaaauccaccugccucugccuuuggagaccugggucuaaaggcgugcccccuucucccccuuccccuccugccagcucuucgauguauagaccaugcuggucuagaauuuacagagaucuacccaaauucuggaauuaaagguauguggcaccauggccaacauuugucguuuauuuuuuuuuaaauuuauuuauuuauauaugagugcuucgucugcauauacaccugcaugacagacgaucccuuuuaugaauggucaugagcuaccaugugugugcugggaauugaacucagguccucuggaagagcagccagugcgcuuaacugcugagccaucucuccagcccccagcguuugucauuuugauuguguucuugcauuuccccacucucugagggagagacuucaauuaggcuccagggugaaggcuucuuucucuauguuuucuuaauuuuacauguguuucuguugugcuucugucuccaugcauacauacauacacacacacacacacacacagucauuaggugggaaucuggaacagagaaucucgagccauauaaauguuucuguaggaugacuguccuugucaucuuauggagacuaaaaaucaagccaaacccaacacaccuguuacuguauacuggaaacacggugaaauaggaaagggugaauccaagaaggaaucuggcuguggacucagaaaaagaaaaguagggugagggccugguacugagaacaugucacacuaagugugcugaauaaaacugauggcgguuggugagguggcugcugauggcgguuggugagguggcuggguggguagggucuugcugcugagucaccuggugaccuuagguuaaucccuguaacugacaaaagaugugcagaacucacuccuguaaguuuuccccgacuccuacacuuguaaacauauauauguacacauacacacauguacacacacacacacacacacacagaugaaauaagguaaaccauaauguaacuuuguagccacugauguaucuauaaauggaccuuuguauacaagagguuaacagcggggaguuuacggcucagcgguuacaugcaccugcugcucuugcagaggaccuggguucaguccccagcauccacacuguggcucucagccaucuguaacuuuagcuuuaggagaucagaugcuccucugggugaguauggacaggaguaugggcagacaguguagaagcacuggggcguggggagggcagugcagggcuacccagcaccugcccacaggaggcucucacagguuuuacagggaaaggaaaagcaacacuggcugaggaauuuuaagggugcagaaugcagcgcuguguggacauccucccaaauguucacacccucaaguacacucaauucccuaugauuauauaugaguuagcuggaaacucacuguguuuuuaauucaguucuugacgcuccaggugauagacugugggucagcggcauuaauaucagcagagagcuugucagcugugugccauuucagguucuaacauacacugaaucagaauauacauggccugcaugugauuucaagauggcuguguaaccuguuugcacauuaaacuaaggugagcugauuucuguaccuuuaaaguucuuagcaaccuagcuauuugauaucuacuuucucugggaauauuugaagacuaugauuugauuuuuauacguacauaucccacaucuaaagauagugcacaucaaauuuuagaugauugcccauugccaucuuaauuuuuauagaggcagagcucccucugguggacaaugggaggaaaagcacacacucuuuccagaagagcaguuucaguuuucagcuguuaaaaugcauuaacugagccuggcaugguggcucacaccuguauucccagcucgugggaugcugagguagaaaaaucgcugaaaguaugugggcaccaccccccaagcaaaagaaaaacaguagcugaccucccaacuuacuaaguggguccaacuuggguagaacaguugguuagcaugcaggauccuuggauucaguccccagcaccauacacacacaagaaaaguccauaauuuaaaacaaaaaaccacaaaagaaccaucaaacccaaaacaaaaaaacaacaccucacucuaaggaagaacaagguagguuuugugguaaaggaggauuauuaacaguggccauguuuucagaauuaaagucacaacaaauguuuaauaguccaucauauuugaagcugguaugaucugggggaauaauuuuucuugccuaucucuuuaccgugauguuuaucgcugugaaaguuucucucuccucuccucuccucucuucuccacuccacuaugugucuuuuaaggauugauuuuagauagugaggccauuagguagcaagugccauucuuuacccauugagccauuuugccauucccugauuuugugggguuuuuuuuuuuuuuuuuuugagauaacauuuuacuauguaggcauuuuaauucuuucauuuauuuauuuaauuuucuuuuaaaauuccauuuaugccaggcaugguggcgcaugccuuuaaucccagcacucgggaggcagaggcaggcggauuucugaguuggaggccagccuagucuacagagugaguuccaggacagccaggauuacacagagaaacccugucuugaaaaaaccaaaauaaauaaguaaauaaaauuccauuuaaucccgagugcugggauuaaagacgugugccaccacacccggcuauuauuuuuaauuguaugaauuaguuuucucuaucugugacaaaucaccaugaccaacaccaugaccaaggcaacuuagagaaggaaggguuuucuugggggucgugguuucagagagacgggagucugucaccaucacaauagggaguguggcaauaggcaaacaguuuuggcucuagagcagcagcugagagcuuucauccugauccacaaacaggaucagagcucacccccauugacacguaucuuccaagaaggccagcuuuguuuuuuuuaaacgauuuuauguguaugaguacgcuguagcugucuuuagacacaccagaagaaggcacaugguugugaagccaccaugugguugcugggaauugaacucaggacugcuggaagagcagucaagccauugagccauuucuccagcccaaggucacacuucuuaaucuuucccaaaaguuccaccaacuggggauggaauauugaagcacaggagucuauagaggcuauucuuauucaaauggucacauuguguguguucuguagcgcuuguggaggucaggagacuacuuacagaaguugguugucuucuaucauguaugugucugguuucaaacucuggcuuaguggcgggauccuuuuccguuuggguccucuuaccagacucacuuuagauuuucuagacagggcccaagcuggccucagcucacucuguagaugaggcuguccucaucuuccugccuccaccuccugagugcuggggcugcagaccugcagcaccacguggcuucauaaagauuuuugagugagugugagaugugcagaaggaucucagguuggugcagauuuguaggaaugcugugauaaggaugauggcccguauuaaagguguauaccaccacgccuggaucugggacuugcuuugucccaggcugauuuuaaauucagcuugccucagucuccugggauuacaggcauguacuaccuuaccugggccuaagcuuuucauggccacugugccucaagaucuccaugucaagaccaggccagaaacuugugucuuccaagccucaagaucuggaucacaggugagcccuccaacucuggauuauaguucauuccaguuauagucaacuugacaaccaggaauagccaucacaguguauaugcaugugugugcaagugcccucggagggcugaagacggcauugaauacccuggaacuggagucauagguugugagccuccuggcaggggugugggaacugaacucaggucuccugccagagccucuagugaucuucacugcuggaccaaucucuccaacccgcuuugucucuuuuguaacuguugacguaucugggcauccguugccuugaacucaccuucuccccucucucugccuuucugcccugaugcuuccuccuccucacugccucuccuuugucccccagguuccagccauggccucugucuccuggccacugacagugacucauuugcuguggauuggagccacuccggcaaugcuuaggcuacuuauuagaucaaaaccuuugaaggugggacccagacauuguaauuuucaguuaauugccuacucaauauuuucuucucuuauucaguuuguaaauaaaagaaugaguuuaacuggacacauucuaaguucacagcguuucacuugggugcuguccacuccccagagugguguaugagcuucuccucugucucuuucucucucccucccucucccuccacucugagcacaucugugacacaguacacacguugaggucaaagacaacaucugagaguguaguucuccuuccucugaucuggagcucgaacccaggaugucaguguuacgccacaagcuccuuuaccugcucagccaucucgcuggccugucuccacccgauuuuauuuacugaguuuggaaaucguuuuacuuauuugucuauuuauuuguuugcuuauguaugugugcauacgacagcauacauguuaaugucugagggaagugugugggaguugguucucuccuuaagcaguguggguucuagggaaucaggcuuucuggaaagugccuguaccugcggagccguuuggccagcucccucuuauuuuagaauccuucugucuccgugugucccgugucagaauuacagcugugugcugcugugauccugcaaaggaauugggguucucauguuagccaagcaaacacuuucugucuaagccuccucaggcgagcaccauauccccauugcgccugcucucuuucuaggcugacuguuucccauucuuugcauucuuacuugggaaugccauacacauccuucauuuuuuuacaacuucccuaaaaggaacucucauccuggcccaagcccucuauccagaccacacaggaacauagcuaaccaaacugggaguacagcuuauggugggagagaauccacaggccacagggaaucugagauggcucagaauacguuagaaggauucauucugggaauugccuuguguuagguggucuuaagaggcuuaaaaaaaaaaggggucugcccuggauuagguguggccaaaaaaugaaaggggugauuucaggaacaagagccacgagcuaguucugaugggacaugcauaucgauuauucuugugcuuuggccagccuucacauuuuuucaguguccagacaugguugcaguaugggcuugccugauagcaguguacuguugaguguucugguucaacugaaggaugcuguagccuccaccuaagggccuggaaggcacacccacucacucacuaccuggugacaucagcccuguuuaugcagguuagcagcagcccuugcuagagcugauucucagcugauuaucuaucuacagagccaccccaugauggcauagucugccaaguacuuccacgucagguguuugccacagugaugaggagggacuaaugacagauaguguuaggccaugcucuuggcucucugcauucgaccuccugagguagacauugucuuauuucucuguguauucccagagagucagucucagucaacaccucaguggccgaaguuugcaguuuccuagagaacucuuugcagcuaaauacuuagacacuuuccugccuucauuuuuuagacuucucucaauuugggguugaugagauggcugaauggauaaaggggcuugcugccaagccuuuugaccugaguucaaucccagggcccacagguggaagaagacaacaagacuccuacaaguuguccucugacuuccacauaaguguugagauaaauaaaaaugaagaauaaccccaacauccuguuuacaggcuccgcuguuuuucuuaagcugaccuaggaguucacagcaagucucauuucuccugucucggcuacaguucuucaacuugaccuuugucacaccggacgaugguaaagucgcucuuuugugucaguagggauauucaggucauaccaacaguuuauaagccuguuuuaaaacccccaggccuaauuugagugauauuauucauguaauuaaugaccuucaaugauuaauuuuuacagucacacaucaaauaaguggauuugauuuuaauuuguaacccaacuuuuaaugaguagaguuuaaugagcaaggugcuugugggagagagauagaguccuugcgaggccagggagccauuuggcugcauugucuaggcaaugugaagugacaggugagugacagcacugauuuucuguccugucgugggucacgccucccggaagugcuucuugucgguagggcauuuucuguucuuuuccuuguucuuucugggaacagauucuucagcugugucccguuuguugauuuuugguucuucauucucauggcgcuguguauuuuauccuucaucgagcauugugugcuuacucauuucaaaggauuccuuuguuucuuuugguuuuucaagacaggauuucucuaguguagcccuggcuguccuggaacucacucuguagaccaggcuggccuugaacucagagaucugccugccucugccuccugagcgcuggaauuaaaggcgugugccaccauuaucuggcaagguuuuacuuguuuuaauuuugugugugugaauguuuggccugugugugcaccguggaagcugggagagggcauccggucacuuggaacuagaguuaaagaaugcugugagcuucuguaugggcgcugggaacggaacccaggucgcaaugccggggaucacagugaauacuacuguaccuagccccagguucuguuuuaacuauuugaaaaaugaaguuauuacauuauauucugucuccuggaagcucuagagacagggacuguggcuuaugccacaauaauauuucucuguucccuuuguauuuaaaacuaaaauacaaucacauaauuucccccuccauugccucccauggcccccuccuugcuccuuuucaaguucauaacuuguuucucuuugucgccuuguacauguauauaaauacacacauacauauaaucaugcauauguauauaaacacacacauauacacaugcauauguauauaaauauacacauacauauacacaugcauauguauauaaauacacacauauauacacaugcuuauguauauaaauacacauacauauauacacaugcacauguauauaaauacacacacauauauacacaugcauauguauauacacgcauauauacacaugcauauguauauacacgcauauauacacaugcauauguauauaaauacaauuugcuuaaccuguuuagaaugacuugaacgugugugauuuaagggccaacuaguugguguuggauaacugguuaggguacucauuuuuuuccccguucucagcguuccuuaugaacuaaaggugagcccugagagaguucccccuuccacauuagcauggcuguugguggcaucuuguucagaucuuguuuaggcagccaugcuguugagguuucauggguacagcuucuuggucauuucuauaucugucacuucuuauauacacuagagcucuuguuaucauucuaggcuacauuuucuccuucuacacauaaauucccucuuuuuuugguuauauaauuuuuuuguugcauuauuauuuuugagacagggucuuucuauauaguucuggcugucuuugaacucucuauauagaccagguuggccuugaacucacaaaacucuaccugccucugccuccugagugcuagggauuaaaggugugcgccaccacuggcuuuuggucucuccuucuguuuauuguuaccuuggagauucucugccuuccauuuagguccaggggcuaguguuguuuccuuacguucauuucuuuccucucccuccucaucuuccuuuucuccgucugggagguugaaugacccuuucacaggggucaccucaggccaucagaaaacacaaauacuuacagauacuuacuguucauggcaguagcaaaguuauaguuauggagucacaaugaaaauauuuguauguuugggggucaccacaccaugagagucgcagcauuaggcguguugagaaccccugagacagauuaaacuaggguggccuagaacuguauagccuaggccaggcaguccccuugccucaggcuugugaacgcugggauuacaagugcaagcucacuuuucuugaggugaaauaacuuuggguggcagugccagggauggaaugcaggacggcauucaggcacgcacucaaccacugagcuauacaccaaccuagaggcuguuuguccaucuauguuucuacauaguaaugacagaugacacuguauuugggacaggacaacuuacaucugaauacuucugcuugccagaugugugaccugggacggaccaguguucaucuucauuuauaaaaugagauauuucuacugugcagugggauugcggugagggucaaaguucaugcugugccagguuguuacauacaugcaacauguucaucccagguuguuacaugcaugcaacaugcuuaucccaggcuguuguagaagugaaggaucaauuaacucaaggauuagaauuaagugcuuuugguuccuuuuugauuggaaaauucuugaguuaccauaguuacuuacaacucagcaucacugacaguggccaugaaucugauauuacccagucuuuugagacacuuuugcuagguaggccagcuugaccugaagucaugaucccuuugccuuaacaaucuaccaucacauucagccuaacaucuauuaguguugaaaaaaaauucuuuuaaaaaagacagggucuuacuagguagcccuggcuggccuggaaugcucucuguagaccagccuggucuugaucucacaugguccacccauguuccacagugacugacucuacauuuuuacaaaauuaauuuuaaaaaguuacauuuacuaauuuaaugcauucaugcaggcauguauucaugacaccacaugcauuuauuuaaaggucagaggacaacuugugggagucauuucucucugaggugggucccagggauuaaacuuaggucguuaaauuuaguggcaagcaccuuuauccacugaggcaucuuacuggcucuuguacuauccauucuugagggcugguucacaaaguccuguguguugaggggcaguacaauucguuucugcuuaaggcuuugguuaugccaucuacuguaugagcgugguaaguuaggagugagccccuuuucucucaguaaaaugggucgacaguaaugaaaacaguuacguuacagaauaauguccagcccugagcacaaagccugagauagcguauguauugguaaguucauucgucucuuuccucuccuuccccccucccaucuuccuucucucuguccauccaccugucugcucauccaucugucuucaagguugaaagaccuuuacacaggagucaccuaagaccaccagcaaacacgcauagugacaaucacagcagggguaaggugcauggaauacugcugugugucuggcuugcugugugucugacuugcugugugucugauauggugccacuggcuuuuugugugugugaccucauuuaaucaucuagaguuuucugaaaauuuuuuuugguauaagucaaauuuuaaucgauuaggaaacugaagacuggagggguuuuguuuuguuuuguuuuguuuuguuuuuucgagacaggguuucucuauagcccuggcuguccuggaacucacucuguagaccaggcuggccucgaacucagaaauccaccugccucugccucccgagugcugggauuaaaggcaugcgccaccacgcccggcuugacuggagggguuuuaauuugccuaaauuaaauagcaaauuguaccugauuucagccccugcuaucuuucuguuuucuguggaaaugucucauaugugaauaguaauucuguuauuuggugacaguacaacauugcuauuaaaacuaacuguuccaggaauugcaaaaaauguacagacaagauuucacuuauaaaucccucccaggugagguguggcuacucauauucagguugaaauuauguuuucuccaacacacuucuucugacugacaucuuuuaaaaguaugaauaaauaaugaugcauuuaaaaaaugugcaucgcugucugaaacuaggaaaauuacuuggguugcgaaaggagcaggucccaagcaaaagagaaaaaagagaaagauaccaauuaccauguuuaccaugccuuguuaugucagcugaguuuuuuuccugugcugugucaucuuaauugcaccguggucuauaagaaagcuuugagagacacauuguaucagagaauauaauuauguaaucaugcauauccccgcccucuuaaaaagaccuucagcuuuuagaggggcaggggagcuuguguuugugcaugggcauucuuguggguacaugugcaugaguguguaugugugcaugagugcauguguguauuuguggguguguuuggcaugacuuguguguuuguguauaugucuguucuuuuuacguggaugcugggacucuaagcccagggcuacaauuguguccaacaaguuccuuacucacaaacacaucuccuagaccccuuagcggucuuuucacugcccccucauuucaucucuuucuuucuuagucagacaagaucucauauaggucaggcuggccuccacuuggcugcauagccgaggcuugccuuaagcuccugauccuuuuggcucuaccuugugagagcugggauuacaggcaagagccacuacaccuggcuucucugccauuucagugugacucauuauguaacgaucuuuaaugcuuugcuugaauuaaugugaauguuucaugagcaaacuagauucuaagcgauugccaacaguucacggaauuaguagagauguacaugucaucagagggaaagccuccuuugaucacauuaaccuugcuaacuuaaagaaaacagauucaucuggguccaaucgaaaauuaguuuuguuuuugugaagaguaaaaucuuugaaaaucugugggacuucaggguacaggcagucacaggguaaguuagaagaaagccaaaauguggguuaucugcuugugguuagaaacucggggccccucagugguuccucgguccaucugauucugugguucgaugcuuucuccucugucccugacuggugaguucuaagaucuuauuucauaucuaucugcucuacugagaguauguggcuuucauuucuugggacucauucuuguuuuccccuguagcgucaaguuauuauguucacaaagcccuggaacagcuugguuucauuuguggugugugugcugugugugugugugcugugugugugcaugcugugugugugugugcugugugugugugcgagcugugugugugugcacuguguguaugugcucuguguguguguguauaggccagagguuaacuucagcuguuaccuaccuaccuaccugccaguuuuugagaaagagucucauguagcccaggcuggccuagaacugacuguguggagaaggcuagucuugaacuccugauccuccuggcucagccucccagguagugagugcugugacuggaaccccagagcugguguugucugucgccacugucaucaaugggcagagcgaggaguugaguaaacuguacuugauucagggagcuggcacuggagaagcuaccuuaccugugcucugcagccagcuggccagaggcagucugccacuggucacucuagagcuccacucguguaaacggcuagguggucagucagccauggucugaggcuuguaauaucugcaucucuugucuucagcccuucaucaucugacugggauaggcacugccuagauucaucugacugggauaggcacugccuggauugccagcggagucagcgucugcuggugucaaacucuaugcaucucggggcaucuggguggggugcauuaacucagaacaaacagaccucauuaauagugaguacgugcucuggcauuaauagcauauacaugcaggcugcucuuuacagcugaacaggaaaauagacuuauauaagauaaaauacuuuuuuuuuuuuggaguuucucuguguagcccuuggcuacccuggaacucauuuuguagaccaggcuggccucgaacucagagauccgccugcuuuugucucauuaaaggcauguaccaccacaccaggcucgagaaaggcccauguguccuucccuuucgcugucacugggauuauggguaugugucuuggugcuaagcuacagcaguuccgugguaccagaaaaugucugcucagugcuuaaaugucucuuaaauaugacacauuauuauuuuuuguuuguuucuucacaucuggugggcccaauuaaggggugauaugcuuauaguugguuaauuuauuaaaggcuuuuuuuguuaaggugaaauuuauauacagaauuagccacgaggaagugaucaaucuaguguacgcacaguggaguguggcuaccacugcuuggcguuguguuucuacucuguggauucccucugucuucuguuacugacaacaucucccuuuucauccuuggcuuuccccagauugguaugucucagauugcauuuccacaccaucauuuccuaugucccuuucuccuuuugaaucacuggggaggucuaggcaccgucaguuuggagcucagucuuauauggagacauguccuuggauggugugugucauguuagggaguauauaaugcauccuuguguuuuaaggacacucuggggggccauuggauaguccucugugacuauuccagagagagcuuugucugcugucuucguuauaguacagacacgugguugucuugguuacccagcugggaaaucaucauuuugggaagaucgaaccacugucuugcacuccugaucacacauaaacccugccuagccacugcuaccugggggagcuuuaggacugugcccugggaguccucugcccacggguccuuaccaucuuucccucaagccuccccacuugccugucagccugaccucucagaucuaccucucagacuuaagggaaucaucacccuucuuuccacccucacauccuacuccucaucacaggaguuguuaccaugguaacugcaaauaacugccuacucuugaucuauauccuccauuuucuuaggucgccuccauauuaacuuacugcucuuuaauuuuuuuuuuuuuuugguacugaaauagcguaaaguuucgcuguuuuacucauuuuaagugugcagcucagcaacauuaaucgcauccaguguucugucuuccucugcauucugguuucaaaccuuucauugccuugaacagaagauuuuuuuuucuuuuuuacuaaauuuuuaaauuuguuuuguauuuguuuguuuguuugguuuuugguuuuucgagacagggguuucucuguguagcccuggcuguccuggaacucacucuguagaccaggcuggccucgaacucagagauccaccugccucugccucccaaguguugggauuaaaggcgugcaccagcacugcccggcuuuuuaauuuguuuuuuauugggaauucaugcacuauauucugaccuauaacugauagacaacaacuccuacuccuucaccccagcuccugauagugucuacucugcuuuuugugucuaugaauuuggcuuucuccgcuguuuuaugcacguggaacugcauguuuguucuguggcuuuuaugcauuccaauguguggcuuuugugacuguuauugucaugaacgguuacauauaagcuuuguuguggacauccuuugauuuuuuuuuccuggguguuugucuaggacuggaacguugggaucauauagacauccagacaucccaaaguggcuuugccaguucacguuugcuuuugugugucuuuugguuguagcuacccugcugugugugauaacagccugucuccuguggcuuugguuucugugucccucgcgguugaugcuucucuauucuugaacugccggguucuccugugugugaugcgccacuauuuugguguccucuaacuucacaggcuacuucucucuuacuugcugugccucuccugccucccuggugaguggagaguauacaacuuugggauuuguuguuucucugagcucuuaggauaucuccauugaugcauuguauuaaaguaacuuuguagcagaggaaguccaucugggaccucuguuucccuugccuucucauuguuacauacagacucccccaagaggaucaugagauaacugcuauauuauaaccgguggcucagaaacugaugccuauaguguucuguguguugguucgagcuggggauaagaguggacaugguggaagccaaguggauguuugaagcuuuuuauuuuaauuaauuaauuaauuaauuuuuaaaucuguaagaaccucacuguauagaaagcuguuucucaucugacaguaguagaguuaguuuggguccuaaauaucacccagggcccacauguuagaaacuugguccucaggauggugccccugggagaugguagaaccuguagagaguguggguauaaugggaagucuuuaggucacugaggcucagccuccaaagggacuucuuuugcuucuuggcuuaugaaguaagugauuuguucugccauuugcuccugccacgaaaggcuaaugugucagcaggcucauaggaguuggugugcuugaccuaggacuggaaccucuacaacugugagccaagauaacaucuuuucucuuugcagaguaauuuggggaaagacguuacucugaaggccacgaauacagagaagagcuaugacucaccagcugccuuccuguccugcagugugugaaugugcugcuuguuaacuugggggacguuuuucauaaagucgggagccucugauuaucaugacugcauauggugcuuggguucauagaaagaagugagugagauugugaguguguguaucugcucaauguuuuuaugccaguuugacaaaggcucgagucaucugagaggaggucacccccauugagaaaaugucuccauaagaucuggcugcagagaagccuguaggguguuuuuauuuuaaaaaauuuuuaaaauaacuuuuuuguuuguuuguuuuuucgagacaggguuucucuguauaguccuggcuguccuggaacucacuuuguagaccaggcuggccucgaacucagaaacccaccugucucugccucccaagugcuaggauuaaaggcgugugccaccaccgcccggcugaacuuuuuuuuuuuuuuaauuaguaauuuugccaggaggacccagccguuugugggcggugucaucccugggcugguggugcuggguucuauaagaaagugggcugagcaggccaugaugaaugaguuggcgagcagaguucuuauuuagccucaguauuggcuucugccuccagguuccugcccugcuugaguggcugugcugacuuccuuugaugaaggguuaaauggagcugugagugaaauagaagcccuucccuccccagaguguucuuggucauuguguuuuaucaccgcaguaguaauguuaaccaagaccaaggagcggucugagaacuuugugacuugugcagugcugggcaauuggcuuuuggucuauaucccauucuaaaacaaauuuagcugggaggugauggugcaugguuuuaaucccagcauucaggaggcagaggcagaggaucucugugaguuugaggccagccuggucuacagagugaccucuaggacagccagggcuaugcagagaaacccugucuugaaugccccccaguccuucccacacuuaaaaauuaugggaaucacugucaaacuacagucggguauuuuggaacuauggaaucaucaaagcaucaugaccaguuuugugucucaagacugggucagauguccuccacuuccuguagcugacuugugcuucgcuaaugagcucuuacagucugucagccauugauaccucugcaguuguuaaucuaguugauuuaaggaacucgcuucauucguauuuauagaacuucuuucgguuuggaucuaacagucuauuuauagauuggagacacaggguuuuaaucuuccucaggggagcccugaugggcucaggaugaaaucugagcagaacaauaaacagcaccagaguauaauugcugugcuccaguaagcuuuaauaacucauaaaauauuuaucugugcuuuauaucacguuaacuuuuagauauuuucauugcaaaguauauuuuuuuguuaguuugcuaauuauaguugaaauuaaaggcucauugugaaugcauucucuucuuuaauucugcuuuauaauugguuaaaucauuuuuuuuaaaagaaacuuuauuuggguauaaucucaaaauuacaggaaaguugagaagaaacagagauguuucuuauguccuuuauccaaauuuagcaaaaguuagcauuccccaugugggcuuugucauguuuaguugcucucuauuuauacacacauacauuuauuuuuugaaccauuuuaaggcuagucugcauauguaauuuuuuuuuuuuuuuacuuaaauaguucauguaugcuuguuucccucuccucuuucuccuuccuuuuuuuuuuuuuuuuuaaauaaggauauuacauuguccggguuggccuugaauugccuguguaggagagguugcccuugaacuuccuauguagaaguuaccauugaacuugcuauguaggagaggcuggccuugaacuugagggugaccuugaacuguuucuguuuuuaccuccuaaguacuggaauuaacagucuugaacaacagugcucagcucguucucuuugucuuucugucucuuuccuuguggauacauugaggggugugugugugugugugugugugugugugugugugugugugugugugagagagagagagcacgugcacacugcgcacacacauacauacauauaucuacacauguauguaugcagaagucaaccuugaauguuuccccuugaucacugucuuccuuguuuuacaugagguaggaucucucacugggaccuguuggccaccagucagguggggccagugagcgccagcgagccuccugaguccauguccucagcacuacaaauguguggcaccgccucugacuuuucacguuugcaugguccacacuuuacccacugagcauuuuuccagccccucggcuuguauuuucucagaacaaggauguuuuguuuuuccuccguguccugcuaauauuucucucuuccucgcuggcaucuugccuugccugguacuugccuuuuaguuaggcuggccuuacagcaauccuccugccccagcuuccugagugcuggaaguauguaaguuuguaccauccgauuuuggguggauuauuuuuguggaguagcagcaacggauucaaucccagggccucaugcacacuaggcaggcauuguccuacugagcaaacccccagccucacacaguaggcuuuaucuagucucuguuucuuuucuucccaucuaaaucuauucugacggcacacauugcauaaacuugucguaucccuacuuuguuauuguggaauuguucuuuaauugugaccauuuuuuuuuccaggcuacauuuuguaauuaaaauaacuuauuugcacaauauauagugaccaaccaaaugagguagucaacauuuuccuccuaaacaccucauuuguuuguguuuguggcuuugaacucauuccaguucuucacugaauacauuacacugcucugaaacaggcuuccugcugugcuguagagcaguaccuuucuccuguaucugacugcauuuuggugucugguacuuguccugucuuuguuccucugcccauacccuugcucgagaccagugaccucugcucuuuacuucugugaggucauuauauaaguuuuucgugugaguaagaagaugcuaucuuguuucugugccuggcucauuucuuccaguuccaaccacguugccccaaaugacaggauucuauuauuuuucuggggcugaggacugcuucauugucuguauguccuguguauucuuuguuagguuuuuggcuccaugccuuguaauugugugggaacccugcagcuccucagauaggguucagggucugggagugguaggcuuuuacagcagcacauauuucagugggaaugucuggggccuccugcuuuccuucuuugcagagggaaguacuuccugguucaagguugcucuccagagcuggggcuguaagugcugugugcuuaguuacauucuuucuacagcuacuguguuucuuucucuguguguuucaguaccuuuccuaacccacucugucagcuccuacucaaaaacucaguaaaguagcuguugguuuucuuuggucuuuuguuguauaagacguucaucagguacuucuaggaagccauuuugcugaaaucccuucugucugaaguuuucacaguggauugcagauucucuuugugggguggggcgggaugguguggauucagugcuagggacugaacucagggccucaugcaugcucccuaccacugaaccacucccccaggccuuacaacacaucugcauuuugagacauucuccauuaauuauuuuuuccuacccagggccucagaugauuuuuuaagaaugucauagcguccaccaucacauggagaccgagggcguuucaguuacagaauaacacguuuggauuagcuuccuuugaaaaugggcgugggggaggggaaggugggggagcucgagagaugcucuuccagagauccugaugauaucaauucccagcaaccacauggugguucacagcugucuguaaugggaucugaugcccucuucuggugugucugacagcuacaguguacucauauauauacaauaaacaaaucuuaaaaaaaagaaaagaaaagaaaagaaaaugagaucggauucuuagcccgugacacuugggaaacguaagaugaucucaagagccugcauguguucucgaauucuucagaaucuuuucuucucauacaucuucucauacaguuuggagcauggaugccuccgcccucgugccuguauucuuuccagauacauacagaacuccaggucaccauggcguuuagucaauagccugauaaugacugggguuuaaccugguuaauauucacuaagguaugguagaaacuuauuaaaguuauacuuauuaauuagaaauuuacaguaauugugaugugcuggcuugaaguuuucuuuguacuguugaaggcgaauagaaagggauuugcuuagcuaauuaagacuauaaacaagaagggagguuuaauccaauaacuauuuucaaacacuuguaaaaucagcacaaacuagggauaugccaauuaauauuuuuaaaauuaauuaaagcaguaauguacucucuaagguuuucuuucuugguauuuguugaaguugauaggaaauuggaccuaaggauauuuuucaaguuaucuugucuaaauuauauuaauauaucuguauauaugcuauauuacuaucuuguaaaagcauaagaaaucaaaacuaaaauuguaaggaagcacaaucuugguugugauauaggaaccaaauaugauaauuugcauuauuuuauauuuuaaauauuaaaaaagguauuucuugauacccaaccagucaguuuuacaacuugauuaagacucacucuggaaaagaauacuggauucugugauaaccuuuaaccccacauuaguugacuaauuuuuuguuuucuuucucucuuucucucucuuugugcauacuuacgugcauguauguggauaucagaggacaacuucugugagguaguuccucugacuguguggguuucuggggcugaacucuagcugugucucaguuuagguuuccauuguuuugaugaaacaccaugacagaacgcaagcuggggacgaaaggguuaauuuuucauuucagucacaugcuccaucacuguccaucacuaagguaacucaggcaggagcuggggcagaggcucaggaccgcugcugacaugcugaccggcuuguuccuuauggcuugcuugacuuucuuauaccauccaggagugcccacccagcagugaugccaaccccugugggaccgacaauccccaaucaaucaucagcuaagaaaaugcaccaagggcugcccacagaccagugcagucgucuccucuccucucuuccccuccccuccccucccccaacucucucuuuacacuguagcugucuucagacaccagaagagggcaucggauaccauuacagaugguugugagccaccaugugguuacugggaauugaacucaggaccucuggaagagcagucagugcuccuaaccacugagccaucucuccagcuccggugggucauuuucucaguugagguucccucuuccaaaaugacucuagccggugucaagcugauguagaaaugagccaucacaguguaccaggcuuggugcaaguguuaggccaucuucccggccucuugauaaucuccucauugucauuuuguuugccugguaucuacugagcguuucuuuacccaaaccagaaaaaugaguagcugagcagaaaguaugguucccauucuugguagagaggugacaaaaucaugcauguuuuuaacugucauaacucaagguuaggcaaaguaccguggggcuguuuaugccagugucauccguauaguaggagggccugcaaggcagguuuuggaaagaguaaguguccaucugggaugugacauuuggcuaguuucuacaggguguaucaugucugcauagugcagaacaguggguuggacaucuccaaugcuaaaccacuuugaguuuaagaaaagugcugugaccuuggaugagaauagagugugcuccucacucugugagcaagagccaggcugggaaaggccaaacaagcccugcagagaauucagacugugucaucuaagcaagggaggagggggguguuuuuuuuuuuuuuuuucuucuuccauuuguuugcuuucuuaaaaagauaacgguggccagugguagccagaggugucaagaggugggcaguauggguaugaauuguguuguuuaaaaagcucaugcaaggggcugaagaaguagcuuagggguaaaguguuaccuggccugcaugaggcucuggguaugaucccagcacugcacaacacugggcauauggcgccaaccuguagucccgugacuuggaggugagggcaucugaggcuacauagccaguucaaagccagccuaggcugcaugaugcccugucucaaaaacaaacaaauagacagacagacaggcacuauguaggaaaugaugaaguagggcuuagcgguuaggaacacugacugcucuuccaaaaguccugaguucaauucccagcgaccacaugguggcucacaaccaucuguaguggggucugaugcccucuucuggugugucugauaucugugugauccagcauagggccaggcugacaugagcuugguguauucugagcccugagaugggcaaggucagugcugggcacccuuucuccaugccugaggaagcccugauaccagucugccugguuagucucugagccugccucccagguucuaguguuauaaauaagauccugcuacaaaacucugcccccucugucucugucucugucucugucucugucucugucuuucucucuguuucuaucucucucucucucugccucugucuuucugucugucucucugucugacugucucugucccuuucugucucugucucucuggcuuuuggcuaacacauagcuucuagcauagcccagauguggguucuuugaauacaaaagccaacaaaaaacaaguccuauggggaggauaucauucauagcaaauggugacggauuuuuguuuuguuuuucaagauaggguuucucuguguagcccuggcuguccuggaauucacucuguagaccaagcugaccucgaacucagaaaucugccugccucugccucccaaguacugggauuaaaggcgugcgccaccccugccugguggugacagauauuuuaauggaagcauuuaauauuuaauuuaauuauuaauuaauuauuaauauuuaauaauuauggcagaagcugggaaggacuaccuccagcuguugugaucagguagagcaguguuuugccuuccagugggagcggcugagggguauucagcccaggcuccuaggagaugacuggacugaugcucagccuugacugcccuuuacggaagucaaacagcuggcucgguccuaauacggucuuauuuaucugaauuagggaacuaauuugguagguuuuaaaagugauggagaugacacuaaaccagccaagcuggcaaauagcugggacccaggagaggcauucuucuggagaacguggacacuaaagagcaggugauaauggaagcuguugaugcaggucaggguggggacaagugcagggaaaagacgaggcaggaaaccuccgggcaaaccagcccugugacggaagcagaggaaguaauucccuuaguaacugugcccuguguuaauucaggucauuaguguagauguugguuagaucuuaugauuuagugugggcuagauauggauguaccuuaaaugacugguucauacacacacacacacacacacacacacaugcauauauaugaguauuuauuuauuugagauugauggugauuaugcuaagcauuuuaucauugauguagugagguaccgucuuuaacuuuuaaccaccagcaaguacccaugucugcuuccaaguuuacuuagaagacaagugcauggaaguaacauuuuucaagaaccaauuuuauuuucugaauucaaagucaccugucacuuuugccauaaauucuuugaggcaugaaauagccugccaguugucuauugcucucaaaguuaaugaaugguuaucaauuuaucacggguaauaaccuaacugcagauuguaaagagagcauucuaucacuuccaagccugggugccucaaggcaguaucugccuuucuguacugucugccuuucaguagcauaguugagagcugcugugucccgaaggcccuuagcccagagcuuggguaucacccuuaacauuugguaauagcacagcgaaauaguagcuaguuguagcucgcuuuguguaacagacuaaguggaguagauuuccaugugacauuguaaaugaaauuucuugaugaaggcuguagcauuuuaaaucuuauuaauguuacuuuaagcaguuuagauacccuucucaauaauucauaguucaagugugacugcuuucuggcccacuagccugaguguaaacacaggacuguuucaggggacccuaguuuucaaggcauaucuuuuccaccuuagacagagaaugugacauuaacaugaauauuugcuuuauaagaucagggacuuggacuugaccuuaucuuuauugcaaacaaaccagaccaaguguuuuuuuaaucuugcaguucaggcacugaggacagaauaauaacucaguacuuguggauuagugugaaccauuauuccacuuucccagguauaacugcuguagagcugguuauauuacagacaggaggauuuaacgucuuaaagauuuuucuucccuaaucacagcaguagagcaauaauggcugggcaguuaaauguguucuugguuccaucacaacuagaucagccuacaaauggaguauuuuuaucuguuuccuuugauuuauucaacaagccauuggcacaguggcccuuauuauacuuauuguuuuaauuauuauucaauauauuuuaguaaagaaaaguaugcaaguugaggccaugccuuguugccaauugauaaccucuacuaguuauugcuguagcuaaggugcauuugccugugugcauuuaaaagccuccaaaauuuuguucugauugauucuuagcauauucuaaaauauauaugaggccuuacagaguauccccauuuuuaguuugugaagagcucuaggcaggccugagcauggcaaacauggcuguggcaggccuuguccuucccccauucccucugccuagcucaagcccguuagauuacauuccuaaagcuacauuccaaggucuguucccuuauuuggccauuuccuccagagacugaccaccaagguccaacaaucaaaagcccccuuuugacuacccuaacuaacaagccccaaauccccucccacccccgcuuugacuaauuaaagcccaguaaaaauuaaacaccucauccuagcacaggguuugauuggucaaaccgagaugcuggaagcauccuucccgcuacucacuguacuguaguuucucaaggaagugcugcugucuccuaaaaaugucuccaagacagaauuuccaguuucccuugcuaauuggcuuuauaguuguguucucuaccuggugcgugugcagggugcagagcuugcuuucuccuuuugauucuguccaggauuucagcccauggaauggugucagcacaguuaggguggacaggcccagaucaguucagggcaaucuaggcaaucucugacgggcgugccggagguguggcuccugcgcaauuggauuagauuuauucauuuuacuuuuugcccgcaaguuuuauguguuuacuguguucaugcuucgugcucccaggggucagaagagggcaucagaugcccuggaacuggaguuauagaugacugugaaccauuauguuggugcugggacuugaacugagguccucuguaagaguaacaaguguucuuaaccucuaagcuaucucuccaccccuccuagguaauucuccuuccucuuaaguucauguuauuaaccaucacauagacuaagccaggacaguuguacaucucuauucauagaggaacuacagauuaagaaaauaguuaauuuuaguuuuaguaauuauugaaacuaguguuuuauauacguauucuaaauuuuauuauuuggacauagaaauaauacugccuuuaaaaaauaaauacaugaguuuuugaucuaauaguacuuuaaauuuuuuucccuucuguguuuuguagacagucacaccacugguaggcacacuuuuuuuuuuuuuuuugccucgugucugacagaguuuugugucgacagugagagucaucaucucuacaacucgccagcugugugacucugggcaagucauuuauggucucugugucugaaugucccugucuaguaaacgggacagaaaugugguucucauaggacuguggugaaugucguaugaggguucucuagagaaagaaugaauuaaugaauccuucucucuguauaaaggggguuuaucgggaugccucacaggcugcaguccagcuaauccaacaaugucaggcugugaacagaaaguccaagaauccaggaguugucaguccaugaggcuagaugucucugcuaguagacacaucccuaagagauaggcucuaaucuaaugccagugaaggaauggacuuggcuagcaagagaagagcaagcgggcacagagcaaaagcuuccuucuucuaaguccuuauguaggcuuccagcagaagguguggcccggauuauaggugugucuucccaccuuaagauacagauaaaaggugagugccuuuccaccaaaaguccugacuagaaguggauccacacacuucuaaccaagcaaaaaaucuguuguaggugugcccucugcuucuggauuguaguucauuccagaugugagauuggcagccaggaguggcagucacagauucucuauacaugaaaugaucugauguuugugaaacggggaagacagcgugugauacccaguaagcaccaucaaacugcuugaugacuaggaaguaccccuuucuccaggcuggccuuaaacaccuaauuuagccugauaaaugcuggcuuucaggcuuaugccaccacaucuagcaagcauccugcuuuggauguacucauuaaaugcagauuuuacacagaggacucuuaggucagagugaagcauuguguguguguguauacauguguguguguauacauguguguguguguguguguaaucucuuuuaaagucgauuuuguguuuuggacuaguuuuggguauagagauacaaagagguaacauauguacugugcuucucaaacacacagcuguccucacgucuacaucccagccuuaaguacaguuaucacaacuccugacucaugugacacaucaccuaacagcuaaaguuuguauuaagauucacuuaguguugcauauucucugaguuuggaccagugggugugacaugucuccaguuccaucuauccccuccucucucucucagucaguccuggccaccgaugcucuucuuccugccucuguggccuugacuucucccgaaugucacggggauuuggaucauacuguguauaacccuuccaaguuuacuucuuucgcuuugcaacaugcauugaaaguugauccuugcuucuguggcuuaauagcucauuuccuuuaaauacugagcaauccauugucugaauaaaauucuauugccuuugaaugacuaaaugucuucccugggucuugucagugagcuaauaaauagucucugaaagccaacaaaguccucugccaaucuccuuggcucuaggcacacagaagugaucaaagcagaaaggaauguucccuugugggaucuccugcauguuuguggcuuaauuauguuugcuuucugucccaucagcccaauugggagucuugucuucuuuuugggacuuuucaagugugguaauagccuggcauuuccacuagguggcaguagggucauauauaaugaacagugcaaggcacugaaaccacuaguuuguucauuaacagaguucuuuuuauaaugaguuaaauuuaaaugcuugcaauaacucuccagauauaaucauuacuuaaaauaguacuuucauuuuuuaaaguuaacauauagaauaauagauuucauuaugacauuuucauucugaugucccccacccccacuccccacacuaggguuucucuauguaguccuggcugucuuggaacucacucuguagaccaggcuguccuugaacucagagaucugccugccucugcuucucaagcacugggguuaaagaugugugccucuacucucacaauccuaaugagugcuuuucagaauaaacuccaauacauauaauuucuuaaauucuuuaaaucucuuaagcuacuuguuguauguguaggaguguuuugccugcaugcgugccugugcaccguuagguacuuugucccuagcggggccagaagagaauguccgauccacugacugggauugaggucacagacaguugugagccaccuuguggcuguuggcagagcaacccgugcucuuaacuacugagccaccucuccagccccaggcccucaaauucuugaguuugucuuccuuugaucagugagguguuuacugugauccucacacaggcuaggcaaggucuaguuuugagaguucaaaaguugaauacuuguuccuugauguccuugagaugucacgauuugacaagggagaccagcuggauuaagggauguguuacagugaguguaugucccaaguguccucguucgaugacuuugacagaugcacaccuauguaaccucaauuccuguugaauuacagaugacuaaugucuuggggguaaucagagggacaguugagcgaugguggccuaacaggcauuucugagagaacgaccuggugacuuugguuauuuuuuaccgguucagcuucaguccuuuugaguccugcacgugcuuugguucuucucugccauuuguccaaacaacacacgugcguuagaaaagacgugcggugacuuucaaagaaagcccgggcguuauauuucugaugauacaacaagcaaaucgagaagacucucaauccaacagcagcgggcuguggauucacaggauuaaaugggccagcgaaagcagcaggcuucacugaacaccguccgugccaggcacagccugaguguugaucacaguuaccguagcccuaagcacuggucauuucugguuuuucucuuguugagaauggcagcaaggaaacugaugugcagaagaucacagagcucauguaaccggucguagcuggaggcggcaggucuugacagccugauuccacagcaagguuuccaaucuugccuccagaagaagggauuuuaaauuacaguagggaaaaaaaaaucacaaaaauaaaauggagauuuuguuuuuauccuuguuugggggaaggaaaacgaagaacacacggguaacaacaagugguugcuuauucagggcccgcuguauguggcaagguggucagcuacccuugcguuggcaguugggaacguuuagaguggagccaagggaagccaccaguaugcccugacuggaggcaguuugugugggaaagauguacaugagccaggaaaaguaugguaucuuagcacccagagguacaggcucuaggauugugaguucgagaccagucuagguugcacagcaagacugugucuuaaacuaaaccaggccuaaaccaaaaaacucaaccaacuuagacagacagaaaauaaaaaccuauagcauccucugguuguuucugaaugaaaucaggagaaaagucaagaggccugucaguuacugguggaguucuuacugcuuuaggcugauugugguuugacucucgccccguuguuggagaaagcagucugaauuguccuccuggaccucuuacuuggcaggugauuggcugccuuggcuugcuucagcuguggcucagagucaguuugugugucuauacauucuguuuguaucuccuaacaguuagguugggaguaggcacgccuugguaaagggacugccgucuaaggguauuauuucccuaggcuaacacuuugguguuuggaaagggaagagcaggggaugggugaacacccuguggacaucuguuacauuuuccccucggaauguuggcucuccagugugguuucuacaccagcagcguugacaccaaccuguuagcaaugcacagugucaggccucaccucacacccacugaagcagaacuggacaugugagcccagugcuucaguuuucacaaggucggagggcaucucugcacugcagcggagacccacuugcugcauaggaaggagcccuaauagcaacaacucaaguucgacugcguccucauuucauaguaaagaauauugacaacuagccuuggacuugcacagggugauagacacaggauuagauucuaggcucgucuuacuaaaagaccaugaauuguacuucaauaaaauccaaccaaacaauuugagaacaagaaggaugggcauaugugugugacuucucgacagcaggaaacucgagaggcaguugccagucaugagaugugaacuuagauuagauccaggcugaagccaggaaacuaaagcagugcuuuucuuuaaucagugggaugaguuuguguguagacugcucacuagauaauauuauacacugcggucacaugacagauuaugcuucucuuaggaacgacauguugaaguuuuuagggauggguaagauuucuuaaguucucaauuggcugaacaaaggaacacgcgugaguaugugugagagacagaacagacguggcaaauugcuaacacauguuuaagcuggggggugugugguagugguuauuuuguccccuccacccccacacaacccuuuuccuuggucaagugggaggaaacccguccuuuuagaaagcugggcugagagcaguggagcucgauaguccaagugaugaguuuauggcaauuaaucccccggaguacacgaggcugccuugcgcuucgaagguguugaaugagggauugacugagccuggagaagaccuguccccgugauuuauggugcguuuguguucuuuagcuccccucccugccuacuucuccagacuuuaaaguugagaaagaaauauuggaaggacaaucauccccuguauugagauaaucaaucuuacacgacaggugagaaugcuggaauguggccucugagccucgcugacuccaugccuuugucuccggcucuuucccccucauucuuucuccucuccuuuucucucuaucccucauauucaugagggaaacuucuagaaguuaauauuucuuccccccccgcuuaucaaguauuuuuagaauuuuaucuuguuacaaacuugaaauuuuccucacaauguuguagcucagaauuaccuucuguuuuuuuuuuuuuuuuuuuuugccuuuaagaaaucaauuaauuguauugaagguauugauuuuuaccaguauaccugucucaccuugcauuuuguuccacaauauuaagaaaguuaaugggauuaacauauucuuuuuuugucccaagaauuauuuauuuuauguauaugaguacacuguagcugucuucagacacaccagaagagggcaucggaucccauuacagaugguugugggccaccauugaauugaauugaauucaggaccucuggaagagcagucagugcucuuaacggcugagccaucucuccagcccagaucaacacauucuaauugacuuauuuaauaaucugcccaguuucuccaagaaguggacaauuuugcagccugccccaugugcugacuagugucaugucagcgucauacaagcuagagucacuuggaaaagggaaccucuguugagaaugugcaccuaauagauuggauugugggcaagccagugaguguauaggcauauguucuuaacagcuuacuuuaauaaggguucagcuuccccucuagcccacugcccaccauuagugggaaagaaaaguuauuaagacuuggaggaaguagaccacuuuagaaauaauucuuugggguugaguccagucuugguugucaggacaucagcaguugaguucaguagugucaggauagcaaacacagaucagcagcugcaguccauucagcaaucaccacccacaaaucagcaauggcaguucaaugcagaaaccacaagacucugguaauucgcccgaguccucggaaguggcaagaggcuacaggaaccucacgagaaguuccuuggugaguuuaccucugugacaucaccacaagcgaagcucagcagcgcaauguaaggcgaaccaauacauguguguugucagcgaagaagaaggagauggagccaggcgaaccaguguuugaguucccacugucuguggggucauauauaaauauaaauuccuucuugugucugcuuuaacaaaacacccuuuuaccugugugccccagcaagacaucguuugaccuaacugacuuuccaaagaaaccagaaguuuccugggucuauaagaaagcaagcugaauaaaucuaugaggagaaagucaggaagcagcaccccucucuccauggccucuccuccuguugcuuucucuagguuccuacccugaguuucugcccccuuacuccagggauggacuuagaagcugcaacccccugcucaccaaguuacuuuuggucuugguguuuaucacagcaauagaaacucuaaggcaucuuaacaguuaagccuaccuucuaaaggaaaacugaacaacgcuacauuauauaccaucuuaguuaaauuggacuguuguggcugcugccuggaaagauguaagucgguuaggauggagacuuggucuguucucacaagaagcuugcugaagagcagguauggucccucccucccucuugcuguggcuuccuugcuugcccuguguccucuucuuugacacauguuccugcccucugccuguuguuaggcccucagcagaggcugaacaagcagggccaccagaucuuucaacuuccaaaacugaggcugaacaaaaccucuuugcuuuguaaaguuacucaguuuucgaguuagcugucaaucagguuuugugauuuuagucaugauaaacagaccaguucaguugguagaagauuuuacugaagacuauaauaccuuuuuccugcaacaacuguuaccuagcaaaaucccuuagggaggugggaguccucauggccuaccucaucuaugugaaauguuugucaggcccagucauaugcagaucuuguguguauaaccauaccucccgugagcucacgagugcaacugcugugucgugucuaggagacaucuuugccccacaucgcaccauccucuggcucucacauucuugucuggcuccucuuccgagauguucucugagcuuuggcgaugauggagucugucaugguuugaauaugcuuggcccagggaauggcacuauuaggagguguggccuuguuggaguaggugugucacuguggacaugggcuuuaagacccucauccuagcugccuggaagucagucuucugcuaguagccuucagauggagauguagaacucucagcuccuccugcaucaugccugccgggaugcugccauaccuugcaaggugggaaccuugaugauaauggacugaaccucugaaccuguaagccagcccccauuaaauguccuuucuaagacuugccuuggucauggugucuguucacagcaguaaaaccuuaucuaagacauaguugucauaugacaacuggaguaccaagcuucucuauugaaggcugggugcagugcucaauccagauggugaaugggcccugggaccagcucuucuguugucuuuaugagcccagucauuuuauuuauguaaauagagucacaauuuuuguauuuagcgacuggcaucuuucacuuagccuguuuccaauuucaucuguuauggccuguaucaguucuuccccucucuuccucccaccucccuucuuucuuuccuucuuuguccccccccccuuccuuuucuuccuuuuugcuuuuugaaacaggguuucuguguguagcccuggcuguccuagaacucacuauauagaccaggcuggccucgaauucagagauccacuuaucucugcuucccaaaugcugagauuaaaggcaggugccuggggaauauauacuuucuuuucuuucuuucuuucuuucuuucuuucuuuuuuuuaagauuuauuuauguauaugagaacacuguugcucucuucagacacaccagcagagggcaacagaucccauuacagaguuaccaugugguugcugggaauugaacucaggaccucuggaagagcagucagugcucuuaaccacugagccaucucuucagcccauuuauuuucauuuuauguucauugguguuuugccugcauacaugucuaugugagaguguuagaagcccuggaacucgaguuacagacaauugugagcugccaugugggugcugggaauugaacccaaauccucuggaagagcugcaagagcucuuaaccacucacugagccaucucugcagccccucuuuccuuuuuaagacaguaauaauucaguuauguauaauauuuuguucauccauuugguaguugacauuuucauuauucugauucuuugauuauucugaauaauguguguagcagggcuuguugagauagaguaacacacacacacacacacacacacacacacacacaccacagucucuuccucucucaaaaaaugcagcuaugaauuugaguguguaaauauguugucgggacuucgaugucaacucucuuggguagauuagcgcccccuacuaaugcuuucgcuuucuguggcuucaguuauccauggucaguaguuauccaaagacauuaaauggaagguucuaggaauacaaaauucaggaguuuuaaaacugcgugcuauccugagugauguaaugacgucugagcugucuugcuguugccagggaugugccccaugucuuguccagcugucagagcugugcauucugucuccucacuaggguccgucuagcucaucugcccaacugucucaaucccacggugcucuguucaugaaaccuugacuuuuuuauuuaauuuaauuuuuuuuuuuuauuuuaugugaguacacuuuugcugucuucagacacacgagaagagaagagggcauccaaccccauuacagaugguugugagcuaccauaugguugcugggaauugaauucaggaccucaggaagaacaacagcaagagcucuuaaucgcugagccaccucuccagccagaaaccuuggcucuugauaaggccucugaaauauaagaguaguaauguuggcaguucaccugugccaagagaaacuguaaaguguguuacuauaaucauauacuagauaagagaguggcuuacgguacuacagaaaaaucuuuagagaccacauuugaauaacuuugaugacauuguaauuucccuaauuuauuauuauuuuuaguuucuuacuauuccuaacuuaaaaauuaaacuugaugauagguaugcugauguacugggggggggggguagaaaacaauagaaaguguuaguaagaacucauguuucgggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauaaaauaauaaaaucuuuaaaaaaaaaaaaaagaacucauguuucagggcucaagggaaacuuggagccugucucucacaggcuacuacauacccagaaauggaacugcggguucugugucaauucugguuuuaauucuaagacagcaucacguuuucugaaucagcuguaucuuuacacauuucccuaacugcacagguuucuuacggcuccauagucugaucaguacguuuccuucccuucccuuccucguuccugucuccucuucugucuccuccccucugguuucauuuacucuuagucaaguuucaugugcuuucuguugaaugcugugaauguccuaggccagacuagaaucaccuggggcaguugccacagaaguauuuuaucagggucucuaagguggguuucuagguguuggacaaguaucucaaggugauuucuguagacagacaauuugagacuuugugauucuuggucagauagguuuuuuauaaauuuucuuaucuccuuggagauucccagugaucauuagcuuauuagaauccucccuuauuagauuucccucccuaaaucuauuuuaugucuguuuaguuuuuauuuuuuuguuuuuuuuuuuuuuuguuguuguuuuuuuguuuugguuuuucaagacaggguuucucuguauagcccuggcuguccuggaacucacucuguagaccagguuggccuugaacucagaaauccaccugccucugccucccaagugcugggauuaaaggccugcgccaccaugcccggcuuuaugucuguuuaauucagcauuuucuaaccuaaccgugaauucuuguguguguguguguguguauguguguaugaguguuuuuuucuuugauuucugacuucagcaauuguucuguagcucucaugaugugggaacauuuuauuauucggaagguuuuagcauugaaaugucucgccuggugauuuacagcccuagucaauauauucaaguuucaacuaucaauuaauucucuuucuaaaggggcuuuuggcucucucccuugaaagcugccuugucuguuuauaauuacugagagcuguuuguuuucugugguuuacauuuuuuuggucuuaagguuuggacuuccuguagucuucuuauacuaaugaaacacaaagacaguugucacauauaaauuaaggcagcaguaacuaugugcuccuucucgggagcguaggguaacagugagucagcagccucuucuguagcugauggucaggcgcccgcugaagauggcgggugucaggagugacuugcugcuccgcaaccaucagcuucauguagcccucgaaaccugaauuaacuucuauuaaaccuaagguuaaguacuugauucgcaccacccuuguuucaagucuccagccagaacgcauggggugauuuuuauauccggacagauucaggacauuuugacucuuguagaaagcuuggacagugccaguauagaugguuugucaucuucccaaguggcauuuguggagaugauucauuggguaaaaacuugaauccaaagauauuuuuuuuauauaucuaaaguuaaaauuuuagaauuaggaaauauacccaaccccaaaacagacacaacacaauugcaguaugaaaagcucaaauuggaaagauuuguugguaaaccugaaguuccuuuaaaaaucuguuaguuuagcuagcaugugugagcggaaaagagcccacugcagacacuucaggauugcacagugagcauucccaucaccccacaggcuuccuucuguagcgucagaagcaccauggagcuugcuuauauauuaaugaaugcauugacagcuaauacucaccugguaaauauaucuucaguaugugagguaaaauauaaaauaauauuuuagguugagguaaacacacuagacuaguugggaaauuuaggcguugauuuucuucuauuacuagacuugaauauaagaaacagccggguggugguggcacacgccuuuaauuccagcacuugggaggcagaagcaggcauauuuuuggguuugaggacagccuggucuacaaagugaguuccagaacagccagggcuacacagagaaacccugacuugaaacaaaccacacacacacacacacacacacacacacacacagaagaaacaauggagguugggaaugguggugcacacuuguaauccuagcacucuggaagcugaggcagagagacugugagucugaagcuaaccugggcuguguagaagacagugucacaaagaagcaagcaacagcaacaacagcagcagcaacacacucuggaaacauuaucugugaacacuucaaaaugcuccuucucccggagaucagauccaggaccccggguguaucaggcaagcguucugcauggagcugcaccccuaccuaccaaccaguggagcugcaccccuaccuaccagccaguggagcugcaccccuaccuaccagccaguggagcugcaccccuaccuaccagcuuuauggccauuguaugccuuuuguccuguagaggaagacuuaccuuugggacauuuugaaauuacuaauuuauuuucaugaauccuucaaauauccauuucauuuacauuagauaggaaaaucacagggaguuaucguuacauuuaagguuuuguuuaacaaguaaauguaaccaguuggagugacuguaucuccaaaaaauagacaaggcuugaucuuagcaaaccagcagagagcugauggguuuuguuuguuucuuugcucguuuucucuuuccaaagcaguuugggaacuugaaguugaaaccaaagaacagagauggcuuaguuucuggacauuuuguuuucuuucauguguguauguguauggaaguguggugugggggugugugguguguguguaccugugcauguaggggguauccaauugugcaggugucagaagguggcacagcacaucuucuuucaagacuuucugccuuagccuuuugaucagggucucucccugaaccugcaguuguguuuuuuagcuaagcuggaagccagcaagccucagagaucucuugucucuuuguuccuccuacuauggagguuauaggcacgaaugggaccucaucugguuuguuaugugcugggacccaacuuagguucccauguuugugcagugucuuaguuaggguguuacugcugugaacagacaccaugaccaaggcaacucuuauaagaacaacauuuaacugggacuggcuuauagguucaguucauuaacaucaaagcgggaacauggcagcauccaggcagacauggugcaggaggagcugagaguucuacaucucuauuuuaaggcuacuagcaaaauacugauuuccucaggcuggagagauggcucagagguuaagagcacugacugcccagcaacuacaugguggcucacaaccaucuguaaugggauccaaugcucucuucugguaugucugaagacagcuacagcauacucgcauaaauaaaauaaagcuuuuaaaaaaaauacuggcuuccaggcagcuaggaugugggucuuaaagcccaugcucacagugacucaccuacuccaaaaaggccacacccauucacagagccacaccuucuaauaguguauaucacauuccacucccuggcccccauaguuuguucaagcacaugagucuauaggggccauaccuauauagcacucucaacaauacugaaaguccaaaguucaaugucucuucugagauucauccaaucacuuaacuguaauccccaaagcaaggcaggaaaccaucugugcaaacuccaaacucugcaucuccuugucugaugucaagauggucuucagaucuccaacuccuuuuucaucuuugcugacuguaacaaucuucuuuuuuccuggacugguucuacucccuguuuagcaucuuuccucagcagauaccccaugauucugccaucucaaacaucuuggggucuccaaggcaacuucaguguuacagcuucuuguuucaaagucugggauccacacaugaucuucugggcuucuccagagggcuggugucacuucucuagcucugcccucuguagcacucuaagcuuagguugauccacuccacuguugcugcuguucuugguaaucaucaacuccaauacgcuggggucuucugcugcaacuaggucacaaauagccucucauaggcuuucuucuuuacaggaccccuucaguccugggccaucuacugcaacugaggcugcaccuucaucaguggccuuucauggccucucauagugccaagccucagcugcucuuuaugaccccuucaugccuucaaaaccagcaucaccugggauacucuuauacauuaccaaguccagcugcagcacaagguacagccuuggcuaucucuggaacacagcuucauuguguucccagaaaacacuuucagaagauuucaccucaguggcacugguuucuucuaaaccaccacuaauuucuuagcuccagauaugcugugaaugggccuggugcuguuuguauguugaugcuaauucugcucuccuggaagggguuggggacaaggagugagucacauguacucaggugacuucuugugaaccaauccccuaaugaauauaggagccaaucacugggugaguaggagggacuccgguuggauagaggaagagaggaggcaggaguugggguccuuuuggacggggauagcaugaggacaagauguaauuaugagugucucccauuuucaaugguggauccagguuuuuuuguuuuguguguuuuaaagauuuauuuauuuauuuuuuauguauauaaguacacacuguggcugugcagauaguugugagccuucaucuggggguauugaauuuaggaccucugcucccuccgguuaacccugcucgcuuuggccaaccccgcucacucaggcccaaagauuuauuuauuauuauaaauaaguacauuguagcugucuucagcggcaccagaagagggcgucagaucucauuauugguguugugagccaccaugugguugcugggauuugaacucaggauuuuuggaagaguagucagugcucuuaccugcugagccaucucaccagccccaggauuuagauuuaauaaggcuuucaagacuaggauuuuaguuguugcccccagcguuugaguuacuguuguuuuggaauuaagucuguguuguguuuuccuucacucgccggcuuguuuggguucaagagagaaagguacggcagcaaagcguggguuugucugaggugcaccacaaaggccgugggggauuugaagcauggugcugguaugguagccacccaccagugggaaccuagcaaguuggguggagacguuucaggagcucugggccagagagucuccacaagauaagaauaggucggccauugccugccagugcauggccagcuaggcugccagggcagaggguugcuggcacaagugcgggaaugaaccgcuuucauuuuuuaauguuucucacaacacagauaaccagcauuaauagucccuucuauucuggacucuaaagccagagccacauggccaaagcugcugauuuuuguuguuugcuggagcuggaacgugguccccuuguucuauuacauuaucaucagcuuucuguuuuccaacuccuucacugccuaagcuuggaugucuuggaacuugcucugagacugauuaauucagagaucugcaagcuugucuccuaaacacugggauuaaagguguggguccaccaaggcucgauuuaaaauuuucuuuaccuaaaacuuguucugaucuagguuggccuugaacucagagaucugcuucucuuugccuccuggaccuaaauuuagcugggugguauuuugccccagggucauuaaucccuuaauucaauuuaauaucuuugaacaccgaccggauccagcuccauuucacuuccuggugcuccauuaaaauucaaaccauauauuuuauauuuuuccuuucuuagcuugcuacacuuguuuaaaaugcccuucaugaaacuuaaccagagaacaaagucuaugauggguguuucugagacuucccuugucagugcaauuaaucugagucuguucuccuuagcuucaggcauaaucuucagacaagggcaaaaaguagccacaaucuucaccaaaauaccacaagaacagucucuaggcuacauauugaaauuauucccugaaaccucuugggccagguccacacaauucaaaucacucucaguaacaaagucuuccauauuccugcuaggauggcccaauaagccccuuaaaauuuaaagcuuuccaaaucccaaguccccaaauccacauucuuccaaacaaaagcaugguuaggucuaucacaguaauacuccagugccugguaccaacuucugucuuagggcuuaacugcugugaacagacaccaugaccaaggcagcuccuaaagcacuugggaggcagagguaggcggauuucugaguucaaggcuagccuggucuacaaagugaguuccaggacagccaagguuauauagagaaacccugucucgggggaaaaaaaaaagacauuuaauugaggcuggcuagcagguucagagauucaguccaugaugguuaagguaggggugaggcagcauccagacaggcauuguacuggaggagcugagaguucuacaucuccauuugaaagcugcuagcagaaugcuggcuuccagcagcuagggugagggucuuaagcccacacccacagugccaugccuacucaaacuggaccuuaccguuuaauagugccacucccugggccggagcauauacgagucaucuuaugcagcaggugcuauuagcuccugagccguuucucaggguccuagauauuuuguuucuuucuuagacagauuacuccaagaagagaaauuaauuggacuauaacagugaguguguauuuuucguggguaguuuacaggccugucagguagcaucauguaauucuugacuacaggugggcuugcaaauauguaaauuuucuuucucuuugugucugugugccugugucugucugucugucugucauugcucaccuuguguuuugagacaacguguuucacugaacauggaccccaccauuucugagagacuggcuggcacaugccugccuccuuauccagcauugggguuacagguggauggugccaugcccagcuuuuauguguuuguguuugggagugaggggccagagguucaaacucagguccccauucaugcacagcaggcacuuacccacugagccagccuuuucauucuuacguuuuauuuuuccuuacugaagaauugaauagauuuauacuucaauaaugugaauggccuauaagagagacuuuugcuauuaucauagacuaggguuuuuuuuucucucaaauaaauuuaguacuagaauucacaguauacuuuaucucuuccauauaaacugauccacauuuuuaacggaaaccaguaaauaauaccuuguuaccugcauccccguauagauuuuauuaccuucaucuuuauucccuuguucaguuuacuuaauaagaaaaggcugcuaaucccccuuuaaauugauuuuacaacacacuaaugggcugcagcugcugugugacuccuguaaucucugaggcagaggucagcagucagcaguugguaauggaggggccugccucugugguaccgugcaggacggaugccucugugguaccgugcaggacggaugccucugugguaccgugcaggauggaugcacggaugcagaugcuccucccucagcagcggugggcgucaggaugcaggccggccucugcugaugagcuuccaggccauugggacccucuucgcccacaccgugucuucucucacguguuccaugcuuacugugauccuggcuacucuuucuuauuccuccauuuuuuuuauuuuucacagugaggaaaagguugagaucgaauugauguaaugcgagaagaaacagcacuagcaacucuaggccguuucugucacgccucagagcagugguucucaaccugugggucucgaccccuugaaagggagucgccuaagaugaucggaaaacacagauguuugcguuaugauucauaacagcuagcaaaacuccaguugugaaguagcaacaaaaugauuuauggcugggggggguggucaccacagcaggaggagugguauuaaaggggcccagcauuaggaagguugaggaccacugcucuagaggcagcucaucccauaccucucaaguuuucuuuccuugugcuuugaaaauuacaaagcuguuuccuaccucuauugauuauccuuuccuucccugccugucuccaucccuuuuuucucuuucagcuuucccuucucuucucuccuaucuucccucccucccucccucucucccucccucccucccucccucccucuguuccuucuuucccuuuccagauucucccuaaugucacccagguuggucuagaacuugcuguguagcccaggcuggccuugaacucaaggcccacccaccucuaccucucaaugcaggcaugcgccccaagcccaucuuagcuccuucaucuagaacauuaauuuccagauccauugcuguuguagucuguauuuaccucauuccucuccugucugaaugcugugucauugccugggcacuacacccugccauucauuuuucaguugaugaacauuugaauacucccccacccccaauuaggaauuauguugccaggagcuauuuuuuuuuuuuuuuuguagauguguuuuuauuucucuuaaccaugcaacuaggagugggacugcaguguccuauugaguaggugccagcuguuugcuaagguaacuacacaugucaccucaucaguaucaaagguuccagucucuccaaguucuuaccaauacccagcuccaugaugauuauagcugaacuaguuaggauugaaguggaaucucauucugaauuugauuuaugcuuuuccuagugacaaaaacuauugagcaucuuuuaaaaaagcuuuacaucauuuauacacacacacacacacacacacacacacacacacacgccuguacacacccauguucaugugacaccuuacugcacugggcucucucuucccaccaucugguggucccaggaauugaacucagaucguuagccuuggaggcaagugccucucccugcugagccauguugcuuucuuguuuuaaguuuuggggcugcuagggauuaaacccagagccuugccuuguugggccuugcagcaauucacugauccaccacugggucugcugggcugguuucaggcucaagugauuuucuugccucagucucuaagugucugggacuccaggagugucccacccccaccagcccagcuugcucuuucacccuguuaaugugcacuucgauucagaaacauuuacauuugauaaaaucgguuuuaucuuuaaauauauauauuacuuauaguuuugguauuucauuuaaggaaaaguauuuccaggaguggugacgcuugccuguaauccaggcaucaggaggcacacagagggucaaguucucggccagcccuggcuauggagugaguccuuuucucaaaaacaaacuaacagacaaacaaaaaauuuaaaaaaaaucccaaacauccaaaauugcuauuuacccaagguugugaagauuuguagugauuucccuucuaagaguugucuguuuaacuuugcauuuaggucuuggauguguuauuuugagugaacuuucacaugugggccgauguggggguucaaauggauucuuugacauguggauacagcgacugaauccaucuuuauugaaguauucacuucuguaugaggaaggagagugugaguuuucauggaauuuacucauucauuccgcaauaauagaucuggugacacugucugucugucuaucugcaucacagcacacguggggaggucagaggacaguuugcaggcguuggcugcugcuccuaccacguggguuucuagggauugaacuugggcucagcggccucguguuuacccgucuugccggaugguuuuuuucuuacacaacuuuauuaaagccucauuuacauaccacagcaaucauguaauuagcugugugacucaguaauugugagaagggagagacgccagcagcgcauuaaggaaaggaaaaagacuugaguuccagaaugcacugagggucaccaguggccauaauuguuggugugcauuuguuuaaagagacaaaaacauuuaaucuguuccaaaagagcugccaccucauuugcuucauggggauuucucaguuguuuccaagauucagcuguagguaaggacuugguuucugggcuuucgcgugagggaggccaggaugcugagggugucagcugggaggcugggccgaguuaaccgccccucucagagucuuccuccagcugucucucaucagucacucgaaagcuugugcacauaaagucuugaugguuggaaacucauuuacuaugugggguuucauaauagaaaucugacccugcgacacacccacagaagaaagguagaacucaaagacaguacucuacuaacuagauuuuauuuuucuuuuguugacaucauugauauuuuggcaaaaaggaguuggagcucuuauagaagaauucccucugaacacuugccaguucccugacauuucuaguuagaaagguuuucuguuuccaaacuuaagacacaccuccucucuugcacagcagaugggaaagaucaauggccgcuauagagaauuacagggucuuuuuuuuuuucuugcuauuugaucuuugaucuuaagacaacuuuuaacccuguaguaaucucccaagagauucaagaaaauauuuugugaagcaaaauucuggggaccacgagcuggaggcccaggagcaagcugccaggcaggaagcugaugcucuuaagaaaucauucucugcuguugcgugguuuuuauuaggcugaguucuuaguauaguuuauguuuaaaugcauuauugcaauuugguuuugaauuuaucguuagaggaauaaugaguccuuuccugaugauuuaucaacagccagaaaaauaaaucacaaauaauaacaacccaaauucucucauuagguuugaagauucaaaauuacguuaggauauuuuaauuuggaacgcucccuuuuaaguugacuuccuaaugaggcucgccuuuuaagaaacaaauucaggcacuaguagagaccggauucugauacagaaagagcguaacccacgaccuuaacacauggcaacaaaaaucugcacaacuuagugugccuugcuguuuuugagcucaagagaguggagauuucagggcagccagggagccagaggccuaagaggagacaggucugcaaggacggaugagagaaaccugcuuacccagguuugcuuaccacagggagacagugcucagaauucugacgguaauggaauuuggaaaaagcugcuguuugugggcuuucaggaggguguggaguccccagaggcuguagaggguaguuaacacccaagcauaaaccuuuucuccaagaacucccagaugacccccaaacaggucauuccucuggcggugcauggggaagggaaacuggcggcugcagaugugacaaggaacuuaaccaagacuccucuuuuguaucuucuuguucucuacugaaaggagguagaugcgaagacugaggagugguucaggggucagguggagcuuguaccuaacaugcauaggguacugugaguuccauccccacuaaggaaaaaacaagaaucccucuuuccuuuaggguacaaacccaggggccugcaagaaggggauaaaggcaaacauacccugaagggaggaugugagcccagagcugcacuggggaaggaaagaaguguggagaacccacaucccuggucccaagggagagagugacuaucuagaacugaugcucaaucagaccacugccauuuuccggagcagcgaguacggccuguugcuguuuagaggugggaagacuccuuagugagacuacaccaagugcagaccaaagcucaguggccaggagacccugagaaaagccaccacaaacacguccucacucuuaagacaggucgccccagaagaaucaaagauuguguauguugacugugcuaaaccucauaccaaaccagcagccugcucagucccaacugaaggguggaguauccauuucuaggcauuaaaaaccauuaucuuaaauuuaauuuucuuugcaagaugccaaguuuuggacagaauagaaaacaugugauggcucaugucucaagagacaacacaaucaacagggauuagaaauaauaaaauguagucacugugaguacugcauuggaaauguuaaugagagaggaacacagcaugcuaaaggagauggccaauuucagcagaaugcugagaccuauaaggaauagaaaacacaggagcaaaggcccaggauaggcuuaaugaacuugaaagcaaguuaguaaaacugaagaaaaaugugaaaaggagaaagaguagaaacaaacaaaauccucucaagcagguguaagcauccaagagcugacacacagcaucagagcugauacacaguaucagugaguuuaacaagagugugaguagaagacuacauuauugaagaagaucacccuggagaaggcaaacagacccagugcauaggguugcuucuugggcuugauuaaaauuaagauagugauauuggggaaaccaaccaaacaccauacacauaaaacaaacaaauaaauguuuuuuuuuuacaaugaaaaagaaauagauaauugaaugaaugauguagggcagcauccagaagaauuucaguuaauaaauacagaaguuauuuguuguauagacaaccacaguuaaggcaccagcuaaacauugcuauagugcaguccagugcugagagucugaaaagacagggauuugcagaauuucaaagucuuucucccaugagacuaacuuuaagggaagagaguggcuuugcaguggagagacccggcagacauccuaaccaagagcagaucacgucgccuguguuccugcccagguguacaaccucauacucugaucacgagaaaaaccucacuucugcuccagauaacucacuauugcucuucaggggcacugcauguuggagccuggaagguggcccggggaguuagaaguucacgaagcacaagcccgacgaccugcauuuguuccccagaacucacacgagaugcugaauguggggcugugcaucugugagcccagcauccuuuagugagaugggaggaagagacaggcucauggccaguuagucuggcaugagauguucagaaacaaggggagaucuugucccaagaagacagauggcaggaaccgaguucugaauguuguccugugaccuccacaugugcacaugguaugcacguguauguccacacuuuaaaagacagguaaagacuuugggauugucacagaccggaugaggcuuaggaaauggaaauacaucguugaacuuugggaaaaaaaacccagugacauuacugaaacaguuaauuuggaugaaaucugagcaaagcccccaguggguaaagauugcauugauguuguuucuugguuuugauuagguuaagacgguguuagggaaaacuggccaaagaacuccuuuuucuauugcaacuuuuauauauacuuaaaaugacuuaaaaaugaaauuuagaagaaacaaauuuagacuaaaaaaauugcagccugcaauggucuguaaaagacaaagccccugccucagguugccggaguagcauuuguauauuuuacaagauguaauuacuuuuguauaucauccuuagaguguuucaugccuagauuuugaccuaaaauauuuagacuuuuucuuuuuaagugaguaaaagauauuugaucacauaacuauuauuuacuaaaaaucuuuguguucuaaggacuuaaaaaagaaaguuggcuguuauuucuaacccuuacuuuuuuuuuuuaucgauucaagaugccgagugaaagccaugugacaggcacuggggccgagccccaggguucccagacucagggcccugguugccugucaccaguuuguaguucuucagagaauguagaaaaagaaagagaaugaagaaaaggaaaaucuugacgggaaaucagugcccugugggugcugcaguucgcagagcuucgacagucauguuucucuauuugcucaugcuuugcauggggaauucuguccuuuagacccuucccaccccugccuucccaggucaggccgucuggcauucccaaguuucugcugguuuuccucacuugaguugugacucucuguccucggugugccuuaucuaguguuagagugacucagaaugccucugcgcuuagcacaugucugcagccaaggaagcgcugaagaacaaauguaagacccacauuuacaaccaugcugaccugcuuucuuguucuccugguaguugcuauucuuucugccauaauuuaaauuauuuuuaaaauagaguuagcauacaaaguaauggguuuuauuaugguacuuucacacacauuaagggguguguauauguauguguguaugccaguauacauugcucucauuuauucccccuuuuagcuccccuccacccuggcucccauuuaauauuauuuuuacagcacuggauauuggacuggguuucugcuggaaccagucgaguacuuuaccagaaccuagcuauccaguccucuuuucauuuguuauucugauagagggucuuacuaaguugcucaggcuggcccugaacuuugaacugaugcuucagccugcugagccacugagaugucagacugugucaucaggcccugcucucccauaguguuauucauaaagguuggaggccuagagauccuauuuguaaaaaaaaaaaaauaaaaaugaugcuguguuggagacguugugccuaaaggaaguacccgagcucugcagcuuguaagagaaagguuuccguuggcuuacagcuuuggaaggucugugcugugaugggucaccuguguuaccuuuggccuauggugacagcacaucaggaugggagcagguacugaguaaaacuguucacuucacaaccagagagcauagagagaagugggucaagacccagaacugccuuucagagcaugcucucguauuaugccucacuucuuaaggguuucacuacuuccagauaaaggcuugagccucgguguguguguguguguguggugugacauuuaugacaucuuugcaaauguucccggaugggaauguuugcagauaaucacaaaugcacgugaagcuuaucagguggaccuagguagaaagaaucauauuugggcccaaaaccuagaguguuaguuuuucucuuuuggcuuggccguuaucgcauuaggaaauaauuuuguggguaacacgaauacuggaaacuuagcaaggaaagauuauagaauguuuuuuuaaugcugaauguaaggagcacugagagguuauugucauauaaggucugccuacagaacaggagugcugggcggggcaggggcggggggguggggagggaaucaagugucuguguucuuucugaucagcagacugagcagggagcacaugaaagacugcagagcuggaaaaucuuuuaaucgcucuggacggagucuccucugcgguuguucagggaagccaucgcucuucuccccucucucgauccuccguguccugucugacuuuaagcucugcuacaaugcuuauugaauuggauguuagaggcgaaccuuuuugaguucucaauguuuugauguuuaaagggcuuggguugaauucagagcccaucagugguuauuaaaugccugcuuugugacagaucuugcauggucuaucucauuuaagugcggcgggggccaaguuaucuaaagagaaaaacugagaacuuagaaucgauauuuuaagacaucucaguaggauuauggccaagaggggaagaacgaaaugaguagcagggaaacuauugcuacucaggaggucgcacgugugaucugcaagugaccuccagugccacgcaccaccgaugacaccccucauacacgcagccauuaggagguuacauuuucagacggagcggaguaacuuacuguagaaauuaauugugcucuuagugggucugcgaugaaggcaguagagucuccagugugcaguuugcucgccaacugcuaacacguugcauucuguugucuaaaauucuucucauuuagaguuuaauuuuuaaguaucgcagcuaauuuugagcguucucagucauagauuaugauuuuguuugccuccuggcccuuggaaauaguugaagaaaaguugccuugccgcacaacgaagcuaccugugacacagugaacugaaaaccuucguuggaagugaaaaugaauaaacucccuaaacggagccccauccuauguccugacagcauguggauuauauggcuuggguuugugauacacuuauuucuggaaugauugcucugccgaugggaugcucuaauuaacuuuucaaaaggagccaaacacucccaccugcuuccuucucguggacucuuucugugagaacaagcacaaugauuaacuuucuaauugaugugugcgggcauaaguaucugaaacacuucuacuaaagcaacgucauuuuuuaaaaagauagccaaguuaaauauguaaucgcccuccagaguaauuagaagaaaagaauggauguaauuagaacgugugucagucucugcaucgggcacacguaacugauagcaccgcuucgcacaugccagcaguagagggagguguccccuggggagagagcugccgacggagguaggccuuuccugugugugcaguggucccauucgaguguaauguaauuuucacugucgggacucaucuguaguuaucuccugagguuuaaaaaaaaaaaaaaguauggauauugggcugccggaaucugaguucucuccuggaauauagccagagaugugaguuuaagaucuggauuuuaucagcugcuauaaggaagaaaaugcucaaguguuuuaguggcucauuuuauuuacgauaaacuagaguccuuuuuagguaaagagugacugagugaaacuaagaauuugagguugaauuugguuacccagagucagcuugacagauuguggccaaaaauagagauaauucauauaacagacccauaaauggcaucuucugggacagguuaggccaagguguuaauaaauuugcauucuuuuucccucuuccucuccaccucccucccucccuuccuuucuuuuauucuucucccuccucuuccuucuucuuucuccucccccucccacuccuuguuuugagggagguuuucucuguauaccccuaaccguccuggaacuugcuucauaaaccaggcuggccucuaauucacagagaugccccugcaucugccuccuaagugcuggguauaaagacgugugucauuuaucaccuggcuacuuagauauuuuuuaaucauauuuugcugaucagguuuuucuuuuccuggauuaaguuuauuuaauaaaaaauaaguuuaauuaagucagaggauuaauuugugcaauauaacaauuuaguuaugcuagcuagauuaguauauaauuucuaagaauuuauuuugugucagaguuuugccuucacuuggguguaguuccugcauaggccaggagagggcauuacauucucuggaacuggaguuacugagcugugggugucaggaacuggcaagagcuucaagagcagcuagugcucuuaaccugaugagcaaugucuccagcucccuugaaaauaauuucauaugcgcuuuacauauguguuuuauuuaggguaaccgcuuuuuuugaguaagaucccaucuaguguuuccuguaauauuuuaucuuccgucagcuaacuccaucucggaucaaggcugguuucucccugcgucuuuuucugaccccacgugcgcauccuacccgcaucccgcaguucagucaggugcuuucagcucauccagaccccagcgauguuuucauuucuguuuuuguuuugucuuugucuuccuuccugguuugaaauggucucaugcagcccagucuggccucaauuucuugcucuuucucccuucaccuccaaaugaugggauuacagaaauacgcuaccuggccacuguuacucuguuguccuuuguccacguaaugguuuuuuuuuuuggggggggugucccaaaauaaaaauaaccagguuugauacauuuuaauauuuuaaacauaaaaaccaauguaaaaaagauugccucaacauauaauuaguauaauaguuacuggcauauuuuacauuuuccccccucuuuuuuggguauaggaccucuuuugcccuggcuggcauuggacccacucugcaguauagccuguccaugaauuaacaucuucucgcccuagcucccauguauugggaucacagucaugugccaccaggccuggcuuauuuaauuuuaauuucuccacuauguacuccuagcuggccuagaacucaugagugauuuaccugccucugucucugucucugccucugccucugccucugccucugccucucugccucugcauuaaugguuaugcaccaccaugcuuggcuucuauuaaacuuuaagacauuauaccuggcucaccaaaauucagaucauccacauuucauggcucaggggccaugcagucacauucuguaggccugcagugauugauuuggggaaguccuggcuuccuguccuuuuccuugggauuuuaagccuggcuccccuguccagugauggauuuuagcaucuagccucucucuccgguuuugaguaugguugccuggugcucucugacaacauuccuggagugaagagaagucagaggggugguuuacaggugcuuggagucaggcaggccuuuagggucacuguuucuucuuuagcaucuccucaaagauccuauccuccuucuauccuccuguucuuugcucucagaguccuagcacaccaugaauccauaccagaaagagacccugagaaaugggucuagucaagucauuuuuuagaauuagaguuuuauaaucucucccaguuauuuaguuauucuguuuaugcacauuuuucucugucuuagggcuucuguugccgugauagagccacugggggaggaaagaguuuauuugcuuauacuuccauaucauggugggaggaagacaggacagugacaacagggcaggaaccuggagcaggagcugaugcggaggccauggaggagugcugcuuacuggcuugcucuccuuggcuuuuuuuuuuuuuuucauccugcuuuuuuauagaacccaggaucaccggguugcuuauaaugggaugggcccucccccaucaauaacuaauuaagaagaugccccacaggcuugccuauggcucaaucauagggaguccuuuucuccauugaggcuccucccucucagauaucucuagcaucugucaaguugacauaaagccagucagcacccucucaccccaucuuuaagaguaaagcagcugcagacaucuuucacugucagccacucauggucuuucugugucauucucauggcuccugugguccccggccuacugaguccaucugugccaggaaaagaucugggguaacguuuccuuaaguccuuauuggcgcacagacagacuggccacuauguggcaaacucugacuugacccaucagcgguccgugcugccugucuccuccuggaggaagugaaucugcaaagguccggggaaugggcaucuggagggcuuauuggagcaaugcagcaacucagggugagcugugcucccugugcaucugcagcagaaccccucugccguccaguuucuuucccucuucaucacugagagaugguaaacuuggaagggugcaucuuagcguccccuccaggcuauccagugccucuucccacggauacuuucuccaguggugcucacuuucccacccaucugucuaugguuaccuaccucacaggucuagaacaucuggucagccuagguaaguaacuagcaaaguggcuugaccugcugcagugaaaccgcaguuggcuuauuugaagaguugaagaagaaacaauguaucggguuggagagguggcucagcaguugagagcacuagcugcucuuccagaggacccaggugugauucacagcacccacacaguggcuggguagcuguucaacucagcucaccaguguuuccagccaguggcuucccugcugagccgucccaccaguucuuaugugaguuuuaauguaaaguccagguaucugaucauuuccauuuaagcauuauacuuguacaagacagcagccuugguuauauucacagcacuguaugaggaucacgacuaucuguuuuuauuuuuguuuugagucauggucuggccauguagcccaggcuggccugaacucaagcuccaccugccuuugccucuuaaaguguugguauuguaggcacaugcaggccacuccuguugggacaggucuguaaucccauccacuccagaggcugaagcaggaggaccacaagcucaaaguugcuccuggcugcagagcaggcacacaccagccuccacacaaggcuagacacugugcuucuaacaauauuucuaucacccugaacaaaaguagaaaccauugaccugcaauucuccauuucuuucucugcucaguguuuugucuccagaggaauuugcuucuucucaauaugccauuaagaauuauuucgcuaacaauaaugucauuagugagaucauacaacaucugucccuuuguguccggcuuucuucacuuagcgcaucuuccaaguuugucuguguuguagcguguggccggucuucaucuauaggcuguggucuugauacugguacugagcuugacucaagacaucuguauggcuuucagugugaagaugaauuauuuauccccuucuugauuucugaacuuaguauuagcauguucugcuuuccucaguggcgccgugaugccaucggcuugagagucaggcggaugaauaacaauuucuuaaaaguuauccugacguguagggccgcuuuucauguagucugcguaaaaauaauaguggcaaauauuaaucaaguaagaaugaagauuugaaugcuaaguuagagagggagagagagacagagagauagacaggugugggagagggagagagggagguguguggggguagggagagaacucaagagcgcagacgcuuaacuagaauauacaguuacaguagugcucccucuaaugugcaugugcauaucuucaggagauaguuuuguaguucuguaguugaaguuuuguuugcuuguuugcuuuugguauuugggggcagagucuugccauguacuuauggaauauuuacacagacuuuuauucaaauguaaauaagaaauuaugacauucuguagaaaauugauggaauuggagaacaaauuaagccacucaaauauugcauguuuuauguguaaucuagauuuaaagauauauguuccuuuaaacauuuauuuauuuauaauuaguuaauuuagugugugugugugugugcgugugcguguguagcagggguggaaugggaugcguaccacaggucagaggacaacuuguggaggccaguucucucuuuccaucauguuuguccugggguuggaacucagguuaucagguuugucagcaaguaccuuuaccugcugagacaucuugcuggccuuaaauguauuguguucuucacauaugugcaugugagcaugugcauacgcagucuuaguuaccuuuguuguuguuguugugaacagacaccaugaucacagcaacucuauaaaggaacacauuuaauugcaacugcagcugggaagcauggcagcauccaggcagacauggugcuggagaaggagcuaggaauuccacagcuugauccacaggcagcagaaagacugggacauacuucuuccaacaaggccacaucuccuaauagugcuacucccuaugggccuaugggggccagguuuauuaaaaccacuacuacacuaucccccccugccccccccccccacacacacacucggcaugaagcaaggaagcagucaaguugggggagggcaagagaacugacaaaacuauccuaggcaaggcccauuuuaugccaaguguugaggcgaaugugcuuuccuggauauuguccugaaagugaagcggugccuguccuguuggcagcacagugcuguggagucaucacaggcaaaucagcgaguccgggccacauuuugcuuucccccauuguuccgagggcucucgcugcugccuggauucauaagugguggcacgugccauuucaaccgaggugguccugggaaggacuggguucuguuuugcauucacuagcucuuugucucugacugccccggggguggaagggccacgggggaaaaugauuuccagcuauucagaggaagggggucuguuccuggguuccacagucuuaugucacccagguccuuuauacucacauagcaauaacaaggagucagucguuaaccauuuuauguucaauauuuauauuagcacaguggaagaguguauuuaauucuuaggguuacuggcgcgugagguguguguuuaaugaguuuuaaugauuuguggacugaacauucuugcuuugcuuuguccaugcaucuuuaugagccucauacucccugacuguucgcuccacccugcuguugggcauagacccugcauucgcaaucucugcauugaucuuuauucaugaaaauuagcuaccuaccccaguuucugccuagugaguuuccguccuaacagagaguacggucuaccgauucagugcauagguccaggacucagaacaaauacaaucuguaauauuauuuucugugugauuuuggacuccaaucgcugacuuucucuggcuuucccauuuuacaaaugagaacuauuuugguacccgacucaggagguuaccgugaccaccaaaugagauguuuaguacaucuucuaguguguaauuagcaacaaugauaguaauuauugucaagaugcagcacgcuguaauggaauuagacagacugggguugcaauccuaacacugggauaggugggugugcagguuucuacgugccauagaacaagcagucucuucugucuguauugauuucuacagacuauaaauugauuagcugucuuuauuaggcaauuaggaagaucuaguauacagcaauauuuaaaaccggccacuacucaccacccuucaguugccagguuuguuuaaggaaugcugaccaauaggcucacaccgugccgcuuaagccuguaaaagaguugccauucaaugcauacuuauauugggaucucuuuuuccaaugccugucuuauuuguuggcugaaauagauaaaaaucauugagaacggaugauguacgcagggcucuaaugucuuauuuuggaagaacaauuauuccgugcagcucugugccaccggagugagugagaaaggaaggccacaccacacagauuccgaggaugagacaggaguccugugucucgucucugauuugcugauggaaaaccagcagcuuuaggaaaaaguauucaagaugggaggagccuccuggguggguaaggaugugagcaaaugaaggugaucagccaaucagacgccucuguaccucugaggacugugcugaggguggcacccaccgacugagagccaagcuggccuggccuggggaagagagaagaggcaggagagggcagagccuugccucagggauaggcaucaggccaugaugagagaagaaccaccucaucucauuuuauuaguacgcagaaagcuaguguugggcaaugggguuuugguuuuuccaugaagcuugggugggaaagaccaacaggcuaauaugaguuuauuuuccuggucccccugcccuucccugugauacggagaacagauagaacaccaagucugcaaaacacaaugcccuuaauaaaagaagagauuauaguuauuugucuguugugguccaggagucaccccacaagccacaugaacacccaucucagucagacagggaugguuuauugaauguacaaccuaauacuggucaaaucagaauuaccugggcuacaacaaugaacaucuuucucugucagcuuguaaagaauaaagucacagaacccacaaugagcucauauucaggugcuggaagugcugcccgguggucagcucugacucaagccauuuuagacauaacaguucauauugaccuuuaauuugauagguccuacaugaagcuuauaguugugggauuucuuaagguuaacaaaccuccuaacacacagaacauaacagaguauguggucagcaugacccugcucugggucaagauauuuuucugugucagugacuggaaggcauauuacagcaacaguaugaaauagcuggcagugguggaacaggguggccgcagccauacugugcgcgcgcggggguggggucggggugggaggugcccaacacauuuaucuaucuaucuaucuaucuaucuaucuaucuaucuaucuaucuaucuaucuaucuaucuauuugugugccagggcgugcuugaacuaugauauggauauggaggucagaggacaacaaccuguggggaauuaguuuucucuuguggggccugggaaccaaacucaggucgucauggcuccaaacagaaccacaagccucuuuuuguuuguugguugguuuaacuugcccagucaucuuacuggaaaccauaucauuuuaacggcccccacucucauaugaaauuuggaaaaggacuuugcggaaggagggaggcauuugccaguucuucuaggauugcgauuaucagguaaaucuggaguguuucaguaacucccccagcagcagggucagaagcaagucuucugaaggccccggacuucacucuguucacucgugcaagacuggguaaaggaacgacugcagagacaccgugugagagcagcgucagccacuccagcuguggacgcccucggauucacugugcugggcuaguacuugccacguccacuguuagccguuugucauccccugaaaugugacugaggaaguuauucaucuaaauacacauagcuaaaugugucuaguaguauugaaaaccaaggucugugaagggacggggacacagaggaaggaggcuuaaagaacuuucuaaacguuggacaguuuuucucucccccucuuaugcgugcaaccccccgcuacuguacuagaacagaaggaagucugcccgaagauaucagauauucagggcauggcaccucucugccucuguggacgcagaggcagugcauagcucugcaagcaucuguagucuggcaggcaggauccucaggucagcagcuguguaugccugguauugcugagcuggcuccggggaccuuuaaugacuacagcaucuguuucagaccuagguggaggaauucugcucccuucagugugaagucagcgaagauggggaccuugagaagauauggaccuugagccgggccucaggccucaggccucaggccucagcauuagagaacuaaauuguuaacucuuugugguuuuggugcuggguuugcugugguacauguagugcauuucuaacaacaaaugauucuuuuauggugaacugaauucaggguaggugaaugaaagguaaaaaugcuggcugacuuuauuuauuuuuaauauuauggcauuagaacaacaguagguuggcaguguuuaguguguccacuuaaagagcaguuggggucuaucuaacaugaaccagaacacaaauacauuucugucagaaagcugccuuuaaagcaaaucaggguaucugagcuguuucuagucuuaaguuuuaucagaagugagugacucagggcagcccugcaccucuuucuauguuuugaguccauaaaauggcacaauugccuaauauggucaucaagacuuuuuuuuuuuccuuuuuccgggacagucucacuauguaacuugucuggcugggauucacuguguagaucaggcuggucacaaagaugacagagaucugucuaccucugccuuccagauccaaggcauguaccauuaugcccugcgccauauggaacuaaaacacagcaaaacagacaaaaccauaaaacagcucacuguuacaucuccaggaccuguugcuauuauuucauguaguuuuugucccuuuucacugcugucugcuacgccauuuggguagcauaugccauuuuaucuauauaucaguggacucuccuaauaaaauaucggaauuguucauaguuugaguugcaucaucauuugaaagcagugacgauaaggaaaaagccauacacaaguccugagaggagggacaaaggagagggaccggggauacaugacauacaguauugaaaguggguuggagagagggucauaggaaugcaguguuuccccacuucuggcccaucacaaagccugcguguauuuagugagugaauaaaggaacauauggagagagagagugagugguuuucagaucacucagaugguuagaaacagaauggagacuuaagacuagaagaucagugguucucagccuuucugaugcugagacccuuccgugcaguuccucauguuguggugacccccccaaccauaaaauuauuuuguugcuacuucguaacuguaauuuugccacuguuaugaauuguaauauaaauaccugauauucaggauaucugauacgaagccccuccccugugaagggucaauggaccccuaaaggggucucaacccauaggucacgagaaccgcugucuuagauuguuuaugcccggggugauuucgacuguccacgaucacaugaccaggagaggggaagaggcuuaaaaugggaaggggcuucugugguacucugucacguagagugauaggccagcaagggcagcuugagcucaaggucagucaacaaaggaguccaaucacagugcucuccaccaaagauugcccugagcuguucuggcccaggcuggcgcgucugcaguggauccgagguguuucagcuaucuguaauucuucuucacucaagacaggacagagaaacccacggggaugcgaucacucuucaucagccacaggcagaguaggcaggcccgauguagcaggaauccuuccuaucacugagcaauuggagacagugugcuuguacgcugcccuugaacucuggggcucaaggaauccuccagagcagcugaacuccaggcauguguaaucggauauauaaccguuuuaauuuaaaaguaccuuuuauuuauuugugguguaugcaugugcacugugcaugaggaagccaggacagcuuguaggaagugcuucucugucaacugugcguguucccaggacuggagucaggugggcaggcuacuuggcaggucccuuuaccugaugagccaugucucugggccagccgcuuguuucuaccagggaguucuuauauugaacuggagaagaaggcugucagcauagcuaaugggauagcuguguguauuuuccagucuguaacauuuuuugauuguuacugguguaaccuaugauagaguguaaguucauguuuaaaauuucauuuccauuauuuuacaugauugagugcuccugcuaggucagggcucguauaguccucgagacugaaucugaauuagagagaugucucuccaugagaaauggagaccagaaaucagccucgaacgcugcaaguggcuguugcccucccuuguucauugucuagguauuuaguggugccauuuuagcaucuaauuaagauugugccugcuugucaaguguugugaagccuuacacagucugaaucaucagaucagccccaagagcaucugaagagggaagccuuacgcucacacagcggucggucccucaucucuggccagggugugaagggcagcauugauucauaagaucacuacaaacagcccagcgaucacuggagucuacugaguggaggaugaaaugcagggggcuauuacagacgcucugucucuauuaaccucccuuacccuuccauuuagugugauggauagagggaugugugcccugaaaucacagagguagcauguguuccgaugacaggucuucuuuaagaaggcaguguuaaucacguuagcagaucauacugaguuuaacugguuucaacaguuuugcuucacauuuuauuauggagcuuaauaaauuagggaaguagagaauuaacaaguuuagucuuggauuuguucauuagggugaauaaacagcuguacuuugauacaccacgaauacuccuagaggggccucgguagaauuaucggcgucuaugagcaucacugcuacaguuuaucgcucucuguauaaucaccgcacccuaauuuuuggaguuuaacacuguccguguucucccguugaaugacuugucucccuacaguuuugcuuuuagcucucuggaagcuuugccuugaaaacuaucacaucuguccauggaagcacgcauccgaugccggggcggcgugccacccuguacacauuuuaaaaguuaaaauugguauucauuacuuguggcuauuaucuuuugauucauaaacuucaacaccuuugagcugugggugucugaaacagucaggaaugccagaaagaguucccuuucacauaaagucuucuccccuuaguccucugaagcgauacuuggcuaagguacucaggaucacuuauugcacaguuaauaucauucaccauggcugcuuucuuguuuuuucaaaauaucccaauuuuucuaucucagauaguccagucuggaagaagcaaggauucuucuuuuggguguggauugagugugagaagccauaaauaacuuaaugacuaaugucaaauauguuacgguuucuuuaugguugaacaccucuuuuauuaucugugauguugggcagucaaucaggugggauggcucgagccauacuucuaaccucucaaguuaucuuuuaaaaaaaaaguugaaaaauguuuuggugcaaaugguauggguguaguugccuggauuauugguaaacaaaaccaaacaaaaaccccaacacacacguaaaauuauucuucugcuagacuaagcuuuaugggaaggcaggcucugcuccuguuuuuuuuuguuuuuugguuuuuuuuuuuucugugcuuauuucuagcuguuugucauggugucugacuugauaaacaguuguuagaggaagaaaugaaugaaugaccacacuagcgacaucuuacaauuaaacguuuuugaaggaucauggaucugaaauaugcagcauuugaucuuuucuuguuuuucuucuucuuuuuuuaauggcuguuuaggauuuuaaaaagagauuuauuuauuuaauuuauaugaguacacuguagcugugcauccuaucccauuacagaugguugugagccaccaugugguuuuugggaauugaacucaggaucucuggaagagcaguuggugcucuuaaccacuagccaucucugcagcugaucucugcaucccugauuuucuuuguuuguuuguuuguuuguuuguccuaagggaaggagagagaaggggggggggagagggaggggcgagagagauccaaacuucagagaaacaugagcacagcccuggccuucaugacuacuugaggucagacuuuugaguguuugugagaaugcaacgugagcguaaugaauucuuaauggcagucugcuaauuuaucgaugagcacugcuaauuucuaugcuugaguuuuauguuuguuuauacaaguaauugucaagcugaagucucuguaucacacuuagggaccaugaaagagccuuaugcauaauuucuauaauaaagucuccagggugacauguccuuauaaauucauaagugauaccauucaguuuguagccugguagcauaaaaaaguccuuauauggguagacacgugucuuuugcaucuugaaucuuuuuuucaugguuuauuuuggcuugggguuuaaggguaaaggacaucuugguagggaagacauggugccagaaauguaaggcagcuaauuguguuguguccagcaucagggcacagaagagaugaauggugguggucagugccccuucgucuuuuuauucagucugugaccccagcccaccacauagaacugcuuccgcucagccugcccuuccccccuucauuuagaccuuucuggaaacacccuuauagguauucucagauauguuuccauggugaugaaauccagucaaguugacaaugaagauaggaagacugccagucacuacacacucaccuugcuggcuuaaacucuguguguguguguguauguguguguguguguguguguguguguguaugugugugucugccauguacacaucugcuuguguguagaugccugagcuugauguauuaggugaguacuuuuuuuuuuuuaacaccauuuaugggcaucugaauucaggcccugauacuuccgcagcagauauuuaaccgacuuagccaucucccuagaaccuuaaaucagguuuuauaaguccucuaugcacucaaggcgccgacaccaguggucuuauucuucagcugauggcaaagcacagagguggugauuggacuccucaugcccucagcacucaucccccugugguagugaugcuuauaauccauuagugaagauaggcaacuuuucaaaggcagcugacagccacugguuugguccuuuuuacuuuuagagagccccuuagggcaauucaaaugacucuuugcaaagcauccauuugucuccgguugaagggaaauagaaaaauaaaauauuuccccauaguacugcaugagugauauuggcucugaggucucugcuacuggugugucauaacauuccggggacagagcaagaugacauaucucuguacuuggacuuacauauuaaaacacuuagagccugccuuauucuaaagaguuauggcuucagaucugugcugcuauuucuugauugguugcguggaguaguuguggaaaggcugucauguguuuggaaauggaggaguuaguacccgucuccuggcuuuaagccugacuggccaagauggaucucuuugacaaguugaccaaauuacccgucuugcacaguauagcauaacaaauucaugcauucauuguuacuguguguuguucaguuuccuuauagaaaugacuuccgaacccugcuugauucccaccuuugggacauuaugaccucuaugaggagccugggaucccgugaaacccaaagcaggauucuccagacaggcagaggugacgaaggcuuggguucuggagaacaucuguucuuuagguguuguggguucugccgcgagaccuuuggccugacauuccggugucagggucuugccgcacggucagguuuguauacaguggaguuaaauucuugugcuggagaaggacaguuguggugcgugucuucucagguucuuuagauucagaagugucggagacacuuggcgucacuaccucugcaugucacacgccuguguugugggagggaguaucauguuuucuaagaauucagguaaaugaucggagcaacaagaagacugcuaguacaguccugagcccgaagaacagggaguaagaauaauugucacagugauaugauaugcggguaggaggauuuuaacucuuuggauuuuccagguggagaggcaguugacgcuggcugauuuucaguuuuauugaaagaugccagccaaguauagaaagugauucagaaauaaaguaggucauuuuuacaucauguuuuuuuuuuucccuucaugcuucuaaucuauugaagauacauaaauaaaaauggucguuggagugcauugcuuugguucacaccuuuggaugcagaucuuuuagaagacagagcuacacaggacgccucuuuaauuuagagcucagguugggcucuguucuggugcugcucugcagugacuguccuaucgugggcaagugauuuauuuuugaaacuuaauuaaaaaguccuuucggcgagauuugauucacgucccuuacguuccacucauuugcuuuguauaauuugccgggcugugcugcugauuccaguuuuagaacccguuugucccuuggaaccuguucccgcuagcugucauccccaaucugcuagaucacaggaugacgccauguuuaacauuugagggacugccagauuguuucuauuuucuauucuuaccagccauguaugaaccuuccagugucuucugauccuucugauccaugugaacgugucuaauugucauugucaauauccucguguguuugaaagacuauacuuuugagguuuuugauggacauuuucuuaaugauuuaugaggcugaauaucuuccaugugucuguuggccuuuuguauauauucuucuagagaauuauacaacauauauuuuauuucugugaacuuuuuguuguugcuuaaccaccuuucagaugguaauaaaauuggugcuuuccuuguggaguuacuguaaggauuuagagagguaauauacgugagaugcucagagccucggcugccgucgagaagauccuuacucuuggcugugguuauuauagcaguuucuucauguggcuaaugcuuccuacugcuccuaaauucuccagugagaauuugaaaacucaacuucaguuccuaguucuaccaauccugucuuugcuccauaugcucaauugcuuguuuacuuguuccaaggccuuauugugauagaaucuagaaauaugaauuaacaaagugaaugucccccccacccccagcaagccuuuagacaguaccagaaaggcaaucagacagugguaugcucauuuauguaggcauugaguacugggcugugagaauagguggaggguuacacaaggcuuuguagucaagcuggaugguaaguaggagauucuucuccauacagcagccucaguguuguggacagaaauuguucaaaugcuuagcaaauauucaggguaaagugagacccucaggggacucuccccauggcaguggagacuagaggcucuuggccacuuccccugauuggguuugaaagucuccuagguaggaguuauuugccucauggagaagccugagcugaugcacaggccuaacauccuugaguggcacuaaaguggauaaacgcagugacucagagggaugcuggggcaaccaggagcucaaccuaugacaguguugucagggccuugccuuucugcagagucaucuucagugucaacagaaagaccaccgucuccaaaaagagguugcaucugaguaaggaugaucagaaaaaguagagucaggaaaucugucucuaccagguucuggggaucgggggauagguauguaguaggugaugccuucuuuuuggaagugaaggaggaugauugcugacaccuucccggcguuguagguaguaggugauggcaagcuaacgaugauucccaaggugguugauuacccagaggccuuugguaugagcaacaaaaguaaucuacauauccaacccaaaccuuggccuggcuccuuuuuacuuagagauccuuaagaaccuagagcuuucucacacguggaauaaaacaguaugcucgucaguucaaaaugcgauacagcagaaggagccagaguuaaaagcaaacagaguuuucacacaucuccauuccuuauucuauuugggucuuccauagugaaggaacccguucaugaguauggaaucaguuguuuauauagucauacacacucugcagcuuccggaaacgccaucccuugauuuggguuuguuuugggccuuguuuuauauaguuacugccgcggagaaauauuaauagcuucacuucagauaaacacaagugguuuugaggacuacaaguguuugugguguuuagguaauguaaguugauuuggcaaccaaauguuuuguguugcugggaagauacggaaguguagaauuacugcuuaguguuccauauguccucuuccucuuccucuuuuucauuucccguuuuucaagacaggguuucucucuguaacccaggcuguccuggaacuagcucucucuagaccaggcugggcuugaacucagagaucugccugugucugccucccaagcgcugggauuaaaggcgugcgcugccaccaucuggcucucuaugacuucuaaauuuccaccugcuccccugcuuacucuucucugaggguguccuuuuacucugagugggauccagaaguguuagcuugaaugggaaagcacuugauguuucugggccggguugacagauagaagugucuuuugaguuacaguguggauggccugucugugaugacagcagaggcuuucuuugucuuguuacuauuuaaguuggugaagguuauuuucaucaccaguaaaaacugacuugcucaaggguuucucaaccugugggucuugacucccuugggagucacacaucuaauauccugcaugucagcuauaugacuauacuauagcaaaaugaguuaugaaguaacaauggaguccauuuaugguuggcaucaccacaacaugaggaacuguauuaaaggguuguaucauuaggaagguugaaaaccacuggcuuacaacuaagccagaaaggaaggggauggaggagggagggcaggaagaggacagggcaggggagaggaauugacuacguccuagagaggggacagauuuugcuguaagacauuauuugccaauguuggugcuuucacgaaauaggggugugugcagguuugaaagagcaaggggagagaugcguguggggacagggguaacuggagguugucuuccgagagcuaggcagugugugcugucuuucuggaccugaacagaugacgucaugcuuguggggacaugguuauccauggagguuaugugccaagagcugggccgugugugcuggccuucugggcugaccugaacagaugacgucauguaaccuuucacuuuaaucauuacuuuuucccuuugaggacccagcaauuuguuugauggucuuguuuuauuuagcugauaguaggggguuugggcuuugccucugugauagccauuuucauacugaguggugagggugcauuucagggcugcaaggauggcguccuuucucuuuauaaugcuguauguucucguuugauuuucauggggccgaacucucugaauccuuuaucuauucgcugacuguuuuuaggucaccuacgaguugcuuggcuagauaucagguacugagaagauuaaaaaagaagacacugcagggccacgcuuugccagagagugagaucaggaacacgagccacauagucagagagcaguucacugcgacuuacuuuuuacuugcaguuuauacuguaaguuuaaauauucugggacgccagacuucauggcagcugucuuuugggagagacagaugcacuuugaaaaauucacuguaaaauacauuuuaaaagcaucuucuguguuuacuugucauuuugauuucaaaauugcuccauugagggaaaaaauguggcuguaaaaaccaguuuaaaguuugcagaaggaacaaguuauuaagaaaauagcaaaguaaauaaaguaaauaaauaaaggcuccagcagggagcuguguuugccucgcuagucugaccagaguucgagccccaggaucuucuguagcucacuaaaagcuccacagcgaucugacugggccagccaaggagagucacaacaauuggaaggaugcgacauucaaaagaagaucuugaagaaacaauuaaaauuugucauuuaaaauaucaugugguuuuugagaaagcauucaaguaaugacguuuuaaaaaugguuucucugauuuucucuaggugaaaaauagauguuuuaacucacugcuauugggauucuuuuaguuuccucaagguugaucaguuacagagucccaucucccgagauuauuauaaaggagcaacgaccuaggcgaugaugccuguguggugaagugggugagcuuaccugcagaaagcaguugucuuuucucuacuggaagguguuucauagcagccugauguguaggaagaagagaacauugguguuaaaauuuucuuauucucuuuugucaucuagguagaaaaaucaaaaaaauacuugcuucucucuugucuuugcucucucucgucuuugcgagugauugguauugauucuccagcuugacaagauugagaagcaccguggaugcaaaccaucgggcauguccgcaaggaauguccagaauagauuaauuggggugugaagauguaccccaaauaugaaugagacuauccugcuggcugggugccuggacagaauaaaaaggaagagagcugcuuacugaguucaucucuguacuuucugagugcggacacugagaccagcugccuuaccacuauggcuuccugccgcaagggauuauacccuugaaacguaaacccagacaacccguccuucauaaagcaacuucguuaaguugucgaguaguuuuuccagcagugcauaaagucaugaaugcauugacucuucucucugagaugaaaguauauaaguuuuaaaaaaaaucuauuuagauaggcauguuaccucccuaagagguugacaguuaaacagaccgugacuucagagcauuucagguuuuacauuauuugauaagguguggacaacccguucuguuauuuacucuuauuuuaguucagugaggucacacugcccacugucacguagcuaaacuacaguccagucccaggcucauguggcuguaguguugaugauuuauccacuacauuaaauucucuuaaaacuuuguugaugaaaaagcacagucuuagagaaauuaauugauaacgcauuauacacaacaaaaaaugaugcaccaugagaaaacucagugaguccaggugaguggugugagcagguagcucaccucagagagacuggaacgggaacgggaaugggcgugugacgauguucucauccgagcagucaugaggagggagcccagcaacacauacgccgagccucacaucucugccuggcagugcccacuggcgggaucagagguugguaggauccggauucagagcaacuuuuacacugccacaggaguguaacagcugcagccacuuuggagcgccauuguuaacguacaggaguguuagaggauguucucagaacucagccuucugugaagcuggacaggagagagacugacuggaaggaaagauggcgacacucucaccaugaacucuuuuauuuuggggaaauacagcuauguuuuuuuuuuuuuuguuguuguuguuuuuuguuuuccccaugaaaacaugcaugccaacgccuaggauguaggggguauaauuuuaaaaaacagauuaauaaguauuuuuaaaacguauuaauuuuaauuaaugaacuaucagauauaauugacauaaaagauccgugaguuccuuugguuggucuaaaucuggauaaagaccacaauguuuuggaaacuguuguaauauguaugcagggcaaguaaguauuguuguaguuuaacuuauaauaaauaguaagagcauuguaauuaacguaguggccauuauguagguuauagaacccauucugucaacauggaaagguaaaauaaauugugauuuaaauuaacacuaaaauugaacuguauguguauauauguaucugaacuauauaguauauuuaugaggcaguauuuacucaaggguuagauggaauggauguuuaaauaauauaaucauauuugugucuauaaauauguaguauaauuaaauauucauauguaaauuauaaaaacagguuuuaguagcuucauacugauuuuuuuuuuaauuuuaauuuuuuuuuuuaaugagacaaggucucacuguguaguccuggcugaccuagaacuugcuuuguagaugggccucuaacacacaagagguccugcccccucugccuucugagugaugggauugaagucagugcuaucaugacugguuugcccucaaucugaccucaaggcagaaaccaaagggaugauagaacauacugcuauauuugagaagaaaacauuaauggucuagagguuuuagcuuggucuuagaaccuucacauagguggugugaaggacugaguucuuaggaaagaaaagaaaaacaaucuuuaaaaaguaauaaaaaguugaauaugugggacuugauauucuagaauguaaaacaucauugguguguuauuuaaagcucacuggaauuuucccugugguaccuauaguguuuaguuauuuuggcuccagcuuuuguguguguguguguguguguguguguguguguauguauguguguguguguuuguguauguauuugugugucugucuugucugucuguaucuauguuuugccagaaauucaguauagagagcaucacuaaguuucaauuacuagcuagcaaagugaccuacaacuuguaaaaccuuguagccgaugauuguucauauaauggggaaaguuuaaaucuguggucuugggaaaaaauguuaauuugcuccuaaacuuguuacagaugccuugcacaaggcaaacggaagguauaagucauaauugccuuuuaauauccucggagauuuaauagucuccccuggcuuuaagguccauaaaggaaguaugcauaaaacacuuuuacugcuuacaaguuagcucuugaucagacaguuaaaucagccauugcacugaauugguagaagcuucagugaauguccacugagcaguggggugcaggcugccaggcaacauucaaaacuagggucccaugcuguugguccacucgaauuuuaaagugauacuuguugucuuagucaggguuucuauuccugcacaaacaucaugacccagcagcaagcuggggaggaaaggguuuauucagcuuacacauccacacugauguucaccaccaaggaagucauuacuggaacucaagcaggucaggaaacaggagcugauucagaggccauggagggauguucuuuacuggcuugcuccccuggcuugcucagccugcucucuuauagaaccaagacuaccagggcagggauggucccacccacaaggggcccugcccccuugaucacuaauugagaaaaugccccacagcuggaucucauggaggcacuuccccaguuaagcuccuuuuucgaugauaacuccagccugugucaaguugacacauaaaaccaaccagcacacuuguaaaucauccguuugacggaaugaguggacauugcuagacguauguagauuuugcucccagcugcccugggagaggcauguacaaacaucuuccccuuuuccuuucugauguggcauaucuaucuacuugcauaucuaucuacuuagaugaaauuaucuuaugugacauagacuuaaauuacaaguucuuugaagauccacucagcugauucucuuucucucuccauggcagauagucuguuuuguguucaccaucuugcauucacuuuguagaucaccucccauggucugcagagucgcucaugccugcuuugugagccuucucugucaguagugaguagguuuacgcuucagaaugugaacucagaucgacgaagggcuuaccuuugcaugcuuucacugggguccggagcggaacacuggcguuuguguaccucuuguuagcauguuugccacaaagaugauggcuuugauuuagguaucugaggacaguggauagccgccucccugacuaacgcgacccagauauuugcugugccuuuguuugagaguuagugaggacuuaaaugacuuguuuuccuucuaggaggguuuggugccagugaaucggagauucaauuucccugaaauauuagucauuaugguuucuuacucucuguuuuauaugcucgaauugugaaauaaagcgacagggaacaggggagaacaaaccuaaaucaguucuauuuuccuuuucucauggaguuacauuauuuugaccacaucuguugcuuuguauuaaaaaucauuuguuaguuauauggauggacgagugaaucucuuuaauuuugaaaaaggccuuugggcucaaaccagcauaauuacuauuuggcaacaaaaaaauuuggaagaucccaucucuaaauuguuuugaauauucaagcuaaagggagaucuuauguuuagcauuuucaagcaucuuuuuguuuaguuagaguuacaguaauuucccuacucuggaagaauagcaagauuuuaauugagauaaucuauuuuuucggaguauagaauuuccacgaagaaacagccaagcccuuggccacauggcauuaccauuuuuaauggaacccaaugcuuagauuucaaugauauaagcuuggaaauuuuguaaagauccauuauuauuaugaaaauaaucugaacuuuacuuaccuuucuccauguuaaaaaacaaaaaggcuuccccaccccaccucccaugagauuuauccuugaaaggugcucgccuuagcauucaggaccccucacaugccuuuucccuggggcuuauuuuggaccucacuaucuugagcagcauuuuccuaggagaccccuucuuacaacugguuugaagguguguggugaugagucaguccacccaaaucagggcuuuuucucuggcaauuuagaguaauggaaguuuuagccaguucucauguuucucaucucagauuucuuucccagggucuccugggccaaccaaccacacacugagucuuggguuuugauuauuuuauucagcuuacuacaggccgcuggguguuagucuuaaaccugagggguguguauauguguguauggagggguauugcaaggacccaugcucacugcagagguguuucugagucuaccagguuguguugcucagggguggguguaccuuagagaaggaaggacuacugacuucauguguugcuauagucagagcuggaccuggagacucagugguaguuacgccaggugucuuacaugaugggccauccacacaggacauuucuagagaagcaagaaaaucauuuaggggcuggagagauggcucagugguuaagagcacuaacugcucuuccagagguccugaguuucgcuugaguucugccacauucagaaaaagccucuugauuuagauaaaaucgguccuuuauuuauuucuauucacuguuucuccuuuuagcaccaggaauugccuaaaauaagcagucccucuucugaagauugcuaguuaguucugguuuugauuugaugugugcauuuguuuuauuuuuucauugcugcuuucaagaaaugcagcuuuguuuuucauuuggauugaaugauacgcuuuuaaggaaagacggagggacgaggauguuuucuaaagugccugcgggccuugacuccccccccccccccuucugcuguucaggaguuucucagcagggguccuuaccccuagcuccaagcucaccccaagaguaaaguucugcaugggaucagugacuggucugguccaaacagggccuuaacuuuucucuuggauucaguaaacacuauuuuggaaacccgaggauuaaaaaucuacuuacuugcuuauaaaaauugugauuaucuaaauaagcgucauacaugggacuuccggcaaaagcaagcaggaguuacuuuauccaguuaucagcccuucuugcuuagugagccacagugccaugugcuaaggugugcuggagcugcuuguugugagccguggaagggagacggggagcagguucggguacuggccgcugcucgccgccaguguucuuagaucucucaguugcagucacuguuucuuagaagcgaacacaagcacucuguguagucggggaucguuauuuccagucaccagaaguaaccucuggacgagacagacaaagaaaggagaguauaaggggguggcugcaucugaggaggugaguuuggugccagcagucuugugguccucccauccucuccccgauguucguccgaccuucucagacuagcucaucacacucuacacuggcuaacuuuucaaagauuuggcuuacuuuugcuuauuauggaaggacagcuuuuuacucuuauuuccuccugcgaugcuauugacugaagucagaucucagagucauuggcgguuguuucuguugacucgugucuugaguuuguuguagauguagguggcuagugagagugguagucaggccuggagaggcagguuccucgugcuguuguuccccagcguugcuuugacaucaugauggaaucuuggguaguauuuucuuucuugugucaugucuuaguuaggguuuuacugcugugagcaaacaucaugaccaagguaagcaagucuuauagggacaacauuuaauuggggcuggcuuacagguucagagguucaguccauuaucauuaagguggggguguggcagcauccagguaugcaugacacaggacgaacagagagcucuacauuuucaucugaaggcugcuagcagaguucugacuuccaggcaacuaggaugagggucuuaaagcccacaccuacuccaacagggucacaccuccuaauagugcuauucccuaggcuaagcauguacaaaccuucacaugucauuaaugcagucuguuguaguguuauguacuauuucauuuaaaacauuugucuuacaauuguaguuuugacucuuugaccuccuugguuuucuauuauucuaacauuuguguguuugcuauuguuuguuuguuugauuuugagauagugucucagaaguaauccuccugccucugccuucugagugcuuggauuacagaugugcaucacugucuggcucucauugaaguucuugguuugcguguuucagguuuuccccuuuuacaugaguauuuaagguuaacauuuucuguguuauuuuuaguacaaguugaggcauuuccuuaauuauuaacuuaaaauaucucuucuuuucuccacugugacucuucaguucuucaggcuauguagaagcuugccccacucagaagagauuguauuggguuuuuaaaaaauacauuucuaguuccuccauuguuagagaaaaugacugguauuucuaacaaggcuguccuuacccuugcagagucaccugacacaugacagucacuucaugcuuccaagcugauuuauacucugguaucuacuuuuuuuuuuuuuuuaaagacagaguuucacauguagcucuggcuguccuggaacucacuauguagaugacgcagguuuaucacagacauccuccugccucugccucugccucugcugggauaacaggcauguggcaccguaccuggguagcaacuacuuuugaucuuuugaaaauguacuaaguauuucuaacauggacauaauaauacugcccaccguauaggacuccuucaaguucggcacgagcuaauagaugaacagcauggcaccgugcccugcacagcagcaagcgcucacacugcgucauucuguuuucccaucgaccccguuacucucuggcaguuaguuggugcuuuggccugccccgacuguccaccccuccacugucuucucuguuggcuaauguuaccgggcuuauuuuaauuuuaugauucagccuuuuaaaugucugguuuuguugcucagguaacuugggaaaaacaucucugaugccuuucagucuuaauccugccugucugaaguaggauuuaguggaguuucuaaaucauuucuuagcagggcuauguuauuaaguuggauaagccaggaccuaggauguaugacuuugggagucuuggggagaugacucauagccuuguuuuaaaaaaaauauuuaaaguguacagaguacaguuugaagauccacagccagaugauugaaaccuuaagcacuuuaaaaccugagacauuuugagcguccacaugaugguagaagauccaacgcugaccuuauauaucaggucaaucacgagugugcuaaaaaugcaauugcuucaggcuaggugcacaaaguaugcauggaauggaaaugaagcugauguuuagaauugguugccaucucuaaaacaucucaucagcucaguuaaaauacuguaguaucagaacaguccaaaauucuaaauacucaucuugucccauacacgucagauaagagaaucccaauguccgucugguauuguauuugacuuuggauucccuauggcgacaguaauguucccgugaaaggaggcuggaugucuagauaagaauacaguuaaauaguaaguuuagcuugaaaagaagauuaguggugauguuggcuuuauagcaugugaauagucugcugcuuuuguuguuguuaccagggcuuuauuaucagacuucagacauagugggcacugagcuuugugugaccaccccagaugugacuguuccuaaugccacugaacucuguacuugaaaauagcagguuaaaaugauaaauucacgcugaauaucuuuguugucuggcuuuucuuugggagauggaacuguuccguccuagauagagagggugcugaccaaccaaagaaaggauugcacccaaacucagcuugcugagccagugaguuuauugacuuauaggaacccggcuaacugacagacagcuacgaugucagguuacccaugacgugccuuguggaaaagcuaauagcacagagaaguccuaccuuauccaaaccauuugcuuacguagugguggguagaauucuggggaguggaugggucugacagggucuccugggucucauguuguccucucucuggaucucuugagggauuuugugcacauugccauagcugcucggcuucacaauaaagauguucaccaucaaacugggguauuagcugucucacagugguauaccacagccuaaccaaagagcaucgccuggaccgugaaagaggauguucagccauuuaaaaauccaaaucuugacucguguguguguguguguguguguguguguguguguguguaaguguaaacagugccuguuuaccugagcuugugccuggaugccggagaccaccuuuaugugucuuccuuuauugcucuccaccuuauuuacauacagacuuucucacugcucauggaugucacugcuguggcugggcugacuauggccggcaugcagugggauccauaugcuuccucucuugcuagcaguggggauguaggcacacacagcuacauccagcuucuauguaggugcugagaugccaaacucagguccucaugcuugagcaacaagcaccauuccagcuccuaaagaaaucuaagucuucaaggaugugccgugaugugagcagaacugugggcaucaacgugcugacguggguuuucugucugcagccgcacguuucuuacuuauuuucuaacacagaacaacuuguucuuugcaggaaggagaagcugaugcguuguucucaaugccgaauugccaaauacugcagugccaagugucagguaagacuauugcgcuguucauggaaggcuucaaacccuccaccucugcauuucgucuccguugugccccagggccuguuucgucuuuccuuucaucucuuguaaagacaaaaccagagcagugauuccuuuuuuaacugguuauuuuuccuuuaguuuuaaauucaauauuuguacaguuugaauaggcuuugucaaggaagggagggaaggaaagaaggagagagagagagagagagagagagagagagagagagagagagagagagagagcgagcacuagcugcacauuaaucaaagccaggcacucauugaccauuucuaccccaacacaaccuccuauugccccuuuagcuaugacucaaauggauuauuucacugaugacaucagugccuucacgacccaggcaccuaccaguagcaccagcuggggaccaagucuuuaauagccacacauguggugguacauuucauuuugaaaccaucacaccauucauuguuaaguuuucugugcaggcauaucugagaucauauauguuuauaaaaacagauacaguuguuuugcuacaaguucuucuaugccuucauuuccuuuuucauauuuagagauuauuuuauaucaccuaauauauaugauauuuaccaugaucauaauuuccucauuaaugaaaguuuagauuuuccccaaaauagauauuauuaauaaaguaucuaagauuauuuuuguaauuuuuguguacuuguaaaauuuaauuuaaugauaaauuucuaaucauauuuuuuuagugaaaacauauaugcauuuugaauuuuuaaagauaaugccaaauugccuuccuaaagauuaaauuaauuuguaaugaguaagguuguuaauaucuuuggaauucuuuuaaggauguauaauuaacauucaacaugaccuuuucuucaaaucuuuugauuaaucauuuaauaagaaguauaauuaugcucuaaugaauuguaucauuaaaaagucuaauugaaacuuggauguccguguggucccaugcucauucuuauuuugggauaugcgugugcucuuguguguuuaugugcacagacacucaugugggaugugugugugcucacuaguguguuccugugcacaagcacucucuuggaguucucauuuuuucaguguggaccuuuuuuuuucagguauuuauuuauuuauugcuaucucauuuuucucuuuugaaauuaguuucuucaggauacaaauaaaaugauuuuaaugggaaaaauccauuguuggauaaugucagagcauccaaguucccacguuacuucugccacuuucuaguuaaguaauuucauaggaaacauagggccggguuggagagauggcucagcguuaagagcacugucugcucuuccagagguccugaguucaauuuccagcagccacaugguggcucacaaccaucugcaguggggucugaugcccucuuguggugugucuaaagagaucaaugguguaaucauauacauaaaauaaauaaauaaauaaaucuuuuauuugaaaagaaagaaaggaagaaagaaagagagagagaaacaaacaaacaaacaaacauagggccaggccuuguuucugagucuguacugaugagagcuaauaucuuacagacaucugcuguguguaagcuguuaauaagaaucuugaguaaaagccuggcagugguggugaacgccuuuaaugucagcacuugggaggcagaggcagguggauuucugaguucaaggccagccuggucuacagagugaguuccaggacagccagggcuacacagagaaacccugucucaaaaaaaacaaaaacaaaaacaaaacaaaaagaaucuuugaguaaauuagcuacaggugacacacucaccuuaccaguaaggaaagagcucagaaaagcaguaaauugcuuuguauuucauaauugauacucucuggauuuugggaaaugaauguauaugaaguuuccagauuuuauauuuaccuuguaaauguaaauuuuauucuugcuggaacauucugauuauaucugccguucuauucucuguuguguuugugcuuuguuucuuggccccuuacuuucacugugaugcuuggucccuccaccuguuuuauauuguguucaaaagacacagaauggaaacauuuuaaaauugaaaacaagagccaaggagaugguucaguggguaaugccggcaagugugagcgagcaccugaguucagaccaucagcuaugaaaguauguaucuguaaccugaaacucugugggaauggagacaggcuugggaguggagacugaagcucauuggccagccagccuagcugccauccaugaacuucaggcucaggaagggacugugucuccaaaauuaaagguagagagcaauuaaggaaagauggucuaguucauccuuggcccucuacacauaugugccuguacacgcauguauaucuucacacacaagcacaagucuuauguaggaacaaugugcacacacacacagaaauauaaaaguucaacaugcuccugauaagauauaaauauuaaaaaauacuuuuauuuuuuauuucacuuuuuacaacaaauacuuugucauagugauaucucagcuuucuuguacaaaaucauaaacaguaacuacaguagaaagcagggggagagagagagagagagagagaaagccacccuagggguugacaguuacaguugacaaauccauauaccuuaggguaauucaaugucuaugcauacuuaucugaucgaaugcucuucuagacagaggguauauuuuauuuuccucaaauuuaaaaauuuagcuguucauuuauaaaguuuuaaauguaauuuacccacugucaauuugccuuauauccagugauuuaccuuagcugcaaauauaugacuguaaacagaaauauaagauuauaagcaguaacuacaauggaaagcagagagagagagagagagcgaaagagacagagaacacaaaugccuuuccucucaagauaaaucauagaaaaucuauuuugugguuauauuuuagcccaucccuacccccuggcaaaauguggcuccccauuuccguaaaugucuggucagguguaauguguauagaaaugaugaauuaacauacuauuugacauacaucuuuuggaaauuauuucuaaucucagcggcccaagccuuuauuuuuccuuucccccauuuuugcaaauauguuuucuccgaggcuacuuucuccaguuguaauaauacagagagagaaggaaaaaaaaacccauuaucugauuagaagaaguagagggaguuuggugugcggguaugccacuuugauucaucguaguguauauauuuuauuacauauauuuguuauucacuguagcaucaauaacagugucgucguuagauauaaugugcaagguaaugggaaaagagccaguaagaugaaauauacgaugccagcuagaauauauguuugugggcuuguggggaguugcguggguguggaggugggagucaaagacuggcuggaacauaugcauuuaaacugcuccgguuauccgccccuuaagguacagagcuaaccgcuguaauuauugaggauacuauaaagcugcacagaguuaaacugacaaacugaacuauaaggacgauaaacagugcugaacaggaaguaagggcaaacagaacggagacugauguagggaaugugacucuguaggagaaaaccacguuugucucugagggaugcaaccggcuggcaacugagcauuuaccugugccuguggugucagcacguugucuuucugcucaaaggauacugccaucgccauuagcauuuacauuuccuuuuuaagcauaaagcacaagaacguauuuucaucauagaaaugaaggaacaggacugagacaauggacauuuucucuuuuuacuucuguuccuuuagagagaaugauucuuuuuuugugaaugcaguaggcugcaaaaccgguuccuccaaguuuccuaugcacucugccagucuguccauccaccacucacagcugagcaugcauauaguguuguuccugguccugacaagauuuauucuuuuucuuuggugacugugagcuccugccugugccugaugguggcacauccauccuaucauuuccuagugugggaacccgccuccauauugguauaauggaccaccccagaugauucagagacugaaaaggaagaacggacuguuuuauuauuaagaaauguaaaaacugaccagguuauuggaagcaaguaaaccaaucucaagcaaacucccuccccgaguaguauuuuaccuuuccuggacuuagcugacgucugauaauuacauucaaagugaacucauugcuaaauaaagcacaugauucuagaucacauuuccgauuaugaucuuaggaaaggcacuacauuugcauagagagguucuauuucauauuugcaacuauauaucuccuuacacacaugaaucauauuuuugggucagcauuucauuugugguuaucaaaugauuugauuuauuuuuacaguagaaaacucuuccuaugucaguaagccuuucacagggugauuuuaucaguuguuucugcaguacuguucuucaguagagguguguguggggggugcuaaacaaagcuaaaccucuugauuauuuuaggaauaguuguguuucaggccucaggcugagaggguuugcugugcuguggaugguccugaugcuguuuguauuuugaugcuaauuccauuuucccaggaggggcuguggaugaggagugagucgugcacauaggugacuucuugcgaaccuucuccccaccuuaacuuguaaaauaaaggcuagagccggugauugggcagcggaagggaagguggagcugaaaaguuugggggagaaggaggagaggggagagaggaugaggaggagaaagaaggaaggaagaugaaggaaucugggcgauccagauuccgagugucuuugaauagccagggguagcuaugaauuauuauauaagggauggaaaaauuacagggcaauuugucuuaucuagguggacaguuuauaucaauaucaguuggcucugaaauuauugugugggcaucuugugaauugagaauuuauugauauauaaaucugacugaugaauuauaagcuucuagaguuuugauuuacucuguuaaggggauuugugacaacuggguacaggggguagauggcuaagaagguaugggcaguucugaggcaggcaaacuggaccugggaagaccuccgccucgggcuaaccuagaggcagagagaccagggccagagaguagcuggguauagaguggguuggugcagauuuuuuaaauauuucccacaacacuccagaguuguuuuuguuuguuuguuucuuuuguuuaucuguuuuuuugagacacgguuucucuguguagcccuguuuuggauuuguucuguagaccagucuggcccugaacucaaaagagauccacuugccucugaguacugggacuaaaggugugcaccaccaaccaccuguauuuggagaguuauuuauggugccuccuuacaaucucaguggugccuggcauucacagugacucuguuauacuguaucaagaucugucauagcuguuacuguuuccuaguucuucugcuuuucuuauuuuugucuuuuauuauuucccugccuuuuguagucuuugguuaaacauuuuguucacagugauuccauuuuuuugucuucccugugcuuuuuuguuuucugagaucgggucuuaccauguagcccacacuggcuucaauucauauaucccaagauagcuuaucuaagauguuccugcaauagccucuaaguacuuggauaacagguguaugucauaugcccccucuuuagggaaagcaccugucuguguaagaguaggaccaaguagaagaccauaguggucuggauggucuuagcauuauauuuaaacuggacuuuucaccuuaacucuccauugcuuagucuaaaucaugccaguaguagggagauauuuuaagauacuuuagcaauauaggcuuuugggguguuaacucccucuguucccccucacacucacacccccccucacccuguaugccccagcccugcaugucuccaucaguuacacaggcuugcuuguuugcuuccucccucccuccuucccucucucccucccuccuacccucucucuuucuuucuuagauuuauuuauuuuauguauauuauacuguugcugucuucagagacaccagaagagggcaucagaucauauugcaguuguuugugugucaccaugugguuacuggaauuugaacucaggaccuucagaagagcagucagugcucuuaaccgcugagccaucucuccagcccuugaaagaaaucuucaugcaagaauuugaucaauacccuuuaguuguagcuguuagacagccuguuccacaucuacuuucuauuuccaaauuccagcuuuggggaucuucacaccucugagggccugugguccaacguugggccuuuuaaagcacagagguugagcucucacuugcuaccaagcccucuugaguggaaugcaaaccuucaggucuucucuagucuagauuguagggcagcucacuuacuuugaguugugcucuuaggaaacccuuguagaugccuguuugucagugucaggaggcauauguugaaugccuugcagugauugaaaguaguccagagccuggggagauaacuuagcagcuaaaggcauuuacugccaacccugacgcccaagauccaccuggacgucacgccugcaaguugucuguucuucugccuccacacauccacugugggcaugugcauauguuuauacauacacaugugcacauacacaccuuaauuaauaaauguaauaaaaaaguucagauaaccauuuuuaucucaugaauagacaguuucuagggaaguuguuagggcauuuaaacagguauguuuggcacauguaggguuauucuagguuugagauuuuuagccuuucucagacccaccuccacaauuuaugauggcuauguuucuugcccccuuuaauauacugaaaugaaauuauacagguaaugcagucuauguaaguuuguauaucuauuauauacuuuuuuuuuuguuuguuuguuuguuuguuuuugagacaggguuucucuguguagcccuggcuguccuggagcucacucccuagagcagacuggccuugaacuuagagaucugccugccucugcuuccugagugcugggauuaaaggugugcacuaccacacccagcucaaauuuguauguucauaaggagaaagaaaauaaagucuaacaaaaauauugugucuuguuauauaaauaguuaggcaugacuagacuggaagucauaguuaguuauagacuggcaaauacacagagccacucugagaaggaagaggagauguauaaccgaaagucuccuggauuggcaaaucugauauagcaggagcuauggccuuagcggauacagcuuuauaaaacaugaacugacuuuagaaaaagucucaaagucuucccuugacuugacaacgacaaaauucaacacuguuaggacuauguaaaaacaagcaaaccaaaguuuauucuaggcugagcccauuagaaacauuucuaccuucacagaauaucucaaaggauguaugaaacuuuguguugccuuugggauucguuuuucucuuguggacguguccuccaugggaggucuggauucucauuuucugcuaauuaaaugucagucaugcacuacagcaucacaccaaauaaaaacaacaguuuccagggcaaccuuccugcaauauugguacuguccucauugggaacuccucauguaauuaguuuguaacaguuacaaauacuguacaaggcacggagacgugcaguuucugaaguuauuuuucgagucuggaauacucugacacauggaauucuacugcagauuuugacuuccuuuucucaucugaaacccaagucuucugcuguuuuuggcucuuaaugcaacacuuguuuuuccuugaucuuccauggccccuuuguacuuguuguauagcauuguuaauuuugaucuuugagaacagaaaacaucccagccaguguugugaacaaacuuaauuguguucuugguuggcaguggagggagaauauaggaaaguuggccauccuuugagaaacugguggacauggaaguccagugugccauuaaagggcccaacuaaggugagggaggauagugccaguguuucuuagugucuuugcacacggaguugcuuaguagacucaugggugggcuuauauuuauaagauuuaugcugaguccaagcagcaggucugagaaaaauacuguuuuaaaaaccguauuuuuuuuuuuuuuguuuuuuguuuuuuuuuuuuuuuuuugggggggggggguuucgagacaggguuucucuguguagcccuggcuguccuggagcucacuuuucagaccaggcuggccucgaacucagaaauccgccugccucugccucccgagugcugggauuaaaggcgugcgccaccacgcccggcuaaaaaccguauuuuuaucaucgugguuagaagaaguggaguagacugagacuuccgucuaacgugaaacauuuccaaguggugcgaucacguucuauguuuacucacggucuauguuuacgacuaaugguuugauccugcuuuugggcagacuaaaggcaaugaacuucuaugauccucuaaauccagugggaggaucagcaggcugcucgcuauuuucacggaaugacgcaagaauagaacgaagggacauuuuucccagugucuguuuauuauuuagauagagcagcauuaauuauguuaaagaccagauguuacuuuugacaagaauucucuaaacuuuggaugcuucauuuaaaccagugccaauuaccugguuacuugguccacuuucugaaguguguuuggcugccaagucuccaaguugaucguaccuugaugaugaugaugaugauccauuacauccccauugcacuuuucccuuccuccacaaagagcaugccuacuuagggauaucaaccaaacacagucuaacaaguuacauacgcuaagaccaggcacaaacccuccugucaaggcuggaugaggcaacccaggaagagaaaaagggucucaagaguaggcaaaagagucaaagcaaccuuccccccaccccccacgcccaccauguaguuuaguacugcaguuucuugucugaauaaagggcucugcacuggccugcuuaacccauucuaacuggaagaccagauggaaguacccacuucacaucuuagucaguguauaucagcccuguacccgaggauggcuggcagugacagucaugggauucugcgucucauaauuuacacacguuuguuugacucauuugaauguuuaguagaugaauuugcuaagcagguuacugcguuuuuuuaaaacuuaucugacaaugaagcaguauacucuuugaacaccuuguacaucuucguaacugacaguugcuagcuaggucaguacuuguuccuacgcaacaagcuuuuucguuccacugaauuagauacuucagguaaugacugguguuauguaaaugcccaagaugccauuauaguuguaaacauaagcauugugaaaagacacaguccaguaugaugaucagccuucuuggaauacauucuccugugauuuaguauuuaguaacauaugucuuccuuucuacuagaugagaauuauggaagucauuaugcucuguuucugccuagcuuauaaagcaacuuaaauaaauguacaaacauggcagucauguaguggccaugugagcacgccaagggcuucacuauccuugcuuauauuuaaagaguuuguuuuuaagucccagaucaugagccuuacuucauguuucuucuguuaaagacuauuucuuuuuucuuucuucccccucaccucccagcccccuacuucuagauaggguuucucuguguagcccuggcuguccuggacagagaacucucucuguagaccaagcuggccuugaacucacagagaccugccugccucugccuccugagugcugggauuaaagaugugugucaccacugcccagcacaaccuauuuuuugcaugaccaucauugucucaugaagcacaaguugacuugaacauagucaagguggcuucaaacuccuaaucugcugucuucagccuccugugugacuggauuauaggcacauuaaacuagcucucuuucuuuuuguucuuuuccuuugcuucucccucucuucuuccucucccuccccuucuccuccuccucccccuccuccccccuucuuuucccuuucccuccccuuccccucccuuucaccccauccucucccucucccucucuccuugguagcagcaggacuugagccaaggcugcuucaugcucagcucuucgccuacuucuuuacauggaacuaguguaguccugcugggugugagugagguguaagcaguggaaugaaggaugacaaaaagcaucaaacaaugaucaucuuagucaacaugagcagcuaacacugaauggaguugaaguggaagcggugggcuugcaaacaguguuucucuaacccccgcuuaugagagggcuggccaggcuaacccaggaagucuuuuguagcaaagggcucacgagaacacaguaugaguuagauguauaauuuuuauguguguggcaucagauauguccgcgauggaacuuaggaggcauuugcucuggcuguugcucuguccucaggauggcauccuucccuuuaguccacucacgucuagcuuugugaccuagcuccaaggcuauagacuuuuaugaaaaggaaucuuguauaguuuagccaggauauaaguaugaccucauacugucuugaacaaacuggacuuagggcuuagcuccuuucugggaugccuuugaggucugucaauauguagucuuuauaguuuugaaucuguuagcccaccugguauaucugacuuuuuacagcacaacucacgaugcuggcuucucugguuugauuuccccuagccccaugauuaacuuuucuagcuuugggugauucuuucuuuaaauacuauuguauacaccaccaaauauugaguuuaaguauuaagaaaggcgcacugguucuuacuauagagccucccagccuuguaaggaccaggcagauuuaaggacagcaugaagccgagguguuggugccuuuguuugauggcuacuuuccugacaaagacucaauucuggaucauaugcaguauuguaaaaugaauuuuguauuuuauaguucuacuuaggcuguuaggaguaaauucacgcuggugauucucaguguucaaaaccgguuggaaugaaaguugacuuccuuccccaaugccuuuccaugcucuugucuucacagaaaaaagccuggccggaccacagacgggaaugcaguugucuuaaaagcugcaagcccagauauccgcccgacuccgugagacuucugggcaggguuaucgucaagcuggugagcacacaucaggaaaggggccugggucugaucugacggaaagcaguugcuguuccuguucauauuuaaggcugagacugcacccauguuaagguggauggcggauuaucccaggcaguguguuaagauaagaaacguuccuauucgacauuggcuuuaugacagugacacgcauagucccuauaaguagagauaguauaaucucuuucuugaauagagucuugagguaacauauuagcaacuaguagaaauuauguuuccuuuguaacuuuuuccuaggaacacacugcauguaggagcgagcuuucauugucuuuucaaaugaggacauaauucgaugauaauauauuaaauugacaaguccaccaccaccuccuccuccuccuccuccuccuccuccuccuccucuucuuaaauagagccaggauuugucucugucucccauaauacagcagagucuagaaaccuacccugaagaagcuucuagaguguuccaugagggcuauagcauaaccaccucagauuuuuguagggccuaauuuuguuucuucacuuagucauuaacuuucgaauuuuuauuuuccuuuuucuccaccucaaacauuuauagaggcuuuuauagugggaacuucuuguaaaggagguuuuuauuggagauaaaacugcuuaggugaaguugcaagacuuuaaaacuguuacuaagcaauuuaaaaaagagcgcuguagagaccuggaggcaugacuagggggcggugugugugugugcacgcgcuagcuguccagcccaaugauggucuguuucuggggccuaucaaugggaggaggggacugacuucugacuguugcccuuuaaccuacacacacacacacacacacacacaaauaaaugcuuucaauguuaugaagaaaaagugauauauaaaaaaaugaucuuuuaaaaauauaauuguagcuggguguggugauucacaccucuaaucccagcacucaugagacaucuuguggaccucuugugauccaggccagccuggucuacagaguacuuuuccaggacagccagggcuacauagugauguagugguauaucaugucucaaaacaagcaaucaaacaaaaacuuucaucagacuaucccaaguguaaggaaagcugcauaauuaucuauugaggcacugaccuuguuuuugguguuuucuccuuuuccuucacagauggaugaaaagcccucagagucagagaaacuuuauucauuuuaugaucuggaguccaguaagugauuauucauuagaauccuaaaauuaauucuaucaguuaucugcugaacucucccaccccaguuuuucucaucuuuacagagguucagucuagggcagcuguucucaaccuguggguuauaaccacugaaaagcacguauuuccaauggucuuaggaacuuagcaaaauuacaguuauaaaguggcaaugaaaauaauuuuauggcuuggggugggggggucaccacaacaugaggaacuguaguaaagggucucugucuucuucuuuuuuuaagacuuauuuauuauauguaaguacauuguagcugucuuuagacacaccgaagagggcaucagaucucauuuuggaugguugugauccaugugguugcugggauuugaacucaggaccuuugcaagagcagucagugcucuuaaccacugagccaucucuccagccccaaagugcccugggccuggcccaaucagccucucucaauccguguggaaucaggguuugggagagaugggcaaagaguuagcgagaauuugcaaacacaagugagugcuaaaucugaauguauuuuguccaaacgaacaccagacuuuuaauacagaagaaaaacaagaaagccaggcgaacacaucugccaaguuacauugacucaaaacaaaaagagugcauacauaaaaagauggcgggagccaggccacauuuaccacugagaauaggaacaacccuuaauuaaaaagaucagcuaaacacaggagccaggugaaugcucugaugcaauguuagucuauuguuaaacccaccaccagggguucuuuaguaaauaucugauuaugcuauuccucugggccuagugagaaaaccugcaccaggagaauucccuucuacuaacccuuucauucaacaacccaccuauuccuaggccauuguguauuccuguguuugggugugauucagcuauuguccuaaguaauuacuaugcagacuagcccugagcuuuucuagcucuguucgaguaaauuauaaugccuaauuaguuucacugucucuacuagaagugaauuugaauguuacugaauagguaacauucuuacugaauuccaagaucagggucagccucaagaauuuucuaggaaccauuggaacccugguggaggcuuagcuauaugucauauacugaauacugaaagagagcacacggauccaaacaccagacuaaugcagugacagguuuuugaguauacgggcuaugggaaugccaagguuccaggaggcaaaguuuccuugaaacucuuugccucaggacugcuuccaggcuuucaggccuguaaugugugucaccgcuggaguagauguagcaccaaagagucucagccuuaggaagguugaguacugcugcuguccgaccucacucaugaugagcacacaguuacccccugaguugccuucacagacugcuuuuaauaacaauguugcucuucuauguuuauuacaugaaucaaacgcaaagaaauguuuguuuuuauaaacagcuaacacaugauuuuguuuaauagguucuaggguagauugggccucauauagguuugugaagcucuacaguagacagaauagugucguugggcacgugaacccaucugcauaggaaacugugcuagaggguugcuacugucaagaauuaauaaacuugggagaauguuaggguuuuucuuuugaguucuuuuucaugucuuuauuguaaacacuauacaagucuuuuuuuuuuuuuucacgaauaagugaaacucugcauugaaaguaggaaguucugaccuuuuaaugacagcagaagagcccuugcuuuauucuuagacaccucaagcaggaaccaucagccaagcugucccuuuucuagucucuggcuggauugugcuuauccaagugaggaugguuugaacauuuaaugaucacuucuagaaugcuccagcuagaaugacucccaugucaggaggucuuccuccaguaacagucacuccaggcauacugcacuggcccgagaaugcaguauccugaccaagccuuggugaacuuucgaugaccccauagcuguucucauucaacaugggagugggaacaccacuccaugaacucagaaaaagguguuccguugacuggggcaagaacuguuuuuugauugguacaaauucgauccuucauuugcauaccacacuuccuuuguuccuggcucaaucagcagcaggcugggcaucugcucuuuaagucagccagaagccuccuuccugugcuggcucuggugauuuuuuuuuuuuaaacauuuuagcccaguuaaaagcauuucccaaauggacuucucuugccuaccugugauuuuuuaucauguguagaauggacugagcugguaacaccaggaagaggugucaccaacugugaagggguaggcugacaagugacuggcucaggggcagagaguaaaggcaggguaacuguugaagaagccaagacuucagaaggcagugggcaagagacuaggggccuugaucuccggaagaguuccugguaaguugccacaccuugaaaagagaagguuccuacuucuaacaugccugagcucuauauggcuaacacuggaguccugaugcucgagagcugucaugccuaggugaugcugacugaugacagccgcuguugugucgagauggugcauagagccaaggauuuugcuugcugucuuguguugguuuggcagcacugagucagggcuguauuccucuaagcugugugguaaaucuucagcuucuaaggucuagagucaugcaccucuaguucuucagaauugaagcuauaaacuuuugaaucuguuaauccaacccauaauccuuugccauacaagggcaugcucaugauuuccucaugagcagaacugggagaaucuguguuuguuaguagcauagcuguuagucuaauugacccuuugucuuuuguuucuuccuucuuucaucuuuucucucucucucucucucucucucucucucucucucucucucucucucucucaagugacauagugaacggcaaucuagggaaccccauagugcccucaugccuuuagacauuaaggcaggucucgggugcagaagaccuaggcucugugauggucuuaggcauuguucuuucccucagcuaccauggugguugccaguugccauggaugccuucaggcuccccagauguggguucaagcacagucaggguuauuuugcuuuuguagagucaaaggucuucuucacugagcuuguaagugguuccagucucaaaccagcuagaacugguagacuacguuuguuacacaguuuaccuaccuaccauuuugguuggaguugaaugaggggaugauuucagcuuugcauuucuggggcccuagcugccaaugguaauauauuguuauuuaagagaucauggguuaauuauucuguuggacaaauaauuugaagaaaauaugcaaaccugacaugaagaagaguguuaguucaauuugaugugucuuuucaaguuuuaauagagaacuaauuauucauuuuucuuuguaguacugcuagauaauuaacaccauuuacacugaauuugacuauuaacauuagcccugcucaguagcaagccauuauauugccuuuggugaaauguucucagauguuauuagucugaugguucacucucagccuuaauauggcauguguaguauaauuuaaaccaauauucaaggaggucauauuaacuuuaaaaauauguguauuuuuuuauaaaaauauaauugacauguaaaguauuuauacaaaucuguggggucuaagauauguaauauaauaaauauauaacaguaaaaauaagguaauuagcauucaaaagucaaaaauguaucauuuguauguauugggaacccuuuggaaguuuagcagaaaugacucagcacaaguauacaauaaguaaugauggaaucagaauguccgaaauuuaucguuuuuauguuggaaacauuuaggcaauuuuuaucuaguaaggacuucagccugugcgcugcagaauggcaguacugaguccuccuagcugacugugcuuugguucccaugauccugccuucaucccacugcugugcccuuucuuacaucugaugaccacauuugacuuuagugagauccucuucugcccuguuuugcagagaccuuucacuucuuuggcuacauuccuuccuauauauuucauuuugggucacaauugugacucaaaguguuuuguuucuuuuguugucuaaguuuguugugaauguguaaaaagucuuaguaauuuuuaugccaguuuuguauccagaagcauuucagaaccauuguaucagucuuagcucuuuucuugugucuagaaucuuccucuguaacugaaacauaaagagaagaaccuguguuuguccagccuggaaauccuuccagguugagauuucucaggucauccauguuucuguuaugguucacauuuuauauggcaaauuacaguugcuuaaacuccaugugaacuuucaauaucuuguuuucugucuuuuuaaccuuucagauaauacuauuuaccagucaguugugaccuacaugugaguuauuauggggaaagucaguuuaaacucacugacuucauuaggauuuaugaugguagaguugugcucuauaagguaaaagaucuggcagugugcagcugauuuugguuuauuauauuuuuaaaacccguaugcaucuguuuaguuuuugauagccauuugauauauuuuguggguaaaguuggagagaauuuauaauguaauauguaucacgcuuuguaguugucaaaagaacaagauugucaggauagauugcgugucaugaaauaucuuguauagccagcauuugaacaccugagaauuauucauggcguucaguaggugauuauacuauuuguuuucuuuacaaaaagauauuagcaaacucacugaagauaagaaagagggccugaggcaacuugcaaugacuuuucaacauuucaugagagaggagauccaggaugcgucucagcugccgccuucuuuugaccuuuuugaagccuuugcaaaaguaaguuugaagcuucuucucuuggcugaugcugucagucagucccucacccucuguuuucuugucauuugcaaacaugccuaagccuugaugggguauugaggaccacuaaugccccgcaucacuccgcaucgcaacagggaacgaaagcucccaguggugccugcacugaaagggucuucaucucucuucugguugaucagugguuuuacuuggagauuccucguugccaauacuacagauaugcccgucagagaaucuguucccuuuuuucaaaagaacacagcauauauauuucauuacuuucuucugaaggauuucacuuuauuauuggauuuauucuuuauguugguuguuuuagccagcugaaacaaucuauuggaaucuauucugauuaauugauuuuuagaugauaugaaagcaugguaguuucugacuuaaaacaaucuaaagaguagauuagugaaauccgaggguaggguuagaaaacagauuuaaaaaaaauuuuuuuuuuaaauuuuugucuguuaguuggagcuaggcguuuucuuccgugaguuugcuuaggcacaggcagccgugauacagccgugugggauggcucggacccaggacuccacacucugcucuggaucuauugucuuuguccauuuauuuucagugguucucacauuuuacauuggaagacgaccuugcugcuuaccuugcaaauuguaaaacacacauuuuauaacaucccaugauuauuuuuaaggucugcuuucaaaacuaccuguuuuuuaaagaauuuaaaugggaucauuuggagcacuagagauuucuucuaguuuuuuuuccccccaaaguuauuuuuauucuguaaaguaugaucagugguuuucugauauugugaucacagcauuauaauuugguuugucuauaauuuuaaaguugauuaugguggcuacucugauugcuuguuucauauguauuugaaaaauuacagccuuuaguaguuuuguaccuauaguacacacagcuucugcaguguuaaacacugaagcagcggcauuugucuuaugauggcugguacaucauuccucacuuuaguaauauggcugcccucuggugucauuuguguuguugaaaaaucuuccauaaagugaguaauugugauuaauguucauguaaaaugucuuaaaauauugccaaauuuaaaaugugcgucauugccuuauuccuauuguuuauuguuaaacauuuuguuuuguuucuugagacagagucucucuguguagucuuagcuaaccaggaacuugcagagauccaccugccucuguuauugaguggauuaaaggcccgaggugucauugcuuggcucuuuaagcccuuuuuuuuuuuuuuuuuuuuuuuuuuuuggagacaggguuucucuguguaacagccuugacucuccuggaacccacuuuguagaccaggcuggccuggagcucuuagagagcuacuuuccucugccucccgagugcugagauuaaaggugugcaccaucacaccuggccuuguuaaacauuuuuaacgacacuuauuuuaugaaacuuuccccauguuguauaugaggaauauucuggcauugugaugaaaggccauuuguuuggacaaacuuuuaauaguaaucucuccucuuucccauauacucguaguugugcuuguuauaaaaguggaguguuuaggaauggggggagagcucagcuauacacacaagcaggcgcuccuccuuuccaaucuuagugcauaagaaguggugacaaguggaucugcccccccccccccauaaugguggcagaauaauggcuuucuucuguuagguucuuagaaugcaggaugugucuguuucuacagucuugguuuuugccuggcaagauuuccucgauguucuagagacccuacugagcaguuauguugugggucacagugaggaccucguccuugucacuugcuguuuagcaccagcaucgauuuugcuucuaccaccccacauaagcacacacaugaacagcauuaguguauagaucuuugguguuuccccugugauuuauaucccaauaaaucccaaugaaucuaaaucuugcuuguaaaauugaguaccacgacauauaggggcacagauucuuuuucccaguucagauaucagaggccccucacauggaaauagaaacugaccugaguuugagaagagaagacacacuggcagauuguccacgguggucuuggaaggcuggguacagagagugacagugcuggugaguggcagugcuggugagugcuggugaccauaacugagacuuagggacacacuuggccuccacaagagaagacuacaaagacuggaagagaggcucaguugugagauauuccagucaguuggaacaaaagcuggauguuugcuguuuucauagaugcuggcagccacugcgucuccagaauucucacccaagaagaauagauaccuugggauccaguggaugauggagaggcuggagaaaucacaaaauccuuuaacuguguaguaaugguuucuuuuuagguuuaagcuuauguuaaauuauguuaaguauauguucuucaggcuguaaaacuguggcgucucaggaucagcgcagguggugaccaucuuucccaauagcagaggcagcugaaggcacgagguggcuggagaugucagcgagucgauuauucacaugcucaccaaagauaagggcuuucucucccuuuugucuucuuccaagcgagcccccucccucccacuucucaccccccccccccacuucccauuccacacauuugucuucuacuuuuauuuccucaugaaguuucugguuagguucugaggugaauucuuccaggaguaauaggagcucuaauaaagucuucagaccgaguccuuaaacauuugcuccaaagguagaaaaggagucuacggcuaccuauaguuacuaacuuaucagaucagcaaaggucagacaccgagaggaccgauucauuuacuuguuuaaacauuuguuuucuaauuuuuauuaguucacguguacgggucucgccuucauguagcuaagugcaccacauguguucugugcccacgcaggccaggagacagggucggaucccuuggaacuggagcugcagacaguugugagcugcccugugggugcugggaaucaaaccuggguccuuuggaagagcagcacucuuaaccccugagcugucucugcagcuccgagaggacagauuuaaaaggagaccgugugguuuagcaguuaagucaucuucuucaagcaagaagugaauuucuccugaucugugcuuaucuguacauuuguauauguguauauauguuucugcuuauuuguacauaggaauaauaauaucaucuucuuuguggauaaaacugaggacuaaguguaaguugcucgguaggauagcuggcacacacuaggaaugucugcugcuguugcuccaccuuccugcguuauugguauuugaguauaaaaugucagcguuuaugccucccagugcugucauucagcgcugagcacaggcggccacugauuguaaaccagaguuucagacggcugcccgccgcugugcucagggccggugucucuugagaugcugugaauuaccugucucgaugagaagaaauuucgcagacagaaaagaguaucucugcccucguaagcuguuuuuguuuuaguccagaguuuauuguggcaaaaauucacuucugccuucacucgcugcagcacacugauugcggagcgauuuugggggcauaucuguaggcgcugugaaaagcagguugugagugagcucuauuccccacuuguaccccaagcggugaaaacuaaaucacaagugucuuaguugugaucauuuucugaaauggacuacaacaugcaauauuucuauuuauuguaauuauuggaaacguuuaugaguaggccaaacuaauuucuguaaacagcuuuugagguuuuuuuuuuuuuaaauuaaugcaccgaaauuauuuguuuagggguucauucaggguuccagaaaaaaaaugccuaucuuuuauucuagauuuguagcuuuucuaaauaugaauccugacugaauagaaacacgguaagaucugagcaaugaaguagaaacugaacgaguugcauagaauguuccagaaauagacauuagauuggaagcagcagaauagcagugaccuucuugaccacagaacaugugucucuguugcugcucccccaccucuguagcacuguuaauuucgcaguguugugccacuggcacggaauucuuuucauuagaaauuccacaucuguuuugaaaagauguucccucuacuuuuccccuucaaacaaaauaauaauucuccuggcuacguuuuuauacuuuaaggcauauaugccaucuuaaacaugauuuuuaauuuaauaaaauauaacguuuaaugcuuuuaguuguauuugcaguguaugcugguuguaugaauuugaaagaggacauuugaaggugauuacuuuuauuuugguauuaggccacugaaauuccauauucucuuucauugugagcaaacuuuuuauuuuuaauuggagaauuaagaauuugucguaacaaaaauccuguggauuaauaagaugagaagauauauugauuaaauauuuaucauuagggacauuagagauaaggccaaauacaacaggacucagacuauuucaaauuguaagcugccuuuagcugguguguacuauuagggaugggagugcugguacacaggcuaccucauaauuccaguaaagagcagacagaaagaaaaaauaguuacauaauccuuucuuuuuaauacuuucucuuuuuucuuuuuaauucugcuggagacugcauuaaaaagaaagagugaugcugaucuugguauaucugggcaucaggguagaacuagaacgaucaguugauuugugcuagcuguuugugcugcugugcugguguugggugacucccgcccucugcgccgucuaauuuguaggcagacaauuaccucuugcuuugaaaggucaugagugugccugccuuugccauuugauggcuucaaguucaccuccaacaaaauuuuagagccuuuuucuugaugagcuccguuggcuuccgcuacagcagcuugcuaucacggaguaaggaaagcaauuuuuugaauuaauaaagugauggauugucuaauuacaaagcugaugugcgguggccauauuguaacuuugacugcauuacuagaugauccuagugacugaucaguugggccuggguuccauuaagggaaaauaugcuauuaaauauuuaauacugagagugagcagacgcgccaggacugcuaaccuccgggcaccggagugcacguaccuauauguuuggcagcgacugcuugaagaggcacuguagugugcucagagcagcuccuggaagucuuaguuguggggauuaacuucuugguugguguaagacaggcaaacagccaagacuuuaagugaacaaugauccuggcauucuaauuacgagcuggugacaacagucaugauuuauauauauauuuucuuuauuauaauagauugaguccccaaguagauucaggagacauuuauucucaaagaugcacgucagcccuucaaggaaagugaaguuuguaggacacuugggcuuugaaggcaaaacaaaucauugcuugcauuuuaaugaugauauuuguauauuccguucuuuacuuugcauuugguuaacauuccucuucauuuauguguaaauaaccugugacagcugugagauagaucaucgcaguuaaagacccaaugccuucuaacuucugaaggugggaaggauuauuagugagcucuuuaucugcucuuuuauuauaccugugcugcccgagguuaacugccuaccuuagguccauugcuuugguuaaaaguguggaaugacuguuugccaagccuuuuauuucuuuguuugagugucugaauugccaugaguuuagauaaaggugauucuugaagacugcagaaacaggacaugcugcugcccuuucugcugcccuuucuuuagcgacaaaaacuugcuucuuggggguacugucccacugcaagagagugagucccuggcaacucuccuguuuuaauuguuggccaaauaaaauagcacagaacaauuuucuguguuguggauguuacuuuaguaaguauuuacaaauagugauucagucgguaaguguauaccaggcagaaggccaucuuuaauaucauggcaaaauucaugaaguuuacuaaauuagcugucaagucagcaugguugacagacugcuauuucaggaagugaaaacuugcuguauuaauuacuccagcaugugggaagccuuucucuaagaugcacggauaugacuaucguggcagcuugaaggcagacuuuuacaugugggaagagcacaacuguggucggucccugaggcagguuuucaaaaaaauuaauuguuuuagauugaaaaaaaauagucccaauuuaucauugggauuuuauuuauuuguuuauuuauuuauuaugcuucaacuucuugauucuccugugccagauuccccaguagugggcuuucagguguguuccaccacacccagccauuucaaaaucuguaaaccuuaugcaguggcaaagcaggcuucauuaacacucaguguuaccucccggggagucagcuugaucuugcuauugaugccuagaaccugggccguguguuugggaaggccauagcugugcucugaugaagcucugcuugugaacacacaacgucagguuccaucucuuuugacauaucuuggaauggucuucuguucauuuuccccaguaaccuuuaaaaacaacuaggcacaguuuuaguuugcaggcuguguuaaagaagauggugggucagauuuggccugugggccauuauuugguaaacugcaaauccuuuuuguaagccagaagauauucuguacauaguaggaaacagagaguacugucagaaaauucuuuaauucaaacaaagagggaggguggauaggaaauguuuuacuucuccuaaccagccuuuaguucuacugguuuugauuucccuuacuauuuaucagcaaauguacauagauacaauagcugguuuugcauucaucuuuagcucuaagauaauuuaauucaguaacuuuaaaaagucuuucaacucaguaauauaauaaagccaugcuguuaugcuaaggagagaaagaaaauugucaaauagagaaaacauauacuuauuaauuguggggagccgcccucacauucgccguuacaagauggcgcugacauccuguuuucuaaguaguaaacaaauaaucugcgcaugugccagggguaguucuccacuccaugugcucugccuuccccgugacgacaacucagccaaugggcugcagccaaucagggagugacacguccuaggcgaaggauaauucuccuuaaaagggacaggguuuugccauucgcucucuugcuccugaagauguaagcaauaaagcuuugccgcagaagauucuggcuuguugcgucuuuccuggccggccgcgaacaucucuuacguguuuaaaauauauccugguuuuguuuauauauauuuugagauagggucucaccauguagucccgguugucuuagaauuugcuauguugcccaggcugaccuuggaacucacagagauccaccugccucugccacccaaauucuggcauuaaaguguauaccaccagauuauuauuuuaaaguuauuauuauuuacuacuauuaucagugagacaaugagggagggagaagaaaagagagaugggaggcucaccuugagggcauggcgaucagagcacagcugguggguucucuucuccuguguguuguggggguugaacugaagucaucugguuugucugacaaaugcuuuaauaggcagagcuagcucccuaacccuguuuauuuuguuuuuaugagacaggacaguccaggcuguucugaaacuucauccuccugccucacaacucuaucuccugguugcugggauuacugguauauaugccuauuuuuugccuguguuuauuguucauauauaagcuaaagguacuauauuuuguuauuuuuuuucugauaugaaacagaaauauauagucuuauguuaguauuagaaauauuuugguugaauacgucaggucaaaauuuguauguguaugaaugugugugugcaugugugcacacgugagcuaugugugggcucacauacauguggaggccagagguuaauaaugacuuucuucuucugucacuucucuaccauaaucuuuugagguauggucucuaguucccagguuggucugagcagucuggccacaccagcagccuugcugcuaugcugggcugcagacccugguacuccaggcugugauguggggguuggggacucugaacuccuguccucaugcuugcaugccggugcuuucacccaccgagccaucuccccagcccaagggucaaaggguuuugcuugauucuuuauaauuuuuauuauuauccucacaauacauuuugauuugucuguaucuauuauaguugagaagggcuuuuccugagagaaaaagaacaaauauauuuuagaggugugauguuaauagugacaaagauuuucacaaguucuguuacauuuuauaauaaacaagagcagaguuauauuuuugagauuagaaauuauuuguugucccuugauguggaacauaagaugauuugauacguuaacaaaaguggagcgguaacuuuggugguggcuaaucuaaggcauguuaaaaaaaaaugucucagucaaggucaaaagcaaccuccaaaacaucuaccaguggacggucuaagauauguucauaucagaacauguauguucagugugcaguaguguugcaugcucaaagggacauauuacacacguugaagaaaagccagaaagccauccuggcugagaugcucuaaggaugaguuaggccacccugguauaaccugaagcugccugacccuggauaccaggauggguuaucucaguauacaguagggccagaugauaaguguugugcucaugggguuugugaaguuguauucauggugcaucaugggggcugcaggauuucuaccucagcuugucuucugaagguuuguuucucucugagguguaaguccaagucuucacucaaacccacggccagagcugcccuuucuguaaccacugguguuuucuacugccgucuuuagugacugaguauuucgcaagccacacauuuuucuuuccagauucucacuuugguugugagggucaugaaaacacagucaugcuuuccucucccuucauuagcauggcagaagaagauaauucucagcuggaagacaacagaagucaucuaccuaaugaccugccgagcucuucucuucuuccucucccaugaugcaucaggcacugugcagaggugaggacucaccuagugauggaagaaagccgaguucauuucuguucuguucugagacucuguuuugcuccuugaugccaacuaguuaaggaacugcccgcugaauuaacgugaaaaugugccagauggggcacaaacauacuuaacugacgucaugccagcucaucaacagcccuugcuucuuguguugaugaccaucucuaugaagccaggaaauuaagaauauuugauguagccguauuaucccuaugaccaucugaagccagauuagguugucucugcgcugaagaauuucaacuucagagauucuguauguccuguguuuaaaugaugguuccuggacaaaccugcugaguccccucacuuccgguaucuugauuauaaacagaaucuccacaucacacauuagcaauaugcggauucauauguaguccaaugcucuggcccaguagacaccaggaagccaaugggaguagacagccuugcuguauguuuucucaguagaucaaggggcaguugaagaauuggccucaggguuccuaguguuacacucuuggguucuacuuuuaguauuuuauaacccuacaaaguacuuaacauauaaagcuacagccaacuacagcagcgcccugaccaguuaccauggucguaaugcucuuugcaggugaggaacgguguaagguccugcuucgucagaguggggaucagagauuuccugugccuuucccagaugagaguuccugccucccucaguccuucacacugccuucugugcugugugaguuccacaguagggcuacccagaguauaaacaggagcaaaauucggagcaacaggaauaaggggauuugcuagcaauucucuuaguaguaggaaaauauuguuccaggcaaaacagugacuuuuagaauggugucucaugcuguuuauaagcagguaauacacuguguuucccccuucccucuuaccaggcaccccuaaguuagugugguaggguggguuggaagaugguguguuuuucuuaugaaguggcuucgcguugacacugcugcacguccguguaaacauaaagguaauugaaguagaaucuguaugggguuaggcugcccucugacaccugaauucuauauagccuggaaguacgguauguauauuaaaacaugaauuaugcaagaguccccagcaugacacuguaucauuuccaggacaucuuuugggcauauuuucucuguaauucuauagauagauguuuuguacauuaaaacauuuuguaauuuuaucaacuauguauucaauacagaauaaaguacuuuugguaguaauacuuuuuuuuuccuuuuaugaguauuuauuugacuugagcauuuauauuuguuaauagcacaaaagaaucaucauauaguauugcuuucaaacacaugcuuuccgagcaaaacgaaaaccggaauuuuacuacaguagguaagccuugacagugauaggugccaugaaaaacuuaccaaguucuucccugugcuggccgcugucuccuuaggcucucucguguccaggugagaguucacagcaccugaguggaauuuccacucccugucuuguguggugcuagugcccaggggccugguuccuaccacagucuuugagaagcucuuugucuuucuggugcagagggaaaguuguugagcuauguugguuuaguacccuucagucuccuguguuagagacauaccguuggcuuucuugugguccacuuucacagagguuugcaccuaaaccccagacaugcacacccuaagucaugauguucaacuuauagaaaucuguaacaguuuuuugugacauggccaguccccgauuuguucaccguguuacuuuaccagcgaucuuuugcugauucuccccguaguguuggcugguaggggucuucagcuguggcuuuccccaccugugccuugaggaaacucaaggcuucauuuccugccuuguuauuuuuccccccuaagcucuaauccuguauuuuuguaauuauuaauuguugcgcgcucaacuggccaggaagaacgacgcugcuacaggauccuucugcacacauuuauucaguccuguuucuucuuucuuuaucucucccuuguuuauaucucucccuuguuuauaucucccuuguuuuuauaucucccuuguuuauaucucccuuguuuuuauaucuccccuguuuauaucuccccuguuuuuauaucucccccacuaauaguaauccucucucgaauaauaauccucccucuaacccgggccucucacucuuauauacucucaguucccauccacgcacagcaggccacgccaccucaccaggcaugcagcuucagcuaaucagggcagcaggggcaaaucuccaccaaauuggauucaccuguauccugguacaccugcgcagcacucaagauguuugugguuuauaugaggaagucaggugcaagucauaugacuuagcugcagucccuggcgccuuugggacugccgccacacccgcuccccacaauucccccuuuuuuucuuuuuuggcagagagaaugucuguagauagccccccgcagccaugccccuuacccguccuugggugacaaacagcauugguuugaucccugucuuagguuggugacaugcccagggagucuuaucacugacuaccucucaaucaugccaagccacuccuggggagauuguguuuugcuugcggcaggugcaucaaaaggccaggauguuaauuaaccuauggccagaucuuaauugcugcaagcaagccucaugggugaagguagaggucugauccccagugugcaagcauaggggcccuacacaaaaccaucccuuaggcucaucacccagagaggucuuggccagcucccgugucguuuuuccugagggaagggaacuaggacacugaaccuucaugcaaucagacgugccuuccacaggaugccaacagcaagcuauccucugugcagugcuuagccucgcaccccacggcauaacgcagcauaauuucuuuuagagcggcaaaccaaaucugaggagauugucccgccuccacugcagcaaaagccuacgcuaccauggcgaaagugcgggccugcacacucugcaccuaacacaugugccaaacacacaacgcacacgcacuauaacaagcauacaucccagggcucucauccccgcucaucuucccugaagcaagggauagauggccagcggggcuaucucuuuaaggggaauucagggaucaaaaagcguggaaaaauuugaaugucaugucgagcugguaucggcuucuggaacaccgaaaggaucucucaucucggcuccauccuuugugcuugugggaucauccaccacauccacaggggcaacuggaucaggagccucauucuugcagcgucucaccaaucucuccggcacccaaagagguuccgucugguccuguggaaacacacaaacagacccucucgcccacaucaacaccggaucuggugaauccccaggggagauggacacaauaccucgugguaaugagaccauaaccucaaucaccuguguguccaucuggggagucaauaugagagucaaguuuucacugcugaggaggcauagggaggaggcacagaagcuaauucgccuuccuccuccgccucggcucuuuuauuuuguccuuucuguccaccugauaacacugugucuccuuucuuuuuccuuuuucuuuuuaagcccuucucuuccgacauacuuucuuguugcucuauaaggauuuucugaccugucuugacugccucuugauucaaacaguaacagaguccauauaucagaacaaacaagaccaaaacuaucagaccuacccacaaagggucaacgggagaaaaaagcauaacuacucagcgaggaucuauugaucacuacacugagguuaucauaguuccuuaaucuguccugaaaccaggaaccuuaacuugucccaaagccaugaaccuuaucauuacuuugugccuccuuccuggcaacuuuauacuugccucaauuuuauccgagguccuucccaaacuccuggggucgcaaguuucacucaccgugaacuuacccugccagcaaccacugacugcugaaaguucugaacucggugggggagucgguuccccguacgggccaccaauugucgugcccgcucucgaccagcaagaacgaugcgaccaccaguccuucuaacagcaguuuauucugucuucaucucucuucuuucucuucaucaguaccuuuccccagcugaagaguucugaauccacgccggauccuucucaacagucuguuuuaugggaaccuuuaucaaccacuccuuccccgugaugcaguucugaauccucccuguagcagugggucuucgcucaugccugaagauguuucuuuucccggguuuuggcaccacuuguugcgcgcucaacuggccaggaagaacgacgcugcuacaggauccuucugcacacauuuauucaguccuguuucuucuuucuuuauaucucccuuguuuauaucucucccuuguuuauaucucccuuguuuuuauaucucccuuguuuauaucucccuuguuuuuauaucuccccuguuuauaucuccccuguuuauaucuccccuguuuuuauaucucccccacuaauaguaauccucucucgaauaauaauccucccucuaacccgggccucucacucuuauauacucucaguucccauccacgcacagcaggccacgccaccucaccaggcaugcagcuucagcuaaucagggcagcaggggcaaaucuccaccaaauuggauucaccuguauccugguacacuugcgcagcacucaagauguuugugguuuauaugaggaagucaggugcaagucauaugacuuagcugcagucccuggcgccuuugggacugccgccacaccugcuccccacaauuaaugaaaaauuucgccuggacaacuugucucacuucagauuuuucauuccgaauuugugagcccccuccuuccaaacagaagcauccuccacagagcaguuagggguguuguuauguuacccaaaucuugcuucuuuauucuuuccugauuuuauacacuaaugguggaguucauuaaaauaucuaguuuuucuaguaugcuuaccuuguuacaacuuuaucuccucucacaaauugauugaugagauauuauuuauaguguuaugaauuuaauuugaggagggugauagguggucuguucguacuucauugcucuauauaauuaagcucucuauuuguaacuuacugcuaaauccuccuuuauccuucauuucauaaagggugucuuugaugcucuuuuguaagaaauuguagcccauugcuuuccaccucacuggcuacaccuugaccuaauguucuuauguuuguucuuuugcuuacuucuauaccuucuuaaaaaugucuauuaacagggcuggagauggcucaaagugugagagugcucgcugcccuaauuacccagaaggcuccaguaccuucuagagagccgaggccuguagcgauucaagugcucucugcuuaacuccuucucauugugauuucaagagacugagguuuacacuauccuguaaaagccuggacucuuuaaugguggcaauaaaugugggaggcuugaauauauucccugggucagggaacuguccuugacagggugaagcauuuuugaacuaguuuguaaagcugcacaugaauaugagggcacacaaucagaggucauccaagcgacaaaacaagaaauggcacgugcauguguguguguguguguguguguguguagcuaaauaucauguguuccuuuggccccuaagguaauagccaucugacuugguucaacuucagcccugagugauaaugaucgccuguaguaguugaguggauuuuucuaccucaucagugcuguugaauuucauaauuaguuaauuacaaggaugcgaucagauuucagaaauccacuucugcuugccaaggucuugcugcuaaggccuugaggguuuuuuauuguuugucuagaugaaucauuuuauuaagaggugaaaguagggcggggcuucugaguucaguggcaucugaacagaugucccagguagagcagaccuuucuggucuuguugauugagagcccuucuggcuuuuauguagagaaacaaugauccuacaaagguguucuugugcuaaaaauauuccauucauagcagugagacuggaauauucguugcuuccuaccacccaagucugccaagagacucccgcaaggucuuuugcaucuuguggacaggaggcauuguguucucuacaguuaaaaauaaucucuuggucuauuugaguagaguguuuucuuccuggcaagaaauguugagacuugaugauuuuguuguuuaaaaauucuuuugaaaauuacuagauguuuugaauuauagaacucaguggggcucacagugggugggucuguuugaggggucgcauauuuacugacagccaucagcgguugccaguucccuuaaagcucacuuccuuuccuuuauuccuaccuuuguuaaauuccacucuccauccugccuggcaagguccuuucugcucuucaagcuguugugggcaucucuguaauccacgggagacucuguggugcacugacgauaugcugagcuugacaaagaaaggaggaaacugacagcggcagccauagucucucaagggaguuuuguguaauuguguuuugguuguuuguguguuucuuucaguucuccuuccagacagacagaagcuaaagcuuagcuuuccucuccccauucagugaugcaggaagaguaaauacaaguuugcugaacuauaacguauuuggccaguucuuucugaccuaaaauacccaagcacccuacuuaaucuuuaccacauuucuucauuucucuucuauauaucagaaauaagaggaacuuguggaugacaaaucaaacuauuuuuccugguucuuuuuaucacugacacacgguauuaaauauccuaguaacacaagaagcagggaagagagucuggaccaucccagacaagaagccuccuaccacgcuaccauacucaaaauggcaacaucuaccaugcuucccgggaagaauggcucacauuuacaauggaaggggagaucacagaggcaguccaugguuuucuguucaaugcacugagcuuuuaaacaaagacagauuaaaggacuucaaugugagagaacucaucuuguguccuuacacucagacguuuccuauugcaaaaggauugcgcugucaacauuuaaggaaaaagagcgucaaaugagcacucaggguugcagccacucgaaguaaggagauggacuuauacacuuaagauuucaaaaggcaacuacccuaacauauucuaaggagcacuccauuccuacgcagccagcggaacaucaagguagauuccaaaaucaguaugcauauauuuuuugacuguuuggaggcauuuaguguuagcaaugaauuauucucacaggcuuuguaguucacagagcaggcuaaaauucuagcaaaauaaugcauaguagcauauuuuaacacagaaggauaagauauaugcagacaggauaaaauauaugcagacaggaauguaagagcaggcauuuggguuuauauuacacucccccagucaaacaagagcacagcaaacuguccaguaugguccaaaaggcaagggcauaaacaaaguugcaucgaaucucucagugacagcuggcugcccgagaugagcggagcugugaauauuaugacucuugugucauguccgugccgggcaguaagguucaggauucuaucucccuucuuacacucagugucuacuguggccaaucugaaauccuauggaagaaguaacggggcccccgaaugacauuuagauaaaagcaaccggacuauggaagagaggguuccagcagacauguuucccaggacaugagcaggguuuugaaaaagaagaugucauuugcugagacguggccuuucaagacuuuuuugagauggucccagugcacucuuuuaugauuuacaauuuggcaccagaggucucauccaauuuucaaaguguaagaacaaauggauccuaaauauaugguaauaaccauuaaggaaaggacuggacucugcccagggugugggggaucagagugagcaacaccugcuuuugagacaccagacaccgaaucuggaaacacaggcuuuugcaacaggggauacgaacucacuagaagaaaucuuucugcacaaugagauuccuaaugggucucguugagcucaugauuucccuaauccacacaaucugauccauuguuuauagaaaguaaauauucguaagugagauuuuuuuuuucagggaaaaugagcuaugcaugacugcauuuaauuuuauguuuauuauuuugcuacaaagaacauuaaaagugauuauaauaacgguccagcucaaaggagugagcucugcucuguauugugcucucaguucuguuuuccuuuuaguugacucacgcuauggcuauagauucauggacuauaaugugaguuuccaguauaugcauauagaaggaaauaaucaaaucaauccguugauucuugagaaugaucagagucagguugcuugaaaggggacagcgacaaggauggacaaggagaaaaagaggcuuagaaaucaugaagcgaagcauugcugcaugucugcagcugcuccucacgcugaugggcuggagcucucagcuacucccucagugacccacgagccagcucaggucaucagcgaguaagugauggaucaaagaggaggugccugugcucagcuuucacacguguacacuuaacauucagccgucccacuucccaggucugacgcgacagggcagaguccaaaggcaugaggggaaaggguagccgaggcguucuagaaaucucagaaagaagccagccagccaccagcgcucaggauugcuaacugggugaagucagcauccaauguaugcucggaggcccacagugguucugguucugacuaggaugacaagcucggggcugucuuuguucucucugagaacaguucacauuuagcuccagggagucaagcuaccucagcuccuuaagccuuggauuacacauaggagccaucaagcugagcuagcuuuuacagcuuacuuagaacccccgcccccauccuauugaaccacagauucauucuaccacaaucagcuugugaggucagcugggaaugcugagguauuugaggaagagccacacagugucaaggugacuuaggacuugguagucuugugaccuguaaugaaaguauccagaaagagaaagaaaggauucagaguggucuguaccugcucugggcacguuugcugccauuacuucuuuggaggucaccaucuuacaguacuccaccuucaaagcugcagaccacuuauuuaggaacuuauuccauuguaguuuggagguuugcuuuacaaccucuuaugcuggguggccugucaucauguucaucuugauguuaagauauuacgguuucgacuguagagcccaauuuauuuaauuucaugaaaaauugggagaauguauucacacaugcuuucgaauuucccuuuuaauuuaaggaacagaacuacauaguuauaguaaagugugaagauauauuugguugaauauuuuugucucgacuaucuuggcugcaagccuuccauucugacucgccaucgauaugauagcuguagccauguguugcgaucccacagagaguguucaucaaauauauggugugacuaucuggcucccaaaucagauggagagucucaagagacuggaaguaguaagaacagagccauuggguuggcuccugauugaggccucccauggucuagcaggagaggguuaaauaucauacucacaugguaagagagaaugauaguugaaaccauaggacacguuaaccacagauacuuuugcaagaaaggaaccuugaaguguguuuguuucgcuuauauuagacuuucuaauuaaggaaucuguggaaauuaaaaacuccaguuucaaaauguggcuguggaugcacacauguuaauuucaaauuauaaucuucaaauggccuuauuucccuuaucaucucucuuuaauauuaauuuuuaacauuuuuaugaggaagugucccuuaucugcauauuauuaaauggaagcagucagacuugaacauuaacauuuuuucuacugcaguaaagcugugaaauuagcaugcuucugauauuuuauguuaaaaggacgauuuguguuacugugaagauaacaaggaugcucuuauccugguccuugugcugaaaugagguucuccauuuauugagugccacauuguucauauagcaacuuuguaucuugugagguuuuagaacuagcugagaagcugaaucuagaaucauuguuucgccaaggguuagcuuuuaacacuggacucagugagcgacuccugaccucucucacagcaggcugaggcguuuuuuucaggagaaauaacuucuuguauuaguaaguuuuauuccuauaaaaucauccaagcuucucaccuuauauaauuuucucagaauguggccugcacaucugugccucuuaggugugaggcgaagcagguuucugcuagcagucucugcuagcaguuccccaagcugcucucagagcugaagcucagcagacuaaaaagcuucagccagugugaugguauagccuuuaaucccagcccugaggagacugaggcacauaggccucugugaguuagaaaccagccuggucuacauucuaggccauccuaggcuacacaaugaggcccuaucucacuaacccccuccaaaaucaacagagguagaaguuucacaucuuuuuuuuuuuuucuuuuaaugguacaaacaaacaaaucuauaacucagaaagauucaucauagggcuauuucucuucagguaaacauguauuaauuuguagcuuguggugcuaagggcuguggugguauuauaagaacauuaaauucaguccagugucagagauuucuguagagaucaggcagcccaguggcauuuggcagguacuggcaauuuugaaaggcugggcugcagggagcauggccaaguccugcaggcugggcgggcauaggcuugggaccaucauucagcuuugaugagaugguaaaacgugcugugauguauuuuuuuuuucuucacuauuuuucccugcuuaggaaagguauuuccauguauuuuuuguugcuggucauuuacuauuauguacuucuguggcuguguacacaagaaaacauuucaaauuuauuaucuugugguaugcuuugaaguugguuuuuuuuuuuacauugaauuauauuuucaccugaacuguggcuaccuccauggaaauuucuucaaauuuauuauauuugaguacauguuuuauguagauauuuacuauuauaguuguuucauauaggaagucuuuugaauguguuuuauauacuuauuuuuuuaguuaccugacaaacuggacuguuacacauccauguuaguuuugugugccaggaaaauuauuaugcuuuguuuuuugcuaacuacuuuuuaucuaauuugcauugaaagaaccuugauuuuauaucuuauuuuuagauuaguaugaugcccuaugaacacauucuaaacuuguuauucccaauugauuuucagucucuaauauguaaaucuuaaaugaguagcuuuuuccccccuccuaaaacauagcuuucaaaucacuuagacaucauuauaagaaagcaguuuuauaagccugcuuuguuucuuuguaucauuaaaauagaauuuauguuccuuuguauauucugugccagcaaauauaauauucuuguuaucagaauuccauuuugaaugcagcagaacauacacuuuacuggcaagccuguaguaacaccagugacuguguauugaggacuuagcuaugaguuaugcuguguucuaguuuucuguuacugcauaacaaguggcugccaucuuaguggcuguacagcauucagaggcaguaguuuaaagggauacaguagaaucuccccccgcccccacuaaaguguuaacucauuuacuccuuacaaguugaugagggagccacucacagcaaguagugucucauaggcucuuuauccagguaauugguccggagccuggguagccacuuggccauccugacuucuuuauuugcaucugcucuuccgucauaaccugugugagggaauuucacuuaucuacggguuccuuguacaauggcaguucuaugagggcacacugaggccagcauucccuuguccuacugugguugccagugcugcaguauugucacccucaugcuuacagcaauguggguugucuaaaaguagagcuuuauagcucugcacaguacacaguauuugauaacuauaacggaugggaauggucuauguguuuauauuaguguacuuucaucucuauuaaauuauauacucuuucuguuuuguuaaaagggaggugucucaacagguaggagggcuugccacuaagucuuuugacacgaguuugauuccccugacccacaagguaaaaggagacaacgaucucuuacaugauguuucuggucuucccaugcaugcgcugguauguguacacacacacacacacacacacacacacacacacacacaaauguaauaugaaaauuguuaaaguuaauguuugucauauuaugccagcaacagucugacaugucucguuucuacuguaucucuuguauguaucacuuuuucuugugguuuuaauuuauuguaauuuuguuccuagacggcaacagcauaguguguguacacacaugcaugaauacaugcaccaccccccccccccauauagaugcaggcaguacauccucaaaaucaugugacccuucguuaugugacaugucucuugaguuccuuugguagggguacaggcuuguuuauuuucuauuuuaaaucuucaauauuugcauggguagaugaaugugaauucgggugccugcagaggccagaggaguggucccuggagcuggaguuacaggugguugugagcuguguccgguggucgcuguaagcugaauuugguugcuuugaucacucuucaucuuuguuugcauucuucuuuuguagcaugauguuucuuagacgagacuguguacuuagcuuuagaaagugucugcucaagucugcauaacuucugcagauuugaguuugcuucuuuagucguccaggaagccuugagcagccuuggguuguuacccacagcuggguccugccucauggacuugucugugcugucugaacuuucuugucauuucucucuuugucucaaugcuugcuaagguuugaaaaguccuggcuggguucuuuguuguggaauucggaguugugacuucacuggaucacuuaccacguggcagcucuuugcuuggccagaaggagagccuugucaaagcagaagcucaagcagugcccugugcugugcgggcuccuguucuugccccuguagcaucuucccacguccuucaugagguucaguccacaugcuguccgcuuucugugaaaauacagcacaacuuucaccgaugucuugcuuccgucuuuccuucccuucccucgccauccuaaaccaagugaagcaugaaggggguuuguuggcuucggaaagucuccauuucacauggccaaacccagggcuuuugacagugucauuaguaucuggccucucucuuugguggacugugcuuucaugaguuguuuuagcucucagacagccugccuucuuuggugaggaagcugaggacaaauccagguccaaauccaacaggauuugggggaaaacccacguauacauauauacauacauacauacauacaaacauacacacacauacauauauacauacaaacacacauacauacauacacacauacaaacacacauacauacaaacauacauacacacaugcauacauacaaacacacauacguauauacacacauauauacauacacacauauauacacacauauauacauacaaacauacaaacacacaugcauacauacacacauauauacauacaaacauacaaacacucaugcauacauacacacauauauacacacaaacauacaaacacacaugcauacauacauauaaacacacauacacacacacauacauacuuccuucauuccccaaauuagcugugacauggguugggucagggugacuuucucgaacuaaccaaugggaaaacaguacuuugauuguucggcuuguacugcaugcucgucuaggggcucaaucccaauggcucacacauagauugugagaaugaugcgguaaaggcucgucacguggugccugccuccaacggccuuguucacugccugucuccuucuuaaguuucucagauacugagcauccauaguacaugcauaugccacguugcuuucgauagggccacuuauuuauucauguauuugucaggaauuuacuuguugccaaugauguugcagacauuguguaaaaggauaugaaagcagagauaaaaauuuuuuaaaaaagauauaucggaucucgcagggaauuaagcagccaaugugugugauuuagucuuuaaguggacuauaaagcuuaggagaugucaggcuugccaugaguaccuuuggcacgcaacaauuauuuugcacgaaaugggcucuugagauguugaaguuuguacauguaucuuauuaaaacacaguuuacuacuucacgcuugccacauagcacgucuugcuuagugaccauuuauucaaacugagaccguagagcauucccgcccuguguuguucucucuuguccgucugcacaggaaguuuccugucucugugucagguuccccuggagcucaggaauucuagcacucaccuuuuucucuguugccucacagguccguuuugguuuaucuuggcucccguacaagcacuguacagugggcagugaacugucgaaucucuugaaugauaaaaaugaguugucaauauggaaaccgguuuuuggcuccugauuuuauuuuauguguacaaaugcuuuaucugcauguaugucagcacauacauauauacuaugccuagugcucacagaggccagaagauggcagcgccagaucuccugaaacuggaguagaggugggugugagccugaggugugagccuucacaagagugcuaagaauugaacuuaggccuucuccaagggaaaugaguguguuuaacugcugcaucaccgcuccagccccuuuuuucuugcuaaauaguauuuccaaaguagccuucuagaugaaugaauaaagcuauggguuuccuugucaguucuuaauggguuuguuugugagagcugguauaacuuucaccucacgcucuuauuaacaggcagauuggggccauuggaguuuuccuuuuggaacuggccuuauuuuugauauuugucacauaguacgccugcucucuaucaucaggagaguacuuugguuucugcaaaucagcuguccuuaguuaggcgagcuccacucgagggcugguguuuucuauuaucugguuugaagccagugucccuuguuucuguuuucuuugcaauaaaacccaggcuuugauuuucugagcucauuguaauugguaauaaaaacguaaaccgauguccucggaggcagaggaugagagccaugauugggcgucggccauaugcagcgccacggcuuacauucauuauauuuaaaauacaacaguucuugguaaguuuuguuauuauucuuguaucauaggagacaaauggaggguuaggcagggaaaugccaugccaggaacacauggcagaacuaggauucugaccuauugggucucagaucucucaguucaagcaaacucuuaguuccagaaaucagaaaucacagagcuauguaaaaaaaaaaaaaaaaaaaagcccaaauuccuaguguguugcuuucccgcaccuccagaaaaacccagauaguauccuuaucugguaauauuuuaucagaguuuauuaauucccuuccauauucccaguuaggcaguuuuguguaauuuccuaaauacuuucugugagaagagcagcuaagcugccacauugccuuuaauaucucuaccuacuucauccucgagugcccuugccucuguucauaucccgugcagaagugugcauuuucuaccauguuaggacgcauuauaacuuauuugaagcauuuguucagguuaaauauguauugucagguccaauauuacaggccuguaaccccagcuauucaggaagucaaggagaaggauuauaaauucaagucccgucugucauauagaguguuucagaccagauccugucucaaaauaaaauguagagagagagagagagagagagauggccauguagcuuggggaguagagugcuugcuuagaaugccugaggcccccagguucaaucccuaccacuaugacaaaccaaaccaaaccgaucuuuauauguauuacagaaaauuuaaauaguaagugaaaauacagauuaaaaauucaaguuauguagaaaccccauucauuccagaucaccauugccaagaacugggucucccaacuauaucaguguuuaguguguauauauauauauauauacacacacacacacacacauauguauauauauauauauauacagguaccccacauauacaugcagguaccccacauauacaugcagguacaccacuuauacaugcagguacuccacauauacaugcagguacaccacuuauacaugcagguacuccacauauacaugcagguacaccacuuauacaugcagguaccccacauaugcaugcagguccccacauauacauauagguacuccacauauacauacagguacaccacauauacauacagguacaccacauauacauauagguacaccacauauacauacagguacaccacauauacauacagguacaccacauuucauuuucuuuccguaguuguaagcucauuuguauggguguugaaaauucagucacagagcccugugagguuguagacaccgggacgugcauaaugacuaucugaucccaauuguguguguguguuuuuaaacaugggauaaagaaauagaaaugaaauugugggggcagauuuugcauuuacuguguguguuauccaauuguuuccuaauccugagcguauucucugccagcauugugggugagaacguuuucucacaacagaagcaccaguguuguuucagucccuucugugcuuacagauuauauaagcagugucucugugagucugguaggggaaaauauccaucuuaucucuauccaauggcuauuuaacugaaugaggcagcccccaccugaccugugaauuguauuguaagcucaggacaaccccuaugcugcuuggagcucucucucucugucucugucucugucucucucucucucauucaggaacguggaacuucaaccaguccauuagucauuuaauccaauuuuuaugcuuuacugucauuucuaauuguuugcagcuuauugacuugguaauccuugauagaauacugcugugggucggcuguggguuggugccuucuugccugaugcaauguuugcuaauuauuacuacuaccuuucacucgaaguguguuccucccauuaaguauguucuuuucuaucucgucugucuuugauaggacuggcuggaacauaugggcugaauuagacaaaagaaaagcuugcguugcucauugccuuugcagacaacagugcaucaagagaggaaaagagccggcuuaccagcccacuucaaagugagcuccgucuagaaaauuaaagaugauggaauauucauuauauggaaaaccacaguuguaguuauaauucauagauaauacuggcauuuaaauccaagaugccuuacuagcagaaaacacaauaaaacaaaaaauguaacucucuaaaauacagaugucauuguccuaugagaaugaauauagcuaauguguauaacucaaacaggaaucuugaaauuguuuuucaaaauucaauugaaaagccacacuaauucuagguagauauauagcugucacugacugaugucuggaucuguggcauucacacaucagaagaaaccaaaucguugaccuuugaugcauuacagaauauucuuaacauugccaagaaauguagguaaacucuuaggaucucuuagaaagccagccauugcagccucugagcucaagcaagacaggaucccgcugagaucugcugaaguaggaagggcgaugccaaagccacaaucaucuuccuuuguugaagauucucagugucagagccaaggauugagccugcuacacugggucaucuuuaaaucacugacuuucugaggcaaguuuucauaccuuucacuguauugaguugaaucacacuuccgccuuaaaugcggacggagugcgcuccucuuuggucugcuuccuuugaccucucugagguacgcacugucgaugaucccuuauuuagucuucuuccaugacuugaugcuugcugucacugcuuauccucuacugaucugcuaaugcuggccucccuuaaagucggugcuuguuuaucccuuauucucugucuuguauuguauuguuguccuuuuuuuuuuuuuuuuuuuaaagauuuauuuauuuauuuauuuauuuauuuauuuauuuauuuauuaauuauauguaaguacauuguagcugucuucagacacuccagaagagggagucagaucucgugauuggaugguugugagccaccaugugguugcugggauuugaacuccugaccuucggaagagcagucgggugcucuuacccacugagccaucucaccagcccuauugcuguccuuuucugcaaaguugaccguucaccaacuguucuugccuacuucagcccacccuccugagcuacagugcaguauguguaacugguuguucuucauucugauuccuaucucaucacccagaguuagggaucuugggugacuaucuaacaccuucccuuagaucaguaugacacauguauuucccuuagauuugucuccucugucuacuuucagcaaccuagaaaccuuugaggaugucagcauuucagaaaaaaaacauuuagaaaauaucuaaugguauaacauuuuaaaaauaauuuuaacuauucuuuaaaaaaagucuuaaguuuucuucagugggaugagugaacaguucucuguugaauccaggaagauugaguuuguauacagaaaauacuauuauauggaauuuuaggacuguauuuuaaaaagguguauauguauauauagucuauauauuacauauauguguguauauaaaaauaugaaucuguaaaagguaaauaauuuguacacaucugcacuggcuguauagguuacagugguuguuaaucaguuucuucuaucauuuucucugguauuuuccuuacaaagucaguuuauucaucacugacaucaugagaguugcaguuuuuauuccuauuauucuccaccauucagcauuccucugcuguuauguaaagucauuacaaaucaaagacaauggauuugcuugcagcucaaguuguugagggaagcauuaacauuuuuggauaguuguaaaaacaagucugagacuuggaaacucuaggagaagagaaaaauccaaauaauuuccacaggugucacugaagccuggacaguuguguagaaaucgcuucuaccucccuaaagagccuuuaugcccagaauuuagguugguccaacuaauaucacccgcuuccuucucccccauuuucuuuugaauauguccuuccgauaauaguuucuagaucaaugugaacaguucaauauccgugguaucccagugugcauccaccccaccugcacauacacaccaaaaccaaacccccaaaucaaacgguggcguuucgugaagcaguuggucuuuaaaauucuuuggcugaagucugacucuuuuguugcacgcugucgucucaguuguucaaggauuugcuuuacuuguucagagaauugaguuuucuggaucguauagcuauagugugaauuggugucaaggucagaaucucuuaauuuuauugauggagcugguauuauaaccaggggguaucaugcuguauauuuaaauccugacauugugccuaaaaaaacugucauagauuggcucuccguccagcagauauuuuauuaaauuccuuggcuauaucuaguuuacuuuuccuucggagaaauauaacagaaaaccaccagccucaugaucacaaauggauuguugccauggcaaccuaccuuuuuuuuuuuaauauuagaauuuucuuguugaaguaaaacuuacgacauuggagaccuuuuccugauggugaaaacuucuuucugucucuuauaggugggauuaugcuggguccaaacagauaccugcuccgauguaggaagaagacaguuaauuuauacacuuugcuaaucagaggcucagucauuguguugggagacccauacuuucuuagcugcagacacucugcaggcucugucuuuuacagauggcagcgagaucugucggaguguagaaaagagaaaccacguugcugucucucacaucagagagugcaguaggucuuagaauauugcucagguuccccaagacugguuucaaacauuguaaauaggaacauuaaucucugccucauggacuugucuuacuaaauuauugcuuucuuauuuacagagagcacagccauaauaaauacacagcauucugaguucauggaucagcucacuuaaccuccauaaguagcugccuugauuuuguuacccgucgccaugcuggaacgcauugacaggagcaacuuagaggacaaagggucugguguugcucacaaucccagcucacagcucaucauuuagggaagccagggaggcagggucuuacggaggcuaccuuucgucagagugcgagaggauggaugugugcgugguuguuucccguucccccguguucacacuguggcucaggauauccugcucugggaucaugcuguccacaaguaagaugaggguuucaacaucaacuaacuuaaacaggauagcccccccccccccgccaacacacacccccauaggccaaccuuaccuagagauuccuucaccaagccucucuuuuuagaugauucucgagugggucaaguugacaguuaaaacuaucgcaaugacgauaaaaaggcacagcguuugcaguuucaugugaagauguuuaugagagagaauuagcugacucauccaugucaguuacucucucagugccuaccucuugggggcuggcuuuccagggaaagaucugggcaugaaacgaugauucaggagcuuaacauggaauggagugguagcugaugcugcuaccgaauagguaaaaagcacuguagcuacacacccucgagaggccaucgagacaucucugcggcugauguggauaaaaggcuugcagugcaagagugagggugaguucagauccguagaacccauguaacuaccggguggauaugaaaguccaccuuacguuccacucagaacgcggggguugggguggggguggguuggggaggggguggguugggguggggguggguugggguggggguggguuggggagggggccaagaugacuggugggacuauugcuaucuaugagcucuggguuugauugagagaaucuguuucauggauaaaguagaaaaacuauggaagauaacuucugacauuagcuuuggacuuucauccgugcgcaugcacccauacugugcccauaccugugcagacauuccccauacauguacagugcucccugcccccccaucaacacacauagaaaaagaaaagaauaaaccauaauaaaccguugaaacaggaaugcuuuagauauaaaacugagaaagagaagauagcagagaugauagacgaacgccuagagagaggaacacagcaaugcuacaaggagacuagcaguuccaagugcuguaggggucccuaggaugagggcugccagugcugacugucucgccuguaaggaaucaugugcugaccuccuggauagcggcauaguguggugaaugccggaccuuccucgguugagcaaguugaccaggaauggcggaaaagccuagagcauuaauuggaaggccaacgaagagucccuguguucucuuagugccucuuacagggacugaguggaugaaccaauaaaaauaaaaaauuaacagcgaguagaugagaggguugucgugauggagcgagaauccugagaaucgacagugaggggauugguugugaguuccaggauagucucuuuccugaggucaguggugggccauucccuguguggacagcuccauacagucccauacaguaggacggcauccuacaguagugucauaggaggguggagaggcaguuuagcuccauguauguaucaugucacuuagaguccacaggccucuagugauauuuuuuguuuguuuguuuuuaaacuugucuuuugauaacaccuuaagucaguuuaauaaaaaguaccuauccaucccaguuacuauaaagcagucuucugaaauaucaggagaaaggcuguuuacuguccugcuuuccaugacuugcucagcguggucucuucuacaacccaucaccaccugcccagggugguccugcucacagcgagcugggcucuccuacaucagucaucaaucaagagaaugccccgcagacuuguccacuaaauugcgguuccuucuucccugauggccucaguuuugucacauugacaaaaauuaaccagcacaagugguuuuuauucuguuuuaauacguagugggauucaaccauaguccucugacacguuacauguucucccugccacagcuaagcucucaguuccauacagccccauacagugugcagaugucuuaagagaggcaagccauuauuccuccggugugggcuggccuggggguuauguuuaggauucuccuugcuguuaucugcagaguuuccccacucacacaccugcuuuuaagcuuuuacauucauucucucuugugacacuagggacuuaaaccccugugauccgagcaggccaggaaagcgacccaucucugauuuguacauccagccacgaauauucauucuuaucgcagcuaagauugcacauggacuuacauguguuucaaccaccgccccacagccccgucucaugccugugucauuugcucaguucuuuguguugcuuucuguggcagcuuucuguuuugagcacagcccuucugcccucaagugaggcgcugccaauacacguucccagcacuuucgggaaggucguaacaugucaugcuuuuuccucugucagugguuuaguacagcauacgucuacaaaaauuauauugugcugugcugagugauuggaauguuggaguggguuuuuauuagcaauauaucugcccauauagugaucauaucuuuuuuaauaugugacaguuacagugaguuuaagauacagacauacuggaucggaugugggagguggcaaagccuccuuuacuaccugcaugcgcgauaaucaaauucacuucuccccaagaccaauauuucuuccuuuccauuguaauuagguuccucauucugcaaguuaauuaugauuauaaauauugaauacuugccauguuuucucaaguaugaaaauaaaggcuuacacuuaauguguaaacucagcuguauguagguccgggcauauggcucuucguguuuccuuaagucauuggggcuuuuugucacugucguuacaaauguccuccaaggacucccacaucaacucuuuucccauucuuuauaaauaaaagaaauacauuuuuaaguucaugaauuuauaauuucagacauuacuccauuggacccuuacuugaagguguacauauaaucucaguuugcuuagcugucccauagucucuaaacauuuggucuaguguuuuuggcuaaaagccagcagcaaaauuaugcuuccgugcaacucuuagcuccucuccccuuucuuggagcaagcucuacaaaauguacucauaagacaucacauuugaauugcaaauuuguauguggauauuaucuuacaaguagccaggaaagcaaccaggagagaacaauucccuaauuuguuagcaagcuguauacauaauuuuaacugauguucgaccugacugcgcagucaucaauguuuugcagauuugucaagaacaucauuccccagccuuucccguuauuaacgaacacccgcguauuuccugccuuacuuaaagugaaacuugguuaugagacaagggugguacggcaucugccauuccggagcacuguaaguuugagggaagccuagguuguuuagcaagcagcagaccaacucuuuagaucacaaaagugagauuucugccauuugccagaaccugaccuaaccagguccugaacauagagagugaacaaaaguagugucguagcauccacauuuuauuggaaaauuguuacuacagacacauuucuaaaagauuuguccauggauucagggagcugauagacaaaaggaguaauuuucugagcguuugagugcaggacgucugccauaucaucucguacuuggaaguuggcguugucugaaaacuugaguaaauaauuuguauggcaaguuuuaaauaaauuugaaaucggagacaaaggaaaauauuugcuuuuaggagacauuggcaggaguaguaguaugaugauuuguguuauauauauuuuuuaaagcgcuagcaugcgcuaagaagcaagauuuuauuauuauccuuuauuaagcucugugugcuagagaaggagaagggaggguuugaaagugugugugugugugugugugugagagagagagagagagagagagagagagagagagagagagagagagaaacaugcccugcuuucgagucagaauccucagagaccagagauuuaucugaguguucaugaaauccaguccaccuuaaugaccccgugacccucggagcagcaagugugcugcuaccuuuggagaauuccgagcaaggugcuuucuuuguucugcaucugcugcauccgcaacauaugccagaugcuagaugcagaagugcugcggcaccugccuguugggaaaucuucauccaacugcuaaagucgcagguccacagccugugacagccuugugugcaccccugcucccuacccuucccccauuguuggugcuggcucugaggaagggcucacaggugacaaugaauauacuuucccuccuaagaaaccauuucugaggaaugcauggaauuuuuuuccccuccaggagucauuuacauuccuuaaucuuucugcuguuugauuugcuguuuuaacuacuucggaugugcuaagcuuaaacauuugauuuuaugcgauauaaacguauccuugugccuuuuucaaaucaagcuagcuggacuauuacggaccugaagguugcacacaggucaccguuaucauggggccugaaagcuggcuuuuuguuuaugacuugauugugugaguagugggagauauaaauuuuaaugaugugacaagcgggaauccugguagguuccugugagcacuaaagguugaaguagaaacugucuugggcuuuugaugccguagguauggcaauuagauuuuugucugaucucacagaagaagcaagugucacugagggaccugagaggcaggagaauaguugaaguuaaaaacuuauuucuguuugaggccucaaguugucuuuauagucagugcaaaggugugaguagugagagcuccaucuaccgagggagcagaggccuuuccauggugcuggugaggcagggagggagaaggcgccaugauacacuuagcacaguugaaugcaaauuccuguguguucaggguaggagccaaacgugaagaauuguccggagggggugaaagacccacaacgugaguucucccccacguucugacucaggagaggcgacaccccaaaucacucacaagaaacggucuugcugcaaacugcaagaggauuuuuauucaagagcgcucucaggcccacggucauacaccacucagggguagaggaccauggugccccaguagcuagguaaggggguauuuaaaggaagaaaccacaacucaaggaaguggggagggcguuguuggaaaauaccaaagauaccaguuaagagucccaaggaagugcaaagucacaagagucacaaggaaugccugguaauugugcagguuaucucucaagacaguuucuaagagccccuaacaauagcacauuucauaguggguuccagcaauggucagggugacuuucuuugaaugaacacucuuugaacccaggaagcggguggguggaggaaugucauuaucuguuuuaugauuagcauaccuuggagcauugagucacagaggccacauucccaagccugggccuaaaggccuagaauuuuguuuuuacguuauacuuucagggugaggcagggcaaggugguauaauggcagcaacucaggcuugucucaugcuaaugcugcaggcacugugcugagccuuuugugggaucuugauuguauagucucuggaaucuuacagauucuauuuagagaggcagaugggugacccacagucaaaggauuggugaccuugaugugcauccaggccuaagcuccguauucaccugcugccagcucccaagugcugagaugacaagcaugugccuucaccagugacuuaauuucauacacccuucaagaaugaguuugcagugaguccaguauagaaaggguccacagucucgaggaucugggcucauucauucuuuuggguuacagaaaucaggcuguuugguuucuuuagauagcuaacaguggacacaaaccagauugauuuaugauauuuuuucuugguagcauuuguugauuguuuugcaguuuuagcuguaaauacauuuuuuuuuuuuuaccauuauccucauaacauauguuggaacagacgucuugucugcuaggagcaguauuaaaaaugcuuacauaacaauaauugugauacgaagaucaucugcagccaaucaaagaagcucaggcacuggacuucauuuaucuucaucugucucuaguguagagaaaagaggaugcugaaaugaaacaaggugaagaaccaaauggagggcuuggguuuguuugccuuuugcauuuagauaugggaucucuacauuguauuauguccagucuccauggcucuguccuuuacaaagcuggacccacauguuccacguuuugcagaaauaccuuucagggaguugauuuguaggcaucagacaaaaccagcagaaugacacuaugcugccuccucccaucucccucacuuccccuuagcacauggcagggcgacacuggagacuguccuugaccgaugacgcuggaauccauuugcucuuugguuuucaacuguugaguaggaauugugccucuagaacauucggcuggcucaugucguugaggccucuccuccuacaguaggcgcaugggagcccuguguucaggagucaaagucuuccaucuagccuuuccuucugcaaugcuuaagcccaggauguggacacuguuuaucacauuuaucacauugcaacauugacuccuacaggcaggucucugaguaccugcuguuucccaggcuauauccuagauuuggaggauacaaagauaacgaggcgcucagcucucguagaggagaaacaccuguuuaaaauaaaagcgccauagcaugccaugaucagcuuacaaucacagucuucuccucuacgcagcuagcaugaacacagaaggccuuaucuguggaggcaaguguggcaguucccggaaagaggcuugucaggcucuggcacauaguagguuguuaacagcagguacuuuagcuuauaaagauaguccaugaagacuaaaucgaagaaaaagggccauaguucaggcaaccugaguccagcaaggccuccugugucauuauggcaucccacccauccuuuacugugcauuaauucugaaauaugcguucuggugucuugcagaugcugugaacacccaccuccagggcaggcacuguguaugcaucuacccacuuucuccuuugcuugaucuuugaggaacccaugaauguuuguugaaugaacaaggguagauuuaccuaucaaaacauucacguagaauagaaugugugugacuucagucauggaguuuccgcaaguaaaagauaccaagcuccaagucuuccgcaggcauugccuuacuggccuuccuuuccuggcaucuuuguuuuugauguugcggucugaucaaauuaaaugcaggcucaaccaugcugugugguuaaguauuguaggguccaauaagugugcaaacaguaaagaugaggccagcaggggucaguuuaauaccaguuuaagcagcgaacgcaguaguuuuuacaucugugugaagugcaggaagaauaggaaaugacacgcaccauccaaacgcaagcuuuuaaacuucaagcuauaccggaagauugccggaaaccuagagagauguccucagcauauuuuccuggaugacgaaggcagagcaggagaugaauugcggcaugcagggauguaguucuccgacaugccgcaccagcacuuugagcuacccuuacuuuucacaguuuguauugaugugggcuagaaggaucuggaacugugauaugcauuuauuugaccuuagcuacuagguaugcuuuguaaaauacuuuaugucccuuuccccuuuagcuggcugcaaagaugaacugccacucgcgagagcuugccugugaaaugucagugucccgcaguuuauagaugaggccggacaugaaaugauuccuucuggcuacuaaucuucaagagaaauagcuuccagcuacuauauauauccccuuguuaucuuaguggauuugcauggccuuuucuuugcaacuuagauguaugggcuugacauuuaucagacuaggaucccaaauacuaaaaguuaaaguuugugcuagacucaagaauuacccauguaguuacuugcugaugauaagcacucucuguagauaaauauugccuugaugcccugguauacuuuuccucagaccaguagcuucuugccauguacuguuuaggagacccuugauguauugaacaccacauccaucaaaacauggacucaaaauauuuggggacaaguugcaucuggaacuguacacaggcaguuuuucuuacagucccuaacaauacacuccagcaaugguggacagcacauuuaaccuguaccugcuaucacaagugaucuagagaugguuuaaaguggaugaggggaugagcagagaucauaugcagacacugugccaugcauguaagggguuucgagcauccuaggagcgcugguauccauaagagggucuggaccgcacaccaagggauguuaucaucaguuaccugaagaccuucauguaaacagucuauagauaauaguaggucaucagauauaaggaucaggucuuguucuagggagcaguugugugcugggucuuucagaggacugcccuaucagaaugcuuuagucuuucuaugucauucauuucccaugacccagcacugucgucuuccucuguuuucugucuaccuguuuaagugauaaauaggauauaguguuaagaacuuugucuuguaacccacuucucaucagccacaaaguaaaaccguucuuucaugcuggcuuuguggggaguccuguccauuagggucaguuguagccccaggagaugagucuuuccauacaggagcaggguucuuucuuuaaaggucuuuuggggugccauuucccauaguucucuuggaacggccaggagguauguuguuuguguagaggaacccacuagggccuggaggaugcugggcugauggagguggucuguuuguggucaagaagaccauauguagcaguguuguuuguugaauuaaggugugguucuguggccuuugcaguuggccguuguguucugaagauccuuacuguauuugguguacgaagcuuuuucuuuuuaaccaaguaagcauccuuugucuuuauuaguuuuuuucuguguagaaugcaucaccacagaucuauuacguuaaagcaacacauauuuaucguaucucagcuucucagggugagcacccaugcuuagcucgguguuauggugaaggccuuucaugguucucauuaagaugauccccggguggaguucuuaucuggaaaucugagaaaggaucaaccuccacggucccuuggguugguagaagcauauauguucucguguagguaggacucaaggaucuagcuccuugauuuuuuuuuuuuugagguggagucucuccauuugaucaggcuaagcuuggucucaccaucuuccuuuaagcuccccaaaugcuacagugacagguccuggcugcuacccaugacucaaacuguuucuuccuuucucuuuucuuucuuuguauucuccucccuuccucccacuccuauccuuugcugauuuucaugguccuagugaucaaccuugggccuaauaggcgcuagacaauuauucuaccccugagcugccuccucagacccugccucuuuguucgauacagucuacucacaguugccagauaucucuguguugugcuuugccauauagucucccuacauggccauuugccuggucagucagccaggaaugccugugaugcaagucuccuagcaccacaucaucaucacaggagugacacuuaagcuuugucacauacugucggagagaagcaaaucaccgacugcucacgcuccaggggaacagaucuuacagggcaugaacgcuggaaagcaggaaucacagucugggguacccugguacaucuacuucuugucccccagauaugucaagggagagaagaaagcaagcaggagagcuugugagagcucauugaguaacaggagagugagccauggaggagacaccgcugggauccacauggcugcaucucuaguuuucccggcugauguaaggcuucaguaagugucuaaguuguugguucuugcuuaucuucuauuugccuucucacugucuaaaugauccuguugucuuggugccuuugucuuuuaauaaacuuaacucuguauuuaaaugggcauguaaauguccauaccauaccacuaaccacacccaugaccacgcccaccaccacuaccaauaucuagaacauucaaucaccuucaaguuuccagaucucuuucuggugacaaucuuuccaugccuggcuauaguaaucagugaucugcaucgggcuucuagauuaguuagcuuauuuuugaaucucuguucuggcuuacuucacuuaauauaaugacuucuaaggcucauucccacugccauuuguccugcuguuacagaauguggcaguuguaagggucuggcauagcuuguauaucuugucaccugucaauaaccaucuguauucucuccagugauuaggaacuguggccaaagcuacugucucuguauggacauauggcuuauugugcucacauaaauaccaguaaugaaaucacugggcauauaauaaguguaguuuucaauuaacacaauagugccaaaccauuuuccaaugugauuaugcaauuuuguauucccaccugcagcgcgugagguugccaagucuucuacuuuuucaccaacacuucauagagucucucuuuccaauugaacugcauggagcaggcgugcagugauagcuugugaugguuuuaguuaaccccaaucucccuuuccuuuccucucccugcuuuaagcguugagucuaccccgggucccacaugugcuagcucuaguacugaucuguaccuucaacccuagauugcauuuuauaauuaagguucccaaucauuuuacacagaccuuuggccauuuauacaucuuucacaaaaccuugcaauuccuuuaaagugaucugaaguggaugaauuauuucaguuguuuaaauucgcaaaaugguacugaccuuuguauguaauugcucauauauuaauuuaaugaacacacauuaagcagccaacagauacuaauugcuuuaugcacauugacugguauuacauauuuucauaucaucccuaugagauuaaugaugcaguuauccccauuuuauggauggaaaguugaggccuucguagagaugcugagugacuucccugcugucuuguccaggcuaauaaagaacggagcuagugucuaaacuuggcucucugacuucaugucacaucuauguuacagcucuggguagcugccguagggaugaucugguaugcacaguccauuugcugaccacuguguuugacagucaugcuuuguuccugcugaaucagcgguguggccuggcugugaggagagacacccucugaacacaguagcuuagguuccuagaagccucuuccuacgacggucgacuuuucucaaaauaaauaaguagugaauaaaaucuuccaacaaaaauaaagaccgaaggguuagauagcaguagcaucuaccagguauucuagcucuaguggcccuggaacuuucuauauaaaugugaggcuauagagauagacuccacgcacauugucuucuucaucccaaugcuguccuuggugcagcauuucuggggaaucacuucaaggguugcagccuggucuauagaaagaacaggaaaggagcagaccaggauguuaauucccagugcucugggcugauuggucacuuucccgcugcccguguucaggacgagacagguuauuucauaggguuuauaggcuacucaguaaaauuuggaugaauuuguacuggcuggagagauggggugcaugaucuagugaaacaucuagaguuacacaauuucagaaaagcauggaguugcuuucaauuaugugcaauaauuuaguuuguuuuuuaaugcauggaagaaaugugcacauuuagagaacagaguccacagcauucagcaagccuugaagcaaagccccagaaucaaacauuggcuugaaugucagugugcccacaacaguguuuuuuauuacacgacucauuccuuuuauaaaagucaggcauugugagaaguccagaugugaagcuuagaauaauaaaaccagagaaagaauacaucagagauuuguaaaacccaguuaauauggaaguaauuaacuaugggaaucaugguauguucuucaacaauaaccuugaaacuucauuucugugucuaaugacucagagucucauaaaaaagaaaaggggggauaugcucucaggcaggcugugaggaaguucugaggucuucucuuuccugacgagcacacacaggcuuagucuaaugugggacuagggcuugacauaaagccugacauugcuggaggaagggguagcuggaaaacuuuauauaacuaagcaacagaagugaccgcgugcucuuacuuaacaacguaacaauuacaaaacacaaggcaagcaggagagaauuaguaauaauuuaaaaagaaaacugagcuagguuuuguaaaugaaaucaagacagaaaaaaaaaaucucgaugaugaaaccaagugguagagcuuugaaaaaaaaaucaaagugguuaacacccuggcuccguagaggcugaggaggaaggagugagaagagagggagggggcaggggcgagagagggagcuugcucaaugggaacaucauuacuuauaaauggaaaagauuaggcagggauccugugauccaauccuuugccaagaaauuagguaccugggugcaacugauuaguucccagaaccuaacaaaaaucuguacugacaccaaacaugaagaaguagaaaacuugaauaaaacuauaaucagccgggcagugauggcccaugccuuuaaucucagcacuugggaggcagaggcaggcaaauuucugaguucgaggccagccuggucuacagagugaguuccaggacagccagggcuauacagagaaacccugucuccaaaaaccaaauaccaaaaaccaaaccaaaccaaaaccccuauuguagccucuccuccccagccugaaaccugcuugcucagggguggagcuugcugcugaauuguucugccacgcccacugcuggagccugcugcuuuccuguuucugagcauucauggguucaccugcaaccuuaucccaggauuauuuggcaggaauccccccccccuucauaacugagugucagaauaguaaaauugagcuuugaucgggaugacugucuuagcugcaucuuucucucgcgccgccuagacccccuucuuuucuagguuuccaagaugccuuuacagacuagaauccagacaugugauccgcuggccggacacaacacccuauaauuaauucagcuuauaaaagacccucccaaccaagaaagccucuaaguagauagcuucacaguuaaauuuuaucaggcacuguugugguuugaauagguauggccccauagacucauguguuugaaugugugucccauagggagugguacuauuugaagguguggccuuguuggaggaagugugucacuguccacagacaaccuuugagaucuuuuauacucaagccacacucagugacacagucuccuucugcugccugugagucaagcuguagaacuuucagcugcuucuccagcaccgugucugccuggacgcugccaugaugauuagggagcaaaccucugacacuguaagccagucccaauuagaugguuucuguuauuagaguucccuucgccgugaugucuccucauggcaaggaaacccuaaaacagacauuuaaaguaugaacacacaugagacuuuuaucaaaauuuaaagaucaggaaagccagccagcaucaccuggauaccaaagccagacaagaccacuacagggaaagaaaacuaugacccauaucaccguaugacauaaauccccaacaggguacuaugaagccagauucaacagcguauuagaaaggauuuacaucguauugaaauaggaugcauucccggagugcaaggcuaguucaguaugugaaaaccauugcagugugccacauuaauaaaguaaagggggaaaaucaugugguuauuugauuccaugcagggaaagcauuugcuaaaacuuaacauuuuauuaguuagggauauaaccuuaguauuaaaaaaacagccacgugugaaaagcccaggcauuaaaacagaauacuggaagacuggagacuucuggaacaugccuguauuccacuuuugcucagccuaccaccagcaccugagccagguuacauaaggacaagaaauaaaaggucuacacuggaaaagaaguaguaaaaugaucucuguucacgagcuguacaaucuucuauguugaaaaucccagcucaucauuuaagaaaucaugaaagaguacaaauguacuuuuagagacuaaaagcacauuggcguuuucagaggcuuggaguuaaaggggggaggagaugggaguuauuguuuaaugcaucaaaguccagcuuaucaauacugaaauauaaggagugucgaggguuguucuguguuguguuuucauugaccugaagcuauaugcuucuaauuauugaagcaguaacuuuauguuaugcauagcuuaccacacuaaacauuuugaaaaaggucaaguuucaaccuagaaggacuuuggaaguauagcugauacuuugaggaaugaagacuuugauauaaauucacaguauuaagaauaaaauuucagccaauagaguuuguugucuauauuuuaaauauccuuaacuuucugugaguaaagcaugugucuggcuuauucagaaucaagagggcaguguaugauaaggguccagucuguacuaacauuaaugcuuauauuuauaucaagugauucaguuaggauuuauugagagaaauucaucuauuugaguucacucuuugcuuggaauuacugugguuggcauucuguagcuguguuccugggaccuuugcggaucuugaggguaagccucccaaagaugcagaagaauauggggaagaauauauucgggaaucauucugaggccugggaggaagaagauggagucauaaauugcacagaaacggagucuuauucucacuuguccccaaguguucaucuggucuucagucuccuuaucuagacaugagaacauaauaugaagaagguuaaauuuauucuuguagcauggaagccauuauagcgagauauuuguguaagcuaucguaucuucauuguaucuguuugaucuagggaaauaucuugagagaguauuacuucguuugaagucaacuuaaaaacaaaagggaacagggccacuucugcaguagauggaccuaacccuugucuucaauuugauuuuuuggaugguaaugauuuaagcggucuucugcauauucagauggaugggugaaggggugguuuuauucauuuaacaucagacacaugcuuguuggauuuuaaugauccugauguaguauugagguccuacaaauuuauaacauuucauuuuuuacauauaauuuuuuaagucuucuacuuuuuuuuuacugagucauaagguuaauggugaauguagaguccagaccacuuugguaaaucgagauguugauaagauguguaggaaacauuguagggaagaagcuucggcugccugucagcuuacaaaaccucgugccuaggaaagcuggauaucugaggcgguaaaggcaggaugggaucaguggucuaggaauagaagagucuucauaugaugagcuggaggcagggcucgcgaugauggaaagcgcucucaugaagccuucacaagcggcacuagcguccuaugcgccuaaggugccgucuaugcuucugaguuccuaucuagcacaacugucuuaagggugugagaaagauccaaagucugaggcuuuguaggcacagccuggcuaaguggauuuucugaggguuuagaggcaaggccuggcuagugaggccaauuaauauuauuugacuuaaagagauuuuugcaaggagagaagagaggaggaggaauuccaagcaaagguuuuuaaauguaaaugcucaguucuuugauaagaucuguuuguaggagaaucaguuucccagugcuuugagaaguacacuaaguauauccaaaugagaauuugaaaauguuuccccaaaguacuauugguauggauuugcuuaugaacugagaauaacaauaauaauaaaccucauuuucuccuguuuuagaauuaggccaagaauauagaucugcagauauuucaucaucugauaaaguuuuacuucauugucuucagagcacacauuaacacauggcuaugugcucugugggcuaccuagguaacaguuauccuuguggcuccucuccuuuuggcccagcucucucuuuccugcucuguauucagcccaugcaaauuuauuuuaaugcugcucuauuucaucuuuaaucaggcaggcaaauauuccaauaaaaagucucaaagugaauauuuaugacccaguacuaaauauauacccuauaacuuuggggagagccauuugucagguucauaaaaugacagauaguccccccuccauaaauaaaauuacucuggaagaauuaaugaaagagaauuaagaugcuguagacuagagaagaaaaauauuauuuuuugauuuuuuuuaauuuucauaugggauuucacuuccuuuuuaguucuaauugaaaauacaucuuugccuuuuuugugacugggucaaagacuuuuuaaaauuauaauguuuuccuuaaaucauuaauaagauuugacauuacaauaaucaaaauguuuaaccaacauuaaccaaucuggacuagauucuuuggggcauaggaagaguuaauuuuguggcauguaguaaucuacaacaacauacuuagugauacaaagcagaacaucuggaaggaacuguuuuagugugggauuuucugaggguuuucagaggaaggggcuguugauucauacauacagugugguuuagauaugcgguucaacuggcccaauaaagaugaggauguccuugucuuauggaggagauaaagaaagggagaccaugacauuccuuagagugcuacuucacuguccugucaacaaaaauugcaacuauugaccauaaccuuugcuauaucgugaagauaaagguuauuguaugauuaauggucaaggauggauugaccauuauuccaacagagccagugaagggggccaccaacaagucucccuugucuuagcaaauagaagagggaaaaugagucuugaacagaugauacaacuuaaggagucuaaggagcuaaggucuguaauauaugguuuuaaaauaaaaugauagccaauguguggaccuuaaauguuaaaaacaugacaaauuagcucauuuagacagaagauucuucagccuagaguuugggagaaaaauccaugaucuaauuagcuggacgauugucagugcaggggaugaggccaauguuuauuugcuuucaugcaauucuauuuaaaaaaaaaaaguauuuucuaaagguccuuugguucaucuugaucccccauaggccgugugagcaggccagcuuaccagcuuauuuauugugacauguaaagaucaccaguugaaguccugcuccugccaugucuguuccuucugcugauuugccaacuucccagccauacuucauggcuauggauuagcaucuauugauguguaaacauccugaggacugucagcccuggaggacccucugcagccugucucuuguuucuuucugccagcacacaccuugcaaaaugauuuuuaaaaugaaagacuauguauugaccagaaacugcagucugcuuccuugucaauggaguuuacaaggguaguuagguacuuacugcucugcaagcacagggaggccucagggauaucgcauuagucacauucuucuccuuaucugacuuuauuuaaaagauacucucauguaauucaaaaucaucagcuggaaauggauuuuuuaaaaaauacaacaauaaaauguguucuauauacaucauagaguugggauaauucacuaauggacuucguguaguguaauguuuuaaaugcuugcguacacuuuugcaauagccucugauaauuggaugauauuaaagaguaccaguuagcacuuccaccccagaaauuuaagaauaucuucaaguuuugacagaaaagaguguaguccauacugccugcaguuccuauagacugguuauaaaccaucacgguauagcacagaguccauaggcuuuaaaaggcucuucuuugucagauaugguauauuuacuuauaugucucuauagaacacacacacacacacacacacacacacacaaaguuauaauucaggguauuaaacucugggccuuguacaugccagguagauacccuaccauugaguuauaucacaagcucaagacauuguacuggaauuuuguugagaugguagaauaaaaauauauugcagaaaugcagaaaauugccauuuaucuucuuuuaaaauaacuauuuuauguuuugauuaugugaguguguguaugucuguguguggguguaugcgugugugaggacagguuccuguggaguccagcagacggcuucagauccuuuagucguugugaauugccaaacaugggugcugggucugagcugguaucuuuguggcauuaaccacagacccaucuuucuagcccugggugaugaguuuuuauauuuuauugcaucugauguauguuuuacaccacagccauguuauuguuuaccuggcauaguuucuuagccauccaaaaggaauaacuguauggguauuuuacuuccauguauaucugugugcacccugugcaugucuggugccguggauccccacagaacuggaguuacugccaguugugagaugcuggguggaugcugggaauugaacucagguccucuggaagaacagucagugcuccuaacugcuaagucaucucuccagccuccaaaaggaauacuuuaucuuaagaguaauggcauguagagaugaugaaacaugguaaugagcguggugguguucuuagaggcaguaagcaucccgaaaaggaaguccggguggggcacucugaaaagucacagacuuaggucgaauuuguggaacugguuugcacuggauucugugucacccccugugccaccuuaacucuuucuguuuuauuucaggcacggauuucucaguuggaucauuuucaugaucuuccauuuccuaccuccucucagacucauccuuagaaauacucaagucccuuaaaaauaacagagauuuucuuggucugcguuucagaagucucucuaaauuaugcgugugcugugucaucuugcagggccgugggccacuguguggugggauguguguagggguacagucugugccacugccggcuuugcccugucuuaaagcuucccuggccucucugagcucauuucccaguuuuccacugccgaagugguaauuccucaucucagcaggccaggaagugugucugucuccuugcaaaaugcuugacagguuguuggcauuuaauagacauuaauguuucugucuucauguccuuauacauaaaauggauuuuacuuauaaaguauaugauugguaucuuggcuuauaacuauuuucaacacgguuguggguaaaaauguuuugaaaaauguugacuuucaagcagcgugucucuaaggcugcucuugccuuucccuucccccuccuuucccuucuguuggaacacacgagggcucucacgggcuguuccuaguugaauuaacucacuacauuaauuaaaaauuaauaauuaauugcauuugcuguguucugccauguaccugucugcaugucccugaagcaugggagcucuuuggacuguuugcucaucuuuuauccguucacccuucguucuucucugugagaaauuucucccucaaguucugcuucccuuacuguguccucuacaagugggcauggcugcuucucccucugucuuugcuuggaauggauggucggccucuuacuucacagugguuugguucugauugauguggggugauuauggcuccuguuucccuauccaguuaauugaaaucuaccucauagucaagacccaacugacucggcucccuuccagaguugcgcagcccauguagacuacaacuaggggaugaaggcagacagcaacaaaaguccucucaacugugggauuagugaugaaagaguauuauccaaugagguucaggguugguugguggugagcguguuugggagagcaugagaaguuuugaagcagcuucuggccgugagguuccuggcaggguaggccagagaagagggagccugcuguaccugauagccauuuuuaguucaguuagcaagagauuggucaugaauguucaaaacucuguugucugaggaagaucuaaacagagcuaaugugcuugauagaagcuuuggauuucuaaccugccugggugcucucucucuuaguuuaauggucucucagucccucagcauggagcaagcuuagaaaccagaguacuauagagcaagaagaguaagguagggaggcauugaggacgacaccugaggucagcugugguuaccauauauacaugugcacaugugugcacaccauacccguggcauguccauagauacaugaacaguugcaugcauacuuuguauacauuagaaugaaguaagcgcuacagguuaacauacaauuucucuucucacaagcaugugcucuggucuuacauuuccucauaucuauauuagucaugaaguuaaaagagacauuuguucugccaagacaauauggucuuuuggcuagaacucagaaauugaaagcuuugauuuguugguuuuugcaagcaucuuguauccgaggaauuaaccugaccuaaaauaauuuggcaguaaaagauuaaucauguaccacuuaauaagaagcaauauaauuauuuaaggugguuucuguuuuuuuuuuuuaguuuuuucauuuaauaugugaauuaauuguuaauauaauuucuuuuccugagacuaaaaaguuguucaaucuuguuuuugaguuugaucaugcauuugguauuuuccuuugagaaugaaaaagauacauuuuaaguggaaauauaggcccauguagaaagaauuaaacuuucuagcaccgccauuuacuaauaauacugagacacucugaagguuaaaaaacaggugagggugucaugcccaguagccuaaaauccacacugacugggaaacucacuugcuaacuccggccaaccuccucuuugacaugaagcucauggaguccugacucugaccuguccaaccccuguuugauguaaagccagcaguuacgaaguucugauucugaccuguuguuugacaaacauuuuacauacauuaacuccacagucgucucugaagcaaggguagaugcuguuagagucaugugcuuugugaagucauaacccgagacugugagacgcaaaguuauuuacccccgaugagcaggugugaguuagcagagcuccugucaaacuccuccacugcaaaguagcccauggguuauguggguucuguauugucaaggcuuuguucauuacugugcagucuugaguacaugugaaagcagcugaagcccacacucugauauuuguuaucgaccuggauagucaaaccauacauacuuggagaguugcagaaugcaugacuuggcacaugcuggccugauucuguuaaagggccagguuuugccaccugguccagacgugugcuggauaggagagguuaauauaucgcaguggacagagaaauggacucuaguguugauagugcgucaggcagagcaccugcagaagcaggaacuccauggagauacuugaggcuggaaggaaggacagaguuagaauuguagccuguuugaacugggcaauuaccuaguuugucuuuuucuucauuugaaacaaacaaaaaaaaugauaagguccaauucagaaauauugaauuaaaauauggcaauaugcccagaacugcgucuggcacauauuaauggauaauuaauaauugcuaguucagcagugaaaaaaauaacacacccguggugucuggcagcaucaggcuuuagaauuggacugccuauccacuguggaauuguacuuugguucacauaugccuguguuugcuuugaaauccaguguaauccucacugguaauccaagaagaagaauaacacacacacacacacacacacacacacacacacacacacacucacuccuauacacagcuucacauuugcacucacauuuucauuauugucuuguacuggggaaaaaucuguauaaaguuguuuuuuaauacauaagacauucuuauacuuagauaccugcuauaaucacagacauauuggacaagugauugcaagcaguagaauuacauuauuagagggaaggcuguacagaaauauaucuguuuuuuuuuuuuaauauuccacuuguauagaguggaugcuauuuguuuggugauggggcuagggguugaacaugucagcugaccauucagccacugaguuauagccguagccccagagugugauuccuagagauuuauuguaacaagaauggagcugaggucggagucauaugguguacacaggacauaacagugucacugugccauuuggauagcucaccuguuuuuguuuuguuuuguuuuguuuuguuuuguuuuguuuuguuuuguuuuuuuccuucuuuuuuuucccccucauuuguugguauugcuuuugagacagggucuuacagugcagugcaggcuggccucaaacuuccagagaucugccugccucugcccccagcccccagugcugggauucaaaggugugugacacuagaccuggcugacccuuucccauguggaagaacauaagcucuaccccuccuuccaguggugagcugauucucuggugcuuguuguacuguguauauagaagcaaacgucuucucugguguagggcagugauuuacggggagugccacuaggugaacucaggcaugucccaaacugacguucuuccugcucaguguccccaagugccaggucacuucccuacaagccacagugaccagcucaucauauauauagaguuucucuuaucagguacugacuaaaauggcuacuuuauacaugauuguauacccuguaguuuguugaugauauuucuauguucuugaaugucaucuuugaaaauuauuaugucuuuacuaugaggaaggaaaccuauuuucuaagcuuaaauuaucauuaaaccuuaaaauucaaugacuauaaaguagcaguaaaacagcaacaauauucauuaaauuuaaauugccuuuaaguaaaauuucaaccuucguagguauaaucuugaaucacaacagaaaugucaaauaacauaaaacucaaaacguuuuucuaauuccguacugagccuacagaguauuaaauauuaaacauuaauuuauuucaugcuauuggcaguucacagugauucaguguuuaaugaaaaaggccccaguuaugagauggugucuacauucugugacaacuguguguuuguuuaccacugauuaacaggguuuauuuugguggucugcauaucucaauauuauuaagccauauaugaaaauacuuaguuuagguagaucugacaucugaacuugguaacuugcaaaauuaaaauucuaucucuuuuggaaaauauaucuuuuuuuuuuaaugaaagaaaugauacaguggugguagauauuagauguagggaugccaugccucauaaguuuaagaaauguagugaaaucuugcaaaugagucugggaaaagaaaaacugccuuaaauaaguacaggaaguuuuugaacagaauuagaacccuccagaauacauguauuucuucauagacuagagucagcgugguuauauguuuuacauggguuuauuucuuuauauuguuauuaucuguaggugcuagagugaauuacuaauauuucuguacuuuuuaaaaaauauguaaauugggggggaauuggagauggcucagcaauuaagagcauucacugguccuuccagaggcccagggaggguucaguucccaggaaccacauggcaggacacaaguaucuguaacuccauuuccaggggauccuacacccacccauagccaugcaggcagacuuuugugccugcuaguuagcuaauagcacaugucaccuugugauaguguaugugacgugaggggucaguugugagcuguggacagugguaagacaggcagacccucaauagcuccacacagcacaguucugugguguaggcuggacuguguuguacuugaugugccccagucaggaaaugacuacacacauagcaggugcucuuuguguuguuuacuugugacacacagagacagacacucucuucugaagcuaccucggccacuuucccucaucagaaaacaaaggcauccuccugcgucauccccagucauccccaacgugugccaguaagcccacccagcagcuccccuccgcuuccagccccaugcuguccucccaccagcucuguggugauccuguuggcuuuguuuggguucgguuauccaacucauaggguuuaauggaggaaauugugucucacugagucucagggcauuuauuguauauuuucacccuaauuaauuaauuaauuagacacagguuuucuguagcucaggcuggucucucaguucccucagugucuugauuacaggcauuacguugcacuguuuaggaauacuggcgugggccuucucuccugcucuguguuuaucucuuuaagagcuaaaguugguuuucauuuuaacauaucaguccauuaaagcuuguaucaccgaacaugguugcccuuuaaauguuggauuugggacgguuguaguuacaguccgauauaccuuccucaucuuucaaauaucuacaccacacuaauuuucaccuuguuuuaguugagagaauucgagauucaccaaagaugucuuaggaaauagaccgucuggacaguguccuagcugaugguuuuguccuagcacugauguaauuguuggguugcguucccacauucaaugugccguauaacuaugauggcaccuucuguaguccugugaacauaucuguugaacguggugaagauuugcucggugaaauggaaucuucucucaagcgcagcaaacauccugcaucuucacaccuggcuacugcggggaucgucugugcugagugcuguggcuuccaaugcacuaaaaaucauauucuggacucauuuguuuuccucagguugagacgguaugacaacuaaauuugucaaguggaaguuggaaggcgggaguauuggacuaugaaaaugaaguuucugagaagccacaguuaucacagagugagaaaaaccggagaguacuccaagugugugagagacaacagcuuagaauuagugucaaggccgaggacauacagaaggaguuuugaacuuuagauuucauaguaagauuuugaaacaguuuggaugguaugcaacaggagaagaggaaaaaggaaugcauuugaauuuauucugcaacuucuuagaauuacgaaugaacucaagaauuauugugccacagguaacacgaacacugccugggaaagugcucacagcagaugagagacaagaaugaauguaaaaaggaaugaguucacuguguguguuugucuguaugucugugugugucuguauuugucuaugugugugucucucucuguguguauauguaacuuguaagcucauagaacauccucucucuuuaagaaacaguuaaugcagcaaauggcugugcaguaggcaauguaacuauauauauauauuuuaacuuguaaacaaacagguuugggaaauaccuaagagcaggagcaaccauguacacgcacacacuugugcagacauguauagaguuucuuuuauuuuaaggagaaagaagaacucuguuuuguauguggcugcaguuuuaucauggccugauuaucaaauauaauuuaaauaaaaauuuuuuauggagccuauuuuuggaaacauuucaucccagauauuaaaacauaaaauaacuacaacaacaguauaggguuuuauacaaggcaauucccaugaauuaaagcauagaauaauuaacaguuugggguugagugugccguuuucuauguucuauauaaaggauuggcuagucuuaccaaugccacuauuuuaucguguuuuacagucuucgugcuugcuccugguuuuauuugaacuuuaggaaagcaccucaaagcagaggagucagagaugcacagcucagccaggggugugccagacagcgucacacucuggcuuucaguguuggccacacgcucucucccuguggaaguaccuaccgggcaggaggccccgaugaagaucauagcgccuuaguuuaggacagaagugcuucacaccgcacacggcugcggcagggagaagugacaagcaccaaguuuugccgugcuaucaugcagaaaagguagcuuuuguuagacuaggcugaacugaagccccugauguucccagaauuacuuugcuaaaaaauaaaaaaauaaauaaaauaaaaaucucuauuugcaaauguuucaaguuagcaacaaaagcaaauuugagaugaucccaaaagauuuaaaaaucuuauaaaaucuuuuuagaauccagaaaucauguccagagcucaguuuuaugaaauuuuuuuuuuuuuuuggucuaccuuaaauugugucaaggauguaguuucauugugccgugucaguguguacacaggaccaguauggauaaaauuaagugaucaacuuccauuuuuuuggggugccagccauaucuugguugacuguaguuuugugaaaucgccugcccgcuagcuccucaucgggacucaucugucguccucugagccuccgcuacacucagcgcgaagcucuuuccuauguaagccagaaagaguguguucucaccucucaugaaccacugaugucaccugcccagucaagacagcagcuggccagguucuuuucauaccaauacacuuuuagagagaugacaaaaccaaacaaagcaccauaaucaaguaaaagccccagacucaccagugguuccuccgggcuuuacugcaaagucaccugacacagcugaaggcuggagcagccgcuugcacucagaaucuaccccuggauguagucuucaggccuaauuguucacaaacacaauuugguuuauuaguggauuuaggaguacaguaugagguuuuuguaaucuaauguucauaugcaaucuaaagauacgguauuauuuuuuguggggaaaaaaacccagaugaaagacauaaauugagauguguuugcuuucauaugagguaucaugauaacauuugaaaguguaaauguuggaaucgggaacucacaccugaauuuucucuaaaaugugugaugaggcauggcacauuuuuuugugcuuuguuuguguaucuuuaaaaggaagauuuuuaaauccagcagcuucaugaaacuaauauacauauuaaauaaaauuauaggugugcuauuaaucuaccugacaggguacccaacaggugauauucuucuugcauuugauauaauuuauuuaugaauauugagcuucaagguucacuggcuauaauguguguuugucugugugucugugucuaugcaugccuaugugugcccgugugugaaucugcaugucugugugugccugugugugucugcaugugccugugugugaaucugcaugcaugugcaugugcccauguguguguauggguguguguguauaaugcaaaguauaaaugucaacucaucauaaguuauaugcuagaucuucaauuaaucuaaugacccuaauuugugugggaguuuuuccuacuauaacaagagcccaaacuacucaaauaggcaugaugaggcugcccugaggaagaauauauacuccugucccacauaaaagcucauuugcauagcuagagccauauccaguucagugcugucucagucucaugccacgguuuauauuaucuggguucaguacaauauuuaaaaugcuccauguucuugggcuucuguaagcuuuuacauguguguaugccguuuggaauaucuuuuugaugucagacuuuuacauuuuuuuuuacauagaaaagaauguuugucauuauuguaggcuaaguaguuaggaacuaaccaaguaccuuuuggaggugaacuguucaucacagagacaaggggaucuguuucuuuuuguugacuuaauggugcccuuucaauccggagcucccuaguggcagucuugguuugagucuuuccugacauguucauuuggagccugcuacucugauauuuguacuguucugugugccaacaucaaggggauacuuuuaucaaaauaaaauaacagccccuauuuacccacucuggccccuccugugcuuaugcccuggugagugucauauccugaucuguugccuuuuuacaauacauacucuuuuaguuauugggaaaauaaauccuuuguuuucuaaucacguuccucuccugagucaggacagcucaucaauauuaaugcucugaguagaaugagaauucuaaaccacuguguaauucauccugggcacagguggugacacauucuuaagaaggugaagguccuaagucccuuagguuauuaugugaagacccuccucuaauuauguagccauuugguaucugcauagcuaaaaagauugcucuucaauuuagucuggucccuuauauuugaugcauuggcaaguuaucuugucauuggugaaggaccuucaucucuuuucucauuuggguaauaaauugcuaaaacaguagcuugccugucaccccuguucuucagcucugcucucugcuaacauuuccagcuuuauaaucucugggguugcuugcucuuuuucacaugcccaguccaugguuggauaaaugugaccugcgucugccccaugaccuccauggccacgaacuuccuugggagcaaaucuguccuaaauuaugaaucuuauaacuaggcauacuggcauaaucugaaaaauagcugguaguguguguguguuucuaugucucccucuuuccuacccuuucuccuuccuucccuuguggaaugauuccaguagugggcucauuaaacaggcauguuuaacuuuccauguguagaucuguuacuggcucaucuacaaaaauucaugaccuauauauaaagcaguguaggaaagccacugcugcugguccaggagaauauauccuagcuuacaugaaaggucuuacugaaacuuugaggaggcuucaauuaauaauaaaaaaaaauguugagcauaucugucccacucugugguauggcugcagucaaccuaggaccgaguguccacgaguuuugauugaaaugcuuuuccuuaguauugagauacauacauacuucagacuuagcaaaagucacugugccaugaucugucuuacauugaauucagaacaucagagggaagcuaugcuccugggaugguaauuguucaccuugguaccacgaccuuuaaccucaaaauaccucaccgguuccuucacgcucuauacacaggaaccaugaccacuuucuuauugggaugugccaauuaagaggcuuuguuuuggaaguuuuagaaaccuauucuggcuagcuucaaaucaacagaaauuaguaugcuagacugagaacauuuauaggacuagaggaaucuccuuagccgaaaucugugggccagcuacauuuuccagaaugcugugugcacgugacaaguuucccagcgucuuuccucugugucucuguccaauauauuuauucuagcauauuccaaauuauuuuuguucccaguuuuuauacuuauuuuucaggcuguauuuuauuuggagauaagagagaaggagagaagaguggcugccggcagauuccaucaagggcuucccucagucaggcuucuugguggguuugcucagaagggaaugagacgugugugaagacgagacgcauuagucagcggugccgaaaaggcagagcagugccgaaaaggcagacuacuacccagagaugagcacacacggagauguccgucccgguugcagaguuaaagaaaaccgaaacuucagcaauuugaguaucauugagguaucauuugucuacgcauucagaauuuuucaggacuaacggggaggaucaacuucugauaguaaugaagcuuucuccccuauguaaaaccguugaaccuguguauucaaaaaagauuugggcguuuguaguaggcaacagacaacacugggaagcucuacaguggcaguauucagagugcuuccuguccuuucucugugaugcuggaauggacaaagcagaaagacugaugaguuggcugugcagaaggccggcucucaggcugggggccuuaugugcugcagcgcaguagaacugcaucgcccccgucaaacugaauuagugcgcuacaugucacggguggcggggaaaccguuuugccguuaauaauaccguguuuugaaacaccacaugaagugauuaugguguguaccaaugaugcccucgguucucuguuuugcaugcgucacauccuauuuauaagguaacguuuuacaaaccagacggggcggggggaggggggaaaacgguccugaagaugagggaucuucuucagugucaccagcaaaagguucauucucuccaguggcuugagucagcauuucagaauauaaaaauuggaaugugaagauuagucugggcaugcuauugaagcggggccacucaggaaaguaaaaggugcagcgggcugcaugcaggcgcacguggguuccuuaaagaaucaaauacaaagaggguugcgcuuccugaugcuguucccagguguaaggagaugauaaugaaauucuuuaaaaaaaaaaccauucaaaucaaauuagcagauacuacuuuaauaggauuccucccucccucccuucucuccuuccuuucuuauuuuuuuaaacaucuguaucaagccuggcccuaaagcgcagggcuugguaauguuugccaugauguauugaguggguggucaucaggacauguguuguaagucugaaaacccguguguacagagugugaggcuacuccuagggaugaguugaauuucaacucauuuucagauuugauugagugagaccugacuuguuagcuuuagcuuguaccuuuaaaaaaaauguguucuauuuccaagaaagcaauaaacaaaacaaaauaaccucccucucagaccaaagccauuaaaaaauaugccuuuguaauaccuaguuuuagggaaaauguacaaaaucugaaaggcuucuuuaucaguacacgauugcucugcuauaguuuucuuacaggaaaacacugaagggacauacgugcacaugugcacagaaaucaaggcuuacaguaauccaaaccagcucucacagaacauggaugcugugaucuagcugagcuuaaacuucucuuuuguuucuauguauucgugugagaaagccgaaaaaugcccccauucccuaucagcucugugaauaguaaagguuugauggcauuaacaaaagagucaguucagugguuaagagucacucauaccuuccauuucuuaugcccucacauuugacccaggccuuucucugacucuccauuccuuccugcuaguaauuuccuucuacuuccacaguaauguacucuuguggauggggagagccuuucuguaucuaagacucauaagugcaacugguuccuggguaccuacaggguuuugccugagcagacacagaagucacaaaggauggggaguuuguguccuuguccuuaaauggguuacguuaccagaaugaaaacaaacauauaagcagacagccacagcugccugacagauguguagcaacacacauugaucagaugcagauaguaagauagauggucauuuuaucucagggcagagaggaaaguguucaagagggccuguccccaucuuccuagaaauggcauggacucucauaguuuucuguggacugagacaaugauggggcugaggcugaguucuucuggauaaugcaggggcacaauaaaaauuaauguguuugaugaaaaccauuuccccccccuguguguguucaugcuucuguuaaaagauugaauucacacacaguugguaaauacugggaugguguugaguuaaugugacaaccuccuugguuuauaggugauauauucuuuucuugacacauuaacuuaauggcuuuuguugaggggugguagcagcugagggcacccagcgggguggaggaacagagagacucaguagggagccuuagcccuugcugccuuuguguccugccugccuuuguuucuaguuccagccagccuuuuagcuuacuguugcuauaacaaauagcccuggacaaucuguuuauaaagagaaaaggcugauguuguuucagagcuuugagccucugguucacaauuaguuggccucauuguuuuauuuuauuuuaauuuuacucuauauuauuuuauugugugcauuuguauguguguacauguggggguuagaggacggcuugggggaguugguucuccccucuccaggagacugaacuccgguugucagacuugaugucgagggccuuucuuugcccgcugagcugucuugcucacugguuuuauugcuuaaagguuaugaagagacaaugaguaauggaguguuguguggugaggaaaaacugcuuaccccaugucugccaaggugggaaaagaggaagaggaugauacuaggcucucacagcugccuuugaggauaugcccuaacuuucaacccuccccaggcuacccucccacucuuuucuguuacucagcagugugucgcugacugaacaccauaccucugauguagggacuuggaggaggauauuacagguucacaggauagcacggucuugcuguauuucuaaaugacuuguaauuucuagagacuuucagucuuuuaauuuuucacuucacuuuuaauuuuagaagcauugugauguuugcuguuauuuuguuguuauuguuaguuauuguugucuguuacuggguauugaacguaagucuucauacugaacgaggagggaucuaccauuaaaugucagccaugcaguuuuggcuauacaucauuuacuguaaauauaauacuucagcuguacuuuucuaucaagaauguaauacauuuuaaugccucugauaucuuuauuaugaucuuuaaggucuuggacacggcuuggauauugugucucaugugcccuugcagugcagauuuuauauuccuggaauuuucagaaguacauauauacaauucuggcaagccucuccuccagucugcagaguagggcuuucugucauggugagauguuuuauaccucacuuccguuccaauaugauagccaaaaaccauguggcuauuaaauuuucauuaaauuaaauaagaaauuucaccucuuuguuaaacuacuacuuggcucuuguucuggauuacacggcuguagugugagccccugaagcccucuuucccagaauucuccuauguaagaaguuaacaguuucucaggggagaaacucaaguugacagccugggacagaaagaggcauauguagaccagggguggaguaucucugguuggauaucuucuggcacuccccagagccuaauguugaugucugugugcccaaggaauugaacaugggguugaguguucuaaugccaacuuccugauaguaaauaacucuuauaaacauaggagagaccucauuauauggcuagaaggcaaugcuuucuaguagaaacugagaauaacucuucagucugguugacuagaagggcuuaaauuuaggguuauugugguagaaauuagcauauugcauaagacaccaaaauuguaauggguaaaggcagguucaucuuuuauccuccagcuuuauacucagggcagguccacugcuaagaugcuuguggcucuaacuuuauacucagggcagguccauugguaagauguuaguggcucuaacuuuauacuuagggcagguccauugguaagauguuagugucucuaacuuuauacucagggcagguccauugguaagauguuagugucucuaacuuuauacucagggcagguccauuggcaagauguuagugucucuaacuuuauacuuagggcaggucuauugguaagauguuaguggcucuaacuuuauacuuagggcagguccauuggcaagauguuaguggcuuuuugucuguuuuuuuuuuuuuuuuuccaaccuaagcuguccagaagaccuacuguuuugacaguaagaaguuagaaaucgaaugccgagaugacuggcuguguugugagaugugucucaauguccuaucaucauuuucugucuuucuguccacauugcucucuccuguuaaacuggauugacacccuagguuuucccuaaagguuuuacuuccauugaaacaaaacauaggaaacauuuucuaguuucaaaucacguagucaugaaggcuuauuacagacauuuuagcagauuuauaucauucuauauucuguucuguguuuuuauggcaugcauggcuuacugcguuagcaaucaagcacuucuuaucaugcagguuaaugaaauauuuuccuacaugacauaccucaugguuacuaaaguucauagggcacggugguggccuggacuggccagugucuguggccaugugaaugggagugcuucucucuguucccuauauguccuuuaaagggccugcugcugcuuucugcuucauuauaauucacacugcauccaguguuacuggaaaacuaaugaaaacgcaggggcuaccagccuuuauuuuacugcugagaauucucagugguuacaguguuaugugccaccuaauucucuugauguugcuuuuuucuuuuaauagugauuuuuauuuucaguccagugagccauuucauccauuaacccucuaaccgcugaguaggcuccaugucacaaagaaaagcgcuuuggguuuauuguaaagauacauccucaucaugugugaacucucguguguaugugugugugcacaucugugugcguguaugugcauuuucucacuagcacuaagaacuguggcguuuuggucacucuccgagacaaaaugcuggaauaagaacaguuucacagauaguguuucuucuacaacgucucggugauagaacuguugccauagcaaaauuaggauaaauucaauaaaaccugcucagcccuuccaaggaaagccuaagccaagguguaaggauuuuaaugucacucuuuccuuuuuccauucgauuccccccaacacacaccaaacacaaaauaaacaucaguuuuacccuuccuuuugaaaaaauugauuugcuguggcagguugauggcauuagacccaggugucaacuguacagauuuguaucccaaacagcaguugucauucaugcccuguuuuaggugucuagugguauaucugaugagcaacugcggccccagaugacacaggcugcuuugaugugugggggaugucaucucugguacaccgggaagcagcucgugcgugugcauuuuaguaauaaccagaacuugauuccugauguggaguuuauagcuguugucccugcguugugacggccacgcagcagcaucuggugcguuacauuucccucaaggagggacagguccucuucucuugugcaccuacugcuggugcuggugcuggccaugaucuuuggacagcgcuuucacagcacucugugaguaucuacagcagauugaaaguuaaagcuagcuaaaccugguggcuguagccucgggaggcuaagacaggagauggcaagucugagaccagccuuaggaacucgaucaaaccacacaucaaaguuuacagaggaauaggggauagaugacgggacaucuaccucagagguaggcaguugccuaggaggcaguggguucugucuuuguagggugcacauguguguugaaguugccaguuaauccuguuuaaaucgaccuggcagcugcagcagugugaacguuuuugugcucccugaaugaaagacacacacacacacacacacacacacacacacacagccuuauauuucaauaugccuuaaacaucucagugggugggccacuccaaacccuccauguggcuaacaccuccccuccaaucuucaugauuuauuacuuaccaaaaucuauauuacaucuuugcugcccuagauccauugggggguuggggcacagcccuggagcugcucuucucuggcucuuacaugauuggucugcucccucuucugcaucucucaggccuggaccuacuccuuucccagcgaggcaguucuaaauccuucuuccucucuccguuaccuugcacaugaguucuaaagucccaccucggucuucuugcccagcgauuggccacuggcaacuuuauuuaucucagcaucuuacaugcggauucuuguacaauuuugagcaccgaauuaacauaauacaaguguuagaccaaauccacaacaugugugcacaacacacauacacacuuacacaggaagacaagagcuaaaaauaggaacagugacaccauagaaagaaagguuccugcuuacccauucuaugcuaaacaauccauagcugaaacaacugagcaccucagagauucgucucagccuguagaucagaucacaauggacauaggugcuucaguauaggauuuguguuuaaaaaccuuuaauggguuaauuggauauauauagucaacaucaaaagauccggucaaacaaaauguaccauuuacuaauuauuuuucacaauuuauaguuacuuuguaauagucagagaugaaaauauacuccaauucucauguaaauuaaauaaaugcacagugugcaaauucaucauuagcuugucuugaugugaauugaagaaaagucuuuaauucuuccaaauuaacucuuucccaguguguuaacugggaaagcaggugcuguaccaaguuaaugaaaaggcuguaggauucacuuuugauucauuuaggagcugagggucagcaugagacagcuaagguugcagguuuccauaggucauccacuccuucuuuguucucugucuagucagugaccacacacacacacacacacacacacacacacacacacacacacacacacacagugguggaaggccgcaucuacaauuugacuaggagagcacauuugcuugcauucauuugaggugugagcaaacuuuccagaccaaauugagagccaguguguggaaaagaguaaaugaagaugucauagacauacucugugaaaagacuggguuauggacugcucuuguuaguagaaguauuuagacaagcaucuucguaaugaugucacucucccacuuccuacuaucuggaaccuuaaaucuguuuuucuuucuucucuccuacaaggcaucacuuuccuucucgucuuggaacauuuauaugaugcugcuaauuuguacacauuuauaaaagaaaggaauaauaguucuucuagucaccguucuauugcugugaagaggcaccaugacgaaggcaccucuuuuaaaagagcauuuaauugggccccacuuauagcuucagggggugucuugaugaucauuguggggagccuggcaguagaaaggcuggcaugccacuggagcaugagagccaagagcuuaccccugcucugcaagaaauuugcaggcacagagagugagguguaccuggcauggacuuuugaaaccucaaaaugcaucccuaguaccaacaccuccuaguccuuccuaaacaguaccaacgaagaaccagacagugaaauaucggagccuagucccauucaaaccaccacaguaguagugugacuaauccacccuucaaaccauugauuagacuugaaagaaaaguaucacagguacuaaaccaacgagaaauuagcuuuucucuaaugucgaaaauagccacaaccuuuacaccacccccaccaccccauguggccuccuccguucuugauaggguagcaagccaccucuuuucccuucuuucccuuccugcucugcuggcuuuucaggggagcaagcacuauuggaucuuuugaugucugaauuuggucacaccucugcuucucuuaguuucuuuauucucucuuacacuuagaauaaacugugagcuccucauuucuucagcacuaaccucgcucugcauuacuuuacgucucaugccaucaccugccuaagccauguccgacuucguucucguccuccuaccuucacuguucaguuucagaagcuucugcucccucugcuuccgaggcuggggugugucgaaggucccaggaagauccccuugucucuccauuguauccucuuugagggacucagcauuuuauuuuaaaagcacugcuuguguguuuguugacgugguuauucugucucagcacugugagaagaaagcuguaaagucucugccuugugcauucugguagcuguguguuauuaaugauagguguuggaaagagugauuugaaaauaaaauguuuuaaauccucucacagaugggauguaaaacccaaauaaaauuucagaugacaaucaaaacuaauuuugugaaacuacuuaaacugaguguuaugauuguauucauccaaauggaauuauagaauuuagcuaguccaguauguuaaaguugcuggagucuuuguauuucuaaaggaaaauucuuccccccacccccugccccaccccugugugucacuucagaagaaacaaagcuaaaugacccucugaacacauagcccauaaagugacccgcagguaagauugguaggucugucagagaagcaagggucauugaugcucugugacugugguuccuucuguacagagugaacaaauacuuuaaaauggguaugccuccucagggaggaaaugcagagacagggaacuaauuugugucgauuugaagggccugaauauuuucagggucagggucuguguaauugaccugggagcucccaaccuuuucuugccuacaacagcccguuguccaucugccccacaugacuguggugauugcccauggccagugccuuggcugcaggagacucuucugucgaccucuguuuucuuccucuuccagggaccagagaaguuggguagagggcugagaacucugugccuuuuuaguguugucaaaaacugcagggcagagucuuacaaagcaguaauguuaggcaaaggaagcuuagccacaacagccagugagaguuguagagcuguagaggccaauuccaauggauucaccuacaaaacaacucucgccuaaggccagggaguguuguggaagagggcgugggaaaacuguaagagccagaggaccagggaguuugcugugagacugugucccuuaagaguguccgaggcuacacccaugaagucucaccaacaugacugccuguuagcugaacaaggucaacaacaguagaaaggucauacuggaugggggaagcccaugaagccacagccauacacaaagaacuacagggaacuaaggaaugcugagagcaaaagaaauagccuuccccugggaagaccacacugcuugguugucuaguaccaaguggucagcccuaagaaccuacauacaaguaauuuauuaagaaugagcaucauauuuaggaauauauauuuauauacauauaugcauuuaacaacaauuaaugaaaaagagguuaugaacuugacagagagcacggugguaugcaugugaggguuuguagggaggaaggggaagacacaaaugauauaauuaaauuauaguauugauaauaagagaaaagaaaaagggcagggggaauuuaaaugacugccagugacaguauacaguuuagcuguguagugaagaaaugcaugcagguuagauguuaagcauguaugguuccccuucacagcuaugaucaucacuguagagaacuguuccuuccuaucuagaacacacagcacacguuagauugccuuccuucaagacgcccuguugccuaaguguggcuguacacagcuuagaguuuugucaccuguaguuuugucaccuuugggcuauaaacuugacccucugagucacgcuugaaggaaguaaugacuaguuaagcaaacucauagccaagaagaaccuacuauuugauuaauauuuuuugagaacuuucuguggauuuuauagaauucucagaggaacguuguaaaucauuuuuuaagcauuucucuuuuuuguuuuuguuuuguuuuguuuguuuuguuucgagacaggguuucucuguauagcccuggcuguccuggaacucacuuuguagaccuggcuggccucgaacucagaaauccgccugccucugccuccauuuuuuaaaauucuauuuacaaaugaaauagaaacugagaaauccagguauuugcucaaaacaauguaccacuaauaaggcacagugguccaaaccccaaguuugauuucugaauuuggcuucuuauuacauuaaguacuucucuaugacagacucgauaauacaaaccaauaaucugugcuugucuaaaauggagaaucagaugaaugugagcacaauaccuauucauacucuaaucccaguaugauuuaguauaagugggaauuaacauuaacaauguguuguuuuggucggcuuuuauuuucugagucgaauuugcgcuaugaugcuguggcaguuuuucucuccagcugggaagguuuugauugucuguugagcuccuccuggcuguguuuggguuucucugaguuuuacuuuaacacccuuccgauuguuggcaaauauucaucaugcagcagaccugcccauccguucugcugccaacccagacaucacaacaggcacaacagcagagcagccucuguugugaauggugagacaggggagucguggaaaagagaaggcagauguggagauagguacaggcugaacuugucaagcaaaauccucugaagccuaggacuuucugagugcucagagaaucaaagauuccuauuuugaaguauuucagaugucugucugucuuucugccuauuuugauguaaggauuuucuauauagcccaggcuggccucaaacuuguggcaguguuuuuaucucagcuguggcauuuuaaguguaucaccacauuuggucccaagaugucagauuuuuggauugauuauauauucaacuugcaaagucaggacacaaaaaucuccaaaucugaaaaauucccaaauaugagagcauucuagccucaagcauuucagauuagagauaguuacucuauaugggaauccgcuuggggauguucagaguucaguacaaggaaagcugaagacauuuaugccagacauuguguuuacaggugucauuagacuuggaauugaaugagcagagcuggugagaugaacaaacaaacacucaaacacacauaccccacuuucuuagccgaagcuuagcuuacauauaaagaugacaucugggcgucggaugcuucucucugggauggaggcucuuugagggagcuggcucuuuaccccuuugcagccucuauuauuugaagcacauggguguuuucugugauguucccagcaugugugauuucucuuucugacacaugugugcugcugcaguacucaugacaucauagcuacgguuagcauacccaugaguguaacuccuuuuguggguggguggagggagacaaaccaaacuuuucuuuuuaaaaaaaauuuuuuuauuagguauuuuccucauuuauauuuccaaugcuuucccaaaagucccccauacucccucccacuccucuacccacccacucccacuucuuggcccuggcguuccccuguacugaggcauauaaaguuugcacaaccaaugggccucucuuuccacugauggcuggcuaggccaucuucugauacauauauagcuagagacaugagcuccaggggguacugguuaguucauaauguuguuccaccuguaggguugcagaucccuuuagcuccuuggauacuuucucuagcuccuccauugggggcccugugauccauccaacagcugacugugagcauccacuucuguguuugcuaggccccggcauauucucacaagagacagcuguaucaggguccuuucagcaaaaucuugcuaguguaugcaaugaugucugcguuuggcggcugauuaugggauggauccccaacuuuucuuuaaaucuuccccaacacugaccauugccauugcuccagguuacacauaacagcugguaaaaguaucugugccguccaccuuccuccagaugcaguauuuccacaucaauguccuuuuuuucccuuaauuucuguccagugaccacaacuguucugaguuucauucuuugguuugcugugcaguuuuucacguaugaauugguauugguauuugguuuauuuugguaugauuuuaauuuuauguaaauugagccaguuuaggcccccaucaccauuuuguuucuuuuugacccagcacccugagauuuuuuuuuuucccaugaugcagcaucuagaugcaguucuuucuucuucauugcagcaguguuuucuagaccagcguuuguccagguugaguuugcugaucauucuuuuggauaacaagaacauuaacuauccuggguccuucuucacguuggcguuugagcugaguuuugguugacuaccuuguacuuugggauucuaauucacaguuguucagauucauuaaauguagucuugggagucucuguuucaugugcagauuuguucucagaccucccagucugggcaaagucuagguggucucucugguguuaacacuugaagcugggauccucagauuagucaguugucuccagugaaaagcuagggaggguagugugcauggggaggaagggacaugauguaauuauaguuuccuuuuuaaaacacacaugcacaugcaugugcacacgcacacuuaauuguuuuaauuuaaaacuaugaaaagaaaccuguaccuuacagaccagagccaauuagccuuuggacuuuucuucaccagguaaacuuuguugagucuugguugugugaggacaaggcugaaagccuacuuugagcuaugcagaaaauuuauggguggagacaaaaggauuaagacuuuccucuuaaaugcaaaacuaacaguuucuacucacuacugauggcuuccgcuagagcacugauggguauacuacuaugugacauuuuacaaaugguuccuaauuaaaaaaaaauacagugcugucacguaacaacagcguuguaugaaaaaagugaggcgaugcugcuucgugauaaucuaaaguaauuuauguauuuaaacaugugcacggaacccugcaaugacauuuuuuucuuugucauugacuucccaguagcucagucguauuuuaaauauuuauguuuuauauuuuccugcaccugucccaugacaaugcacauagaccaugcaaacagagauguauuuagugcugggcuugugaaaccauuuucuuacugucccaaucuccauuggaaaugaagcugccuuuucaggcguugcuugggcaugcuauauaugaguaauugugcagauuaucaucauaagcuucucuuccgcgugcauauagcuuuugugguaaccgguaaaacauugcaucuuaauuugaaugagaaaaaaauaucaaaagcauuuaggagauaggaaaauauuuuuaaaaagaaaagaauugaagccauaucuaugaauuuaaauuuaauacauagugggaaaauggcauagauaauugaauauauaugcacuuauauaguguuguuaauguauacacaacacagugggugauauguccuuaaacuagacaaaucuuuuaaaaauuagaauauuuccuuuugguuugagaucuaccaggagaaauaaaaugaauuucaggauccaucccuugucuuguucagucucguuacccucguaucaugguguuaugaugaaccugcuucuguuagauuaacacugucgcuucucaggagaaggaaaaacaaaaguuucauggacugagaaacaaagauuaaaccuugguuguguuccgcugcuuguaucagcacagagcuauuuguugaucugugucaccuacagucugguuccaguagccaugucagaaaggcaccuggugauacgucagaagauaaagcgaauuacuguguucagugagagaaaucagcaggacuaggggcaguguuuuuaauucguaggcuggguuagagcugugguuuauucaaagcugacagccauugagccgaucccaggcauccugggaagaguaccagcuacaguagguggaccgccuggacugcaucugugugggguucgucuuggccuuggacaaggucacuguccuggucuggaugugcaguguaugguacaggcugggggccaagucaggggguugauggaccuauugaccuuguucagccuauguggaggcucagggcccaagaacagcuguuuguuucugccucucugugcuuugaaugaaaguagcucccauagauucacguguucgaauacuugguccccaguugguggagguguuugggaaggacuuggagguguggccucauuuggagguaugucacuaggugcagacuugaagguuuuaaaaggcuaggauccagccauucccuguguucucuucuuggagcaagagugaguucucagcugcuauuccagcugccuaccucugugcccuuacuuugcaaucguaaaucgcuacccuuggaaucaggaguccaguuagguacuucuaucaguugucuuaucacugcaauacaaaauaaaacaaaacaaccccccccccccaaaugaagccuaagacaccuaugguguccuuugaaauguguuuguuacuauuauccagccucuucaaaauggcugauuucauucauuagccuuaagauuuuuuuuuuuuuuugguauguaugaugguauuuuguuuaugcauguguuugugcauuuauuuauucagaauacuaaaaauaauauccagugcuuccuguauguuaagcaaaugcucuaccguugaccuccucuucagcuauaguuuguuguuguugcauguguguaucugcaugacuguauguguguggucacgauugguaugugguuacacuuugacacagguauacgaauguguggaacccagagguugauaucaggugucauccucauuuguuccccaccuaugaauugggccaggguccuuuacuuugagcccagaacucacugaucuggcaagucuagcuagccagcuugcucuauggaugccucgcuucuauuuccccagugcugggauaacaguugggcuuccccauccaccugacauuuaugcuggugcuguggauccaaauucuggucuucauacuuauguaacaaagcuauuuacccacugagccaccucuuccgccccauuaacuuauuuuuuaauugaaauauuguaauuguaaauauuuaagagacacagugugcucucucuucagguuuguaaugugugagauucagaucagggcuuuuacuuuaguugucgcuucaagccuuugccauuuucuaguguugggaucauuuaaaaucuucuccauucgcuguuuaaaauauauaguuaaauguugcccguuauaguuuccuuguuuugcuccuuaucugucaguuaaccccuccaaugaccucugggcaaccaucauucuucucucuguuguuauaagacuccuauccucccucucucucuccuuccuuuccuucuuuuccaauuccuuucccucccuccuucccucccucccucccucccucccucccucccucccucccucccucccuccccccuccuuuccuucccccuucccucccuuccucccacccuccuuuccuucccccuucccuuccucccucccucccuuccuuccaguuaccacauguaagugcaaauguuacuugcuuucaacuuuaucccaccuagcauguuuucuucuaguuucuuucacaucacaauauucacaaaggauuaaaugucauccauuuaucuugcuaaauaaugaucucuuggguuuguaucacccuggguggaugaaaugaaaagaaaagaucuuccugcuguggugugaugucauuuccugggucaagcacagaaaggaggggagcagcaguaagcguugguggcccugugcauucugauugugagugcgguguggcuggugcuucaggcuucugccaucuauaccucccugccgugauggacuguauucuuaaccuguaagcgaguggaggccugacauuuacuugggccuacagugacaggagaaggaacagagccaugcacuuucaaguucucuauuucacuugucuaugagugaagcguugauugugaagacauaaugccauaccuuauuuaaaugcugccaucuccguccccaauucaguuucucuuuccuuucauugcucagcgaauguucuauccucugugugauuuuaccaucggcauuuauaucuuaaaugcuuucugucguuuauaauuacguauugugacauaauuggagucauuacauuaucgagaaguuuugguaauggccagacugcaaccaacacaggagcguugccgaggauauguaugugguggguauuaagcauguugcugaaaaucauuugcuuuuuguguuucauggaacucccuuguaaauuugcauuuagaaugauaauucaugcuaacagcuuucaucucccuugagguagcagaaaugaguucuaaagauggcagaaugaaagagucaucuugcagauaaagucaaugagcugucaaagaauuuuucuucaucaaacacaucccaaagcacccugugcuguucuagacuuuccguaacugucaugcuaggauucuuaguucaguuuuuuauauuuuguuuuuguuuuuguuaaccaggacaaauauuaacaagcauauguggucagucaacggaaaguacuuauaaagaguaccuuggagcgguguuucaaucuucaggaaaauggugaaggggaaacccagcauugauugcuguugcuaggcaacgccuuuugcagcagauguaccagggacaguggugcugucugccagcacaaccaugcaugauaaaaagcagugcagugcugugauguuucagagacccuggaaucagccuagugcuuccucuuuuccuuuggucugcuuugauaugcauuugagaaguuaacuucacaugggccaaauauguagacagugagaaacuuggugcccuuuggggauuuuuagaguggcaugaauggauuuguugagccaacucuaggagaaucagguuuuuuaaaauuuuuuuucaaguaacauuaauuuuccugucugcuccuguguguuuccauucauucaucugugcauauacccacacauacauucacugccaagugccuugcguugcaaagcgcuguguuccuaauaguuuggucuaugcuguacugcuuccuguuggauagugcaucacuguauggauuauaaguguguugaagggacaguugugucaguguaaauguuuucugaagaaaggccucucgccuucugagcuuucgggguauacuggggaguuuguugagggcuuccucggccuccuuccucgugagacuauugccccaaucuggaagguauaucaggaguauguauugugccugagcccccuggguauauccuuuugacugccaaagagccauccuugagaaauacugaaguagacguauuagugacgaguuuaucaaugucacuugucagguugaagucauucccggagaagccacuugcugcgguguucagucagugccccacaccgcagggugacuccucagccucuucaugccaugauugcuguugauuugauugaaucggaugagcucaccuuccuucgggaacuuggucucuggaugucccucagggaagcugaggagcagcaucguugcgugggacuuaagccaccucaagaaauagagcuacauaaaagccugccaaccuccauccauguuuauacagguagauccugaagauggacgcuucagccaucuugaaaaacccaccaaugauucaacaaauaaggcagcaagcaccugaauucaccucuuuguaguugcuuucaaugucaacgcugauaaaacauuucaguggucucugugcuaugacucugaucaagucuuuaauaaagcuuuguacgcuuauaaaguauuggcauaaauuagcaagcauuuauugcuuauacaggcuguaauagagaauucuuuuuuacuuucuucaguuguguaugccuggaauccccguuucaguuagcgcuuguuaagauguuggccuuuucccaugggauagggcagcuuaauauaugguucuuauuaguuugucuaguucguuaccauuccucugucaagcuaaauggcuuuuagaugacucgugcauuuaagucuguucaaaaguuguuaagguuuguaauuuaucauauaaccauuucugaccuuguuuggucccugacuagagugauguucauugaauauauauugaagaauaugagaaacauuaaugucgcacuaaaagcauuagcaguaagcguguguguuuguguguguguggugugugugugagcacaugugcgagguggcuaaguuguugcuggcaaucaaucauaaggcuuuauuucuuauauuugguagugaagacauuuuccauuauuuauaauuuuuaaauuacuuccauuuuaaaauuagccacccucauuucagcccauguucaacagugauauauuuucugaaucuauaucauuguauaugguuugaccuuuaguugaaucugguaguaaagaucaggaugaguuaugcucgagcggagagggccuuuaauguuucuccgugcuugguguugucccaccacacaugcugugugauguuauuaauuugcuugaaucauaaugagcuuaaaaaaaaaaaccccaagucggucuuggcuaaugcauucuuggacguuaagaaagggcuguaacaccugaguguucugcaugagcugcaauggaggcagacaguugccuacaggcagcagaauguauuucugcagguguguuuucucuguguguguguguaggugacucucgaugacccuagcaguguccuuauucucauuugggagcuaaguuuuuagaauguaacuaacugaauauuuguggagucgcccccaaaccacucaaacaguaggaaggcauaaaugacucugaguguuuaaaacaugcagaagaauaaacucggucaucaguggcaugcaguggguauguggcugucuguauguuaccauucccuugggcccagcagugucuguucaccuaggcaggaauaucaaguccuugacagugcccugcccggggagagucagugacuauggcucagccuuagucacagggccugggccucuggaacaccccuggucuacuuuuuugguauacaaugacucauguagucgaucgacugugacagugaagugauugcagacagggagaccuaggcuuucagugaguccaugaggggcaaaggucaguaucauucuaaaaucauucacagcccacagaaguaaaacgcaacuucacuugagagagucgaugcauuucugaaaguuucauauuaccagaaaaccaccaucucaucauaaguuccuuaaagugcuaggcagaugcauauaugggaaaauuucaggcagccauaggggcauuuaagagugcuucaaaucuauuaagauugcagauagcacggauuuauagagcaaauauuuuuuuucaauaaaccaucuuguggggaggauugaauaagcugaaaaugaucugggaaguuuugagugucugucaccuccugggagcuagugucaauggagaaggguauugguuuaacugggcaaauucaucauuagaggcuaacagugacuuaguaguuggcccaguguggcuaugggccacucguaucagaaaacuugaaaguuacaggauauuugcuucguuaguuaaggucaacuuccugacauuguuaguauguuuggacacuuuagaaaaaaaucucuuagauuuagcuggggucauuuugcaagccuguaaucccagcuacuccaaggggcugcggcaggaacauggcagguucauuggccugucugaguuauagcggguauucaaggcuagccuaagcaacuuagugaaucccugucucacaauacaaaguaaagagaagacccgguuuauggacccaugauggagcccuugccuagugugcacaagccucuagguucagucaagccuucccuuucucuccccaagacuaccucagacuucuccuaaguguguaauugauaguauuuagaucccuaaagggucuaguacugaaucguuuucucaagauauuuaagaaguaauaaaagcaaaugcuuccuuaucuuagaauugaggaaaauguuauuauauauguauauauauauucauaaauauuauuuuagggggauuuauuaauuuuaugugugaguguucugucugucugucugucugucuguauguauguauguauguuaugugcaccaugugcaugcuuggcggccauggaggucagcagagggcaucagauccucuagaacuggaguuaggaaugauugugagcugucauguggaugcugggaaucuaaacuggguccucacugcaaucagaaguacuuuuacccauugagccuucucuucagcccauaaauacaguuuuuaaucacuaaauagauaaauagauagauaaaaaaugcacugaacaaauauguuuuacauuguauauuucucuugggucccuccuacccccauaccuuauagccauugucucuuucaugcauguagcuaccuuucucuguuuauucuuuuucuugagagcuagcugugaguguuuuguauuucuuaauacaauuugccucuuuuuuuuuuuuaauucauuuauguaaguacacuguagcuaucuucagacacuccagaagaggguaucagaucucauuagggaugguugugagccaccaugugguugcugggauuugaacucaggaccuuuagaagagcagucaguucucuuaacugcugagccaucucuccagccgcacaauuugccucuuaagaggcaaaauugagaccacuaauauagcuacucauguaacaagagagaaaaugaguguuagaacauuuuauucuugaaauucagauucaaugcccaagaagauguuaaauuaaaacguuuaggaacaaauuuuauaugauauuugacauuuuuuugacaugguuucuccuucagaagucuuuauuaccuucaccacacucacagccauuaauuagacuuaauuauguaacuauacuggcgcucacucguguuucuucagaaagccaguuuucugguccugccuccucccaucccuguagucucuaacaacaguggcagcugaaguuuguuagguugcuuaaccuuccuuucuguggcucaccuugcugcagauugaaaauaauuuuuuuuuacgucaugcguguccaagcccccuuuuguagucaguauggcauaacuuuuguuuacacaucauuugcauuguacgugaagcagggguugagugugcaugggaggauguguguaagguugucuagaaauacucugcuauuuaucuaggauacugagcaucgugacaucuugcugucuaugucagcuucuuggauuccaagggcugauugcguuaccagcguguccugggcauuggugugugcucuucugucgggguuaagccucucuacaccgcucugauguugacuuuauuauuaucuccucuggaaagauaaauuaacauaguggaugagaacugaaauacuuugugcguugucaccagaccuuugcagcugcaagcugguaaauccgccucucucucuaacguccauauuucccuuggguagaagaagcacacgcgcgcauacaccugcaaaccucgccaaucugagaacucugcacagcuucaagauauaaaugaccagugcaguucagcaggacauuacugagccacgauggcguuuuccucccagggaagguaaagcuguggcuguccuacugaaucugccaguucccucuucccaggcaucccguucucucuucucaggcaucccguucucucuucccaggcaucccguucucucuucccaggcauccuguucucucccugcgcaaacuaugcuuguagguucacacuuucacuuuuaacuuuaaaaaccaagcccuuguugcuggguuggaguuuggccugucaggucauuauuaguuaaacuuguguaaaauaacaaaauucccaucaugucagauuucgguguuucuuuggacuugaaaggauccccacaucgcaccuguguuucucgcucccgucccacuuacuggcuuugauuccucucuacaaaugcucguuguucucauuggcuguguuuccauaaaauaaaggccaacccacaggcuguuuaucuuagcagccugaggcuugccucuccugcccugguacgcuucuucuuccugccuuguuuccagaggcacccuguccauccccaacccuguccauccccaacccugucucccacgauggccauuagaagcucauucuuucugucacucuccuuccuucccuuuuuggaacuuccuucugcuguggcagcggcaggucuugguuagcuggaccaaucaugccaacaucgauucuccaaauguauagcuuucugggcucgaaaaaguucuccaccuucuagucuacuaauguaauucuaaugaaagccggagauuaaauaauugauauaaccaaaauguacugaucugaggggaaagaaaucagauccaaaauagaaaaauuaaaugaauccucccucacggggucacaucugauuauuuucuucugcuuauaaaugaaaacaaaacuaaacauggcucaucaacuguaguuguuuuacuuuguagacaguauaguccuuuuuccuccuuuuccuccuccuccucuuccucuucuucccacuccuccuccccuuacccccuccuucuccucucuuccuccucuuccuccccccuuuucuccucuucuuccuccucuucuuccccuuccuucuccucccuuuccuccuccuucuuucugucuucguuuuuacccuacaucuuuauaucaggguccuugauacaugugucacuggcuagccuuuucccauggguccugcucuuccgaugugacauuuuccacaucuccuuuauuuaguagcucccaauucauuggccuuucccacuccuaugcuguauguuaguuugaaguaggaggacagguccuaauagacugcauuguagugcuccgauggagcuuaagguuucuaggguuccugucgaaggguaaaaaugaccaugguggagggagaagaggcaugaaucccaaaaaggacuggaaagagggcucagcuguuaaaaacuccuguggauuuuucugaguagaguuccauuuaccugacaaucauguuaggcaguucaaaacugccuguaacucccacccaagcugauccacuguuucugguuuccuuagaaaccugcauguauauacacauagcccauauacacaugcacaaauacaauccaaaguuucauaaauaaauaagauuaaagagaaaccuacauccagauaguaagugauacugcaucuacucuuuuucaauuaaucuuuguuacugaugauggggaauuagauacaucagugacugauccaugcuaggggguuuagccuugccauaugcccuacaucagugacugauccaugcuaggugguuuagccuugccauaugcccuacaucagugacugauccgugcuaggugguuuagccuagccauaugcccuagauggaugaguaacuuaacucuaacuucugucuuuaacucuacccagugucuuuauuaugucuagaagugaccaaucauguucauuuuaagcaauguaaauauccaagaccaaucuuaaauauuauggcuuucuuagacuaacauuccuugcucaccauaaggaaugagcuguucagggaacucaacuuucuucagccugccucuggguaugucagcacuuuuggcaaaucaauauauuuaagagggaauugaaaaauuaauagggauuauauuaccacaaacuuagguuuuguaguuguuaaauuggcugcaaugaaauaaugaauagucaccuaaacuguuaaaaugcacuauacucacucuaacgcgcccaguguuuggagguuuuccucaccgcccccgugcuucaucaaagcauuacauguaaagugcugcccgggccacaguucgauuagucgugucuuuuggaguaugacagauuuacguaucucagaagaugcugaguaaggaguucuacucaggcuguacugaaauugccuuuaugcagcgcaguggaugagacccagaaauagaauagguuauugauuuuugccuauuuugcauuuauggcaagagaaaaauaauacuuguaauuuuucuuucaagcauacaaagucugugcagaauuuuucucucucauuucuugucugauguugauauuaccagaacuuuccauaggcucccgccuccacauuugcaucugugaagucagcaugccuguaguaucugucuaacugauuagcugcuucauuuccccacagauuuugcauugcacuuucuuauucaggaucccucucacuuucucaaguugguuuaugguagaauaucgguuugaauguaagacuuucucuuccuucuccuccugcuauucuucuuccucuucuuccuccucuuccuucuccuccugcuauucuucuucuucuucuuccuccucuuccuucucccuccuccuccuccuccuuuuugauauuuaguugaauagaauguagaccuauauuuuuuuaaaaaauaaauuugaauuuagauuuuucuacuuuucguacauguggaucauuccuguuuuucacaguuaagacaauuuuaacaaguaaaaauuaagaagcuugguuuucuguuaggaauugaagucaagauagagaugggcaauucaugaaaccacuuaagccaagcacuuccucagccuucguagcuuucaaguaaugccaugauccagaguuuacuggugaugaaaggcagagauaagagcuguagcucacuggucuguuaccguacuaacagaaacugacauuugcaacacacacuguaccucaugucccuuuucuuaaaggagacaugcuuuguuuuggccucauugccaugaaucugucucaggaaagggucuuaagagaaaacccacucccucuuuuuguuguucugugcauuauaaaaggaaagaaaagggaauacagcguuugauuggagcagugagcauccccucguggaucugguaaccuuguuaaaaggugauguccucguaucuucuccugaguuaguuuauaguugauaaacuagcagcuugcaagaugugcccuggguuucuaucucuccucuccacacaccuauuacuucacauguuugccugugugcacaacacaugccugaugcccacaggggcuagaagagggcauuggauccauagaucugaguugcagauggcuucgagcuuccauguugguauggggaaucaaacccugguccucugaagagcagccagugugcuuagccauggagucaucccugugucuccuuuuuucuauauucuuauaucugacuccugugauuuuagacacuuccccuuuggaagcucagagucucuuacucuccucuucuuguguuccgcccuucuggaagaaccagaccgugcacaaacugcaggggugaguugacugcaaauccagccuguucuaguaaggccucaaagcaacaagaacagaacauacgagaaucucaggaaucuagucaagccuugggcugcauauuaaaagcugguucugcucagcuaugguuucccuacaaauuuaaaguuauacuaaaauaguuuaugaauucaagcccaguugacucuucuuuaaaagauuuauuuauauauuuuacauauacgaauguuuugucugcauguaugccuguauaccagagauaacaucagaucucacugugaaugguugugaagauccaugugguuugguagaaauugaacucaggaccucuggaagagcagccacugagccaucucuccagccugccaguagauucuugaugaagaugugacagagucauugacacauauagcuaauaagcguuagucaucuaccuugauaacucuuggauuuucacugucucugaauguuuguguucucaauauuaaauguguacauaaguaacuuuuuaaguaacugagguaguaucaaaaauuccucuuaagucagauuuugcuaauauugaaggaaaacuagggguucugaaauaucaggccauucaaauauacacagcaccuaauggacaaccacgugguaagucauugacgccuucauuaaguagcuggugaacccuucacaguuagucaggugacaauuucaagcuuuauaagauaaaagagcuagguugauccuucggaauuauguaaggacacacucuaaucuggacacaguggcaaacacaggguaggugaagauaaagauaccuggaaccugccuucuaggagcacaaaugggaaagacgacagagaauccguggggacucagcccuaacuguuccagggaacugugagaaccugaagggugcaaaggugacagacuucagagauggagagaugaguggcaggugagggagugggaaagugacuuuagagaugauagggcuugggacaggaguggacccugguugacugacggcaggcuguuuauuuggugcaccuacaauauuucauuguuaccacaauguauaacacuuuugaaaucccacguagacguacuuaccguguccuuuugaaaaucagaacaggacagacacccgaggcuuuguugucaaacguggcuucaaugagacugaugcucucuggcuccacaaccuuucaugugacuuggagaaacccuggcuucccagugagggaagccgugaaauggaagugggagaagauuugggucaagccaugcaucuuacuccuuucaaguagaaaaggauuuucggaagauuaucaaagaagauuccucaucaaaggagaacuuuuuguggagaggaaacguagguugacugguguccaccccaaacgcaugugcuuaaaucucagcugccaguuccucaggauguggcaauauuuggaaguauuacacuuuaaagagauaacacccucauccuguuugaauguguugucaccaaaggaagagacaccggagacaugugugcccagaagggcagccacauuugccagucaacaagacagaccaugguggaagccauauuuacucuggagagcugcuuugguuagucaugcugaacuaggccggcucuugcaagugaacaaggggacucugaggagaacacugauagagcugggacuguugacucuaauugugcagaagccaccaacaguugccagacaaaccuccaaugucaguuuacagaucuggccaaagguucaaugaaggccuauugcauuaacuuaacucauuagagugaaacauagcccuggggucagauacccacaguauaccccagggauuuguuguagguagugaaaggaaccuugagggucuuuugaaaccuuuguccccuacuucucguguagagaggcugaggaaugccacggugaugauaggaugcuuucacuaaaagcaucaaaucuuuacuugguccucaaggcaacuaaaagagggaugggugucugguguuucuucacgugccgcuucagacgaaacgaauugcacuugugcgugccuuagcugaucuagagaugaauacucauuuucugucuggugaaaaaguauugugauugcauugcucuuuaaaagugcacacggguuggagggaaagcccagcagucuuacaggagccugcauuugucucccagcacccuaacaguagcucacaagugacuauagaucuaguuccaggggauacccuuuucuggcccccguguacugcauacauauauacagucaaaauacauauaggaaauaaaaacaaauaaaucuuuuuuuauaguugcaauacaucucugagccugaguugucuacuucagggaucaggugugggugugccuguguguguauguuuuuguuugugugugcuuguauguguguuuguauguguguuuguauguguguguuuguguauguguuuguauaugugugcuuguguguuugucuguguguguauguauauguguguguguuccuauguguguguguuuguauauguuuguguguguguauguguguguguuccuauguguguguguuuguauauguuuguguguguaugagagugugcuugucacuccucucucauauuaucagcaccauccacucaggcugauggauauggaagcacacucggauugugcugagggaaugcauuuguuagucucuaugaguguuuguuuuuucagguugcuguguucugccucuaggcucugaaccuugguuucuaugucaacagauaggauucuuguggaguguuuguaagacagcuagcuggcugucaaggauacuuguuguccagaauggcuugcauuccugaggcugcacauggauuuaacaucucacaugauaccacgauaagaaacuaguuuguuuguuuguuuguuuccuucuuucuuucuuuugaaaagagaagggaaugagaggccaaaguuucaucucugaugacauuagcaaaagucacagacacucuguggacuucugugucagguauagugaagugacaguuccucucucauguguuuauuggagcacugaauugaaucuauguacaagcacagugccuaguacaguuccuggggguaagcugcuuaccccuaacuaacccuuucuccucugugcagcgaguaucugugucccugucugcucagcauccaugccucucuccuccaggaccagccucugggcuuuggguggcuucacuuucccuaauccccaccuuugugcuagggauccaacaaagggccuuagaugcugggcaagugugcuuccacugaacuguguccccagucaccucaccacuuuuaaaccuugaaaugggcaaggugauugugcugcaauacaccccaaauucccacuuguuuaugaaguaauuucacaaacauucuuccuuaaagggcaagaaauauuuguuggcugccuuuuucucuguacacccaagccuagggcuggaguacauucaaaggacguucaaaggacccuucucuccuggugcucucaguacagugacuucacaggggcagaguagggaugguccuuaucuagcagguguauguagaacagccagagguacaaucccaaauuaaguuuggugccaaguguaguaacuguucacuuuacucuaaaagaguuaauuaagcaauuauaaguuaaaaaaaaaaagccuuaguucccauuggucaauuagaggcuccuggaagaaugguuaauuauugaauguguucacuuuauauuaucuuuuuauguaaucuagaaaagaaaauauuccaggcgcugguugugcaugcccuuaaucccagcacucaguaagcagaggcauguagagcucugaguuccaagacagccagggcuauacagagaaaccaugucucaaaaaaaaaaaaaaaaaaaaaaaaccaaaaaaaacccaccaaaccaaaacaaacaacagaauuggaugcuuuaucuuacaugcauuuggccugugaaaugaaugucgucucucuuuagcauccucugaacgguagauguaagcaaaguguucuucucaugccaagcugcugauggcucuuaacgaaucagugccacucucugcucagaggcuucauagaguggcugguuucaucuguccugucauuagaaaacuugccuugacugugaagucucuguguuauugagagccaccugcuggcagggucacuccugcauauggccacccugauuuagaugcuuacggcugauggggacauauugaucuuauuaauuuuaugugugcauggggguggggucaaauauuauaagaaugucacugaagcugccaagagcaagaauaugucacuacuaaaaguuagcuugguacuguggccaggauagaagcuauugggccccggcuuguguaucucaugaugauuacaaauucacacuggcauguuuaacagaaaccuaaaauuguguaugguacugccugguguuagacauuguauauacaauuuaacaguagacauuuaauuuuuagaguaucugagauuuagagcaaaauugugaugauagcgcagaguuaccaaguuuucucuguuuacuguuauccuaguauugcacacugcuauaguuaguggacagugacagugcacaggucugugcuauacagacguucuuagcuuucacauaacaaucuuuucccgaucuuguauccugccauaccagucuagucaucguguuauuccagcuuucaguuacugugacaacuucccagacuugcuuuuuugacagucuugccuguuuucccgauuauuggucaaggauugcagaacgaaccuuauguagcagaaggucacauuuguugaagugggcuuuauuggguggaguuacaugcagauauggguuacauagagggaaaguucugauucuauuggcuucuucccaaccccugagaaagcugugacuuacuguugcuguuggccuuaaucacaugaccaguugguguuggcccuaaucacauaaccaguguaucuuccccacagucuuuugaagaacacugcuguguucagcccacacugaugggcuugggguuuuguccuaccugugaaaggagucugugacgguuacacaugcuauuggcaauuuucucaagggaauauuuaugucuucaucuauuagguguuuguaucaguauauguuuagagacucuaguuuuggacuuugaguuacauuggaaucuacccuagcuugucacucgcaaaguguccucacuucgaccaccuccuuggguuaugucccuuugacaucccccaaucauugugaaacuuuuuauuuauuuuaaaaguauaucccaacauuauagcuuucuaugaugcuccaggcucaucuucuguauuuccugcuguguccugggagcagccaugucuucagugagcccugauuucucauagcaaagaguuuagaaaccaggauccuaucccuggcugcugggccuuugcuccucugucacauagaagaguuuuagccguccucccuuuauuaacuuuuuaaauuuuagauauuucuuauuuuuauguguauguguauuuuaccugcaugcaggcuugcacauguacguaccuguugcccgaaagggcaucauauccucugaaacugaaauuauggacaguuucgagucauuccguaggugcugggaauugaacccagguccucugcaaggaauaagugcucauaacuauggagcugccucuccagcccccuaacuccaggguuuuguuuguuuggugggggagggguccaaguuuuaauuuguuuggguuucuauauuaagcaauaccauuucuauuaaauauuagggaccagaacuguuaaauaguugugacuucuaugccuuuggaaagaauguucuguugcagguaucuuaaagaauugcaggagcaaaacaaaauaaaaaggaaaacaaaguaaacagaacacagauguguaggacucgcugucagggaugcugugggugaugcuugggcagagugccuuugcaguagccuuugugagcagggggaucccugaggaugaagccagggccuccuccguggagcuccugaggcaagcauccuguaccugagcuccccagcucccgacucucagcucugccggcuuucauuuuuuauggacuucugucuguuuaugacuagacuaagaagugcaaguagccacucaauuguauuuacuccuuagaacauuucuuuuuuuuuuuuuuuuuuuugcuggaugccuaauaucuuaauuaugcagugaaaagugaucugcaguaucuacucccaggaaugacuguucuaguaggugauuaucuaaucacccaguggucaggaaaggacaacacgguauuagguauuuuccuggcaaacacucucccuaucuagaacucaacaacuuagagagaucagagagaucugauaaaugauuuaauuuauauuaaaugauauauaguagaaugauagaaaguagaaaauauuugacauuacaucucauugauauucuugccaagaaagauaacaccuuaucaccuuauucuuaacaugacuuauuaauauucuuugauaguauguauauauauauauauauuacauucugcuuguuuuguuugggccuagaacuucuuauuuagaccaggcuggccuugaacucacagagaauuguuggccuggccucugugccacugugcccacacauauaaugcauucugacuucuuucaugccagccuccuacugucucccgcacaccucucuuacccuggcuacucccccggacuuccuuacaacuccauuuucacauucaugucucuuuauuuuguccugugauccagggccuuucucuccauagaaucugggcucuauauggaguugaagggccuccucuguggcuucaugagugaagacaaucgcuggcucucucuuagaauuuggucgcuaauaauucagcaggguagcagcguuggggcaggccugguacgggacugacgacucguucuucuuuucuucuuuucuuuucuuuuuuuuuuuuuuuugccaaaaauauuuauuuauuauggauuuauuuguuuauuuauuuagagaaugucugugugugugucuaucuuucugucuucuuuuguuucugugugucggugugcgggcauguguauggcacaguauguauguggagcucagaggacagcuugugggagucgguuuucuccuuccaccauguggucccuggggccaaaggucaucaugcuugguggcaaacaccuuuacuugcugaaccauuuuaccauuccuaagguuuauuuucaauagcuguuaacugagaguugucuggggacugggaagcucuggcuauuccguagaggacccagguucauuccccagcaccacacggcagcucacaacaguccuuaacuccaguucgaagagaucuacagcaccaggcaugcauguggucuauauuaucugugcaugcaggccauaccuauauauacaaaauaaaauaaaucugaaaagaagaaaaagauggaccccuucaugguacagucaguuacuacucagaggaagccggcuuaccuuuccaugugaagggagcuuguucuccuuggcagccaagcccugcagcugcugccugugcccuggacugcccgcugcccgacccuacuugccuuugaggguuggaggugaggugaugcagcaucaauggcacagauucugggagcaggugagaaagaccacagcaagcuccuuuagucccuguccacccucacaccauuggccccaagaaagcaucucuuuuagacagcaguucccgauuggcuagcacugucugcaucagcaauccuuggucucucagacaguccucaauuagguccuccugcaggagauaccuuuguuuauguagaggcaccucacagcuccuccuauaugcagcagcugcugcuggccaagccuugcgaucuuuuuagauucagaacaaaacaaaacaacaacagcaacaacgacagaaacccaacuuugguucuuuuauaggauuccuuccccuccagugaugagcagaaaggccccucacucacaguaacaagcuacguaaauuuuguagagguuuuuuuuucauaauagagaacguguagccacaaagaguaagauuuagaagagcguugugugugucugagagagacagagagagagagagagagagagagagagagagagagagagagagagauaugccaugcagucuaaauguuccuggacuauuugggaccuggaggguggguuguggccaugccugugggacugacaggaugauguaugaccuuaggccgcuggaagcaaggccagcuguguucauguguauaugaacauucacuuugccacagaggcccagugucagaguccugcugucaggcuguaaaggaauuccaggcaaaugugaggccuacuguaaggguagcuuuuugugucugacgaugaacuuguacccacucacuuuuguugcccccgguuugauaaacuacuuagcuaucuauucgaugacuucaccaucacaggcauuuugacuuuuggcucaaagcagagccucgguaugaacuuaguuuugcuguaguucagggagccagauuucauacagucaguuuccaggaaacuguaaggauagugauauguguguagcaguuugucuuuuuucuuuuuuaauccacaucuuugccaggagaguuugcuguguaauaaaaaggugagagucuauagcugucugugugccaagccuaguguagaugauucggugcucgagguagcugguagcugcaagagagccuaugcaaagagcuguguguaguacuccucacuguuccugaggggucagaugcaagucuauaguccuguuuguggaaauucucugaagagaggaacagcuccuggguugucgguguccuguagaguuucuguggugauggacacacccucucucuugcugcauaauaugacagccacaggccauauaggucugcucagugcuugcaauguugggacauggcuggggacuugaauuuuaaacaauucaacuuacauuuuauuuccaauuuaaauagccacauuugucuagucauugcucuuucuuuggacagcacagcucuaaaauguuuacuuuucuaacauucggaagugcuuagacccccacaauacgucuaacuaacaacccagaaguaaguaguuagucuuuuguugugaguuuccuugugucuggcugcugcaugugugccucugaaaguucaugguggaaccaggcacccuuaggaaucuagaguuguagauuagcucaggaaggcauugcaccacucuaaaugaugcgcaccugggacugcaaggggaugugugugguaaguuugugucuguguugucuccccacccaggacuuggugagcauggugcaggaugcucugcugccucauuugcucugccauugauccuuugcccucgaauaaaggcgaagauuggaacggggaucuuggaaacagauaugacagaggaccaggaaaucugaugucugcugcaaggcuaugucuuuuggauaugauagggagacuuugcuagugauaucuuaacaguauggcugccuaaagaagaccggaacaaugacaucacuaauugacaugcuaguguggcugggagaagucucaccagggcccuaaucccagcaauuuacaauugugaagagaggggagaguuggucuuccccaagaaugaguguccucauuguuuauccaguaccaauuggucagcucuaaagacaugaguauaggcaacauuaaauggacucagaagguuguauuuaaauauucagucauacauauguagcaguaauaauuaaagaauaagaggccauuaauuuaggaggaguaggggugaugugggaggggcuggaaggggaugugauguaacuauuuuaaaaaaagaaaauaagacacaccucccauuaaaacaaaguauuacccuuuuuagaauaucuuaagaucagaguaggaguuauuuauuacuguagcguuuuccaaagagagguaccgucaggucaucucauuccuuuagagcugaauucuaauaauuacgucuuuagagaucacaggaauucuuuaacccccuuuaaaguuacugagaaaucgcagagcagcucuguggggaggggucacaguucauguuuccuuuccuuuucuagaaacauuuacuaaaaauucuaauuaucugucacuuucagauuaaaagagaaaccacacacagccucaucuguguaaauauauauacauagauuaaaauccuuaugauacugaaaaaaaauuguauaaguccuuauuuucccaagagaaaacuucuguuuuuuccgauugcuuuuggauacauuuuucuuccuuccuuccuuccuuccuuccuuccuuccuuccuuccuuccuuccuuccuuccuuccuuccuuccucccucccucccucccucccucccucccucccucccucccucccucccuuuuccuucuuuuuaucucaguguuucucagacuuucagaguuacagauuucuggcuuaguagguuugccauaggcccugguuucuggugcugauguggcuggucaaggccugcucuucagcaaugacugagccaucuugcuugaucauccaggaaccccaugaucugcuggcagauaugggccuucacugaaagaaaccaaagcugaaagaaaguccuuuccccaggaccacgugauaaauuggggugaagagcuaccuuagucugggaagacuuuugauauugucuguuagguuucaaaccuggacaaaugguugggguaccacuuaacauaucaaaguggaccuggcugucaggcucucccugcaucccucaguccccgccuguugcaggacccuccugguuguguagaccuugccccacacucuaaacucugccgcucagggggcucggcugcucuucccuuuauaauccaagcucuuuucuuaucuguggggcuccugggugcugcaccuggccccccucuguccccucuuccuuccuguccccccucucccacacagcacagcucagggugauguccacucuggacucccccagaggccccugacccuggcugugaucucccacaggucgguaguaaaccuucugcucugccauauccaggagcagccaggguucccuccuuuuccuuuuuauuucuuuuauucauucauucuccauuguacaccaggaauuuaguccccaaaucccucugagaguucaaacauguucaauauccucaucucauccuuugcggagcuauuuagaugcaauccuuccaguacucauauauuuauucagucauauguuugagucuuuuucucuuuucaagaggacaauaacuauuuuuuuuuuaccuuguaaaaggcuagugugcugacucaaaaaggccagauacuaugaaagccugcagacccagaacucauacaaaaggacgagagaagugacucuuuagaguuauccuguggcauguucaugcauuugcgugcgugcacacacacguacacgcacaugcacgcacacacacacuaacaacuuuaaauuuuuuaaagaggaagcauaaagguaccauccccuuuaaagaaacaauugauugcgcuuguuaagaccacucacagucaaugacaagaaagggggacaugcaguccuauaacuguuuuucuaaacccuaacuugucuguagaaccauuauuugugggcccagcgaauuuagguggaugaugaaugacccaggacagggagucugauaaccacacggccagagucccuauacuuguauuggcugcagcaaggugccuuuacugcuuguaugauuggagugugugugugugugugugugugugugugugagagagagagagagagagagagagagagagagagagagagagagagagagagagagagagagaaagagagagagagaauuguaggggaacaaagaaacccaugcuaucauaaacuugguccuacugagugguuucauaucacauauccugcauaucagauauuuacauuaugauucauaacaguaguaaaauugcaauuaugaaguaggaacaaaaauaauuuuaugguuggugggaagggaaggggcugagguucuguguuacaggguagcagcauuaggcaguuugagaagcaccgaccuaaggccagugugugguuuuacuuauccugcagccuuuuaggggaucauuuugaggaaacugguccuggugggaguauguaauuuagccaaagucucucacauuuaagguaagcaaucaagcuggggcauaaauacccuaccuuggacugacacguaagggcuggcagugauacucacugggaguugugugcaaaacuccacauuccucgaaguaaauuauucuccaucaaugcaaaacuaaauuuuuagacugagcccacguuucucccaucugucuguugaccaguuccuuugcuaaaaugucagguagcgugucuugccguggcuaucccagggagauuuuauggcagccauuuggguguuaacugccguguguugugagcuucaauuugucuuaaagcuacaaagagcuuccaugacauuugcaccaauaacucagguuuguuauucuucauuucuccuugguaggucugauggcuuuccaaacaaaggcaguccucuaaguaccuggcauaaccuaguucauggaggugcuuggauaaaacucccggagaugucuauuuaagaucaguuccuuagauucccccauuguccccaaggucuuuuuaccucuuguaugaguguuuuaacagaauauuucauaaugauauucagauuuacaauaauugauuuguggauacuauugauaacucuacacugaacaaauacaugguaacuaauucauguagucaagucauugccguguggcuaugaggacuguauuggcucuuagauguuucccuuaccuacugaguaagguaaaaaucacugacuugaaaauaaacuccuuccugccuuuggaugucagcuuucuuuucuguuaguuaugcugcuuuccuccuugaguggagugagauggcgugugucauucauaccagugucugugcaguggagugacaguaagcaguggccaggcggugccucuccuuaaaauaguuuuucuucaugaaaaagcucugaaaucagagcacagugguccaacuagaacguagacaucuuggagaaacagguuggaagcaagacugccaugugaccccuugagacaaacaucuuuaggaagaacacaucaacuaggaacauuaguaaaagggucacgcuuauagagagggucagggugucuucgauggcagaacacuuugcagauggugguggcauuugugugucugaacuuagagccacugaaucgggccacuugaacaugaagaugcuuaaguggcacugugguggagugcacgcuuauauucugagcccugcguuugagcucccacacuacagacaauaaacacaucaacaguuacaaacagaguugaauacuggugcuucaguggaaaauguaagcgaagaaaagagcaguauguguugagcaucugagcugccuucugggcaucucuccaguggauguaccaucacacccggcaguuugugaccagcagauccauuugguggaguggaucccaccugguuaggaaucuguucucucauguuccaggcugugguccuaggggcagggccagcacacgcucagugagugaggacaccguuccccucaguagcccacgugugguccgugcacucgauaugaccacagccuagccagcucucuggagaugacuuggccucagaugugagacugggcagcaugguggccucaccuuucugucacucaccagcugcacacagauucuaaaggaauuucugaaccuuuucugugugagaauagccauacuuguaagaaccaugcacggcuuagaggacccgaguuugaguaccauucuuacccuuacguggugaggaucuauggccggaaucugcugcucuccuggaguuaccgucuaacagcgccgcuuuuacaagaggggagcucugugacguggccagugcuguacugaugugaaaugagucuugacuggacagaaaguuacaaacuuaauaauaaugugaaauucuacuuucuagcaagucaccuugcuauucuuuaguuucagagcaauuauaaaauugugaacgauuuggaguaggaggaaggggucugguuaacucagccaggcacgauuuucuccuuauaagugucucuggccugucuaguaguccgguauguuguggacacugcucauugucuuugaacuuuuuauccuuuggugugugggauaggaggagaguggagguggagaugggggagcagcggaggcauuugcuucucuuucuagcuccugggucaggucacuccuuacagccaccugcuacucugccaagggaucuaauccccucuucuggcuucuguagacaagugcaugcacacacacgugcacacacacgcacaacaacaacagcaauaauaacaacaacaacauuuuuuuuccucagaagaaagcaggucuuaaggcugcuggcucuugucacggacacacuggucauguuuggagagugcagcagaccccuguccuaugcacggccuuacuuuggcccgauuuccuucaugauggugguuuagauaccuauguguuuuccauuuuggauucuccuguaaguuauagcauuucacugguuccuucauuagugagaucaauaaaauuauuuaccuuuguuuauuuuuuaagagucauaauuuuacuuuuauaaagaaaucuuuccuuuuuggaagauacauuuauuuuuauuuugugugcauguauguuugcuuguauguauauguaccacauucaugcaguaccuaaagacgccagaagggggcaccagauuuuuccuguaauugugguuauggguccgugucccgcgggggauggggugggggggggggcauguugauauucagaacuaaacccuggguccgcugaaagaguagcuggugcuuuuaauugcucagcuaucucuuuagccuguauaaaugaauauucuguaauacaguaaaagaacacaauccugggaauuacauuucuacuuugucugucugucuguucaucugucuuuucuauuccugccuuucucccucccuaugcugugugugugugugugugugcgcgugcgugcgugauguguguuggugcaugugugugcaugugaggacagugaucaacccuaggccuuguucuccaggagccauccccccuguuuguugagacagcuucucacuuuuuagcaggcuacccagaaaagcaccguggagcgagccccuugccucugcuuuuccacgcguucaccaccaugccuggaucuuuaugugggugccuuaaaugaccucuggcccaugguuaugugacuugaaauuuuaucauuuaauacccucuaaacccaguaugucugccuuaagccuguuaguguggaagcacauuagcauaaagucgaucuaguucuuucagugaaguuuacccucucuuccucccccuggcacccgcuuccuuccccccuuucugccucucuccuuucucccuuuguuucucauagggucuuauuauagagcccgaggcuuaccagacucucaaauccucccgucucugcuucucaagggccaagacaaauugcaucuugcaucacuucagaaucuguccuauauaaaggccacaguagaaguucucugaagugauuguuaaagcagacagaaguauguuuuacagaaguuuuaucuguugcuuuguauuucuugcuuauggcaguuuucaguagagaguaauugaagaaaaaagagcauccuacuguagguaaugauuuaguuaagaaagauguuugccuguaaaauggcaucuugguauagaaaaaccaacagugcucacagaaagcaauggugcuaauuccagugacuugcuuguuuguuuuaauaccaaccacccuugugcucagaaaaguauuuccgcaucacccaaccccacagaguugagacauguaaggauugaagcucucauuucugcuguucguguggucauuuuuaaacacuaauacuagacuugcaucccaugagcuaaggccacuaaacaccacaggcuagaugguuugaaaaacaggauuuauuguucauuaucauagcucuauaaaacaggucagaguccuucugcauuguuuaacaagggcuugcuuucugguugcaaaugguuccuucuagaaaauccccuuuauuccugcaugcccaugaagaaguauauuucauuggaaccuuccuccuguuaggucaagacccaccugcaucuccugauuuagcuguaguuucuccuccgaaggcuucaucuccaugggacacuuugaggguuaaggcuuuaacauaaugaauuuugagguggauucaaacauugaguuuauaaaaagguacgguacuuuuagaagcagaaaucagacaucuaagguauaggaggcaucaagugcugucccuagaggaggccaggugagcaccacccaggcccucaugguggugacacgacaggcccacaucagugcggguucucaucuagaauggaguaauuauacuaagccacugcuguuccucgguccaaaauuuugacuaugaucucugaaguuucccccuguagugaaagaggacaauaaaccugccuuuuuacauuuuuaauuuagucuaaauuuggggaugccuuugggcaguacaugucuuuagauguuuucagcuuauauaaugguauccuagaaaagacaaaugcuuucuguuuuuccaauucuuggccuuuccguagaacugccuuuauugguuccauugcuaaugggaaugcugucacucaggacauaauauagcaugaucuuucuugguccuuggaguggcucccuuggcaguguggugucaccucagguccuggggcucuccuucugggccugaugccuuuuguugcuguaugucaugucucaucuuguaaauccuucuagcaauaccuuuuauuacugagguggcaacucuuguuucugccagggcucuacacugcuacuguuauaggucauucauuuaaaacaccuagccaaagagcagcagacagaucaucaccugcaaagagcagaccaucauauuugcuuucuucucaaacucuguguugaucauggaaaguuuuucauguauccuaggguguccucaaacucacuacggaguggagaauggccuuaaacuccugaucuucacacauccugggauuacauacaugugccagcgugccugccucaucaggccuuuuuguuaacauuuuuaccuuguaggaaauugaguuuguguuuccucaccuugagcuaucauuacuuaaggagguuagucuaacuauuucuggcuguuuuuucuccuaggccauucaucucaugguuaagguguggucauagcugugaaauuaaauggcaucuaacagccaaugaacuauauuuagauuugugcuugauaguauuuucuucccaguguuggggauugaauccagggcugugcacauaggagguaagugcucucccacuuagccauauccuaacuucuaaaaaugcuuugagacccauuugauguuuucucuuuccuuccuaguuauccaccaagcuuagucuauuugaaagauacuguuuucucauaaucuaccuuuaguguacaguuuuauugaucccccuaaauuuauacagauuuucucuuacuucugcugaugaucuuucucuuacauuaacuuuuuaugugcaugccgcugauauaaaauucuagguauaaagagcaaaacagacaauugggccaggcagcauaggccugcagucuuagcuacuugggaggcuacaauacgaagccuggaaguuuaauguucacuugggcuacagggcaaguucaaggucagccugggcaaguuaggaagacauugccacaaaccacaaaguaaaaggaggguugagaguguugcuuaguggcaaagggcuugccuagcacauuggcaguucaauccugagcaaugcaaguguguccacacgcacuuaugcacacacucauaugcacuaaugugcacuuguacacacaugugcacaccgagagcaacgugaacaaccaaagaaacgguuuagacaaaggauagaaauauaauuaaagcacacacuguuuaacuugcuaucggagguucugggcucuggagaaagucugaaagauucucuuuucucaggaccuccuuuucuaaacuaauuuuucucacuuguacuuaguggcuugcucagugccuucucaguaugagcuacguacuuugguguuaacugucuccccuccaucuucaucuucagucuuaguuaggauuuuacugcugugaacagacaccaugaccaaggcaacuguuaugagaacaacauuuaauuggggcuggcuuacagguucagagguucaguccauuaucaucaaggcaggaacauggcagcguccaggcaagcaugguacaagagacacagagaacucugcaucuucaucugaaggccacuagcagaauacuggcuuccaggcagcucagagaagggccuuaaagcccaugccccacagugacacaccuacuccaacaaggucccaucuccuaauugugccacucccugggccuagcauauucaaagccaccacagugucugagagugaagagcaguuucucacaccgaggagaaguugacauucaggaggugcucuuccagggaugaugcccucugucccgcaagugucccugugaaacuggcuucuugguuucuagucuuuggaugaagagacagggaagcugaacuugggagguuucuuggaggcaucauggagguaucaaggugucagagugugacuuauuguugugcucacuuguaucugaguuuuuuugcuugugaauccaaguuauguaccuaaugagagaauaauaaaguaguaucauuuuggcuuaaauuuguuucuuagauuagacuggugcauucaggaagaacauagcgcaguguagugggaagaguauuauucugggaggccuacaucuaggugagaaggcagcuuugccagaugacgaguacgccgggccugagccugcuauuucaucuuuucaggccugagguuuccaguucuacucugaaggagcagagguaggauaacucuuggaucucucacuucagugcuguaguggcagugagagggaguuuguaacuguagaggggacuggauagaacugggacagaggacgugaggcaugagagaugagaggguggugaaggacaggggcuguugugguggcagagcaaaggcuguugcucaggaaugcagcugauuauuuucaauggggaauuaauaagucaggugugacuaugggaauuaauagggcaggugugacuauggggaauuaauguggcaggugugacucugggggauuauuagagcaggugugacuauggggaauuauuaggucaugugugacuaugaagaauuaauagggcaggugugucuauggggaauuaguaggguggugugacuauaggaauuaauagggcaggugugacuauggagaguuaauagggcaggugugacuauagagaauuaauguggcagguuugacuauggagaauuaauaggccagguguggcuauggggaauuaauagggcagaugugacuauggagaguuaguagggcaggugugacuaugggcaauuaauagggcaggugugacuauggagaauuaauagggcaggugugacuauggguaauuaauagggcaggugugacuauggggauuuaauagggcaggugugacuauggggaauuaauagggcaggugugacuauggggauuuaauagggcaggugugacuauggggauuuaauagggcaggugugacuauggggaauuaauagggcaggugugacuauggggauuuaauagggcaggugugacuauggggauuuaauagggcaggugugacuauggggaauuaauagggcaggugugacuauggggaauuaauagggcaggugugacuauggggauuuaauaggguaggugugacuauggggaauuaauagggcaggugugacuauggggaauuaauagggcaggugugacuauggggauuuaauagggcaggugugacuauggggaauuaauagggcaggugugacuauggggaauuaauagggcaggugugacuauggagaauuauuaggcuaggugugacuaugggaauuauuaggccagguaugacucuggagaauuaaucgggcaggugugacuauggcuacuaaugagaaacacuucuuaaucuuagaagaggucuuacugcucuguuuguuuuguugagaaaaaucaccuuaaaggaggaaaggccuauuuugcucacgguuuuagucuguggucaguuggcuccauuauuuuuguguccauggcaaaauagcaaauuguuggugcaaguugauguguguaccucauggugcauaggaaguagagaaugggaagaaaggagacccuuggcccccuaaaugacuucgcuucuucacaucacaccccacuuucugguaaaaccacagacuggccaauaagccauuaauaugugggccugauuaaacauaacacuuccagauuguaacugggauuaguuuucuguugaaaacuaaaauuaacuggggaagauguaaggcgauugcuuccuuauauuuccaucuuaaugagguuaacaucauauauuuauuaaaagauuuauaaaacaauagcaguuucugccauauaaacaggauuauccgcuguagaauguaaugugggucucucccuaccugaaaucuuggcuuugagacucugggucuggaagauguugcucaguagacugagcugcagaggugauggugagucccagaggugaaugcuguucauccuccuuacucagguuaggggugaauccauaaccccacauccuuaagccacgcaucucuuucuuuucuuuuuucuuuuuuuucuuuuuuggugauuugaauucuuucuuuuuucccccuuuuagacagggucuuguguugcccaagguuagacucaaacuagcucauuagcuggugaugaccuugagcuaucucuuauccuaccucuaccuuugcuaguauagagagucaacaccacaccugcuuuaugugacaccaggggcagaacauaggacucuaugcauguuaggcaacaauuguaccaaggagaaacaccuuccacucccuuugaauucuuuuauaauuaaacaauuuguacaucuuugggcauucugagauuaacugugucugucuguggagggaaacuuugguaacccaauacaugauauaacaaaccuauacaguuguuaguauuuuccuugaauucccugagucuucuguguaccaaaugggaugugaucuguacuguugcuggggaugaugucggcuuuguggcaguggaggugucaguugagaaccugaagugcuuugcauuaauuuucuaaguagacagaauauuauaucauagcggaauaugauuuaaaagaccuccuuucugucgugguccagggaagcuucuguuugaagaaccgugcagaacagacagcucccuuuaccacagcugcuuuaccguaauucucuagugugcccccaagaguuguuccucugcuacauucccucacgacccagcuuugcguggccgcuucccuucguggaaagaauccuucacguaucaacuguccccugcucacaagaauaucuguuugcauuccaaccacacaggccccucuuguuucucaggguugaggguggauggggcgagauggaugagaguccuuuucauagcuuaagcaaucucuccgucucagggagacagauacagucuguaugauggauaugcuuuaggggaauguguuuuuggcaugaggcuucuguguguuuacagcuuagcacguuucuccaucacucuucucauuacgugcucuguuuuuguggguucuggggagucuuugagagggaaauuuaccuuccugggaucuuguuacagugguugccucagccacacaaaacaaaacaaaaaauucaugacguugcaugcgagguguaaggcaugccaggugguuuuaauauuccuccagacacacagucuuugaguuuuagaugcuuucuuacuuggggaugcacuggcuauagaacuuguucugcagaggcucuggggagaggacaaggaggugaugguacacuccucaucacgugcccaagcccagaacacacuuagaccccagauuugguuuucuaaggagggugcggagacgcucucagaguugaaaaugaagaccacauugguuacuuuucagaaaguacuauagaacaaacuuuugauauuaguugaaaggaaucagaucuuuauuuugccuuuccuuuaugaauuucaccagagauguaaccacuuagcaugaggaaaaaacucccuucagcaacaaaagaaaaauggcucagaaauugucugguaaccccugggacagugagugguugugaguaccccggagaggcaguggggaucacguaaugucaaccugugaguuccccggcccgugacugcucaccuauuuugcaaacugucaacuagucagguucuuccagugaccaacagugacuggaggcaagaaggacaggaggaccacugagaagacagcauggugagacaacuugccuaacagcucucuagaacagauagaugacucggauuuaucaaugggaagaaacaugccaggaaggaauaacaaaccauggguggugacuguauaguagauaucggccaguguuacugucuggaucuguuucugauccucaguguacaaauaaagaacaaaagauuaugaugugggaaagguagugcugccuaaguauuugaagacauuaagggggugcuacucacguguuugaggaauuagaauauggagguuaaaaacaaacuauauaaauggaacuauugacaucuugggggaugaaacaauguggcaguaggauuugcucacguaagggccaaaugauggagauuguacaggaagaaagacuggcuugcauuaguaaagguggaagacaggugcauuuuuuucuucaugugcaugggauggaaauaaucugucagaauaucuccaagagggaauuguaggugaagauauguaguaauucuuaaaacaguaagagaucagggaguuagaauccuuagcggaaauccuuuuguguugaauguuuuggccacuaguuggcuguuguuauuuuaaauucauacauguaccugucuacuuucccauggcacuauucauuuuguggaugaugcucuuacaacagaagcaacuccagcagaguccauuggcuugugguccgugagcaucucugaacugucuauaaguggcuucuagacuugggguguuaagauaagguuggagauugcugucccuuagcauaccacuucagcaucuaaguuuguuuuugaggguagcucuauccuuuggcuugagcuuugccuaccucuugaaucaugcaauucacaaaggucacgggucccaccuacuuggugcuagaaggaccuugucuaauuccucacuugguucauucaaguggcugccaauuaagcaucuaccuccagguuaugguugaguuccuauggcaaagacccaccccccuccuccaccauuucaccuucagaacuguuguuacacucuggaagauuuuccaauuacuacaucuaauuagagggaagaauaaauuaccgaagcaaguuaaauuaucucgugugucacaacaauaauuaacauucaaauaggaaacugcugccauuuuuauaaacaucacuaaguggaggcagcaccuccugaaagcaggaagcauggguaucucccucgcugaagucuggcguaaauaaguaugguuugagagagaucugcuggccugagcgugcgagaggccaauaccaccagaggacauuuauauucagugcguucacuucugcuucccuggcaggacacacucagcuccacagugcuagcuugggcuuguauuugugauuuguaaggagugccauaagaggggacauacuucaucuuauucaguuauuaaauuuucuagccuuguaucauuacauauauuauuuggggauuuaaaaaugucaguauggaguuagcugaaaggcuauaggcagaaugccuuuuaaauuauaaaggcccccaaaacaaaugauaaacagaauaaagcugccccuguccuuguuuggcaugagguaugugggaagauaagacucgguggccauagguagcuggaguuggaaaucauaucuguuuagucaauaaaugguccuucaccuagaauucauuuagacaacugacaaguuaacucuggcuuucauaauacuggcuuaugauuucuguucuugcuuaucuuuuacauuuacaaacacuuaagugauacuugaguugagaccaauggaaucugauuuaagagauagcgguugaguuguaauuugcucauaauggagagauugcccugagaacguccagcacauuaggggagucuuugaagguuuaaauuaacuuugggggagauuugacuuggacaccaguacagauccugauaccacaggccaauaggagcuguaguuucuuguaacugcacacuaugccagaggaaacgucagaguuuuucuuugcuuagguuucuuuuccucuucaucugugcugguuagcacaaacagucggugcgucuucccuuucacccuggagcuuguggcuucaacaucuacgggauuuagggcucaccagcaaccccagcaagaggcugaugucagccuuauucucguuucuuugaaaauggccuuuuucugauggacagagcaugugagucguuccucauguuuuaaagaaaaugccuuuuuccccucuaaaaaugaccccaauucaaaacuauuuuucaugcuuuccucuuuuuugcuaaggggaaaauaugauucuaaaauuuaucagagcuggacagcagcggaggaagcuggcccgauguuacccgugacaccucucaccgugguugaaugaggguaauuuugucaggugaucuccaguuuggggaacgacacuuucugagauuaaguaucauguaaaaaguuaauaauuauuuucuaguuccugaagggaauuugagcuggaaccugggcaagucaaucagaaugagacaaggagacaaggaugaaacagaaugucuuacucuugguggagcuguuuaaugcuagcuuuguuagaaaauaugguucccguuacuuuguugccuuugaaugaauaaauguccuagacauauuuugaaggaaugauaacuucucgggucaaugcaaauuacuuucuguggagaauguauugaagauaggagacuucuuagaauaaauugcauauuuugaaaaagauuuuuauucuguauaaaauacagaauaaugcacuuggaauucccagcuaauuuacccacaccucauuuacaauguguuuuaacacccuacgcaaugaauaguugguaauuaggugauugacacauccucucauaaucacacaugcaaguaaauugccccuguguuccaggagcauugccuguauaugucacacaccuuguccaguaaauauuguucggcauaacugucaguugucuggggacacugucuucacagcugacuagccccguacucugaaagcgcagugcucuuucuuagaaguaccuucaacgcugaggauaaaugguucaaacucaggcagcgagauguggggguuuaaaguacuugaauucuuaagccaggaaggagugucuauuucaggguauucacauagguuauguucacacaggauaguuagagaaggacggucaguucuguuuagugagugugugauggucuucucauuucacaagacaguggggucgcugagcaguaacuuucucucagaaaugcuuuuguuuugucucgugaaucagaaaaaucaaucguuauagcuuacgcuacuccauuuuaaaacuuacacaauuacuguaucacauauuaccauugcacaguacuaucuuauaaaauaauccucaaccauaaauuuaauaagguugauguuuauguuuauauacuauaauacuuucuacauauggcauaaugcuuaaauuucucuccuuaguacuuuuauaauaauugaugcauagccuacaaacaaaauguagauuuaaauauggaaauuuauggaaauuugaauacaugucuauguacauuccuguaacucacccuaucauuggcaucuaauggacauuuuagacauuccucauucuaaaaguagcaaaguucuacaccuggcaaggacagaaauuccauuuuaucauguuaaaaaaaauggagaucuuacagcagucaggaugucugaaauaaaauacuuaggugacaggacgugcugguuuggauguggagaaaggggaagacuccuucauuguuggcagacaugcaaacuuguacaaucacucuggaaaucaaucuggcagcuucucaaaaaguuggaaauaguucuaccugaagacucagcuauacuacaccugggcauacaccuaacagauuucccaccauaccccaaggacacaugcuccacuaucgucauagcagcuuuauucauaguagccagaaacuggaugaugucccucaagugaagaauggauaaaaaaaugugguauaucuacacaauggaaugcuauccagcuauuaaaaacaaagacaucaugaaaauugcaggcaaaugaauggaacuagaaaaauaucuuacugagugaaguaacucagacccaaaaggacagacaugacaggaaccuagcauacuguccuuuggguggcuaugcacagcaguggacugaaucagaagcagacauccauagccaaacauuaaacagcggucggggacaucuauggaagaguugggugaaguuucgaaggccccgaagcagauggggaucccacaggcagaccaacagagucaacaaauccagacccuggugcucucaggaucugagccaaaccaaagaacauacaugggcuggaacagggaccccagcacauauguugcagacaggcagcucagucuucauggcuggccaguuaggccucagugggagaggaugagcuggcagagacuugaugugccagggugggugggacacaugugggagguuuccaccuggaguccugacccauccagcagguccaguuauucuagggucucgaggggaccuucuccuaaaaaccaaguggaaggagggagagaugagaacccugugcaaugaacgauauacggaagcagucugaguagcaucaaggucucacuguauugagaaaggcucaaggcuuaaaugcacaagcaaaaggggaaguacuuuccagcaggagggguggggcaguagaaaugcacaaguaaagggggaaguacaaguacuucucagcaugagggguggggggggaaauuuuucuuuuggcagcuacacggggaagcaggaacuuggcgguaucaggguguggucaggacaucuggcgcugacuuagggcuggaauauucugugguuguucuuggaacggugcaucaguggccugcuuuugaccuccuuuucuucuuggggggagaggccccauucagagaucaggacaauuguguugucuuaauaacucccaacagagucccacacucucaagaaggggagagguauagugguagggaugggggcggguagcauuuggaauguaaacaaaaaugguggagaaaggcagauauaauuaauaacuagaaauuguuaaggcuuuacucugugcuuccauugcuaaaauagauucacuauuaauaaacacauaauaacaguaacucauuuauagguggugacaucacccagccuuaucugaagagaagguuaggcugugagugaggcuuguuaaaacuaaaggggcugcacugcuuuauuucuuucagguaugcaggacuccgaauaaaagauugagugaaacaagcuucguaucuguccuaagaauaccuguuuucaaucaucuuugaaacauuuacugaaacaguguuuuggggagacacagauaaccauaccuaauauuuaaaaacuaagaaaucaacccuuggacugaaguggaaauuaaaacaguuuuacaagucacagaaaguaaaccagguucuacucagggagucguggucucagcauaugcuuguuccgcucugaagccacagaaaaccauuucucugcuuucaagagaaagacugaacaguugcuuagaaaguaucauguauuuugcauauaaauucucugagaagucuugaaauaaacagagccuacacauaccaaagaaaauacgaagaacucuccauagucucugaaguguugaagauuaauggggaggcagacuguguguggagauaaggccaccauccuaggauggcagcguugccaaaggaugcuuuuagguggcauuauuuauuuuagauaaguguuuacugugcaugcggaagaacggaucugcaagauagcauaugggaagacucuccaaagcaaacaccauagcagguaaacauacgaaaaaggauuuaaucucacuaauggucaaagaaagacaaauggcgagacgccauuugaugaaaacuaggacaaaauauuaauauuccaauguuagcaagagcgccaacccagucacucacagcgcuguugauuugggaguagagaaaauuagggaauauuuauuaacaaucaaaacuggcuaauugaaagugaacguuguuugauauaauuguccccccaacccugaauuucuuuuuuuuuuuagacauggugucacuauuagguaaccuuggcugcucuagaacugcauaugugagaccaaaccagucuugaacucauggagauccaccugucucuagccucggugcugggauuaaaggugugcgccaccauccccugauugaugauacucuuuuuuuuuuuaagcaauaacaacaacaaaccccaaacacaaaucaacaauauggaagugguuaaaugaauugcaaguaacugggaagggaaauuuuagugggaaauaaccaggguacuauauuaauugaauaucauuugaauagcagcaguuguuuuuauagauguauacaugcuauauguaaaauacacaacauauuucaguagauauuuauagggaauagaacaaaaucagcaccuuaaauuccuuauuuuaugauacugucaaauauauuguuucauuuuauuuuuucucauuaguacacaauuuuuuaaaaaguuucaguuuguaauaauacauuuuuucucucuuauguuauuauauggcuucauuaauuucguauaauauuuggaaaacaaaugcucaggaucaaauugaaaauuuuucuauuauauauacuuuaaaaaucaaaguauuuucaucgcuauaggaguacauauguaaaacaugagaaugguaucuauauaucuguguucugauuuuugaaacauuucauaguuuuacaacuuuacauguuagacaucaugugaguuacacagauuaaauuagcauucaccagacugcacggucauacaucauuguguguaaugaucucaugggucacagugguaacugucccauagcgucucacagugacugaguuccaaauaaacgugugcagucaggguucauagcacagccuuucagucucuacacgcuuagcauccugcuuuucauuuuauuuuguuuaaggaguauguucagcagggaauauugcagagccuuacaaccaaccaugaagccaaaggcaaaagccuuaguaggcacaacgggccaacagacacaugaaagggugcuccaaggcauuugucaccgaggacacacccaucagaacagcagugagcuggcgcuucucguucaccuggaugcacagacacaggaaaacgggaacuggauguugauaaggauauagagaaaugagcauccuuguauuuuguugaugggauuauaaaauagagcagucaguggggcaaaaguuugucaaagacuaauguuaaaauuaagauauggcucagaaauuccucuggcuuuugucuuugguggacccaauagaacuaacgucgguacuuuuaaguccauguauguguaugcucaccgugagagucuucuauucguguaugcucauagugaaucucuucauaauagucagugaucuggguccgauggaucuaugcaaugguggacuuaagcuauacaaagaaugaagcacagauuaugcuacaacauggaugaaucuugaauacguuguagcaacuaaaaagaagccaggcagaaagguccuauugccuggguccauuuauaggagaugccaacacaguuaaguccauagaaaauagaggaguugucaggcucauugugagcguagaaugaagaacagcuggagugagcacagagcucauuucaggugaugaaagcauuuuacagccagguagcaugguggucacacaguggugugacugugcuggccgcuucucacucaguguuucauuuuaaaaaaauuaauguugcaugcauuucaccucaguuaaaccagaguagacuaacuacguuaucccaugucaaguagcucaucaguaccagucuuuagaguauacacucuuucacauguucuaugggccaaauugcaaguuauacaaauacaaccauuagccaauuauauggaguguuuaacauguucagggauccaugauugacagggucuccagacucuggggacuauccccacuccaagauuguacagacagaauauggaggcccuauggauugaagagacacucaguaaacagaaggcuuacauugggacaagcccagggauuaacugucuuuucacacagugagucgucugggggaacuuaccagacguacaugcauguucaggcagcauggcaucauccuucugccaguucggguacauuucugucacgcauucuggcauaaguaguucgggugagaacaugcuucagagagcugucugugcaaauauguaacuuucuucuucagggaugugcaaggaacacagcagcccguggccugugugaccucugcagaugaguuccggcucagaccaaaccuuuaauggccucagguucuugugcaaguucccccaaaaagaacccuuuagauguccagucucgcaucccagccacaucugcaaggggccucaagaacacaguauuuucuuucaaaugggaaagaagccuggagucagcagugucuguauuucuggcuuuuccuuccuagucuuggaguaaaaaaauagaaggauaaggcuaacuauaugugaaucauuguauugccaaagaguuuguuuuguuuuguuuuguuuuguuuuguuuuucuuauuuggaggagagucuguguugaggauggagccuaggacacugcaugugcuagguaugugcucuacuguggagccccacucccauccccccaccugugacuuuaucguucaguuguacaaacucuguuauuuuguaacuaaacuuaacagucaugcaugccccuucucuccuuucugacacuugcccacccauguugccagugccagcccaccuuaaccaaccacccuugaggagccugggaaucaaugcuguggaaacccgccauuugcacugcaccuugccugagacuauuuuuuuuuuuuuuaugauaugcuauguguguuggguuuuugccugccugcaugcuuguguggggguuucugaauccccugcaccuggaguuacagaugguugugagccgccauguggugcugggaauugaaccuggguccucuggaagagcagcuggugcucuuaacugcugagccaucucuccaggcucugggaacauucuuggcuugagagaugugggcuaaguuuuuuuucauuccuaauccauagccuuuagcaguaucaucuucuuucugucccacagaccccagugacaaagugacaugcucugguuuucuuuuucccuucuuuuucuuuucuuucuucuuuucuuuccuuuucucuuucguuuucccuucccuucccuucccuucccuucccuucccuucccuucccuucccuucccuucccuucccuucccuucccuucccuuccuccuucccuuccuccuucccuuccuccuucccuuccuccuucccuuccuccuucccuuccuccuucccuuccuccuucccuuccuccuuuccuucccuuccuccuuuccuucccuuccuccuuuccuucccuuccuccuuuccuuuccuuuccuuuccuuuccuuuccuuuccuuuccuuuccuuuccuuuccuuuccuuuuguuuccucucucucucucucucucucucucucucucucucucucucucucucucucucucucuuucuuucuuucuuucucucuuucucuggcuuucuucuuccccuuccuuccuuccuuccuuccuuccuuccuuccuuccuuccuuccuuccucccucccucccucccucccucccucccucccucccuccuucccuuccuuccuuccucccucccucccuccccccccuuccucuuuaugucauggacuauaugucaccaguuacauguucucuuuucuauucuauuuuguuucucuuuauuguuucucuuugcuuuggcaaaauacccaacaaaaagaaggcaggaagggaggguuuauuuuggcacacagaaugaggguacauuccuucauaacagggaaagccuggcagcagggcacggggcagcuugucacauugcaucugcauccaggaagguaggguaggugaugcaccucggagcaucucuuaccuucugcuguuugaguuagucuggauccccagcccauggaaugaugcucucuauauuuagggccguucuucucacaucauuuaaggugugcuagaaaccuccucacagacauacccaugguuugucuccuagggaauucuagguccuaucaaguggacaauuaaauauuagcuaccacacugcuuuaaaagucucuucuaucuuuugaaaauagaaagggaggggacagaagcuaugucuuuucuaccucuucuucucugccuuugacucccagucacagucuggauugccuccacuguucuaaguguccucucuauggcugugauaacacuuggaccaagagcaacuaaggggaggaaaggcuuuauuugacuuguacugccaggucacagcccaucauugagggaaguuaggccaggaacucaagcaggaacuugacacagaaacauugagggaugucucuugcugcuuacucaagggcucauucuuagcuggucuuccauaguccaggaucaucuccccaggcaauggugcugcauacagagggcuacacccucccauaucaauugauaaucaagccauucugaucgggacaauucuccaaacgagagacuccuuucucuggugacucuaggcaaguugacauuuuuauuucuuaacaucuuuaucucuuaccaccugucccuagcaguuuggucuucagguacaucccucgugucacugagaugacuagcagucuccauguggcuggucugaguguguacucagcucucuggaucugaccuuacaacauuuuguccuauggacagaacucucuccucugcucuugguacaagguuucugugacauuaaaccuuccuuguuucugccauguagaucugugugcucauuuuucuaccuguuuuguucuuuaaauaguaucuuugagccaccucauaaauuccuguaguuacuuuuaucauguauugugugaaugacucucaaauuuauccuccgucuuaauuaccauuguauguuuucagugauuggccuagaaccuuaguuaagaggaugaaucgauuuguauauacguuugucuagcaggaauggucauuucccuacccguuuguauugcuagucaauugugauaguuuaagaaauaugcccccacaggcugugugcuuuaacacuucguucucaguuagugaugcuagccuugcuacacaaaguacauuagcaaagauuauauaccuucacuguggugguuugacuaggaaggcccccagagacacucauguguuugaauuauuggagcauagggaguggcacuaucaggagguguggcuuuguuggaggaagcaugcuacugugauggugggucuugaggucuccuaggcucaagcuacauccauuggcagucuccugcugccuguagaucaaguuguagaacucucagcuccuccagcaccaugucugcuugugcucugucaugcuuccugccaugaugguaaaggacucagccucugaaacuauaaacagcccugaugaaauguuuuccuuuguaagaguugcuggugguugaggauaugagcucucaguuuccugcucacgccucugugccugcugccugcugccccagcucccuuccauggugcacucuuauccuucuagaaccauaaggcaaaauaagugcuuccaccgauugcuuuuggccauggugccuuaucauggcaacaccuaauguaucaccuuuuaggaagauaauaacuauaccaagagaggcauuguugggcucucucaaggacaguaagcuugguuuagggcagguacccauuuagugugagcacaugaaagaguagaugacucaggaaacaauccuggcacaagcccacagucucuguggggucuggcuuucucgguuugcaagccugccccucucuuucacacauauccccauacacaggucccucucccacacagauagcacugaggguucuuguuggaaaucugcccauucuccugaguuuucccuccccucuccucccucucuaucucuggauuucccauuucgucacaguggggagaggaaagcuaaacauaauucccaguggcuagagauaccagggucucucuggcuucugccuccagagagcagcuccgagcuuuuauaucucuuucccucuuaccugggaccaccgcgcugcccucuccauaggcaccuaacgaaagaaaggggcuuaacacauugugcaguuuuagauuuagugagauaagucgacucugcuuaaggugcagguaccuggaagaaaacuucaauuaugauuggugucuuaccuccauuucacagccacaauggcuacgguguuccuuuugauaggaaguucuuuccuuuccaacucugacuaucugggucccuucuuccgagguucugcuuuucucagacccucuccuggcguccucugcccuaaggcuccaggacuggcuguuagagauaucucaagcuguuugcugcucugcugcaugcagucugugucccaggaccugacgacacccacggcggguauuccuucugucuuaccguuugccacucugcuucucacuuauuuacuuguucuuacagagugacagcaguuucauuuauuuaucaagaugcuuacaugcucccucuuaaagagcaucuagauuaauaaacaccaagcacagaaccccaaccugaauuuauguuuuuauugagagcgcucuaauuaaacacaagcuuuaaaaaaaaaaucacccaggagagccugugugucucucaacaucugaucuguuucccaucgcagggagccaggcccucucagccuucacuuccaaguucaggggcaucuagguagauggagauuaaaauggccugguugugaauauauauauaagccuauaaaauacauauacaaauugguuaaagagcaauaaaauuucuuucuguuuccggaaugcuuagccgggcuauuaagacaugagcaugcugucaucauuccggagcugcagcucugcuguuugcccugcguaauuguuuucaaggucauucccuucuaccaaaauccaggccagcuggaaaacugucaagcagccuagacaugccgaaugaagccccguucuuacuguccguuccuagucacguagagucaugauuucgggucuccuaguuacagcuggucauugaacacaaaagucacaaugauuuacaauguuaggaacaugacuucauuaucuuuccaaccauuacauauuccaaggaucuuuucaagagaaauaauugccaaaaauaauugauguauucuaggaggaugacuauuuacggcuucauguaucacuacuggugaaagugauuaacugugcaguagguagcuccaguagaugaauauaauugagacauacagcugaagaggguugugugcuuagccagccccugggucacuuaggagauauguuagacaagcuggcaguacaccacuaacaacuggcugaaaacgguuuucuguacacagagcaaaucucuggugaagcaacacguucugaggugcuuaccaggaggguguguggcguuguucauaccuuccugugagaguucuggcacaggaguaagccuugugcauguggagaucuccacacuguauucugugugaagccuugagaugauucuuagcuagagaucuggucuauacuacugccugacuucuguaaucucaguacugaggaggcugaggcaggagaauuguugaaaguucagguuaacccugggcuauauagugaguucuauagaucaaaaacaugccucaauacucacacagaccaccaccaccaucaucaccaccaccaccaccaccaucaucaccaccaacaacaacaacacauuccccaagaacagaccugagguuucagaauuuuucaucuacucacucuuaggaaaugcuauguauucuguaucguccccagacccaugaccuuccuuuacuggaaauuuggguucagauuaagacagacaaaaaucucuagaugcuuuugauaguagauaaaaauuuaaagugacccaacaauacauaaacccauucuguuaguuuuauuagaauugcuuugaguggcuucauaaaguucagaucaguuaucuguggcccucagaguccccucugucacuguuggacagaacugcacuccucucgugcacaguucuuguuagcguggccugguucugaacucuuuucagcuugggggaagcuuauaaggcuggugcugagccagcguggugacggaugcuagcucuuucaaugguggugguuucuuuggacuggacuggcccucugagcucuuuugaaugccuugcucccauugccuugccuucucuguugauccucugacaaacuuuccagggaaugaauucaaucuaaccaaccaaggugacuuccaugguugucucuuagcugcaacagggacucccagcccugucguaccuuuucuucccugggcuuugaaacucuaggcucuucugguuugcaccuagauaucuuuguccacgguuuucauucuacauuccugccacauguacacgugcacaacuccugucuccaaaacuuugcugguuuuguaaccuaguucacccccagggcucagcauggggucucauacacugagaagcaagguguaugauugugaugugaaaagcacuaauuguuagcaacuaggaauguccaucagccugcccccuuccuucccucuuugucuuguucacgugcucucucucauucccugucagucucuaucucgacucucucucucucucucucucucccucccucccucccucccucccucccucccucccucccucccucccucccucccucccaugucugcacuccaggauagccuuucacucucccccucccccaauaacccucuugcacuaggucuguggcguugcaugcuuucuuagcugcgcaggcccaccaaaggugcuuccucaccucuuuauccacacaauaauguaucucagucagcaugagcaugcaagguugcucuuggcccaguggagaugagcaacgugagggccuggguagaagagccagagauaugugguuuggaaauagcaggacuuggggacacuucuuccugucugucauuuaaaauacacucuucuuaugcagauguguauuugauuaucuuuucagucuuuagauguaaacaguuuuuagguuaugcauuuuacaagacaucuuuaagcagcuacugauacaauccggggucuuguuuggguuuguuugguuuuuuuuuucugccaguuaaaaauuaaaaagcaggaagagccuggagugcagcccaagaaaucucaaacaccacagacagugaccgacagaaucgacaggugaacacagugaacagaugaggaaacacacgagugcaguagacaaacggagacaaagaucuucugcacagcacagggggaacucgggaagcugagaaauccagguucuucauugggcauggggguuguaaaaccucuaaaaccccccugaccuacucuaggguuggucaguuugaaggcagaaaggauggaugguugaucgguccacuacaguuguguaacguguuccgaucaggcuuugaacuuauugaaccaguccaucagcaggugaccugcagguagaccauaaaagcugccagauuuuugucugaagucaggagguuaagagagaagcuggccaucuuggaaauuccucacuuaacuauuauuauuaacaauuaacuagcgguggcuccugagccaucucucugccucccacagagucuaacucuuagucucucauacuuuguugcaggcaugguacugcauauugggaauauauauuuugaguacaaaaaagcaaauccuuguguuuauuuuccuuacugugaugaaaaacccaagauagaacaucauauaaaggagagagguuuguugagcucggaguucccaguguuuagaggcaugauguugguauuugagcccugaugaggccuuccuuggcugugucacgccuuggcaggacaguggccugugucacaucuuaguacaaggcacagagugaguccaggguugggcucgggguuuuagaacucacccuuccaggagaccguaauugcuuuuuuccaggucagaauucccagucaccuaaagaccuccuauagggcuacugcuccuaaaaguuuuaucucugcuccuaauaucacagaagugaggagcaagaucccaguaggugaaccuuguguggacagacaucauccagaucucagcaguuacagcagagaugcagaucaagacacgugucgaugcucaggacaggagcaguaggcacgcaggggaauugugagggcaacacaggauggcacuggaguauaggcaagagcuggucacaagcacuacaggacacaccgaaugagcuggugguuugcaccacaagucccuuggugggacaggcaagccuuuuuaacugcagugaaaaacagccuggccauggugguaccaugcaguuggacuccccaacugugccucuccagaugcauuuggguggggcucuacucugaagugcuuacaggguccaaguagugccacagagaagugaggcuagagacugaggucuacuguaagcaauucuaucauacuggggcugucccagugacugcuccagacuucagcauguguagcagacauguccuggcuaagaagugucagcaggcagccuacuuucucucuccuagagcuccguagaugcccucccugcagcucucuccagggucucauagacguucaucuuccuuuagucuuccccugauuuuaaggccuggcuuguccugucugggaucugagaacgugucucccuacuccugcccaagagucaccuacagucugcucucucuccaguuugagcacucaugacaaguucugcgucaggaaucuggugacaguguuggggauaauacagaaacagaaggaagucuugugagguucugagcagcugucuucauagcucuccgccuuuccccaucuucacagagcucuuuauccugggaaacucugcuaccuuccuucauuaugcacagcaauuuaguucccaaacaucccuaggcugugccccccacuguuguagauuccauagcuccuuagugcuccugugcaggggagcuggcaagagcuuuccuaucauggccuucucuuuuucucucucccccugaaucugagcgagccaagcugcggaugaauuuauuuccaaccaacacacguuuucacaucucuagccugagccgcaggaaaagguccacuugguuuucaucuuacacuuuuucuucuuauacugucagguggguaaagagacacgcacaagucucucggucagaauuucccaaucagugcugcuguuaggcagugaagaaaugugggcguaagacaguagccagcaccaaaaggaggcaggcagaucuggaagcaggugugugagcaagacagaggaugggagcuacaaguguuguagaagauacuucaucucaacugggguuucuaccccgccuuugaucgcucaguucccagauaaaagacacgcaaccuuuaaauuuauacuaagccuuaaucagcacuagagcugggcagaugucugcccgcuaugcuauuaugucuacuucccugccaauaacccugcaacacgacuugcuauguucccucugggcugcuccuaacuccaauaggccagcccucauggcaucuucucucucuaccaucuuucuucuucggagacucuccucagaccccaaaguggggacagggggaccccaccuaucucaauucugcccauuuguaggcaucuuuauucaccauucagggauaacuuaggggucaaggucacauaacuaaguguggauucuaucaacccucagguaagcaggccuucaagggcaguauuuagcauuacaauacucagcugaacuuggaaagccaaaucaccuuacuuggucucuugucuuuccaaauuuugugaauuuaaaugaguuacuugaccuccaguucagguuuuuuuguguagcccuggcuguccuggaucucacucuguagaccaggcuggccuugaacucagaaauccaccugccucugccucccaagugcugggauuaaaggaguguaccacccccccaccccccccucaguuguuuuuguuuuguuuuguuuuauaaaauaagagaaauaaccacccagggguaagagagacuggugauuuuuguguuuaccacccugaggcccuggccagcccuucccugcugugguggcuuucccugguaugguuccuguguccugcauacucuagcacaagccucuugucacaucagagacuucgcagcaucaacugcccaggacaccgcccauagacaacugaccacucaugcuuucuucaaagucaauagcauagcuuuuuguuuguucuaaauagacccagguugauucgaaucagaaaacacucugcugucauuuggaaccuaacuguucucaauaggcccccagguuaagggcugauucucacagcccauggcacgguugggaggugguugguccuaguugaugucuuuggguuacugggagcguguccucagguuagaucccagucucugugccgugguguuucaccccagccccaaagcaauaagaccaguugauuaugaaucaaaacgucaaaccuuuucaucuuagaauuguucauugcagauauugcguuacagacuucaucguggcugggaacaguuuccaaagccgaugucagugaaagccagugggccuggcuucugcugucuccucuccugaaggacucacagggcugcuugguacccucccuucugccuggcuuucagaaugcacaugggcgaagcugaaggauggaaaccacacuccgggugguaaaaagaaaauacugauguauuuggaucccuacugauguugcagaaguccugggagauaaagacacccuuauggugaagugucucaucugguggucucuuguaagcaguagaaauuaauucugcuuacacgugucuuuccaaaauuuccuuagcuuuuaaaaaaauuaauuguuaaugauuggcuucuugucaucaauuauuuaaacauccuucucagaaagggcuacuauagcugccccuucacaggucuucuauguccugcugucucucugcaugaucacuaccucguuagcaugucugaagugaucuuguuuuaauuuacugggcauuuugcucaccguccuggauggugagccauaucugaauauagauugaaggugaauuuuuacuagagagagaaaaccguggaauucguggugcugggcuaaggcagcgacauauauacugugugcguguguuuauauuguaaguucaguguacgagguguuccauauaccuucauuuucuuauuuuucaguaaauaguucaauuaggaaaaacaaauguaagggcuguggugggcuauauacaagacuguaaauuuaguccucaccacugcaaaaacaaaacaugaaauccuguaucuuauaucugcuuuuccgggauuuuucuaaaauaaacccagcuuccuuuguuaaccagcauauauuuacuucuuuuuaaacccagucucauguucccccugcuagccuugacuucucucuguagcugaggaccaucuugguucuccugcuuccaucuuguaaguaaugucauuauagacacuuggaaucacaccugguuccacauuguuuguccuaagaugcuuguaaaugagacuuuacaugugugguacacuuugaaaugcaacugcgucuuguccagcuagaaauguccugucucgugucucugcggcgucucacgucuccguggcucucugucacaaugugcauuuuuacaugucaagaugguuuucuuccuggccauuucaggggaugacauuucccagaugaaauuucagcauccgcugcaucugucacaggccaacagggccauuucauuuucacugaggauggagaaagagucgagagaauaacaaguugguuuuuaccuuagagaagcggcauuugggaaaagaaccuucauuuagaagucagucguucuucucacagcagaccaucgccggcuuuaauaauucauucugaaaccugggcuuuuguggccaaugcuucuagcucuuuacuuauuuagaggccccugucccccuugguuugcaccugcagcugccccuucuaugugcugugcacggccagcagggaguaacacauucgcuggaaucauggaagccccacagcuucccagaaaucuucaauccauugggaauuugcuugagagauuuuuccuuacgaagcucaucuuucauuugaaccauggguccagaucuguaaacucgggagcagaagcuucuggugcugggauucuugagaaauucaaagccucacgaugcauugccuggcuugaagguuuucaacucugcuagggauaaauagaauuaugcuagucucuggggugucuaacaagaacagcagaauaccgaaaacagagcaagaauccccaaagcaaagacaacccaagagggccagugaaaggacacuaaagcugccauugaggcaggggagaggagggauuucuuuagugcuacugggugacccuuucauggauaaagagggcuccuaguauuacaaaaaaagaaagaaagagagaaggaaagagagaaagaaagagagaaagagagaaaacaaaaaaacaauaaaaaacauccuuugcaucugacagcaaacaugauuaaaaagagcaacuugagaagagaucuguguuagcuuguuuccuugaucuacauacaaugucugacagaauggcagccuggcuuugaaagccugacuucaugagaaaauguaauuguuguagucucucucucucucucucucucucucucucucucucucucacacacacacacacacacacacacacacacacacacacacguguuuguguagccagaugucauaugcaccugugggcacaugugcaugacucuggaggccacaccuugaugucugguguuuuccucacucgcuccucaccuuaguuuuugagagaguuucuuacuaacuuggagcucauccauuuggcuagucaacuggccagugaacuauagugaucuggucaccucuguccucugucccuauucugggcuuauagaaacagggcugcacccagcuucuuauguauauacuggggguccaaacagacauccucuuucuugcugcaaggcgcauaacugauaaaguaucuccuaggcccuugcuguagcuuccuaaccagguagaguguuaugaugaagaacaugggcucugggacaagaggguagucugucccuugucugucccugggcaaguuacuuaccuuugugccuugauuaucuugucuguaaacuguguacucaaagguacaugaaggaaccuuccaggcaaggcuccagcauaaguugaggacaggcaaaaaaauguaaccagaggauacaaauaggaagcagggaggacacuguagggaggacggaugaucagcacugggaucaaggcagcucuuuuucuuuaucuuggucugguuuacuauuauaagcccugaaugggaagcaucuguuauucugaacaugugugaggcaaagaagugugcuugugcauugucgucguuguuguuguuguauuggaacaaggcuuuacucuguagcucagacuggcccuaaacucaaaaacuuuccaguguaucagccucccaaaugcugggacuacagcugugaacuacuguauacagcagaagguuuaaguauugcacuuugcuuuuguaucucucaggaaaccacacccuuagcccccuguauccacagggguuuuugaauguugccuacauugccuucaugacucugcuaccuaaugacucccgagucuuuccuuugucuuuucuucucugucaucuagucacuaaguaaguaugguuugcucccaacccuuuaccauuauagcauuggguuuccuuuaucucauagacucggagccugagauauuucaggguuuggaaguugugcguaguuuugaacuauugaguaucuuuaauauucaaauuacaaaacccaggagcaggaccugccugacacugugcucaguagguagagugcucaccuagagugcacagaacucaggguuccauccccagcagugcagaaaucagguugcuggcaaacaacuauaaugccagcauuucagagguagaggucagaggaucagaaguucaagguuaucuucagcaauauaauagguucacagccaguugagaauggaugaggcccucucucaaacaaaacaaagccccaaaaauuccaauggucuaggaacauuuugggguuugguuuggggauuaggauggauauccuguaccaccuuuuuggugaagcaaauucuuuaacuuuaggggaauuguaguucucugggcuacacauucuguagcuugcuucuucaguuugauuggaauuucccuuucuuugaucuccaaaucagcugcugugugauguaaagcccccuuuguccuggagauaguaccugcuucuaccaggcucuuagcuuucaugcuuccuuuggccauuugugucucuaccacuuagcacacacuucauaaagaaaaggaacucagugguguuuacaaaugaguuuuauauuaauuuauuuauauauuuuaaaagauuuauuuauuuguaugugcauuguuugugccugcaugucuguggaucugggguuacaggcaguugggagcugccauguuggugcugggaacugaacuugguucuucuggaagagcagcuagugcuauuaacaguugugccaucuccagcucgcauguauuuguuauuuuauguguaugguguuuuuucuguacaugugucuuacguaccauguguuuacagugcccacagaggccggaagagggcguuggagcccuuauacccggaguuauagacaguuguuagucuuugugugggugcugggaauggaauccagauccucuggaaaaaacaucuagugcaccuaaccacagagcuaucuccaacccucuaucucaauggguuuuaaagaugccaaagaaggccuuuucuuuuuuuuuuuuuuuuuuuuuuuuuuccauuuuuuauuagguauuuagcucauuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaauauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuuccucuguugaggggcaucuggguucuuuccaguuucuggcuauuauaaauaaggcugcuaugaacauaguggagcauguguccuucuuaccaguuggggcuucuacuggauauaugcccaggagagguauugcuggauccuccgguaguacuauguccaauuuucugaggaaccgccagacugauuuccagagugguuguacaagccugcaaucccaccaacaauggaggaguguuccucucaaagaaggccuuuucaaguuaagcuuuggaucauguuauaauuuccaugauauacucccaaauagcauagauaacuuguuauugcguauuacaaaugauagcauucuaaaacuuucuuuuguguccaaacuguuagagaauccguguggucguaaaacuuuucucugcucccaucaagaauaugcaguguauucaucaugcuguuuuauucucuuuuucuccuuuguuuucuauuuccuccuuucuagguuguuagaauuuaguaccauagguugcuaguguuuagcacaguagguuguuagcauuuagcaauguuaguggugaaaaccacaccaucaaaagcaugaugguucuucucagcuggacucuagucaagcucccugguuugguugcauucuugccauuaagguuacgcuuugguuuuguggagcagaauugguuaacagguuugggauuaugcauuugucuuuaaccaaaaccacauaggagcagugagaggacugguuugauauguuguaucaaaaguaugaaauuaagggaggugaaaguugucugcuuuauauuggucuugucaugagaggguuggaauuuguuauggagcuaacaccaaacaccaaggaacacugcccauguauuuauggccaagugucgccagccuugcaauuauuguucagcccauucgcugggaggugaaccccagaugugccuuauuuuggguaaaggaagaagagcaauauguuuacucuuucugggagcuuaguauaauuugugucuugacaauuucauuugcauccuacugaguuaaguguaggaucauggccaagaaugcuuuuucaguccugggccuugcugcuuuuuguagccugagaagucuuccuguaugauugcuuugaaaccuaugagguguuacuuuccuguucuucucaaaggaaagagggguaaaagaaaaacccauggaagugggagaucuggcucuugggcuccgagucuaccaucauuguaucagcagcagaaaggccugugguggccuauacgugugaccuuggcaucucgcugugcugugagcagagguaaaacuuagaagacuuaagccccaaucacuaugcaagugagccaguugcuuaccagagacucaggguguccuaccuguuagacguuugggucuuuuguaaugcacuugccaaagacaccaguuccuuauugagagggauuauagagugguuaaugucagcagagacagaaucagugugguguguagugaagaaggccuuagagcuaccaaggcccaccuuacuucccuugguucauuugugagcacaugcuggagaccuuguccugcuuggcugugaagauguagagccaggccaacauuuuucuuuguccuucuguggacuugcaagguagcacagcuuuaggaguguagaagagaacaugauucuugcaugagcccacaagcaaaacgggcuggagcuucaucugugccuuguagucuuucacaaucagugccaugggcugacugcucaguagugccacaguaugugcugcacuuagugggagauuugggaaauagagacaauagcaagcauauaugucauguggucuggugcgguguagacugugaggaacuuauucaaacauuuggccuuuggugcccccagugacacccacuggcuggcugacuuccucagauagcagcuauguacauggaaggcccagcugggacaacugcgcagcaauguaaguggcuugugaugggagagcuauacugaaugguaccagccaaaguuugaaaagucacuucagcucugaaaggauuuggcagccaucagggauagugaagaaaccuuaaccuugguucuuguagugaucuaauaccacgcuguuagagugaaagacccacaaugugaggacucccccauguucugacccagaagaggcgacaccccaaaucacucacaagaaacggucuugaugcaaaccacaagaggacuuuuaucccaggcacgcucaggggcccacagucguacaccacacaggguuagaggaccgugggcccugaguagcugggagaggggguauuuaaaggaagaaaccacaacucaaggggguggggagggcauuguuggaaaauaccaaaaauacuaguuaagagucaugaggaagugcaaagucacaagauucacaaggaauacuugguaauugugcagguuauuucucaagacaguuucuaugagccccuaacaauagcacauuugcauagugaguuccaagaguggucagggugacuuucuuugaacgaacacucccugaacccaggaagcagguggguggaggaaugucgcuaucuguuuuaugauuagcaugccuuggagcauugagucacaaaggucacauucucaagccugggccuaaaggccuagaaguuuuguuuuuauauuauacauuuucaagagcagggauagggcagccauggacagaguacaguuaggaguuugugucuucuuugguguuaaaaaaaaagucaugaaauugccucacaagaauuauucauuaggcacgaugaaaaucucagcaaggcuuugcaaacauccugaaaguccccgagaggagccccucgcucaagccucgggacaauagcagacccccaagaacucacgagagaccaagcuugaugcaaaccacaugaggcuuuauucggggaaagccagagcucuggagaugacucauaucccaugcagagguagaggagucgaccccaaggggaaaggggucccaguuuuuauaggcccuggucgggggaggacaaggggggaguaggggauuuccagaucuaaacaaugcaaaaugauugauuucucaagaaauggauaugggagggaaacaaggaaagagucuaaugcaggugcaguaacuccagauuggccccggcugugguuacuggggagauuuuccgacucuaucuuagcaaacaauaucacaaacaccuggcagugaggugcagcagugggcacacaccuggguucaaggaauaauucaauacauguaaaugaaauguguuacuaaucaaaucagcuuacuuaguagugucuuaguuaggguuuccauuguugugaagagacaccgugaccaaggcagcucuuauacugagacaugacucuuauauugaggaucgcuuacagugucagagguucaguccauuaucaucauggcagcauccaggcagacugggugauggagaaagagcuaaaaguucugcaucuuaguccaauugcagccaggagaggacuggcacccucaggcagccaggaggaagcucucucaaagccuaccuccacagugcauacugccucuaacaggguuacacuuccuaauaaccaccgcaguuagcauucccacccccucaaaauuuagcccauuucuaugcacuggaacucucuggacccuccuaauuguuuuugcagaauuuaguaaguuguuguagacaacauuaguuccuugccaggaagaauucucccaucuaacagcaguguuccuugauggagcccgacagggaacuccucccccugccuucucuuuguuuccccggcuucuacugagucccauucucuucccuauacuguaggaauaagguuuuuuacacuguauaaaguuuacccuuggguuauucaaaugcugauuucucugcccucaguucuuguuucaauggggaacgacauuguaaugcuuauaccaagaaucuccugucucaaguuuguguaaacaauucuuaccuuuuuuucucuacccugucaauaaauucugaucacucaaauagguuggcagaauagagaguagggugggaugucugccaaccagaggaaagagagaaaggaaagagagggagauucagaucagcacagaggaagaggauagaggguuuggagccauggggaaggggucuggagagagaucauggaaacacacugaagcccuaagagccagaugaauaauuuuaugcaagugucaugggaugaggcugggaggcagccagaucaacacagaaagucaauguaagucaguuaacugcucuauugagguauaguuuuaaauaaaccuuguaaaucuuugugguuauuggggaacgacauaaagugaagaaaucaaccaccagauuaacucacuguuuacauuuauauuaaaaauggcucauagccgggcaugguggcacacuccuuuaaucccagcacuugggaggcagaggcaggaggauuucugaguucgauggucuacagcaugaguuccaggacagccagggcuacacagagaaacccuguccaaaaaaaaaaaaaaaaaauucauuuacaguauucaaagucauuuaccccccaaaaugacucuuugcuauguuaggaauuaaaacuaagaaguugaaguauuuauuaauuuguuuaagauacauccauaaaauguuaauacaaaguauuuuaugaauuuguauggcuuuucucaacaaagaaaugaugggaauaacauuguuuacaguuuucaaauuuauucaacaucugucccaauagaugacuccuaaguccucaaggccuccucuggaaugcucucuugugacacccaggugucccccuccuggaaaacugccuacuccuuuggccaggggauggcacagagagugaguucuuguagcaugaggaccugaguuuggaacccuagaaucuacauagaggcuaaggaugacagcgugcgccugugcacugucacugagcaguggaggcagggggguccugggggcuucugcccagccagucugucagaaauugggaacuucaggaucagugguacacucugucucgaaauggaagggggaagagugggaauggaagacacugaugucagccucucuacacucacccucucacauguguguauacaaaugaacacacacacacacacacacacacacacauuauuuaaaaaaccaaacccaacucuuuaauucugagacacugagagugauaauggugaguuuuccuaguguuuggaugaggagauuugcagcugagggcaagugcauauucuuuuucaaaggaaucugaaaauucuugaugcaacucucagguaaaucuaucucuguggcgaggccauaugcuugaguauagucuggucaggaagaagaaauuucuuuucuuuccuuuccuuuuuuuuuuuuuuuuuuuaagauuuuauuuauuuuauuuaugcuaguacaccaucacuguccucagauacuccagaagagggcaucagaucccauuacagaugguugugagccaccaugugguugcugggaauuggacucaggacuguggaagagcagucagugcuccuaagggcugagccaucucuccagccaggaaguuuauuuucauuccaaaacuuucacugaggaagcauaucuaguaaaguagaaucacugacugggggaauagagauucugcucccccagccccaacccccacaccuccccuuuucaggcaagggggaugggccagguccuuugcaaguguguagcaguuuucccucuccauggccuugcagguagcuuuaucauccuuuuuguaacagauuggaaaacggaaggcaggagaaauuaaagcccuuggauuaucacacuaauuaguaguagaccugggauuuuaauacugcuugucuucuuggcuuuuuuccuguuacgucugagaagagugaguuugcuacacucauccuacaucuagaaagacaucaugacuuggaaacgggcacugugauugggcugauguauuccugccuggaagcucauuuaugagaaaucauuucugcagcaugucauuugaacccagagccaagggucuacauaaucaacccaucuucucccagggugagccaaauggaggcaaacauuggacacaauugucuuucucugcagggcucuagaugagccacggugguacaaacauggugcuuacuucccacucucugaugagacuuucccuuucuugccucucugccuucuguggccacgguggagaaauccuugauuugacuaucuauugguuugucccucugaguuauucuuaggcccuaucagacugccgugcuaauuagucuaguuagcaaacuaguuaacuaccaggugcaaguguacaccaucauuucacuuacuaggucuaauuacaaaaaggagccagcuguucuuuucccagugguaacuuagaacaacagcaucagcccacuguaggccaugaguugaagaggaaauucagggaaugaaaacccgccucaugggcuggagagguggcucaguggucaagagcacugacuucucuuccagagguccugaguucaauucccagcaaccaugugauggcucacaacaaucuguaaugggaucggaugcccucuucuggugugucuaaagauagcuacaguguacucauauacauaaaauaaacaauguagaaaaaaagaaaaccugccucauuggccacuaaugacagaaggcuugauugacaguucacuugguaauaugauucuauucuguuuugguauguaugcuauguucuguuacuuggguauaaaauguuuugucaaauugaugcuguguauuugauaguggauuuuuacugaggacuuuuuggguugcugguguugaucaugguguaaucacuucauaauaccaagacgauauuuaaaugauuuauagugaguggcuuuaauaacaacccuuuaagcagaggaaucgaacuccucucccagguucaauuauaacuaucaggugugcuuuucccgaaugagagccaaacccggaauuggugagcucuggggauuugcuguuguuguucaguaauagguugugacaaaaaggggacuggagagauggcucaaugguuaagagcacugacuguucuuccagggcuccugaguucaauuuccagcugccacaugguggcuaacaaccaccuguaaugcuguaaugggaucugaugcccucuucuggugugucugaaggcagcuccagugaacucauauacauaagauaaauaaaucuuuaaaaaugauagaaaaaaaaaaggaagaaaggaaaucucaaagugccauuaaccuggcuuugucaaugucucucucucucucucucucucucucucucucuuuuuuuguuuuguuugcuguuuguuugcuuguuuguuugagacauguauaucucuauguuguccugacuguccuggaacuagcucuguagaucaggcugacuuugaacucacaggaauuugccuaccucuacgucccuaguccaaccauuaaagguauaugccacgagaccuugcugucaacuucauuuuguaaaaucuuggcugcuugagaacuaaucucaaguccaaguguaacguucacagguuggagcagcaugauggcaagcugguggucaggaagugugauguuugaggaagggugacacucauguugccucuuccggguguuucuuuggauguuuaaauguucugggaaaggaaagccauccaugccuucucuggagauguaagcgucuaagcucagaagcaaaugcacguuaucaaguucuucacagaaucucagugaaaggagucagggaugggguuuccuuauagcagcgaaugcaaaacaacaggugacgaggcucacugcacacgggagcgaaggauggauucacagucuuagcacgcugagugaagggcagaguaagcuuucggugggauuguaggcaggagaacuggcuuagggucuagcaaagcuucaugccauggaccuucccguuggaauguggauucugcuuggaggcucuuagauuuacagcuugcugccucgcucuccacaggcuuuuucuccacagugcucuccacgggccuuugucugauguagcagaagaaauccggaacacuaauuucuaaaaguaugauuacauuggauuaggacaaugggcacauugcucaucuuaauaaugcuuccagccuuugaauucauuaaaauaauaaaagauuuucuuuuucugccucauuauuuuugauguaauucucccauagagcagacuuaaucccuuuguuagugaaaguaguuaacauuucccuucugagaggaaaacaaaaaacaaaaaaaaaaucacuugugugacuccgauuucuuccucuuugaaaugucugaaggaaaaccaaauaaaacccaggaucagacaggagagcuguguggacuaguggaggaugagguauauauaggccuagguggccaagagacucuuaaauacauccagcucuggaaagcugaaccgcaaaccugugauuuuuuuuuuuucuucuauagaaaaggaaggguucaguuucgacccccaagguuccuuuuaaggcucacuuaaaacguggcagauaauaaauacuuuuaaagccauagugcucauccuucccagcucuuccugaccuugcuucuuuuccaggaccacaucucaagggcagugucugucuuguccuguccuguccuguccuguccugaugccacuguuauaccagacgaaucucaccuuacuacaaguaaaggguucagccuaggaaguugcuaggggccauugcuggagugguaauuguguuuuucaucuuggaagucacuaaaucacauuuccccccuagaauaccucauguagcagaugaaauagcaggccucugagccuauaaggguuccuccauuuucuuccuuccauccuucuuugcuugguaaucuuucucugugaauaggagcuuggaauugcgcgugcagagcacguccugauucccguugcuuucaguacguaaugaaggcauauucuuuauggggccugugcccggcuucucuccugucucucacaggaagugagagcuguuccccuggcuggagcucaugacaggaacccucugaggcagagccuuucuccagcaaauaaauuacugcugcugcccgcugcugccucugaaggcgggccuuuccucagccugggaaaugaagaaagcagcaaccugucccuucccugggggguuugcccaggcagaguuuguuuacaaugagaaaugugccaggcagcaccggcuucaaccugacaguggguucagaaggcaggaaacugggacauugugagcacuguggguguguguuggaggcgcuuaguaacuaccuagcaggcuauccccucugccuggcgccaucaggacuagaggggauuaacaagaaaacaggcugcuucuauccucaagauccacacaggaugcugugcaguuugugucugugauguccgacagcacaaucugccuucaguggaugagcagcagcucgcucucucucucucucucucucucucucucucucucucucucucucuuuuuuuuucucucacucucuuacucucucugcccucccagccucccucccccaucagaugguucugugcucauuacaggugaggugccuuauggccccacuccuugcuguuuuucugagucauugcuugcuucccucuggcuguuuuccuccuucccuuuucucucuugcucaaaguggccuuccacauccccacugccaucucuucuuguucacucugccugucagaguagcaggccucugugaggguagccuucaucagcauuugugccuugccauguuccagguccauggaguccauuaugagagccaucuguggccauggccccccucccuggacaccaugggggcuguuugauccuuauuaaaacacucaacucaugacgggaaggaguauauuagaaagugagggaucucuuuguuaugccuuugaccuuacaguuauuuguucuuuugagaacagacuauacagguguucuuccuuuuagagcuggacucuuuaaaacucaagugucugagcuucuagagagcuagcugucuuaguuacuguucuguugcugagaagagacaccaugaccucagcaacucuuaugaaggaaaucauuuaaugggggccuugcuuagaguuucagaaguuuggucaguuauuaucaugguagggagcauguaugguaggcauggagaaguaauugaaucuguuuaucuauauccugauucauaggcagagggagaggaagaaagagaguggggaggaggaaagaaagagagaaaaugagaaugaaugagaaugaguauuugggucugguauggguuuuuaaaacuucaaagcccacccuagugacacacauccuuuaacaaggccauacugccugauccuucuaauccuuucaaagaguuccacugccucaugacuaagcauucaaauauaugaaccuaugggggccauuuuuauucaagccaccacaauaucucugaaaauuuugguuuuaagaaaaagucagaauguaagcuaaugaaaccagggcuggaacuggccuuaaguccagugccuugggcacugguaggcauugguaggcacugguaggcauuggcaggcguugguaggcauugguagugcuucuaacuccaaacacuggcacagaauuguuugcucggugucaacugcucagagagugugcuaaccaauuucauuaugaauuaguugugagcacaucugcugccaugcacugugcugcuaaacacuugaugugcaugacagcagccucuuagaucgggugguagaaucgcugcucucauuugaugacuaagaacccaaagcccuagagguuagaagcucaaccgguucacuuugcagccacaggcaccgagucaagacugaaacagaggcuuccuaauguagcucugugggccuugggagggaagaaaggcaggacccagagcuccucaacauccaacaagguucaguucuuaaaauauugugugugggggugagaagggagcaaauaugaucacaucuggagaaaacacuuucagggagccugcuuaaggguuuguguuuuguuuuuuuuuguuuguuuguuuuccuuccuuccuuccuuccuuccuuccuuccuuccuuccuuccuuguguguacuacauaaacaauaacucccgaaaaauggguacauauucggguucuuuuaggaaacaauauccauggaacugaacacuaaaaaacagaacagaaagaaagaagaaaacaagagaggccccuagagcuacacacacaaacacaaacacacacacacacacacacacacacacacacauacacacacacacacacacacacacaaucuugauuccacuaauuccacuaagauagaugggguauuuauuugauccuaaggccaugaaaaccacauuuggacaucaccauuucuccucaugucugcuuauuuaaggcaggguuucacucugcguccaagguggcgcucaaccaccacccucccaagaacugggcuuguagguguguguugcugcaccaggcucuccaucacagguuuaagaaucaacugccuccccugcagccuccagcauguaguggucccucugugcaguagaugcaguccacucuugguaguuuugagcagucucugcuagugguuucaagcuucggguauaagccauaucuguaacuuccaaggggaaauuccauaucuaucccuuaguuuucaggcaaguguaacagugaccacguucaaaugcuuuguguguuucuaugagagucagcaguuuuccagaggucuuguuuaugaagguuguuaguuaugcaaagugggccuuuauggauaguucuaagaaaugauuccaauuaaaaagaaauggguagauugccagucaguggcagcuaauuaaauuaugauaugcuccugucauuaacgagaacccugacccaagcgagagggaaaaaaggauaaaugcagauucuuggaauguguugauagggaggguguauggcuuuauccguucucauauaauuagacguguaaacuggcagcuuccuguuaugucuuugaaaucagaagccaaaucuucccuucuaggguauaauuaaucaauuucugcuggaguauuuuagaugcuacagcacaaugcaguuucauuaagaucuauaguuuaauaauaaugggucaaucaucaugacacuauggcuucagagcuucaaacaccaaaaccauauacuugcugagacaagaacacugccccgagaagagauugaaucgagaaggugguguggcugcguuagcuuucgaaggcugguuccuccucagcguucugcugggaagacgagagggaucuuagaccacaggcuggcacugagagcccuaaggacacugcggcaucucaaauccauauccaguguccaucaccacuugucaacuccacagggacgcuguggucggagugagcagagccuugcaggguggcaguaaguagcuuaugaggacgguaagggaguggagggguuuucuggaagcauuuuguuagccgugcugcugccugugaggaagaguucaaggcuuugugaauguuaccuuuauuggauuaaaucaagguuugguacugugagccagugugcuuuuguggguuauagcagggacuuuuucucacguauagauaaacgauguugacuugucauacgggagacccagagcaugaugcuggggaaggccuuggggugccucaaacaugauuaaagucuugagaaguuuuacuuuacuagcuggacauguaugaugaggguuauuucucuccuuuccuaauaugcuaugaaaugaauuuggagugccaugcaugauauacccaccacugcaaggcagaugugagaacuuacuaucaauggcuuccuugucaaagcuucgugggaaguuuugagucgugcaguaauaccugacuugagcguagauccuauucuaagcauuuccaucgaacuguguacccuccauccagaagucaccaaaggucagaacuaagaccaugagacuccugugucuucucuauuaaucuuccuuacaguuuucuggccggcuauauuugugaauguccagaaaguagagaauuaccuaaagagauugccucggagacuagguuucuauucugauggcucucugucacagaggcacugagugaggauugaguguccuuuguguuggggacaagaaggcaggucugaagccagcacucccuauucacaacugcucuccccaaauacuuuuauuuuacuuaaagguaguuuauuaaaugaaaacuaaaaaaggggcagggagggauuaccuugaaaaugugcaagagugaaccaaagcauacuuuuacuucuuuauaggaaacuuaaauuuguaccaaaauaagacucuugcuuccagcuaaacagugccuccguugucuauacaagaaaaaaacaaacaaacuaggauuuaucuguuuuuuuuauuuauuucaucaucauuguguguguguguauauguguguguguguguguauguguauguguguauauguguguguguauguauguguguguauguguguguguguguguguguguguguauguguguguauagcacggugcacacgugucacugugaucacauggaggucacaggauaacucccaggagcugguucuuuccuuucacuguggggauccagaaucaaauuccggcuggcagcaguagccugucaacgucccagauccuuggucauauaaaagucaaguuucgauaaaucuagggcagaggcacuagcacugaguacauagagaauggggaaccaaaggagaacacugauuuccaagacacauauguugagauucaagaccuauuagguuauaugauacaagggguuugguauacuaucaacugccugaacuuucauuuuuccuggaaaucacuggcuuucagcaaagcagaggaauugaauacacagggccacuugaagcugucccacugcacagcuccucccacuucuguauuugucacaagugauaugaagcaguaacuguuggcccucaccgagguccauuauugcuaggcagauucuuuccacccuguuaagccaggcuuggggacgugcauuuacaaaguaucccuccgaggcacugguuucaauggccuggugcuucuugguguagucuuuagugaaggacaacaaaaacaggucuguggagauggugacucacuggugaagguagcacaggacaccucucugccguuguuacuucuccaggcucugcuguuuggcuaggaugacugauaguguuccagcuggcacuuguacucuuaccaccugaugguuuugagcuuauauuguuugcuugaagauacacugucccucguauaagguuauaguuucucuuaacgagaugaaacuuaagccugcuuuuaucuugggcuugaaagccaucuuauaguaaagagaaacuagguucauuccuguuuaugaugaaaucuuuuucucaaggguugggcugugcccuaccuguaaccuuaacuuccaaugguucuguacuuucuguuccaggaaacagcaaccguaucuuccaaagguuguuauguuaugaccauguuauuauaaccaccuuguuaugaccacuuugcaagcaggccuuuguuucagaagguuguagugaccaauguguuaagcuaauguguuucucugacucugcacuuauuugccuaccagaucacccauucacgaacccccuaguccugagcuaucaaaaccuuguccuccccauauccagugcugacucgugaagcucgccuuagggagagacagccugaguacaugacuaaagcucccuuuaauuaauuuggccgugaucugauucuguggucuuucuccucccauccgugggauuaacaaacucuacagaacaagcaugauucccauuaagcaacauuaggcuaaagggccuuggagaagacagguccucuuuucggugugacucaguucagauuccucaagauuccgaaccuucuguuuccuugggcgcuuuuuggaaaaucuuguuguguguguuuguaugugaauguauguauguauguguauguauguauguguucuucagcugacuacuuuaaaagagauaaugucuuuagauauuauuguacuguacuuucuauaguuuucugaucagguaguaaccaaugaaauagauagcaggaggaaaugcuagacucucacgacuacugagagaggaugaaccagacaccucuggaagccaggacccaccauccuuuauuucccugugagauucucagaagguucucuccugagaccaugcagagacauucaaauucuuuugacuaccaaaaucccuucguuuuuuuuaaacaaaauaaacauggaggcuaaaaacccacauucagaacucuacaacccacuaguggcuuucugagcuuuaucuucacaggucaacuuucacacuuaaaugcaaagaugagugaucacaaaagcaaaguguaucacuuugauuuaacgaaucuaucucagaaucagccauguucuucuccuccauggccugcagcuugaaugcuuugcuaagaguggacaaagggaguucugagaugggagaagcugggaguagagugcucuggaguccugccugcuggaaucaggagaaucgccaucugagacacgaaguaaaggugucacuucagaccucucuaacacacacuuggaaauggucauuaaagguuagaccaaauaaucgaauuaaggguguuugggacacaaaauuagguaaacuaaaaucuaagucuguuuuucucuuucaucuugagccauucuccuguguauugaaauaccuguguuuguuuguuuguuuguuucuuguaaacauaagguuagcaagaaagguuaaaggguuaauuuuaggucuuucaucuauaaaaaauuaaauugucucacgaagcuugaucagauauuaaugcaacacccgacagugcucuggggccugcugggagcuaugcuaucccuccuuauugauuagaacaugugcuuuuugcugcuucugaauuauuuauggaggaucccccggggugcucaggcauugaaaaggcagaugaugaaauccuucagucugaauggcucaggcugugggcuugguggcuauugugacugacccugaaggccaggccuccugggucccuggugccaccacccugcaguccuggggagauagacuuacagaaggaauuagauuggggccagcagacucaagggaccagagcacuuuguaacauguuuuuuaacuaugauuaaucuauagagagugacucaaaggaaugcagguacuguauuuaaacauaagauagauuuuuuuuuuuugcauagguaauaugaaaaggugaacugaccaagccauaauguuuucuuuguuguuucaucugggaaacuaauuaucacuagggccauuguuucacuacaaacauuguucauaaaugguguguggauauguauaagcuuguaacaccgagaagacucaguugaugauguugcaugcuguaucugugcuguguguggauuuaagaccauguacacaaaccauggaugcagacuggggaaaguaagaaagaugcaucuuauuuuuguccaguuaguuuucauugucuuaaggaauauuuuuaaaggcguuuuguacuuuuuagauuacagcagagaaggggauauuuaugggcauucggcagaggagagggggagaaauccuaauaggauuuccuuuacaacucagugcuacaugaucucuggaaggaauuagaaaguuuccauauuucaggaggugcagucguauaccaaagcgccaucucgacacccugccguccaauuauauacauaauauauauauauauauauauauauauauauauauauauauauauauauauauaaaauuuaaugcaaguaccuuacuguucacuugaaaguagagagaaaaaaaaucaacuaaacuuauaauccucugcaucugucuggggacgagcagagaaacacaugugcauuucucgacagaacucugucucacucuguggcucgaaggaaaaaucaauuaugagcugagucugugaagugggugauuagcugugcaccaucuacuuaagccuucuucagagcuggccacuagauuuagguuauuaugguaucuaaaggggagaaaaacaaccgccaccuuugcagcggagaagcccagugguacuuuaaaaaccuuaacgaacccugcaaauugaaagugccacaaucggcauguagaaaggagaauugugugggcuguguccugaguucuggcggucugucuuuggcagauaauuacucaucuucugcagaggcuuugcuacuuguaagauacaccacaugcauucacucuggggacagugcauguuaaaagacaaacucauacuaagacugaugcguguuaauucguggacuaacagcaggcagaggcagggcaagugggacgugaccaacuauaggcucaugguuucuuuugggggugauauagauguuuagcuuggaacucgauagcaacgguaguuacaugguauugugcauguauuaaaacccauuaaacgauucaccuuauacauggcuuauuacaguacaugaauuaugacucaauuuguuuaaaagcucguuaacccuaaaaguucacuuaucacaugugcauccuaguuugccuuuguaguaaaaaaagaaaauaguaacaacucuuauuaggcuucuguuucuuuauuuuuuuuucccauuccugcugucacuuauaucauagugauuaaaauauuugauacauuuucacuucuccuaugaaagacuuuguacauagauggguaggauuugcaucacauaacucuaaggucuucugcauguuuguuuggacagccuguggccucccuguccugacuggauuauaggcaccugccuccgugucugucuggcgccuucuugucuugcuuuuuaggauggcuucauacuggauacuugccauaaguccaccugcaucuugggcccagcccagcaccugucaaccuccugccuuuccagguuuacucagucacuugcuguuuugcuuccugaguccccuguggguucagacacucguuucccuacucacuuggcaacuguaugacuuaccaucugucuuagucaggguuucuauuccugcacaaaacaucaugacgaagaagcaaguuggggaggaaaggguuuauuuagcuuacacuuccauauugcuguucaucaccaaaggaagucaggacuggaacucaagcagaucaggaggcaggagcugaugcagaggccacggagggauguuggcuugcuuccccuggcuugcucagcuugcuuucuuauagaacccaagacuaccauggauggcaccacccacaaagggaucuacccccuugaucacuaauugaucucauggaggcauuucucaccugaagcuccuuucucugugauaacuccagccugugucaguuggcacacaaaaccagccaguacaccauacacagccaguuauuuucaaucugucuaacuugcaaaggccugcugguggucaugccaaccucugccuucuuccuccagcuccuugguauugucagggcucugcuuacaucucuccuguuugcaguuuuucuuugccauuguagaaccaguguuuuuaucucugaauggaucccauccagauggaauggguauucuaccccagaggcagguggaaggugguaagagauucauucuucccucuugucucugggccccuccacuggguguccaacgugccuggcaugauuuuaacuuuuaacucugaacacgacaaaccuauacuuuuacaguuguucaugaucaguaugaugaaaacuggggcaugagcagguaagauggcucaguggguaaaggugcuugccccaaggccugacaaccugaguucaauaccugagacccacauguuggaaggagauccugaauuguacaagaguugguuugggcauaaauucuguagaauggacugucugaggcucuuacuccacucuuggcacagcggugagauaguagauugggaacaaguguacucaucaucugccugaggcgaucaaucucaggacucaugacagagaacccuuccaagcuccucugaucuaacggucaccuggucuggggggcccuguucuuuuuuuuuuuuuuuuuuuuuugccauuuuuauuuuuuguuaguauuaacugaguguagaaugguauugggaagccuucuguggcuauucauguaauugugcaggacuuuuauaacucaagaagacuuagccaaaugguaauuggccagacuggaggcagaaguagauggcucuuagcaggccuuucuauuaacucuguguguguguguguguguguguguguguguguguguguguauaucuuuuauuuaaaauauucugauuuuuacauggcaaucguuucagcucuguaugcauucuaggugugcaacuuguuuuuagcaauaauagcuaacuucauuuuaauuaaggagcuuuaagauguuggauuguggaacagcuuuugagcuccgcauuuuaauaaaguuguggguuuugccucaauccuucauuguuugggcauaaccuaagguguguccuucgaagcaauaguucuguggaagaauuugauacauauccucaacauggucuauuuaugaccuucuucuguuugagcacauacuuguuauguaaauuagggucacuuccaaaagcucacauuauaggacuuaauuagaucauaucacaccaaugacucaaaacuauuuuguauugucuucaguuacgaggccccaugucugagucucacuacagaaggguguugagcacgggaccuuugagcaguucacagagagcaguugggacagucauacuuuucaaagcuuggaaagaaaagcuuucagguagaugacagaaccacuguagcucccccacauaucguaauagaagaaagagucacuucuugcauuuuccgagcauauuuucaucaauaguaauaggugcaguuuuaauguagccguaccucagugaaacucuuggcauuuccugcagcugugugauuagacaggagacacucaacauaucuaguacauuuucuaucugguuuaacuauacauauuucuagggauuauaauuucuuggauugguguaguauguaagcaaggauuguuaacauuccuucuaggcuccgccccacgguuaccuggcaacagccagccaugccugacucaguauaaaggggucuggcuguuugcucucuccucuuucacuugucccuuccucuuacucucuucaccucuucccucccugucccuucucuccccauucccuucccuugcccccauguguucauggcaggccucuacuccucccuccuaucucugucugucugucucuacuacacucucagcuccccucccuaugccauaaauaaacuccauucuaaacuaguaucucagggggaagggaugccucagcauggaccugcagaggcaccuccuucccccgcaccauuccacgccucuaccaaacauauccccagcuuuccuuuucuuuuuuauaaaacacaauaaagauccuuugaaaauaguuaaaacacuugguguggguggguacauagcuugccccaagagcaagaggaccuggcuccaaugauagagccuguguuaaaaaacaaaacaaaacaaaacaaaacaaaacaaaacaaaacaaaacaaaacaaaacaaacaccccucauaccugguaccacacucuucacugccagagcuguggagagggagacagguaggucccuguugcucccuugccggcaggccugucgacuuagcaaacucuuugucuaugaaaaccucugcuucuauaaaccagguggacaguucuaaauacucacaccugagguugccaugugaccuuuaaauacaugugcaugcauauucauguacagucucacacacauguaaccagacacauuuacaugcauagagauaaguagacacagacacacacaagcaaacagaagagcacaaguaaauaucuauuauuuggugcacggauagaaauuuuaaaaugagcccguaagucggagcguggggagccauaguugcauacuuguguagaagggagugguaagauaccuggcugcuuaaauccuuugaaagacagagggcccuacucuuguuccaggaugcuccuuaugcuuaaguaaugugauggccuuugagccuaaaccugcaguuucugaaauguccuuuguuuggcagacacaguugagaaacuguugaaagccaagcacauguguucacccucgcauaauuugcauuucauuuucaaacagucauacauccugaaguaagccagugcaccugcccgcuggggcaaauaaauacugcuaauucaucuuauaaaaacuguagguaugucaucucaauuuuacccuaaaauugaaaauuucauuaaagcuuauuucugaguugugucaaugaccuauuuggucgaagccugguucaacaagcccugauuuaaaucaugacaaugcaggacagacuggauugugauuuuuggaguacuguuucuuaaagaacauuaccaagggcaggccauucuuccugcaaugccagccacaugccacuucuagaagaaaaggugggaaauaaaaacauuuuucuuaaugcaauacagcgagugauaaggagagcugacuugcucacgaagagaggaaggagacgucgugguuuguagaggaagauuaaagugucacuuuacugaagguucucugccauuuccccagggcugucuugucugugggaggaauggguucuucuggucuaaauauagaacagcuuuaauuaaguugaucagguuuuuuggaagugcuuucugccuauagauagccauggcuuaauuacaguuuuaaaaugaaaaccuaaguuagcuuacgauuuuaauuguaauaacauacacagcagcaccaauugcugccuuagccauggcuauuauugaaauggagauguuuugccugauuucagugucaggugaguucuucccucccuccuguucuuaaaaguguauguuaaugagggacaguuuugauuuccuugauuggucuuucuccugaggcugccccccccugcccuccucccucucccccaugccucucagccuuccccacccccuaccccacgccucucagcccucccccuucucucccccaugccaucagcuucuggugaugaccugaaacagggcuaacaguggucauauuugccuuuucucucuuuuuuuuuuucugucagucuggcuggaugucuguguuuguccuuuguccuuuggcagugcagccuuaccuuaguucauuucuucacuguuuccugcucuccuucuugcacguguuuguggcugccuuuguuauuuucucuuccuucugcuucguguggaguuauuuugcguugcuucucuagguuuugagguaagggcuuggauuguugauuugaagucgucuuuuuuuuuuuuucuuccacuuuuuauuuucuuuugaaauguuuauauuuauuuuagugccagagcgaaugugcagaggacuuuugggaguugguucucucucugcaccauguugucguucccgugcagcuguuuaccugguuacuacagccucuccucucccuccuccuccucccccuccuuuucuucaucuagaaagauaaauuuauaauauuucauucuccccugcuccucuuacuuuccagaguguucuguuuaaagcaagugacucuguuuguaguuuugggacagguuuuuagauuucccguguccaucuuugguugaaagcauuuguguaaugucagccucaacauucuugucagauaacggcagcacuugauuuaccugagcuugguuuaugucaguuaccucgucuggguuaaguugacauucccuuggauuuuagcacgagcguuuucagcugucuccgggccauugaagauauuaugagauguuggacauuacauccacacacuguuaguggacuuccucggacacugccaguggagaaggaagggagccacuuguugccaaccuggacguagguagaauucaagcucugugcugucuuugaggggccacccguccacuuucuggcggggugcaguucaggcucccuuugggcucugcugauguucugcacgugaggagguaaggaggccucguuaccauuucuacauugcuuccauuucuacauggcuaucagguggagugugugauguguuacugguagagcagagccuuuaccgcauugcuguaugguggggauggagguccagucuccccaugugguccucgcuguuacuagagagagggcaauugucuuuaucagucagccugugauuccuauuugggcucccuuuugugacuuuauuauacaacccuggcucccaacacugcuuuagucuuugcugacacagguaggaaggggccuguagauauuuuccuauuguauuuuguuggaauagggcacuuauugccuaaaguuuccuaucaaugcuagugugcuuuaugcuugguucuuagguuugauaaaacaggcucgguugggaguugucuuugcaugcgggcguuagugugcuuuuaaaggaaagucuuacauuuuaaugauuuauuuugugugucugugauucugggagaagugcacaguauagcaagcacgcggaggucagagggcaccuugcaggaguugguucucuccuaccgugugggucaugggguugaacucggguccucaggcuuggcagcaagugcgucuauccauuaagcuguuugacagucuuguagcacacuuucuguuacuguacuagucagugaguuuugaaauuaggaugugugauaccuuuauuuuuaauuaauuuucaagauugguuuggaugcuuuuaguacuaugagauuucauaugaauuuuauagacuuuuuuuaaaaaaagucacaauaugcuaauauaacuuugauaaggauuucccuaaauuuguagauugcuuuggguguuugccaucuuaacaauacuaaguuugaaaugcauugucccagguugucuuucucuaacuuaacuguucuaaaauuuaaauuuagaacuuggaguuuaauacugcugaguguaaccuuggcuauuuuggcccaauauaaucugacuaauuccuuuaaaagcucuuuuaacuuuacaaauccaauauaguuacuguuuuugucaacuuuauaucuuuucuaaauacauuuuugggucagccaaguuacugauuaauguguauaauaggauucccccaaacccaugaagcaauaacauccauuagaaauggaccuaaggauugaauugacuuucaucugugauugugcacuuggugccaacaccacacucuaugguuuaucauuuugcucuaccacuucaaaaaugucuugguuaaaugucauaacccuuuccuguccagcuuuaggucucuauaaaagggaaauuacuguaguuccagauaagguauuuuaauaaaaugcuuuccuauguaauugucaucuucucguguguguaucagaguuuaaagccaguucugaauuugggaagugggcuggagagauggcuccacaaucaacaauguguacugcccuuguggaggacuuggauauagauucuagugcaccuauaucgggcagcuuacaauugccuguagcuccaacuccaugugauggauccaaagagaguacucuuuugaacaucagcuuugcucacucagguacauauacacauaacuuuaaaaaaauaagaccugacauuccaggggagauauauguaagauuuaguuauuuucuuuuccuuuuaaagaucaugagauuauagguuaaauucaccuuaguauggucuaauuugaaugacgauauucagauacacacacacauacauuugucugcaaaucauugaaguuguugccauggcagagcaggcuuggucuacagccauuaugaacaacaaacagccuguggugugaacacaggaagauacagagcagcccugguucuaaccagaaccuucucugauuuccuaacucacaugugucaguguucacacauaucaaucaaguccacagaagagcuacauccggcaguguggccgguuaccccggaauguaacuacccagugaugguuucugauacaggaagccucccucagaaagugcacugcagaagcuucucucucccauggugcuuuucugccaaagggcugagcagugcuacccuggagagcagaggcuggaccuggguccugcccccugcacuccuucaccacaccuuauguggggcccauagguuaaaccucaugaacagcgacuuccagcaaagcucacccuguccuccuggugugagcaauuccaggaugagggauaacuacaugcuuguaggaagugguccuugauggaugacucuuaacccucuuguucccagagcaaacgggagagauuccaugccuccagagaguccuaugaugccaguguucuggucucagccagcuuucuuuaucccuggcuagaaaagaaucucgaaacuagaaaggggacauuuccagguuugguguuagcaguguaacccguacaacaccuuauauucagaaagcauuuacugaguauggccaugcccugggcuuuguugcagucucugcuaaugugguauuaaauagcacaggagccuugaucucaugcaagagaggucuguaguggucauugugauagaaugagcacauucuagugauaacuauacaucuauguguucugggaacacacagggaguacauuucuaacacgcguguccaggcugugucaagauaauccuagauuuacauuucagaagcagacagacagaggcaccgaggaagucagaugagauacuuccccgugccccaugguaaaggugggcccuuuccaguuccuggagcauagaauguaucgagcuuccuuuuacuugggaagcuaaagcagcuuugcuuguggggcuucuugguggcugugguauaaaguauagacuuuauuauguaguccacaaagggcagcuuauagcuucuaagcagaugaauaaaugaacaugcugauuuggaaagauaguucugguaauagcaugaaagauggauuagagaguuugggagagaaaaaggagccuaacuaugaaacucacagaguaguucaggcaggggaaaugaaaugcaaaauuggacucuuauaaaaaggcuggacccaucugcaagccagggaggagcgcguagcuauaacuuuuauuugggaaggcauuucuucuugugauuaggaagggcuuaaaaucuucuguuaaguagaauucuguaguauaagggagauaaaaguuggugguuaaguuaaaaaugguccguauuucacugaagguggcuagcuucuuuuaaaucauaaauuuagcuugugguuuucuuugagucauacaauuuuaacuuuaaaagggcagaaacugaaucagaacacuugagcaucaaugaagguucuucuggagggaggcugaagcuagauuuuggguuggagagagcaaaguagguucaaugugcauauguuagagcccaaagagaggacaguguucuaacacuguuaauaugcugaaagaacaggggcucagggacuuagugacaggccacgcaggccugaguacuguugccaauaauuuugucuaaaucugaagugugaaagcuuuaaucuuaacuuggaaccucuaggagugacacauuguauccauuggugacagaagaaccgaacaacccacaggucacuuggcugccacuucccgagcucacaaugccagcaccgagacuguuuacugugaauuuuucccuuuugugcuucaaggugacucuggaacucgagggcccucauuuuauucuuuuugauuuuuaaguagugaauguugcugucauccuuggucuggcuugccacagcuuuuguaagaugugcaaaguacuuaagcaaagggcaggcugaggaggcccagccugcaggggcgauagccugcaggcgcgaugguucuuccuagguccagaguccaguuagcuguuacaggacccagcaccauguugaggggaauuaauugcucucucuucuuucaguuguuaaagcacagaaagaagcguauuucuuuagaacauucucggucucaugcacaaauggccccugugacacgaggcaaugagucuucagcccagcagccucuccguggauccccuagugaguuccucggcacaguccacuugccauauaugcacaagcacuuuauucggguuugauuaaauggcaaacauaauagcugcagauuuuguucccuuugguuuccuuugaaccaugaacgggcagaggacggugcucugaguugaagggaaauugccgggaaugucaaagguucaucucuccaagacaguuugcccaaaugagaaaauacagugucacuguggaaagcggagagcagauacacaggcuuuguacugacaguagcauguuuuccagguuugaugaggccguucccauccucuguugcauuauuuaggugugugucuuuuuuguuuuacaggacuacauuugcaagugcccacuaaacuuuacuguggauuuagaaaugcagaugcaagcuuuccacaccugcccugcccccacaacuacuuuaauacucauugccauguaucuugcagaggaucccagccaggagaaagaggguccacaaucagggacccccccagaccgaccuccuuaacguagacagauagaaaucucaugacagugagguaacagcuuggcauggugucaggcccaccgcugcacuguaucaaacagcuugcucaucaggaaauccuacuuguucaccuacaggauggggguugaugcauuuaccuuguaggcgucuaucacaagaguuaguuaaaauaccguaugcaaguucucaucaaugugccugggccuggagaaagcacccuuugagugguccaugauguagguauucuuccgaaaacuuaacaccagccuacgauguucuagguccuguuuggaaggcuggagagcacaaugagcgaagcacaugacuguugcccucuaauggauuauaucuuagugagaggagauagacgauagucauaaucaaugaggaaacuauguaacaugggaaaguuaaaggucugugggcaauaagaauauaggacuaauguauuuuaagcccugagugacuuuaggauucauuaacaggacccucccaacaaugaguuagaggcauuugauguuauuaauuccaccaaauuugcacaugcauuucuacucuuaccaugcguagcaaagcuucugauaauagaugaaugcuuaauacuuuagaauagcaauuuaaaaaaccccgggcaugcccauuuuugccacaucguuucuucccucuuuguguuuuauucuauuacauugcagugaguuuaaguaucauaccaguuuaagagcugauucuuuaaaagcagaacagaacaauuagcgggauucaccuguagauucaggauucuuccccccaucuuuugucugcuacucuucauucugacacaugaucaucacacugaagcaccagauccauaggagcugacagagaggcucucagccugacugugaaaggacagguggugaugccugacucagguggauaagggacauaguagaguguuaguuacccuuugcagugacagaggaguucccaaaaguggaacccuuuucagagcuacuguauuuccaucuaaugaucaugagcaggggauuuguuuuuaaagugcuacccccucuuauccaugccuuugcacuuugccuuucucuguaggaacacuggagaccauacaguuucucuaaugucccuugggucgugguugccaacccugguggauucauugccccuuuauaaucuaguccugcaagccuucuuuauuucugaaauguaguagaugccuuaauucuauacauaguuuuaaaagauuagauagccauaacuguaacaucaauggcaaugguauuuuaagcauuuuauuguaugaaaguuugauugcgcucuagaguacagugugauguucgggucccucaggcauuuagauggucucauaaugaacagguuuggauuaaugguaaguaaaucaguguuggcaagaguuuguauugagaguugaagcuuugacaugaguucuaaguaacuauacacauaaacacacaaagugaccauagauggucauacaucuguacauguagguuguguaggugugcuguguucguagcuuaaacaucaugaauuguggacacaaguuucccucauggcaaacaacucuccacacaguucuauaccaugcaaaauauaucucuuccucaguuaagaaaauugcauucuuugaaaaaaaaaugcaauauauauaaaacuaugcaagaaguucacuagucuauaaguaaaauggaaaaggcuguagguuccucacaaacacauuagcuggagacugguggaagauuugaaagacuugcaguauguaggacaauucuuucuuaacccagucuguccuguuuagcagagcugccaaaauguccucauggugauugaaaacauucaaaugaccccaaugcuauguguccccacuguaaaccacuggcgcccaucugggguccuguucaugcugugguacccuguaacucacagcagccuggcaccacaccuggucuaagggguacccuuggaguucuguaaguauuugcuugaagagaguaccagauggugccucaugacuucuggguuuaugggagugauuuccagauggcggcggcugauagugccuuagucccuucccucagacaggucugcuuuaccguuuccucaaaggcugcugagcgugaacugcuuagaguaggagcuugugcuucuuacuacugcucugagggcagaaguuuugugguugaguuuguuuuugauguguggguuaaccgauuggguauuuccucuguugucaucugcauguuauugacaugugcccauguucauugcucugagucccugucaccaauucugauaagacaucucugcuguucuuaccauuguuccuuugccuuuaucccuuccccagcuguaugaaaggcauucuguuacauguuacuacuccaucaaagcgugucuuuccuucucagucaucacucauccaccucugugcucagcugccuuuuuaaaaaauguuguuauauuuuuaacacguuacauauuuaauagugaacagcuuaauuaaaaagaaauguuauuuuuuucccaaaguccgugagagucuagaaguaucugaaugacucacuuucuagaaaacacaaguuuauuugaugaagaaaccuguguuuugguuuuuuacauuucuucguguguggcuaucauugagccuugauuaggaaaauuuggauaccauguggagggguauaaaaagcucuuucaaaauuuuugagcucagauuaaaaugaggaaagucccauuguagugacuuuaaauaguguucauuauguaguuuuuuuuuuuuaaaaaagagaaugauuggauggcguucucucugaguuuauggaauacuaaggaaaaccauucaagaguuuaaauaugcugucaucaacaucaccgccaacaagaauuaucccacaauuauuuacaugccaaaaauucauuaggaaaaauaugaacagauuuuauuuggccuaggugaagcuuguccaggucuugugugugaacauaagguauuuuuuagaaacagggaauauuuucacuugagacuuccuaucuaguuauuaccauguguguguauguguguguguuauauguguggugucauguauguguaugugcaggugugagugcacauguguuugaaugccucuggaggucagagguugaccucugucaucuuguuuuugagacagggccucucagugaacccagagcucauugauuuagcuagagaggcuggccagcuucagcaaucugcuagcucccucaucccuccuucacuucagcaaugagguuaaauaugugucuugcuguaccagccuucccauggguguugaagcucugaauucagguucucaugcauccauggcaagcacauugccagaugagccaacugcccaggugugucuuaaaugaugcccuugugucuguuccuggcacuuagguugccugcccuauacaagugugugugugugugugugugcucgugagugcgcgcgugaucacaauagauggauggagagagagagagagagagagagagagagagagagagagauauuuuacguauuuuuguccaccauaguacuuuaaauguuacaguugaccaauguauauuggauggcaguuuuagauuuuaugcuuuaaaaaaaaaacuuucgaagacuuuuagauucuaguccaguugaaacagccuuuugucuuuuaagcucauaggacucuagacuguucuugaugaauggugccucucuuuagaaaauuccuuugguaaauaggaaaagggcuuucgggagguuaagcgacugucccagcucacuagcuggcuagugaugguauucagaccagcauauaacugaggugcaguugaaagaagcuacuucuugcuuuuuuaaaagcuaaauguugcuccaugguggugguaaugguauaauuuaucaguguccaaguguuuguuuacacugguuaugcacacagaacaguaaacauuaucgucaagucuauguaacaucaauaaaggguuuuauucugaaaaugaucuuuaguguagauguuuaaaaacaaagaaauguggugaauagaauggcagguuggagacagcagugacaggugauugcagugacaggugacugacagcacugacaggugaucacaguggcagacaggugacagcagugacagguugacaggugacugacaggugacugacaacagugaaacugcagugacagacaugugucagcagugacaggugacacccaugaagcaccgacaggaagaagacuugggagcagguggagaauuagccuugugcuguggugcuguggaugccaacacuuucauaguucuaauauaaaacugcacaucucuaaaaauaaaaaaaaucuaggauauuuugguaacauuccuuuguaaugguguaaucuugcuuuuggauucaauauauuacuuuauauaaaguaaugcaagcacguaauuugguuuuaauagcuucaguuuuauuaggaacagaauauaaagaugcaaucccagggcuggcagcguuggggaaguauaauuggacggugcaucgugauuuaggcugucguauaagauggcucuucuguuuuggucaucaccuggcuacaucaugcaauuccuguaauuguggagugcuuugaacacauucagcuucaauuaucugacagguguucucguucagaauuuuggauuuccguggcuuugagcucuagagaugauuuaaguuauuuccucuuuauuggccuagaagauuagggcaggaaagaagaaaagugcagcggugucccgcuucuacuuauuucugggcagcagggggcgugcuugcuuuguguccuuagggcauuagcugggccuggccuguucacucaucgcuuccauugugaauuuggucacugagguuucaguggcacccuaaaguugggcugaucugaauaacuaaccacucagaguuaggauuuacaaauaagagaucuacaagacauguucuucaggagacuuggccuuuaaucaguuggcgauuggggccauugcacuaacaugccauaauuugugacucaccuuugaagugugauggauguucaggcccuuacaguuugucauuugaccgcaggagagucacuuucaggacuuucagggcaucucuugugacuguaccugcaugugugugagaucgagagacuggacuuccuuuucguccacucuuccuuuccuuccuguggcucucccuucccaggcauucaacaacacaugcugguuuuuuuggaauucuuccccuuuaaauggaaauauuuucaauaccacucucaggccugggggcuauguacuuuacuguaaaaggaugugagaugggugucuuagcuaguguuuucuucugaacaugggcacuuauaauuggccuaugguguuuuguuuggcuugaaauccuugaguaauaacccucuuugcuguguugugauguuucugguuuuggugacaccccaagauggcauuccugaucucagaauggugccguucauuguccauuuaaugaucaguuuccaaaacauguucucuuuuacuuccuacaaaaaucauuuuguggucaccccaugaucgaacaagccuuuaucguuguauugaaaagaccuggcauuaguuuccuuugauugcaggacauaagagaaaaaugguccacauugagaaauaaauacaccgaccaaacaaaagagcuugcuucuaucuguggugacagacauauuuugaugaguuuagauuccuuucauuuuccagaguauaauuaaaauagcaacaauuauaaaagcagcuuuucuugccgaaauuggaagaauuucaaaauuaaaaaaaaaaaaguaaagauccccaaauaaaacagugcaaaaaaaaaaaaagcacaagggagaggcagacucaguuugcagacguugucugguuucaaaauaguccuguguuguggcacaguuagugagcguaucaaaaaauaaucacaagguaagauaaaucaucuauuaggauaauguccuagaaaagauugcuuuguaguguuacaagcauugcaagaauacucaauaaagggaccagcauuugcaaccauagcaugguguucugucuugaaagcucucguuuucaguuaggacccagcccucucagagcaggaccuucucuuccuccuuuugguggcuucacugaagcagugagguuagggaaggccauccuucaucuuccugacuuuagucaacacucaguaaauauuuacuuagcguguauccuaagucaggcacauggcuccacgcaggaggugcugacugguguaauagguggcccugcccuuuuagaccucacgauguagcaggagaguccacuguguaaauaaccaaccccaguacauucuccacugguuauguacagacuguacuggaggcaggugggaagagugguggguuggggguggggguggcacggauacaagcuugcuggccugugaugcaguauuuauaaaucaaacuaaugaccaucuaagcaaggucauuaggaaucaggaacugugucaaguacaaagggugcagagaggaaauccccauacuccugacacccgagacaccacuauuuuauaaaaggcaggcacgcguacaguugggcaaaggacccauguguagagcccugagugguuguuguggaaggagagagacuagcaaggcugaggaagacagggcuacaaagauaaugcacagaaaggagcccggaguccagggcuggggcuugggaaguaggagggagguaguggguucaucucaagcuuggagucagccaguagacucugauauaugaacauuuggagcgucauaggugacggagcuuggggguggucuuaguguuugagcagacagcagaagcaggaaguaugccuucagugucucacccuucuucccugaagcaugcuguaaagccugccuuccagggaugccuccuuucaccugcuggagagaagcauccuuauccguguauccuuggagauggggaggugggccuuuauaaaaaggccuuguuaacucugccuuagcucgucaucagugcaccucagccccucugugcacucuuacuuccauaggccugaguggaaaugaacucgcucccuuuacuucuggagguugaucaggaucuuuauuucuaacggcuccaacacuauguaaaguucacguuaagcaaaugugcacgcuucuccucuggcuauuccaucuuuugugauaggguucucagccgugaacuuaguaguaauuaagaucagacguauugggggcugaagagauggcucagcaguuaagaguacuaacugcuguuccagaggucuugaguucaauucccaguacccacauggugguucaugaccaucuauagugugaucccgaugcccucuucugguguguagcuguauaugcagauggagcacucauauguagaauaaauaaguaaaucucuaauuauuuuuuuuuuaagaagagaaaguauuuuccuuacacagagaauagauacuuaaaaggaacucugaggugguuugaugagaaucacuccuuaggcucauguauuugaaugcuagguccccaucugcugcaacuauuuugaggaagucuaggagguguggccuuuuuagaagaugggaagguguguuacuugggguaggcagugccauuucaaaagcccaccaagccagaccagucucacccucucugcuucuaacuuguggagauguaagcucucaguucuugcuccagcgccaugccugccugccugccuguugucaugcucccacucucugaaaguucaaggaaaucuccaguuaaaugcuuuccuucauaagauaccuuggcuauggcgucuuuucaaggcaauagaacaguaaccaagacaguccuguagcacguggcagaaagugggccuaaaaggcaacuugaauuucugaugggugauggaugugugugggugugacagucacugucgcguccgcucucgaccagcaagaacgacacgaccaccaguccuucuagcagcaguuuauucaguaaacuuccgucuucaucucucucgcuucaacuuuuucucucucucuacucacggcaagccacgucaccucaccaggcaugcagcuucagcuaaucagggcagcaggggcaugucuccaccaaaauggauucgccaguauccuggugcaccugcgcagcucucaugaugguuguggcuuauuuucagguguaugaggaagucaggugcaagucauaagacuuagcugcagucccuggcgccuucuugggacugccgccacaccugcuccucacaagucacaacuuacucucugcaagagaaagucucaacugcagcggcacacauauaagaguuucuacucuuauacacaaguagccaagagaaaggggucuguaacccuauagguggaacaacgauaugaacuaaccaguacccccagagcucgugucucuagcugcauauguagcagaagauggccuagucggccaucauugggaagagaggcuccuuggucuugcaaacuuuauaugcuccaguacaggggaaugccagggccaagaagugggaguggguggauaggggagcaaggcggaggaggguauaggggacuuucgggauagcauuugaaauguaaaugaagaaaauaucuaauaaaaauuggggggggggagaagccaagagaaacauugcaggacugguuagaucuuuuaaaaauucucagaagguagcuaggggcugugcuggcuuacaguauuaugaugguuguagauacuccaaaaauccgugacuucccuagcucuggauaguuggcuagauuccugguaccagccaugauuugccccuuguuggucuuaagugcaaucaaagaucuuuugguuagugccaggguaugugugccacuucuguacccuugggguuuuugugccgcacagcucauugugguucagagaauggaagaaguagucuuccauaugguuauccagaaugacuagcccugagaaauacaaguaacauuguacagacagagcagguuguccuuggauauuuaugaauacauauguauguacccacacacauacgaacaugauguacacacaugaacaacaauuaaugaaaaagaggccauggauuugaaaaagagcaaggagagguggugagagagucuggagggagaaaagggauguggagauauaauauaauuauauuauaaucucaaaaaacaaagaaguccucagagaucuggucaugguggccaugccuguaacccccacaaucccgaggcugagggaagaagacguugacuuggaggucagccuggggaaccaggggcuggguacagcucagguagagagagagcccuugccagugucagcaauuguuugcuuugcagcguuucugggaccagcagugggagugguggguggugucugcagauucucagagauuccgcagggugaguuggcuuuugucuuggcuauacuugcaugugaauuuugucucugcguuccuguauggcacuuagggcuccauggagcaauagccauuucaucuuagugaggaaaaccgggaaguaaagagccuuagaggguacuuacaguguguguuuuaagcaaauucccccaagcuucacacaauauuucuauuuagcaaaugucuaagauucaaaacauugaggugaaggaagaagggagaauaaaggagagcaaccagcauuccguauugccggggagugucgucaaauacaggcuuguaaguauuucucaggcugaaggcuggggcaggaaauagacacagaagucaaggccccauuguucugcuguguuguguuggugcuggggauggaccucgggccucacacacacuaggcaagcucuucugagucauugccucccagcauaacucucuucccacugucucuccucacuaccacuccugagagggacagccauggcugcagggcagcucauucaggucgcccuguggcaggcaagugacugccccccccccccccgcauacacacaccuguacauaugcugcauuucaucccugacaaucccuuucauuuggaagauguauguuuggguuaagguuguugguacucgucaucugggaaugcacuagaaaucucgguaucgaaauguuuagcuucuuagaugagagaagcccucuaggagaaugagcagacaucucacuaaaggggagaaaagaugucaugccauuguuugggggauauaaagacuuaaaacacacacacacacacacacacacacacacacacacacacacaauuauucauguucucagugggggaaaaaaucaggaaguugcuggcugcauacaggacaaaagggcccuucccuccucccaccaaucucccacaguuccuccaucccggccuccugggagggaacccagggccucacacuuccgugacaagugggaacugucucucagcagcaagucuuuacaguguuucucauuacugucacuccugaguggacacagccaugcccguucucuccagugucaaggaagggacuggagcuuugccucgcacagccugacaugggccucacaguucagauugugcgcgaaugcauuucagucacaaaaugaacagcuccuugagagaaugaaauuaucaagcugagcugccaggcuggaucuggccuucuguucagccaggcuuggagagguuucugacugugggugagccugccugcuauacucccguuaaacagaagagggcggcagagagacugauuagaaaacccacuuccuuauuugcuucccuccaaugcaagcucuugugcaguguauacugauaggaaaugaaaauugaaauuagcaccuuuuauuuuuuucaacaccaagugauuagagaaaaguuuaaaguaacacaacccagauuucuucccgccaggccccccccccccauacugauguugccaagaggacuaauacuaggggauuuugauguucacagaugugacagucaaaugcaauggauuauuuguugcagguaaauaacccugaugggucuuggcuuucuccuggcauuccaugugcuuguauaaaaagcaugcacucccauguguuuugauggcuuaucgcaacgcauuugcccgcuggaauuaaagggucccuaaggaaagcuguuucauuucuugcuaagacaaaggaacguuaaugccauuugacuuaauuuugguuuggcacuggcuuuguuuuuaaaauauuguuuuuacaacccuguucuuuugaugauagaauuagugucuaagcuggcugauuggguggcuuuaggcccuugaccuuuaaaaugugacguaauugaagucauguuuaucugaggaggaugguuuaugcucacacacuguacgugaacucuggcuggcuucucauuaauauucuaucuuuuuuuaucucuggucuaggacagcugcauaccccagggcuucuuucugauauuuuaguauuuucugguuuuaagguuaaggacagugaguaguccuagcagguagcccuugcuccacugugacucauggggucaaguuauugguaguccuccauaaggaaagcgaggagcccacugugacauuuuauauugugauaaauuuaaucuauugguggcuuguccuuacggccccacuuuauagauaagcuaugaaugaaguaacuggucucaaugcugcuuucaaagugagaagugucauuguccaaggggaagggcauguggcauggccugauggcuuagcguggaaaaugagugugugugcuuaugugacagccaugacccccucaggaccugggcuucuagcuuguuucuaccuacaguauucaugaucccaccugucaccucucuguaccccuccucagcccaaaacaauacagaaaaucagucaccuuugcugucuaucaguggccucaggucucagcucuguccauguuuugggauaacuuuccuaugaaaugagggaguagacaaggacaccaccgaucucuuugauugcauuaauguauugguuaucaucgucuuugucaucuuccuucuucuccucuuccccuccaucuucuccuucacaaaucuauuuuauuguuuuaacuguaugauguuccgcuauguguaugucugugcaccacaugugugcuuggugccugcagaggccagaugaggcuaucauauaaccuguuuuuuaguuugaauaggaacggcccccauagacuccuguguuugaaugcucgaucacagggagugacacuauuaggagguguggcuuuguuggaguagguauggaggaaaugagucacuggaggugggcuuugaaguuucaaauucucaacccaggcccagcaucucuuucuuccuucugacugccaguccugauuuaguaugcucaacuaccucuccagcaucaugcgugugugccucuucagccugcaugccacugcacuucccaccaugaugacaauggacucaaccuuugaacuguaagccagccccaguuaaaugcuuuucuuuuuaagaguugcuuuagccaggaugucucaucacaacaauaaaacccuaagacacccuggaacucagaauuucacacaguugugagcugccacguggcagcugggaaucaaaccugggacuugcugucucuggauggcuuugggauuuguuaguuuggucaguuugguccucaguuuagguuacauaacugacugaggaaagguugucuugaucugcuauguauuuccucaugagucuuaagguuucuaucucuggguuauggggucaggaaauagggucuuggaaaguuccuggugauguuacuaagaauauaguagagguagguuuguaggaagaaaugaaaaaaaugaggauuuagauggcaucagcaucuagagcaguuuuauuucaugacagagagguggcaaggucccaaguucuggcugcacuguguuugggccacagaaaccaggcacacaaugacuagaguucaagagaaagcagaguguauccuucaagccgggguuuuuguagcuaaggauagggguuggggguugggggugagguggcacggaaucaaaggcucagacucagggagcuugcaaggaugaggcagugaguuuauuauuucucugggagcacccuuuauacccacuaccuuguccccuugguuccaaacaagcauguccuccaagcggcaguuccugauuggcugucaucaucugcaucaccagucucuaggcucaggcaggcuucaguuaccucggggagggugggggugcuccccacuugcuguuuucugaaguuuaugcagaaugggucuugucagugaggccugccaugccuucuacagacaggaaguggguuggggcauuccuugggggcugccuggaggaauuagcuauuuucuugagacaggcuauuaguuugaaacugugaggucugcugacuuuuuaucaccaccaggucucuggggugggggucagcagcuuuccuucugcaaucuccaaacagcuagacuugaagcucaguuuagggccuuguuuuucuuuggggggggucccuuuaguuaacuguaaccaaccuucagcaggcucagaugccaacucagcaaagaguagguuccucucugguguucugaccugugaguucuucuugccuucuuggucccugaacuuuuagcuucaucuccuuauuucagacacuccaucuaucuccaccuggcuugcuccucccugccgagugcucugggaaagcucacagugugccagcuggaggucugcacugccuguuucccagugaccacuguccuuguucaaugucuugagaaacaucaguuugggguuguuucauguggaagguaaauccacgucucacugcacauccuggcuagggacuaaagcaccucugcaugauuucuuaaugccuuucugucagagcuucucuaaggauauuucccucauccugauaacagcuauguuaguguuauaaguuggcacauccccucuaggaaccucagcaagaaaugccaccacagagcugccuggcuacugcccuugcuucugugccucccaagaagaugcaacaggagaaaagaugaccaccugauguuaaugcagagucaguucagaucccagcaguacaggcaggaggaggaugggcugauauagguugguuuguuugaaacaaggucucauguagcccaggcugggcucaagcucgauauagcggaggaugcccuugagcuucugcucugugacugcugggauggcagguguucaccacugugccguuuuaugcagugcuggagauccaacccagggcacucugcacacagggcaagcucucugccaacugagccacauccccugcccaggguagucaucugugagcacauauguuuguuuucuacaaucccuuccugaaagucaaguaugacacuguaagguuuugcuuuuuuuuguuuuaauuuuccguauuuccaggcgccaggagauauuaaaacaacccaaguggucguuuuaaucccuggcccugggaugcucacuauccauaggagaaccaaauaugcaaaaaaggagaagucuauaaacaguguaaggaagcaugggucggguggacugggaguguagcucuugguaacugagugcuugccucccaugagggaggaagcccugggcaugguucugagcacugcccuacuuguaagaaacaaaagguccuaagccuagccaaacaaagaacauggcuucccaguuuaaagaccuuaagcaaucaaaggccaucuaucuaauucuuccuugccuuucaaccagagcggggguggggguggggugggguggggauggggaugagggggugagggagauaauaaaccucuggcucucugugcuucaggcuucucgguggaucagggcucccucuuuuauucaauagcaaaucacugaugaaggaaacagaaaagcaguacugguagcucucuaaacugacuuuaguccaaccuagcucuuggucauucagggaccccaccgugggcuggucagucuuggucauucggugaccccaccucccaaggccgcgcugcuggucauguguguguugcucucugguuaacugaugagcuucaucuugcaugacaaguagaagggaaauugcgagcccagaucccuaccuuaugcaucuccuugguggcaguucuggcagaaauauaggauuauuucuguuauauuaauuguaugguuuauuucuguuguuguugcauuuuuuuuuaaagaaaacaucucuguaaaguuuguuccaacugucuuucuacacauacuucaagaaacugauuuuccuugugauaaagacaguguuguuccuucugaggacccucucacugggaauacacuuucucaaguauauuuuuaggagcuaucaguacguacuuaucuauacuuucuuuguugagacuugaccuaccaaaaccaaauaaauuauuacuuugcuaaguuugggauuucaaaauacacauaauuuacugugugaacaucucaguucugccauguagcacagggaggaggaaaaccggaauggcgcugcauggcucugcauggcucugcauggcucugcauggcucugcauggcucugcuuggcucugcauggcucugcauggcucugcauggcucugauuccuuucccacucacaguccugugugcaccaggaagcuucucuuaagcccuaguuaguaauguaacacaggagaacgucaugaagaacugacuuggaugaaagcaaacaaaauggaagcaccauucuaaugacauaaaaugagaauacagcacuuuaaagaaauagaauaguacuucaauggaggcuuaccaaaagaacugacuauuugaaaauuucuaccaugauugacaaauguuacguuuuggcuuugccucuccaccguggccggaagcagguuauauccagaagcucugggagagcaggguuaucuucugcuguguuccuuuccauuuuggaagaaucuuuucguagauauugacaucaggauacucaugauacgcaauauuguuuuaacugaugaaaauuagguugaccauucuguaaguuaaaccuucugacagcaggaaaaccugagguucggagcacacaucucuuccagcuacucuugcuagcuugcuagcacuucgcaaaaccguugcggugaauggagcgauuuuauguguguguguaugagguguaugcaguguacucccuccaagguaaauauucauaaugggggaaagcaaaauccuguccacgguuaagagcgauguaaagcaaacaauaacaccccuccaugagugagucuccugccgcugugauuuuauagccagauaauaaagagcucuugagaucaaucauagacaagguauuuguacgagaguggacagacuugccaccaugccuauaugccacguguacgguagucugggaaaucccuuccccaucccuaccccuugcuugguucauacaguuggcugugcagaaaaggaaaaaugucuuggggugcaaccugggggugcaugaaguuguagguaccauguccagaggaacccaggaggacgguucaugcaguucugucacagccacacagauauugccaccauaccagugaacacagcccuuccaguauggagguguucagucauagccacacagauauugccaccacaccagugaacacagcccuuccaguauggaggugcggauacagagggacccccguaaacaguuguagaggaaacuuucugaacagagcuacucagacgaggaaggagcgguaaagcaccacagagacugcuuggggugcacucaggccggcacgguagacgucucuuguuguacaucguggaagggaccaugacucauucagcaugaccagagaugcauuuguucccaagucagugugaaagggcaucagaucucugagacauuagguuaagucagcacuggucaugauggauccuguggcugggaucucuugaaaaucguuuguggugagugaguucuuucugcuuugcucagaaacacacuagcaugcaaguuccuuucuuuuguuaugagacuucuuacugaacuaguaagaggcucaaaagcccaggucauugccucuggcauauagacaccacacucaggcaugauacuuggaugggaauccuugaugagccuaggcugucuuuucuucuauauuucccauuucuuucucuucaucgcuaaccucacagacaccgaaauggaaaaaaaaaaaaaaaccgaaggaaggacuuacucuuuaguuugcaguuaaggaauccuuaaaaccccaccucccucuaauuuccauagcugagagcccuuccguggacuuguacuuuagaguuaggaaucacuuuggaggucauuaucugugcagauggaagucugaucuccuuaaagucucaccuacuuguccagaccacaggucucccuagagacugggcgagcaggcucuucuccauuggaaugauugccuagucuguacacgcagucccaggaagauuuaauuuuagugaaaccaacuuagagaccagguaaucagugggcuagcggcaagugagaacuggaucccuugaugugagguuguuaagggaacccggaauucuaagcacagguccaugacuuuucuagaagcagcaagcagauuuuucugguccauggaaaauuuucagugacagaguauuuuuaaagccuucagauucuuauaacauauugugguguuuuuuuuuuuucuucuucuaauaaaaucugaccuuaagcuuaagcaucaguuugucaaauauccaucucgcucucccuugagcucacuucaggcuucagauggauugcgaacugccgaguggcugcucuagagcuggcauaauccaaugggaugggaucuauuuauaauaaaaacugugugggagcuauacccagaucauaacauuauuucuuuaucauacccagcccaaguuuaucuuuauaauguaguauucugccagccuaauaggcaauaauuucuuuuauuagacucccaacuagaauggauuuaguacuuuucuuaguucauucaucugaucuaaucuuugcugcaucugggagauaauuaaaaagcaguccuugaacucaaggagccuguggucuauggagaaacaaaaaugaaaucacaccaguacaccaaagcaguuuuauggcacagaccagcaguuuucagccugugggucaugaccccugugggguugcauauagauauuuacauuuugauucaaaacgauagcaaaauuacaguuaugaaguagcaacaguaauuuuauaguguguguggaggucaccacaacacaagaaacuauauuaaagggucucagcaccuggaagguuaagaacuauuggcauagacagcacagagcagagagaugccugcccuggugacaagacauacagagaagaaagaauugucuggguaaagaugaugaccuuaggaguggagauagcccauuucaggcuguggaggcucagaguuaggacaccggucugcugacuugaagucagggucauggccuucccuuguuugagaauauagcugcuauuugcuuggcugaucugacugaccauguauuggauguacauucucuucuagccugaacccccuggaggcuuuucagacaccauuucagucgaaugcagauguucugcuaauuacacagccacuggaauagugugaacacuggaguuaguguguuagugugucagcucuccccagacuagagguacaggcaguguguaucgggauugaucagauccucugcaacaguggcuacucacucuuaauggcugagccaucugcccagcgguuuaacagguagaucugcauucaguacagcaagggcaggaagcauugaugaauuuacccucgauaaaggcaagauuuguggagauuguaaggagggugauuucuguguaccugaacucauagugugaccuguaccccuuugccaucacacuuagaucuucuuauuguaacugucaguuacuucgguggaguaucagccccuggagcugaugggcagcaugcggcacaugccguaugcguagcggaugcucaggggacaccugaacguucacacggaugcuuuagccacggccgugagggacugacccuggaguuuguuuguuugauuuuuguuuuuaaaucaaaaagagugucaugucuugucagaaacaagucuugcucugaagccaguuauaaugucaauaaaggauuaaacuucguuagacuuucauuuuccagagacuaacuagaccuugauuuuucacuguuccuuggagagaauucacuggagacaguucuuguuuagagcuuagaugaugguggugguggugaugccguuaaugauguaugugugccuaguguguguguauauguguguaugugugcauacacauauggauuuuuccccccaccuacuuggcuuuuugaaccaacaccucuguaaucucaguaguaauuccauuguagaugaauucauuuggaagaguuaaaaacaaaaaaucacuucugucuuuuggucuugaguugacuaugcuuaagacugccaugggggugggggugacccaggugacacagcugggggucuggugagcuuaugagaauggaauucagaagacccauuuguuuacaagagccucagcaauccauuguauuguuuccaucugcuuuaggucugcaaagacaaguguugggauuuucuuuaauaggcucucuuuugaguuaguuaauucagcuaagucuacaauuacccagggaaggcaggguuccugcucugaauugcuugaugaggggccagugggcugggcuguacaucuuggagccacccaccuggauaguacaaacugcucuguuauaaaaagaugcaccuuuaugagcuuguccacgguugauacauggcuccuuuguuuaaagaacaauccgaagagaaguacuuugccuccauuuuuuggagagcuguuuucuaaaugggaaaaaauagaaauauuaacagcucaaaaggcuuuuuccaauagccugguuuuccaauaggcaguuuccaacaguccaacauucaugcaugcaugcauucauucauucauucauucauucauucauucauuauuucucauucauucuaacuugcuugggagcuauacuuaucuuccuugugcuucuagaagguauagaucagugccaaagggcuugccuaccaaauaguaguuccuggauuugauccccagccaaacaaagcccccugggccccacaaguguuaacucauccaugauguucccuuagcaguuaauauccaaagcuauugaagacccacgaagcagaacuuuacgguuaccucaauagcccacagcuucuuaugagcuaguaccuuucagaagcagagagaacggaggagagauaggcugggaacauggcucaguugguaaggaaccuguggcacaagcaggaauaccagauucccagcauucccugaaagcugggcauggcaccuuagcacuggagggagggaagggaaggggaggggaggauggggggaugggagggucccuggaguagaguggcuagccagucuagugguggguggggaucucuggaauuugguggcuggccagucuaguaguugaaucacugagagacccuggcucaggaaggacuuuuaccccuggccuccguacacaggugcaggcacacacaaauuaaauuuagacaaaaucgugggaagcaaagaaaaaaagacuugaccuccauuggaagggagacagacggcugugccacccugaaagccaauggugagaggaugcaucuugauuccucucugguaaguguggcggucauaggcaaaucaggucucugcuuauagugcaucucauggagaagucauugcuguucuuugucuuaccucgccauucagaaaucauguuggguuuguuuuuccccauuuucucucucccucucccucucccucucccucucccucucccccucccccucccccucccccucccccucccccucccccuccccucccccucccccucuccuuccuuccuuccuuccuuccuugccaaagcauuuuggugaaaaaugaaugagcuuccaauuuuguuuggcaaugucuauauuaaaccaauggauacaggcuuucaccuucccuauauuuaauucuuagcuucaacuugagaucacauuaauuuuacaugagcuauucuguugcaugcuaacaaccaccggcuuuuaucuacuguucuuguggucuucugggguggguucucucacugcaaaggacagcuacaauacagcaaauggcaaaccgugucagaaguauuucuuagucuuuaaacccaucugggguuuauuaguuuuccagauaugggcuaacaugggucugugacuaggcauaaggcccagagagcaggauuagguagguuuccaggggcucugaacucaugucaagcaaaacuguugugcuggguggcuaaguccacugaauggggaaaagucuaaaauugcuuuaucucauugcauaauguuuguaaauuuuauucaauuaaauuacagcuuuaggggcucaugagguuaaaauuaaauuuuugugaaguuuugauaaggagacagccaaacaaggcugaucagcaguggcugcuuuggaaauguguuggccgaagugugaaaacaaaggguuuggguuucaggagcccuuggcaugccgagcccauuggcucagagguggaagugcgcaccugcugccugccaucacaggucuuucucuguccuguguuuucuccgaaguaaccuccaaccaugaagcaagcauccuuuauaacucucaccccaaggcaguguuguaggcaggcugccagugauguuaggcugucuucuguuucccucccuuguugcauguucuuuagucuuuaagauauggccaccuuaguaaguugccccccccugccccccccccccccccacaguagugauguuucuuuccucggucagcucugccaggcugaaggaugacaaagagcacaggacaggcuuccaaguaaaagacuggggcuucaaagcaacauccauuaugguuugcugaaccucuuccucccccugaccccucuccccccuccccgugugugugugugugugugugugugugugugugugugugugcacacgcgcgcgugcauguaugagaugcccuaaacuucagcaggggaagcucaugcuuugagauguaguggugaauucuuuccuuguccaagcccucuguuuaugcuuuuugagcauucucuuuaucaaggcucagcuguucacuuccuucuggagugcaugcagguuuuaguuuagguuguuguuuguuuugagacaggguuuuacucuacagcccaggcuggucucacauucauuauucuccuuccccggccuccuagugguggguuauaggccuguacugccuguuaaagguaccaccuuccuuuuuaaaaucuaguucucacuagaauauuccccauucccuuuaugaagaagccccuguugccuguucuccaugucuggucacccuuggugucugacaggugauuaaucuucuguugugcccagugucaugcagccugucuccagcaagaaacuuguuaguuuagcuuagucagaauucuagcuuugguuuguucuuugacggugacagacuuaaagccuuguuuauauuagaggggcuaaaacugggauggugcaaaaauugagaagggacauaauggagaaacaguuugugugacauguucccgucaacuuaucugugcucacugugcaguguauuauggacugauauguggaccuggugcauacacuaugacuguccuaaagcuccugccacuugccaacacaccugguggcagcugcugcugcugcuccugcuccuuuccugcuccuccuccuccgccccuucuccuccuucuucauucuuuccuuaaacuguugaccucaaaaaagcucaaaaagcaaauauaacauaauuugagaaucaaaaugaagcagaguaucaauuuaauauaauuaauuaacaaacuauauuaaauguacaaucaaauguauguauauguguguuuguauguauguagguuauguguguguguauauguacuuauguauguguauuauguauauguaugucuguauguguauauguauguauauguguguaaguauguaugugugaauguguauauauauguauauacucauguauguguauguacucauguauguguauguauauguauauauguacuuauguauguacuuauguauguauaaauauguauguauguauguauguguauguauguacuuauguaugugugugugugcacgcguauauauguacagagucugccuaugcuguccaggaccuccuagcagcagugcuucccuuggagcagccuucagaguaucugggacuacagcuacaugcuaccacacucuccuccauucaguuuugaacuuuaaaaaaaaauaugcuuuucuucuuuuacaaaaucaacacgugacauuuacuuuuuuuuuuuuuaaagauuuauuuauugauuauauguaaguacacuguagcugucuucagacacuccagaagagggagucagaucuuguuauggaugguugugagccaccaugugguugcugggauuugaaccccugaccuucggaagaacagucgggugcucuuacccacugagccaucucaccagcccgacauuuacuuuuaaaguaugaaaagauguaguuacaaguuaagccucuaaguaugguggugccugagaacagguucccuagcagguggacaucauggcuggggauugucaagaacucaaaggauaccugcguuaugucaggcacuggguagggagcugugguggacuccgggaggguugaaaagcaaauaccccacccucauuaagccaucaaugucagagugaugcuguuucuuggauuucuguuugacaacuuuugccuguaacaugaagaaguaugcacugugguuaguuuucucuuauuaauaucccauuugcucgucuuuaaagcauagcucaucccaguggauuggaaguuguggacagaacuuguugucuucuaagcugaggacugcagcaaagccaucaagaugcuaugagggauggcuucccugaaagcauggcugaucacugagcucuguuagagcccaagccuaggcaaucccuuucccccauccuaguagcccaaagcauaguucucaugucauuuguuggccaucuugguuuguguuaguuuauuuauccuugaagccuucacuucguugcaaagucauccaaaugcaagaaaguuguuuagagagcagggugcucuuaggagcuuccauccaaccuuuugugauguagccacuggguuuguuguggauccugucagggcuugcacacucucuuugacagaggggcagugucacagacacgagaaacgaaguucaagaaagugagacuuggcagaguggagcugucugcagcucagugggggcucucccugauauuugcagcgacauuuaaccuugaacuuugcagaagacuccuggucucuggaaccaggugugcccucuucugaggagcagugagcagucugcaaaaauggagaaggaagugggcaggacuagugugggaugaacagaugugcugucuguguggggagaugcccagcggggcguccacagagccuugacaccagaucagaagucaggcuaucacacugacaggcugucagagucuucaauggcuaccuuucacauaaauuaacccuuuuaaucaacaugucugcccuaccuguugagggucucugaaaagguuaaacuaaucuaaauauuaaccccaguaaaacaauuaggacgggccagugugcuugguaaacauaaucuuuuguaucccaaaagaugacuagaauuuauuauaauuauuauaaaauuuaauuuuaguuuuuauuuauuuuuaauuuuaauuacacaaagcaguguuucuucucucuuggcauggagaauggaggggugcucaucuccuccggacucuccauaauuccuuaggagaugauauacugcuaagggucauuuaaugauuuaaucaggaagggcuggcuguggugaggcagugagaacuggcauuuaacaaguuaauuggaauuggagagagcuauuaaaaggccaggagaaggucuuuuaugaagcccucaaaucugcuucaagccugaagaucuuauuaaauuaugcuaaggguguauuucccuuucacuguaaaucacccauuaggaucaucuaaucagcuuccucaaaguugcugcagauggaaguauuauuagccucaccaugauggaauuuuaauuuuuuuuccucuucaauuguuacuguaucgauguugaauacuggauauuuucuuagcccacugagaccaaaccagaauugauuuuagaaauuucuucucucucuuuuuuuaguuucaaacagaauuguuugaggcacuggugacggauuaugguucucagcacacucaauuguucuguugguguugaagguguggccugcucuccucugaacaggcauucagugugcuguuuuucgugugucccaccacagaggagcagauggagauuuuuggaucccauugucccucugcuaaugacccagagaucuguuuauuucacagccauaugugggacacaauaauuguuucaaaaauaaauaucguguggacuguugaucuuagggaguagacucugccaggcccggggagacuguuuuugguggccuuuuguucucagcuuaccagacucaugugaaugcuccaggguaacugaagggcucucuugagacuguuugcaguuucauacuggagagaggagguugaggguaaagacaauuaagaaacauugugucucuuuagugauuagaagcucaacuuuccuuuacuuggagagaacgcaaaaaugguuugcaaagcaacacuugagcugcagcugacacuuaagucuuuuagcaugcguuuagaugugggcacaugggcauaugcauguauugccacauauauugucuccacuauguuuuuuaaaagcugcgcauauugaaauuuuuauaacugaaaugccucuuucauagaacaagaaauccggugucguuuccugauguuauuuuuaaauaaaguuuagaagaauauuugaaaaucacauaaguaauacccagcuccuucucccccucuugugaagggccgagagcuaaaggcagagaugucacucucuuacugagcucaguucucuccuugacauuccuuaugagaggaagggucuagguaaaaugcccaggcuugccuucaacuuauaacccuccuacuuuagcuuccuaaguuauaggcuugcccuauggcuaacugccaauauuuuguuaucugauucauuuuuuuucaggcaggucaacuaaaauaugauaggaaacauugaaaagagauuuuuaaaaaaaaaaaaaaaggaaaacaagguccgaauuuauuuguuuuaaauauuuaaguguucaaauauugggucuuaucugaaugcacagcauguagugcccauucuggcaccuuuugaccuuuauaaccaacucuuucagcccaguagguccuugaguauguagaaugucuggaaacucacucccagcgucauguaggucauagggcuuccuugguugguagugacugagugguugaaggcugccuguugacaugcaagaggcaggcagauguguggguuuauagauuuuucuuguuggucauuuauaccaguguauagacuuacagcaugaccaaaugcaugugugagguaguuuucccuacuuuauucaucguuuggugggggugggggggaugggggugugugugagcucuucauagcucacuugucuucuuuaugccaguaaauuuaaguguuagucuaaugguaauuuauaaacgauacaugguguugaagaaguuugcaacaauaaugaaaaacucccaacacuccggcaaacuguucaggaaaacucaaugcacagagccaucuucagacugguagaaacggaacuugugacagccuguaacuguagucacagaaccauacuuuggaagaaauuagaugcuuggacaaaauuaacuugauuuaagaccaucacugagaaaagccagugccauuacuccccaagaugaccuagggguagggcucccguuucucugcaucuugcugauaugucaggcgggugucagguuaugcuagggcaggaaagaugaugcugcugucuccuaguuagacuggucguucgggagcugcguaggguaggauggagguaggggcauuccagcauuuguccuguuuguugguacaaauuaaucaaacagaacuuuaaagggcaugaaucgaagagauuccuguuuguggugugaaaaaaaaaaugauguuuuucaguguuuuuucaaguaauuaaguacuccagaagugaauauuucauaaugaaaacauaguuauaggcccugaggggggcgggcuaugaacuggagaugagugucauacuucuaguucuccucauauuccuggacuacauucaagaaagugaaucaaagcccaaagacuuggaggagaagugcuugggcaucagaugccuuggaggagcccauccuugcugcugacuucgucuaagcuauacucguugugggguaaucagacauggagcugugaugagcauuuguaagaccugcagaccccguaguuaagucaaaaggcagcugcugucuguuucauauacaccauccagguagccagcacuuuaccagcucacuggaagcuaaggucaggcguguaacuugcuguacuuguguuagguguggacugacuccugaguacugaaguuaguuaugcucugugagcacuguccucugaguccccuggagcaaagcugauagcagucagagggcuuggcucucacgccuucguucuccccgcugccauggguuacugaggucgcugugcaucuuguuucuguuuauucacuuguacuuuuugccaggaaagaagucuggacaaggguaguauuaaacugucuccacagagcucuuguuagucccaccacggcccacuggcaagaguaguccaggguucaguaguucacguugucaguuugcuccgaguucagugaacaaagcaagcccuggacacaaagcaagaacuauacacuuaaacuaauaggaguccacaggguaguggguaaauagcaacagucagcuaaucaacgaagaagggaaaguuuccagcauguauuuauuuagugugugugcuucugagugccucugcaugccauggaggauguggaaaggauggugaacacuuauguaggacucaguucuugccuucugccauucagucuccgagaauugaacccauugaggcaucucacuggacaguacuuucuuucuuaauucuuuuucuuauuagcagaaaaucuuagugcugaguuuucggcugcagagaaagugcuauuugauauguauccuaguuacaguaucuccagccccacagagcugcaugaauaguauucauaggggaaaacuauuuuaucgacuaccauagguauugaagaucauagccccgugguuguagauagauguaugacgaccuuuguaaaggggaguuuuaagagugggcacugguguauaaaaauaagaacaggauuggugauaauguucuggccauuccucccucaaaggguagcugcuggucgugcagccuuuuuuggcuuugauugacuugccuggcgauuuggaugcuaccagcugcauuuccucauguccccuccucauuuccuccuuugagguuucaggcucaaguugagauguccaagcacuggcauagccuucuuucacuccuccucacuugacguguugucccagugugugcucccagagucccuuguacuucgucauguccacauguggaguccuugucgaccacaccacgugccaccgucucuuacuugugccuugucucuugcaucuagcaucuaguguaaguucaguaagaguuuguuaaacgagcgauugcauagcugaagccuuacagaagauuaagagguuaaaaacugacucugagguucuucugcuagucacucccaacuguacuagcugugucugcauuagcugccagugggcccacuuaugagaagagacagucagucuaggaagcaaauuacaauauuguaugugacuggcgccaugaugugggcggggccuuuggaugccagcggaggagaugcaguccagccuagggagcccaaggagacaauuggagaacaccaugucaggugagagaaggcuauuggccgagugugggaaagucgucagugagggcgugacagagaacucgagcaugacaucaguucagacucugcagaucccaaagccuauagagagggauguguaacuaaggcagggggugagugugacaaggaggagccggacgggagaaaagcagcucugagauacuaauuaauaccguggagguuaauguuuguauaaaacccuuuugguuuggguagcaaugcaguguggaaagcccacgguucgugucccucguguggacuucauaucaggcuggucauucaggccucuuagugcuauuuuuuaacaccgcgaguucauacuuuuucaaguauuuuuaggacuucuaaugaagccuguuuuauacacaggaugcugacuaaaucuguugagcguauuuuaaaagggcauugugcaguagaaaugccagggcacuaaucagugguacaaucuugcugaccaucugagagaacaaccacaguuaagcggggcccugccuucaguuccuggcugccaacaagguuucauucauaacagacaugccaccuucucuagcuccauacauaaagcgagcggccuuagauguggcugagcgacuggggcacagcucuggcaucgaacucccagcgaagcucuuuuucugggacuggcuucuccccucuuaggaccugugcaugcaaggguuuuguugacagucccuccuguccuguauauaaccuucacgaaucgauucuguguccuggcuggguuuuuuuccaguguuugagacucucgcucacaugcuuucuaaauccaguuuguuaccuuaacacaauuagauaguccuucagucguccugggacucuggcgauuucauggaaaucugaagaaagaaauagggacaaguggccugggucuuucagaguccuccacugggaacuacugagaagacuuggacguagccguguccauaucucucugaucucugcuguguaaaugccucugcuuccagacuuagguuucagcacagcuucagggcagcuaugagccguuuagaggguggggagaugggggguccugugcuguuuccacuggcagacaaagguccuguuucuaccgcagacuuaaauggaguggacagcugcucagucucgugggugcacaaagaaaugcaaaccaaacucaugaccaggucaaaaggaaaugcuuuugaaaacugaaagcuucaacaaaggucugugagcguuuaaugaauauuuaacuguucauuuuuuagaagucuuaauggagcaguuuaagugcugcuaagcaguuuaaaugauguuugaccagaaauagauagaugaguggauaccucuuccaaaaugguuaucuaguucuaaaaauuguaguuaaaagaaacacaguaacacaaagggucucauaccuggagacuguaauagauaggcacauaguuuugagugagaguuuguaggagaaagaauguacuagaaaaauaugaucauuaugcauugguauuuuaaauaacaaagucaaguaauuacucacacaguaguuaaagguucagaaggcucuuuaacuaaaaaugugucaaagcccuucuggauacacuaugucuuaugucugcacauacauguauuuaucagcagaagcauggaccaucuacugauaacuguaagacuucugaauuuaguaaaauacucaauaacaaaggagacauauuaugaucuauacaaaguuaaaauuucuaaauaguuuauguuaucauacuggaagcaaaaauaagcagcaaucaaacuccugauaccuacuuuugaggguacaguuuaauuaggcuauuuugugggguuuccauuuuuccuuuugacuuuuaugccagaaguaauaaguugagaacugucaagaagggagugcaggugugcuuuccugccaugagccuuuaucuggauuauauucaguagcaauacuggcauuugucuugacaugcguuuccugaucaaaaugacacucugcugccuuagcuagauccaggcugcuauaugaagcuaagccaacucaugugugcaggguucuguggcggacagaagcacaggcuacauucggaagcagcugcugaucuuuuuuauuuuuucuuauuaacgacucuguauuaguuaugaagucauuauauaaguauguacaaaauaccucagaaguuugaauguagauacuggcuuggaggaagaggggucuaucccaggggugaggccccguuuacugaaagucagaggagugcuaaggacugggcaucagccaguucacauugccuuaugaauacagccagggccuuaccagugcuacuguguuuaaacuuacaaucacagcacugcuggaauccuccauuugucuucuguucaaaguuagaaugaaaaggcacagguagguucugcccauguuguauuuucagaucaaguugccaucuuggcagauaaacauuuucuagagagaaugaauuugucuuacguuguuuucuguugcuauaauaagacaccugaggcuggguacuucaacucaccaguuuuaagagcucaggagauauauucuuggcucuggugagggccacaugguggguaacgacacagucauuggaucauaugcaagagugugcuugagagggaccaagagugauggaaaugggagaaagagggaucacuucuaccuuugcacgacaacucugggauuucaucugcugugugacacauuaauguguucaucaaggggagauccuguuccuuaaaauuccguucuuugaccaucgccucgguuagagaccauacuuccugcacaugggcccuugcugacagcaaucuuccuugguuagauucuagagauugaaggcacgguccuuggcuugcuaggcaagauccaugcuauacagcaugagacacauuccagcccugcagagucuuuacuuaaauguagacagcagagaaaacgacugcuuaggcugucuugcucagcuucggugagagcugcuauaguucuuuuccucacuguugccuucccacugcuucaaaaggagagaaacaaugacugaagcccagugauguaacaguaucaucauucaacuagugauuggugacuggugggugccaguauaucguucacggagcuuauuaucuaguagggaaagaaagauguuggguagaugaguuuuuaaaguagcaagaaaugccuauuauagaaagaauggaaggcuagauguugaaauaguccaauggguuugucaauuuacuagaauuugagggaauuuauggccauguauucuauguauucauguacaggaagaauauuuuucugcaggauauagauagcauggaggguggagaauuuggauuuguggagucaggaaggccaggagcggucuccagagaacaagaagacuagccucuaacauaguaagagcaacugagagagagagaaggaggugugcauggcugcucugugcugcugaacugugggccuccuguagcuucacuuaggacucuggccuucagcaggaaaaugacagauauuccgagagccacucauucuccagucuuuuguaggugugcauauugaauaucucucuggucauucaguugcuauacuuagucuggaaaaucuucacaaguuucauuccuucgcaaaaagcauuuuacagaugagauuuuucaauaacuucuuuggcaaaaaugguuaaaauugauacugugugcagcacagaaaauacuauuccagaaaugagaaucacugugugguguggcucagugguagagcuccugacuggcaugcaugagaccccuuuucaagccucagugcugggaggggaggggaggaggaggggaggggagaggaaggggaggggaggggagagggaggggagagggaggggaggggaggggagagggaggggaggggagggagagccuuuuaggaagugcugauacuggcuucugacaccuuccuuuggaacuggggaggguuuugguuccuucaagguauugcuuugucccaguguaccuagaaccacagucuaagagugauggucccggaggcagccaucuuuucugugugcuuuccucaagauuuuauccggaaauccuuaacaacccaacagaacuugucacuguugccugagccaaucagaaacuaacagcaaauuuggaucuagagaucaugauggcgccaagcuuuggguugugcucaguaguucccacagauggaaaaaucaauagccugguucuuaggcugggugcuuggcacacuccuguuacaguagacuguauauuauacuguguugugcgaguagauugguuccuuauugauuucacacgugcccauaucuuuucuauaaaauuagaucuugugccaacacacaaacacagcugacugccauagcacacuugacuaaaaauuggugaaaacugaagacuuuggauacauuugaauacccuguguguaguuguaaagacaaauauauuaaauuacuuuuguuuguguguauauguauauguguauauauauauauauauauguauacacacacacauacauacacaacuucuuucugugcauaagaacuagcagugaagacaagagcgcagagaugcaagcaacaguguuguuaguauuuucccagccuccuugcugucuccucuggaugggaccacauuccucccacaggcucugugcucauggcuguugugcugugugucagcuguauuguccuugagugcaucauuaucccacccaauacaauauuuccagcucaaaggaugaauuaauccccgagcuaggguuguaagcauuuuauucuuucugccuguucuugcgauaguuuuaucccagaggcauuuagcuaucuuccuccuucuugugucuugcugaugcccaguccugcuguggccuuacugugccuccgagcucagucuccgugccuuuccuuacugugucguaacaagccuggugauguccuuaagauguguaauuugucacagccuggccucuguaaacuuguuacuuguucuaugagaacgcaucugcacccucuaguaauuagcguccucugcaagggcucuuccaggcaguggggaugaaagccugucuugggccgucacacacauaaauagagacacugauugucaaguugcagaggcagcacagugacgguucuguaaacccaccgacaccucuagcuccugguccuguuagguucucuaacaagcaccuuguaagggaaggugacucgaagacucaacagccauuuagcugccaagugugacucaguuacaguggauugauuagcauccguacgggugccaucauagugucagccaagagagcuuuaaagagagcaugcagggugucuggauaaugaauuuguuuccaagccagaauaucuugagagcaaaagggagaggugggaauaccugugcuuggauaaaugacacagacuggggaugaacuaggcaaauugcauucguggcuaccgaagccaugggaugugcuagguucucagacccuguucauggaaagguggaagguuuucuguugcucauucaccugucugucauuucaccagggacaaggugcuuccaucauccgcagggcaaacaaacaaaucuuuuaggguugaccagagacaagauauugaaacccuuuuuguggugugugugugugugugugugugugugugugugugugugugugugugugugugugaggggggaggugaagauagcuuuccuccucuuccuguuggccucagcacugagauugcucugccgggcggauuaacaagaggaaagcauauagauuuacuuguuuuaugugacucgggagccucuguaaggaaauggaguugcgaagagcgcucauuagacaugagugguuucuguauuaguguugauggagaguggacagucauggagaaauagaguggggcagaggguccugagguaaauguaaugagcacaggcuguuugcugacacucccuugugccuugugcagucggaggaaaggaugcuaugugggagggcgcaucucacuugagggucuuuugaccugcuucaaggaagagccguaaaaagccuuccuguguuuuaugaccuguuuuagagagaagggugugguggaggagucaaagugaccuuccagcuucuacuguuuucuuaaagcuucaucuuaagauauccaguacgccauaugcaggagcagcguguccugaccccuguugguagcuaccccuggcucgacagaaugugauuagaguuuagcagaugaugaauaacccagagaaguccuucuuuagggcacuggugcccagaggaugcaaacugaaaccaagcagaacacauaggaagcaugcugcaaauacuuagguguagagguuuuuaaaauucacugcaggaagugcaauagugccuuuguugggagauaaaacccuuuccucuuuuuguuuuguuauuuucuuuuccuuaaaggugggggauacaccuggguuuaaagccauuaagaggaaaacacagguaggugcagcauuuaguggcaauuugugcucuuuuuauguauucuugugaguauucuaaccauaaaauauuaauguucaucuuuacgguuaaaauacugugcucuaaagaguauggauagaggcggaugacuuguaauuauuuacuagacuuucuaaacuaaauaauucaggguggcacuaaaggaucgauaaucaaccuccugaaaauugaauaaugcaaucaauucguaugucuuccguggcuacugauggagccacaauauuuaacuuucccauacacgacacacaucuaaaaggaaaacauauuaaaacauuaagguagaaaagugucuuuuaauaggguaaaauauaauucucauguaacuuugugccgugaauuuaauguaaugaguaacagaaucauuaucaugauaagagcgacucccaggaaauuccagaguugaagcauucuguugcugcugacagaguggugggauaagguugagggauuaguaguaaacuguguaauuucucagggcaacaauacggaacuggaucuuucuuccugccacauaggcuucauuuauauccuguggauacacauguccagguuaccaucuaacuuaacagucuccaccuugaugacaaacagcaagcucugcaaacaguccuuugaucucaucuguaacacggagaugagacagaggucuguggguucuuuuauuuuuuauuuuuuuuaaauuuauuccugaauuuucauaacaaagguuuagguuuggcuucgguuuauauugaaucgugugauucuuaagcaguuaugcaauugugaccuuuguauauauucugugggcuuuuuguguuaauuuguuuggcuucuagaggaucuggguucagguaacggaggaguccauaguauggcugucugagaaauaagcaagaccagaugucuugauuggcacuuuuauccugugugaauggagcuuucuuagugucccagaacuaagguugauccccaggucaccuugaagaaaguauaauacaucuaguuuuuuuuuuuuuuuuucuagcaaggagacauacauuuaaguccugagcuagcacacuaguaauuaagaaguaaaaguuaggucaaaaagaaaguagcccuaugcuuacuacuugcagguucuuauuuuccuuucguguaaggaguguuugucugcauauuucaggugucacauggcaugcugugacugugaaggcuagaugaggcccuggguccucuagaauuggagguugucagcugccaugugggugcugaccccugaaccacgucuucugccagagcagcguggcucuuagcccugagccaucucuccagccuccaguuuauucuugugaaacucaaaagagagaugguuccuuagcagucuuucagguccuagggacaagguuuugacuccaucucucaaaaguaacaacacucuuccuagauagaagccagcugacuauacagaugacagucuccuucaucacagcgaaggucauaggaauuaagcuguucacauuuuccuugccguggcuugcauugauagcacuugcuaaucagacaaauugguagcucauuugcauuggugauggacuucuucgaaguuuugcuuccgacugacaugcauuaauuauccuguuggagauagauacaaauagccugcaugacuuucuaaggcuugauucuucagccacucugcaauuacuguugacugccuguuguuuguuggacauuguuguacauagcagggaggcagcaaggagggacaggguaaaaagcauccuugccccuacaguguuccuagucagggagauuuuaaacuaggguaagugaaacaccuggcuucuuuugcaagaacacugaacuugaacaccagauuuaagguaucuuaaauagcucaccuuuuguguagugguggugguggugguggugguggugguggugguggugguggugggguuggaaauccuugggaaucuuuuucuucucaggagcagugggauuuuuuuuuuuuuauuuguuuuggguuuuguuuuccuuacacauucugcaacuuucuuaauggacuuuuccuuuaaaaacaaggucgagcuaaaacaugagcuuaggaguuaaugaagaaaggaaaacaauuuagggauuucgaauaaaagauuuaucuaggaaaaacaaagaggaguuuuaugaacaccacugauguugaaagcgcucccccaaagguucaggcguuaaagggcgcuucucucccauacugaucuuuauuuuuucuuaauccuucaucucccucuuugccucgcucauuaauuugucauaguuucgguauaaaacagcucuuaauggagacuacauaguuuagagaucacauucugugaccaauaaagaacauuuaaaauuaauagcaacaauuauaauaaauuggagacaucuaggcaccccuaaaaauaaaauuugaauaacucuaaagcuuuaguuggcuuguuuugacucucaugaauuggguaaugccuuaucuagagguuuagaagcacggugaguccagcgguccugacauuuccagaagacuugguuuuauucugcugccccgccucugcccccgcccccagcuucuggaguuuacaaucuuccugucuccucuucacgauaaugguccugaagcuguggagagggugaugugaaugucccuccugaggcucagugccccacucacacuuauucucugcacuuuaaccaaauccugaguuucugcauuaaucaccgacaguuccucagacagaugaggugugaggcuaauguauggguauauagauucaaguuuaaugaguaguuuaacacuauauccgcuuagcagaauaacaggaguagauuaacccuuggggccugggagcuucacaaccaugaaccaggcauucuaaaacucccaucgggugugucuuaaauccaaucagaaagcauuuggcuguuggcuacccuucauaacacuuggagcuccuauugcccaaugggcaccuugugccauucaagucauugucauaguucacggcuggauacaauuauugaugauuuuuuuccccaacagacuacauagcauuuuuugguaguauuaaagacagccagcagggaagacacuuucuaguccguauaaaucugauuucucuguguuucaugaccaagguauguaaugcaaucagcaauagaaucacacuguucuguuccugugagcaacuaagagcaaugccaagagcuggcguugauuugggagucuccacaauaccaacagcuugggaaugggucccuaggucugacaguggaggagcuccugacagucaaucaccucuggcagaggaagagucaguuuuuucaaggguguggccccuggaaagguugacuaugccccagugaaucgcuccaaacacacaaguaucuguauggucaacaugaauuggacuuuuuaaaaaggaugugaaguuaggaggggcggggaaauggggauagaucucagagacauugugggaggcauaaggguaaauaugaucacaauacguauccuauuauaugagauuuucaaagaguuacgaaaguuuagaaaggauuuccuagcagagcagaaaaggcgguccucguggggcaggacaagggucaaagcagaucgguccuuucacagugaacuucugucugagcucgaagcuagaaggacugucuuaagauacuguaguuuuccuucuuucuaaguuuaggggcgcugcugaugcuuuggaguaguauuuucugccccuuccgucuuuguguuuuucccaugacuccauuuaugcgcauguuaucauccaauauugaggacgcuuauauuaaaauuuuuuuugauucucuauucggacuggcguauuuuauuugcuuuauguuauuucuaaccgauaguaaacuguccagugaaguuuucuaaguuguacauagggcagcuuacaguuuuaguaguuuuauugaguucuuuuugguauuuuauaauuuucaacuguaugcaugcuucuuucccuuuccuugcauaguaaugaaugcugacuaagucaucuuuauuuaauuuuguaaacccucuuuuuaaaggaccaauuuccuauucauuuuuuaaauacaucacuaauuugggcucuuauuuagaauauuuuaaagcuuuuguggguuucugaauucuauugaguuucucuaaagaauauggauuucuguuugcuuuaacaagcuccuaacuugauacaugugugcuccgaguccagccaucccugggaaggacagcagugugacuggucuucaguuacucuagccugggaugcuugccaucucccaagggcauguguuuuggggacuggggguggggcuugaucacuuagauuuaggcucaucugagauuuaggcucagcauaugcacuagaaugggcuucuuucuucucuguaccucucacugguguuucuucucgcucuccuguuucuucacgccaugagacuacccauuuuuguuccaaguuuuacuggccccaacuggcucaacuggaaaguuuuuggcuucagugaaaaagacuuuaaaaacaagaaaggcaccuguguuuaauuuggcguuugaaaauuuggagacaguaaagacuauguauuaguguacgugugaaaguuuucagagaagauuugcaugggagucagccaagguuuggagaccccuuugaaugugggcuguaccauccagcaggcuggggcccagaugcaaagagaugguugugguuguuaauggacaugugggugcugagcugaccuggaguccucugcaagagcgaaaaauauucuuaaucuuugagcagucuguccagucagagccaucugaaaauuuaaaacuguuuucaguaaagauagcauguuccugccucauguucaaucccuaguaauguguuugcaugugagcgcgcgcgcgcgcacacacacacacacacacacacacacacacacacacacacacaguccauguaguagauagaugagaaugcagacugaaauagaaguacaguuucacuuagcaaacacucacaugcacauacauauacuucauuauggaaaauaggaagcaucucacacaaagcuaauauaccacuaauuugaucuuucccucucucccccucccccucuccuuccacuuuuccucucccuguacccacuucucucauuaucucucuguguguuuagggucccauguaguccagacuggccuucaacucacuaugcaguaaaccggucuuaacucuugauccucuuuccuccacugcuucaguguugggguuaugaguaugcacuaccuugcuugacagacagacagacagacagacagacagaaaggcacacacacacaaacacacaucggagcaacauccuuauuuuuacauacugauauaucuucacuugcuugagagacagauagacagacagacagacagacagacacacacacacacacacaaacacacacaucggagcaacauccuuauuuuuacauacugauauaucuucacauguuuacuaagcucuagcugacgacauuggauauucuauacuccagacuuucuacugauaggacucaauuuacccuguuguaaucuccuuaggaaauccuucaacacguauuccuaauugaaccaguaaagccucauuguuuuugagccugcauauuugagauucaugauaauuaggccaagaacagaauuaaaauuuauggcugccaauuaaugacuuugaagaauauuuuuccuaagagacaaagagcuucuaaacaucaguuuaaaacggaccaguuacacauacaucuuuaucugcuuuucauuuccuaaccaaguaguaguuuguucugcucacucugcagauucaaaagcaauaaaagguacaugcuguuaacauacuuccacgucagacuugucacuaaugaggacucugcuuguguuaauucaaacacaacucuucuuuccccccccccccccccccccccccgugcugcccuccccuuuccuauuauccuacugcuggagucccugccuuuacuuccuggggaggagauccuccaggagggaggagggaggauccuggaucccugggugcuuccagcaagggaugccaucgggggcauggucuucugguaucacauuagcuuauagcuuuuccaaguuuuuuuuggaugucauuuuuuagacaucacuaugggaaugaauacagggugugccaagcacuaaugacuaaaagccuauuaguuugaaauggauaaguuuagaaagccucuuaaagauugcuccagacauguccggauguauuucuggccaaccaccgacagaggucuaguuggacuugaccgguauuagacaaugcuggcucuucucuaucucugagaaguaaagucaccuccaucaucuugucucaccugcagacagaaguuagagaucuguuaugagcucagcuuuaccauaggcaaggcaggcguaggaagaagacccaugagugccauggguuagaagucaccagcucccucccaguggcuggugcugcuugcaucucuuugguccucaugccccucagccuuaaaggcagguaggaaggggauguucccucagaagucugacuuagcuuucacauccauccauggugggcaugaagaaaacgggaagggccuuggagauucacuucuuuccccuauggaggcaacacacagugaggauauagagggugugacuaucuucagugcugggaccugcucaccugagcauucugugaggaguaaaaucacucucugccucauuugauccccagggcacuucagccucaccuuguagaugggguagugagacagggcugccucuccuuuggggagaauuuaaacacaauucucucucuuugaauucuugaacagaggagaccacagagggcuuggcuauagauaccuuggagagccuuguggagugggguagcccaguguuggacuguggaauuugagggggcggauagcucaguggugggcuugggagauagcccaguauugggcuggggcugaggcuggcacgggaguagguuuggugggggauagcccagugugguagagagcaugccuaacaagcugagaccuuagguuuacucccuagaacuccaacuaaauaaaauaaccuuuuuccuuuuacacuagauccccacccccuccccccaauuugguauugcauuccuuaauuuggucuuauaaguauuauauaaauacguaaguaauauucuuuuuaggcacuuaucuauacuuaauuucugauguuggccuucucugcuuagcagugauucauuggcaaaaaccaaugcauuugggguuagcagacuaacaucugcaggcaggccugcuguguguguguguguguguguguguguguuuguugaauuaacagaaguaucagauguuuugucuuacauaaaugaguuaaauauuaaggacaaacugaagguguguggcaagagucuuuccuuaccaugaaaagucauaguugguaaacucucaguuuguuucuuugcucuuucugucugucugucuguccgucccuccuucccucccuuccuuaucaccaucaccaccaccaccaccaccauuaucauuauuucugguucuggggauggaagccagggccuggugugugaaugaugagcucugucuuugagcuucagccaucucccuacugugauucuuuuuuuuuuuuuuuuuuuuuuuuuugguuuuuugagacaggguuucucuuuauagcccuggcuguccuggaacucacucuguagaccaagcuggucucgaacucagaaauccaccugccucugccucccgagugcugggauuaaaggcgugugcuaccacgcccggcuccccgacugugguucuuauugguauaagaguaacaugcugugcagcacaucgccaucccugccuucaggcacauacugcccaccauguacugccugggggcuggcugaggacugcaugauggcacacugaccuugacuuuggugucuuugcacuuccugcaucccugcuggcuccuuucccaucagcuccaccucccaacaugguaaaggucaucaggcgguucaggcugaagcacuuaguccuacauuguuauuucugauuauauaacugggauuuucuuuuguaggaaguuuuagcccuuccuucgauugaggaggcugccuuguacccuuucacuaagggcagcuguaaauggcagcuuuguacugccugggugcucucuuuuuugcugaccuacaguuuaauuuccaaugucuagacuugauagucugaauuuaaacacaagacauaaacagagucaucuggaacucauuuuuccccacacuaaacacuucuuucagauacuagugugcaggagacuccuuccucuaaccacaccuccagaugaaaaucauuuaauuaacugagaaagguuuagcuuaauugcucuccuaaacaaucacgcauaccggguugguuuagguuuccaguggccggagggugguaaaucgcagauucaugcuuagggaacuccuacagggucuuuuugcucaaagaugugguugcuccagccugcccuuucucagucucacaggccaguugguucuggguguguggccuugcuaauugcuuguggcuuuccugucuggugacaaagacugagcuggaccucuucugggaaugugccacaaaccggauguaagcacccgauauccggcuccccucaguuuguugcuaugugucugcucugcauucaaauaaaacauuacagucgauauaaauaagcuguuuaugcaguuaugugugucaugcaaauaccuuggaucacuuaggcuuuggugcugagcucugccugcuugcuaaagcccgaggcagaaggaugcaggaggcacugggugauggaggaguuuguaccaggaggugcaagucuacagaacuacucucagaccagaguuggaagcuccaaacuuugacuccggaggugaugaaacccagauggcuuccccagcuggcacacuuuacacacuccacucucaacaagucaacuuuuuaucuucuaguccagaaauuggguuuaaggggaguuugggagagggaaugugaauaugaguagaagccccgcucacuugccaaucagauaguuccagccccaaauagucuucuaauuaggaaugaaaucagacgggugggucugcgcagaggcagguacgccacugcguuagaauuuguugcauuuuagcaguaaaacaggguuccuuuucuuuuaucaccgggguaauuaggaucuccgugacaucuacaagacacucuuccuuuuccaacuccuagcuaaacuguacugucuucauauaaagugacucuguaaaugucuacaccagcuccuaaugcagcagaacuuuuacagagucuaagaguuuacuaguugaaagccuauucaugcugaaauaaauuacugaauccuccugcacucucuccucccaucccagacuuuaauuauaaagccacaaucacaccagauaguaaaccuuaaauauuuuaacauuuccccagcaggagacagcagcacauaaaccagcaggcaguuauauggagagauuuauuucuuacugacccaggaagccaugccucagugccucaagaagaugcuguugugccccgcccucuccgagggugcuaaugaaugagcacaaauaccuacagcgaguuaaguacucuuggugggacagaugacagagggcaucagacagugaagauuuuaaaguuaggucugucgggugcucagggauguuuguguguaaauuuggaguugagcuccgacaggucugagguuuuuaugucgugcaguccucuugguugugaaaauucacuuauuccagucugugucuauuuagaagcacuggaaguuuagggcaagcucucacaagauuuaccgcugcacuguuggguagaaaaugauuugcagaggggauaucgcugcaguucauuaggucagagcgcuugcugccaaggcugaggaugaccugaguccgauccuuaggacccacaaaggaaggaaagaaccaaguccccaaaguuguccucugaucucuaccgaggcacacccacacuaaaugagcgaauacaaugucauucguaaagcaugacuuuugaaaaaugauguaaaacaugaaaagacaguuuuuggguguuuauguccagguuguugagaagguaauuguaaauggcucuucugagcuggagagauggcucagugguugagaguaugcugugcuugcugaguucaguucucuaucaccacugggagacucacagcugccuuuaucuccaggagaucugaugcccuccccuggccucugcagaaacugcauucacaugcacaaacccauagacauacacauacauaauuaaaauaaauccauaaaugauagauagauacuuaaagccucucaguuguuaaaauucaacauuuuaggacauccacagucaacuuuuuaaaauuaacccauuuauaauugugaugcuggagaauacaagcccugccuuucaguaguccaguuugaaugacuguuuguaccugggauaaauugaacugaguuaucuuuagaaauucacaauguaucauguguucauaggaauguccauucagcaauccaaauuccuuuccugccauugggaucaaaccaccugauacagccuaugccaccgggggauuauucguuuuggcucacaguuuagggguucagugcaucauaaagaggaagguggcagugguccaucagugcauacaugugcguguaugcauauggugcugggggcaaaaccagaaccuuagauauucaaggcaugcuaucuaugagagggagcugggagggggaggagcggaaccuggggaaguagcagguuucucuagggacucucaggagaugcuugucagggguggugggagaaaugcucagggcuuccugaacaucuguauacccagaguaucgugaaugugguguuucaguguuuaaugucagcuugguccuucuggcuaguuaguuacagaguucuauuuaggguacuggaacaaaaugcaugaggcugugcuuacacacagcagaaccgagaagggucagguaauggcaucguuacaacugccuuggcacccaaagcuggggucaaagcuccccaaugucuucauggauuugaugggcuguuucuuuagacugggagcauccaugcuaaguuuaacucugagccauuuguuuuaugccagcaguuucaguaaagcaagguaccauguggacuggcuucuuaugagucuuguucuugugugcucccuuauucuggaugacuuaaaagcguggaucugagcuaaggugccaggaggacacacuucccuuccuuaaucucugaugcucuggauccagcuaggacugauaucaggaaacauuaaaaaauaugguagaauguuuucaugucucugaaauauuuucuuuaauauauauccugcccugaauuagaugaaauauaagcuuuggaagaacaaaaaacaaaacaacaacaugaucgucaugggaggcucaggguucaguggaagcaaguuggaacuagaaguuggauuagugggcccaguacaggcccugacugcaaggucacuggagaacacaacacaguagcuuuuuaguucucaaaaaaagaugguuaaagaggauagcagggacagcaugucagucugggucacagcugucugucuaccuuugaagucuucccuccugggcuauggggcagagccaacaagaaaaccucaauaaaaacaugauggucuuugaaucaacacuauuccuggagucugguaguuugcugguuucuagacuagacacuguggauacugaauaauccagguccugaaaaacacagguagaguagccuaggcacuauacaaaucaauauggaguuuccuuuacaaaacuaaagacagaauuaccauaggacagcacugaaccacuccugaguaggaaccccaaggaaucuaauuuagccuccacagagauacuggcacaucuguguuuauugcuacacuagccacagcugcuaagauaccgaaguaagcaaaaugucccucagcagauaaauggguagagaaaccgaugggaaacuucagcagcagcagaaaaaaugccuggaaccagaaauuaacauguuaagcaaaauaagccuaaugggcagauauuacauauguccucucacauguggaauguagauuucaaaugcacguguaggauaugaaaggagccugugaaggggaagaaaggggucgaaagggaagagggaacaagaaagggcguggcuguuggagaucuccuccaucagucucuggucuuugaauacuugguauccaguugguggcuguuugggggaggauuaggagguacggcuuuaauggaggaaaugucuuugggccuggccuugggguuucccaagauucacaccauuucuagugcccucuuugcuugcuguuugccuuuuaagaugugagcccucagguguucuuguuugcuuucaggcuaggcagggacucuaagccccaaauaagcuguuccuuccgcacgccagcuuggucauggcacuuuuuaucauagcagaaacccuagacaauggguaacagcaaaaaagaaagaccaaugucaugugaagcacacaaaacacacaucaacaccuauacacacuacuacaugagaaaccaagggagcguauggggaggcagccauccgaagacagggcgaagaguagggaggaucaugggaggauaaauuugaguaaauacaauggaauacaucuaugaaaaugucccagugaaguucuuuaugauauauacuagcuaaaaccauaauaauuuaauaacaauaugaucaucauuauuaauauuaauuaugagugguggaauguaguuaguauggggguaauucaauaauguagacugggaaauugcaaucuguguacauucucuggagagggguaaguacaaggcauggugacaccuagucuccagacucagggaggggaauguccagggguguucucagcuuggaucacccgagcucuaaaggauacacccuuguuacacuucuucaucccaccaacagcagaaaaacauucuggguggggagggcacaucauaugugcucuguggcuaagacuagaaaguauggccuuaugaaaacagcucacggcagcccaguuggauaagagcagaagguacacuccgagagacugauaaauuagccaagaagauaagccuuuucuguagaaccaguuguuauggcuccugguugggagagggaaagucuuugcagucucuugcaagggcagacguuauagacgacugagcccagagaggagacacaguagacaucaaguaagaugacagaggcuucaccucaggacagaggcagguggggcucugugaguuccaggccaaccuggucuacacauaauguuucagggcggccagcacuacauagcgggacccuguaucaacagaaugaagccuagaguauugaaggacagugggaacagaauuaacgccguuugacuggaagagaugaaccauagucacuucuggcaacaucauguugcuuauugaguuagcauagcaaagguaccuuguuaucucucauugaaaagagccguuugccaggcuggucuguggucaacaucuggagucuccauauucaggacacucuccccaguaugugacaagaguguaucacuguggucuacguuuauaccgaacaacugcuguucuccugggauccggaaauuagacggggcugcagaggauuaaccuucaguaaaaucucaggguacagcuagcuucacuggcuggcagccuuucuggcacguaguccagcaacuuucuggaggagugaccguucucaugguaacaucgcuggaaggggauauucauuucucgaagucuccccuccugauacccuuccguugcugacuuugcuugguguuccuccacugugaugcauuauagccaggacucuggccauaugcugggucucagacgccaucugggcaaaucacugaaaguggcugcggcuuguauuucuccagcacagucuccugcgguaguaccucucagggguuaagaacacagagggaggaguaauuacgggaugggagcaaccacauggucuacuuuaaguuuuuuggcucaugccuguauaguuauuggcuguuuguugcucauaaaauuaauuuaacuggagaacuuuguuuuuugugacauacuuucauucauucagccguuaccuggugaacugucacuggacacugggaauugguuaagccuuuuaaaggccacagugauguuuagauauaugagcugaguguucaaagaggccaucgccucacuggaaagauuuaccucugaaaagcauauagcauucauuucgaauaagaaauguuuuuauaugcagauauuuugucauugagaaauuauccaacguguuuccuuauuauggugaguagaaugugcagguauacaaauugugcuuacuucccaauuggacuucagguccacgaucaugugagcaaucugcuuccucuucuaaugcuaaaacacguuuaaaaguagcauccagaaccuguucaccucuuggcaagguccccuaaauucaguaugccucccaucuucuccugcugagccugcugaguaugucuucuugugggggggucuggucauuuccucuuguaggagugaaagggcccuugagucagagauccaccuccacacuugucagcuaaguacuccucggcugccuuuauccacuuaggcacagcgagagggggugaucuucaagcuaccccgucagcaugcugugccgcacguaagcaaugcaagcaugguuccugcugcuccguccugaugaaugggguccauuaacuaacaggguacauuuguguugcccugggaaacuaagaagaguuuuggcuugaggaugccaagaccauaaggaacaucagccagugaagacaguuuauuaagaagucaacucacgggcuggcgagauggcucagugguuaagagcgccgacugcucuuccgaagguccugaguucaaaucccagcaaccacaugguggcucacaaccacccauaaugaggucugccgcccucuucuggugugucugaagucagcuacaguuuacuuacauauaauaaauaaaucuuaaaaaaaaaaaaacacuuaaaaaaaaaaaaaaaaaagaagucaacucacuuccucauucagagguuuuuauucuagugguauggccuauuuuugccuucaugaagaaaaagagaaaagagacuuuuaguauaaguaccccaagugucuccuuuugcacaggcauaacacuacugagugauagccucucggccaaguccacucuaaauuucauggcaaauaaauagaaguggucgcaugaagccacaguaucugccuuuuugucugguuguacguguucuguuaaacaguuuuuccuacuuuggagcugaugugaaucaccucauacacauuugauuuccaaagcguacaucagcacguaauuuuuagcugguauguauguccauggcucauggcucccagcaucccaccccuguaucuuguuacagcuauuucugucucuugugucaccguugagaguuugagggcauuuaaaauguuuauuuauaaugaaggugagcacccccaugcaguggagauucaaauaggaaugaaggagaaagaaaugggugcugaauggacaucagcuagagcucacugggcuguuugcccuuucagcaacacuuagaguccuucccggauguugcuuaucugguuuagcaaguaacaggacagugcagugggucucaaguggcuggggcugggguaacugaacaauuauguccaaguguagguccaacccucuuucuacagcaugggaaaaacuagggugaaaaccuuuguccuaaguaugaugccugaaggaggaaugaccauguccgccacugaggaaucagugggaggagcccaaagaauuauuagaugauaaaacaggaaccaucugccccuuuucuuuucccuuguuugauuuuguuaaucuccaagugaucaagaaagauguucugcuauuugagcaaugccaugccauuuuuaaccauuuagcaaaaaugguaguugagauaugauuagggggaaguaaaacuuugugaaguguucgcucaugaaagcuguguagaauucuuaaaucagugguucaaaauaggacacuuacauuccacagagcuugucaaguccugcacaguucaaagcaacguuucuuuaaacuuuuuuuuuuuaaacaauguaucuggugaucucuagagugggucucuuuguuagaccugccaaauucugagaugauacuguaaguagcucguacugucuucuauuuuaauuuucauauuaauguuuaaaugccuucuguuccaacauaaauggauuuugcuuaacaaauauugcucguaauuaggcucuuaccagcuuaaacuggauccugcaagcaugcagcacauuucuucauuaguucuccuaauugaguuacagaacaugaaauauuauuaugccacaaauaauuguaucuuauuugccuuuuucuugaagcuuuucaaaagaguuuaucacauuuuaaaaugacaggaauaaguguuuuguuuuguuuuguuuuuuucccuuagcucuauucuuuagccccaagucuaagacuauuucuugcaacugcugagguggaucugcuaguauaaaauauuuacagucacuuaaauuuuauuagcucucuauuuuuaccuaagugaauggguuuuauuuucucugaugcuugucacacugacagccugucaaaugugggccaccagacuuagcaaaagaaucacacacaaaagcuccaaagcccuucuuccuuucuugccacuagugaacuuggugcucauuagugaccuggaucuggguagguaaagagauuguuaauuguggaaaacauuauuucuauaccacuuuuaauacauauaaaugguaugauuguaauuuugaaaaaaaaucuaccaucuuuauuauuuccuuaauaagcacuuuacaauucugcgcuucaugagacagguauguagaauguaagaguuuucauauggccucuuacaaacccagcugcuauauuuaguuaucauaugccacccucaggcuucugcauuuugucuuuucgaagggaaucuuccaagugguagagaaaguuuaauucucugagaagagaaaggcaggaagagaaccauucaccaaugauaaaugaaccauauauuauuucauaagguaauguauuauuugagguuccuaacugagucuggcuuccauccgucauaguuucuaucuccuguguucuuuuaaaagacgcuuuuguuggagagauuuuaggcuuacagcaggauugguagaggguauagagcuauacucuugccccauagaugcauagacucucccauuaugaugguccuccuuguagagcaucuguuacauuuguuauaaucagcaaacaaauuguuguguuccugucacucaaagucuaucuuacucugaagauucucuggguuggaaaagauggcuauugauaggcagucgcuggcuuugaugguguuguguggagccaucucacugcccuaagcauacuccgugacccaccuguucaguuuuccuuccuguggucccugaaccacagcuugccaccguuuccuugguuggcuuugguauggcaucuuucuuuucagacugccuuuuuucacuuagcaccaugcaucugcuguuccuuugugucuccucauggugucauagcucauuucuucucauugcugacugcaaugaccuugucuggauguccuggagcggucuauccauuuacuuaauggaccuuacuuaaggauuucuugaugauguucaaguuuggaccaucagggacaaugcuguuauaaacauuuaccugcaagauucuuuguagaaauuuguuuuccaccugauuuaaauagguaccgccgaauaaaguugcucucuuaugugguaaaaguauaguuaauauuuaagacaucgcuaaggaccagugagaugucucagccaacaaagaaaggcugaugugaccucauuacagucugcagagccccuuuagugacaggagaguuguuccuugauccucacauguguacuguagauaugaacauacagggauacauacaugcauuugcaugcacacgcaaacucgugcgugcacacacacacacagagucaauaaauaaauacauguaguuuuaaaaagaaaaugaaaacugccaaacugucuucugaaggcagcuccugucgcccccgcccacuccucaccaugugggguguuguccggguucuggauuuugccuguucuaaucuguauguaguagauucucaugguuguuuuaauuuucauuucgcugaugacacaugaugaagaacaucuucucgugugcuuauuugccaucuguauccguuauacauuuuuaauucaaaaccauuaaaaccguaauagguugcgagggagagacagugggagggaggaaggggaaaccucagcuaaaugaaccaucuccuaagaaacuggcuucuucucgcuguuuuugugcacauaacuguacacuucugcaccuagcuguuguggcagaguuuacaggaagaugaagaggcugagguuuaccaagagcuuagcaugcuugaacauuguguuacaugcuucgcugucuacgguuuuaaucacaaaaaccccucuggaguagaugaaguggucaucuccauuuaguaguugaagaaacugaggucggaggagccuaacagcaacagcgcugggguaaggaccugacucugaaucuggagugugugcccauagucuuuacccuuggcuguugaacuaaaugguguaaaacguacaaagauggaaguguagggaacacucugcaagaggcucaguagcacgaauagaagggaaguugguuuguuugaucgggcccaggauccuggccuugucugucuuuguuucccccuggcuuguagccugcugaacucauacuugagcaaguuuugcccugcacaucugugaagaugguggccgugaagcggccuuuauuguuuacucuaugaagccuacguaaauaaccucaccaugccaaacuuuucguuuucuugucuguaaaccugaacaccgguguuauugggaugacaaauaaaauuaacacuccacagcuauuuacugagugggugaucuucuuucuccucuccacuccugucccuccugcuccucucggagaggaaagcuaguccccuuggcaggaugaaacagugaggcaggccugagaggcaucaauuauauucuugcuaauuugcuggugucuuuuuuuucccccucaucaacuuuauugagcaauaauuuuauacaauuaaaugaaucuauuuaauuggaugaguuuugacaguuuuacacucccuugaaagcagucacagucaacacgcagcacucuuccaucucucucuucuccccuccccccacacauggaggccauuauuagggaagaagaaauguaucuggacauaagcaucaugauacuauaaaggguugguuugugcaaggaugccagcuccaugacuaggcaauguauacagcuuggauucacuaaaagaugggcuaauccuuagcagaguggaccaaugugagacgucacgauacucacaguagugugcaauuuaaagcauaaaugggucuuuaacuccauuguuauauuuuauguauccauuacccugacgugugcgcccaugugagcgugugagaauacauacauauguguacguucaugcacgcauguccugccacagcaagcaugucgagaugagacagcgacuugugaacauggccuugcucacugcauccuguaagucucagggguugaacucagugucuggcuccauggcaggugccuuacccacugaaccaucucacugguuuguguauuucuggauuauuauauaguuauauaguauuguuauauaguauuuccaguucuuaguugauucuggugaacugaaacagcggcaaagaaaauugcagaugagagaaggcaagccagugucuguggcucuucuugccaucuguccauccuuccuccaaggcccagccucucacugagcucuuauuccacuguacagugacuucaaguuuaucuaagugacaucacugucacuccugcaugcaacuucucucacuuaagugugugaucuucagucacacgcguauuguugggucuucuuucuuuuuuuguuuuguuuuguuuuuuuaguuuuucgagacagaguuucucaguguagcccuggcuguccuggaacucacucuguagaccaggcuggccucgaacucagaaauccaccugccucugccucccgagugcugggauuaaaggcgugcaccaccacugccuggcugggucuucuuucuauuacugaacauccuuccauuuugaauacauacugcauuaugucauuuuccuaugaguaguuuucucuaacauucauguacaaaucuuucuuugaauauaucuuugcguuucuuucaggggcuaaaggcuauguuguaggguacuuauauuugacauuauucuuuaaagugacuagcaagcucuucugugagguacuuuucaauuuuguggccuccuugguaccauagugguuucacugcagccuggcugcugccucaaauugucagucuauugacuggcagcauccagcuggguggguagcgcucuuucacugugauuuuucuauccuauuucucagacugguucaacuuuuuaugagcauucuaccauuuggauauuuuauuuugagucuuuuuuuuucagcuauuuugccauuuuguaugauuugucuucauaucauuggauuauaaaaaauacuuuaugcauuaauaauagggauuuuucuauugacugcuuuuguaugucagcuugacucaagcuagaguugccauagagaagaagccucaagugagggaaugccuccaugagauccagcaguaggguacuuccuccauuagugaucaaugcaggagggcccagcccauuguggguggugccaucccuggguuggugguccugaguucgauaagaagacagacugaacaagccaggggaagcaagccagugggcagcaccccuccauggcuucucuaucagcuccugugcccagguuccugcccccuuugagaguuccugucaugacuuucuccagugacgaaccaugaucuagaaguguaagcugcccaauaaacccuuuccuucccacuuucucucuucgucaugguguuuauuacagcaguagaaacccuaaugaagacaguucugcauaccuguuucuuguccuuuuguucccuuauugguacaaguugaagagagaguuguuaguuuuaaaguuuuuguuuuguaguuucuguuuuuaaagaaacacacacacacacacacacacacacacacacacgaagacaaaaaucaaaaacauaauccuagacugccagcuugcagcugcagaguugggaccuguuaguggaauagaaggccccuccaucagugccagccuacagcaacuucucaugguauccuaguggcuucuggguaucucuaaggaucuugaugauguaaccaaggccagaugccccagacgucuuugcacagcaacaucccuagucuacgucacaaugauguccuuggguuucacagcacuagcugcagagccaccugugcacaaggaucagaaucagauggccugucacauggcagacaggccuuacacuugcuguguuucagaccuguugucuggguguauggagcgcagucaucaauuuaggcuccuuuugcccucagcaccgcuuuugugcauucccuucuucaaaggagagcacaguugaguagcaaccuggugucuugccaauucagagaggcauccuugggaagucuuauccacagaaauaauuccccagugacaccagcccagcagcaacagacuucucuucagaugccgugagucuacgagcaucuugcucuucuagggucccuccuguugguccaucugucucucuuccccugccacuuguugcaucuaagaacagguuuuccucauggaauucauaguuuaucuuuuacaguuagauuuaucauccacuuugaauuaacuuuugaaacugaucugagaaacaggcuacugcuacccaguugcucucagcccccucgaugauguccuuauguaagcagacaaagagauguuccuuccuccuacugccucuccuuugaaucuuugggagccagcugacaguguuugugcaggcucacauacacauuuuggcuuccaucucuuucuaauccucucuuccucgaucuggcuuuucagugagccuuugggucaaaucauaaguguccucugucacauccacucuuucucccgucccuucccuguuuaaauuaauguggauauuuuuguuuucuuuuuacugaguucauauaaauuguaggacaagcuugcagucacugugguuagaaugcuauugaauauagaccacuuugauggagauugacauuuuaauauugaaucuucugaccuggcuaucucuucauuuggagauccaauuuaauuucucaagcaugcuugccucucauuucuacugggcaccuuguguagguuaguaaaguucaaugugccuuguacuuagucacacgacuuacagacaugaacuguuuuuuuuuuuccauguucaacuguggcaacugagagucacacagcuaacacaugccaccacuaugcuuauuccagaagccaugugguuaggcucuccauacauuugggaauuccccggucguguauuugaaaagauaauuagcaauuauugaaugcucauuucuucccucccacaaccagaauuaaaugcaugaacucucugacuugcuagcuguauccacgggugaauagauuggucuucaguuucaccaucucagacucacaguggaccugcuuguuauuagaaaaccauguuaggaugauuucugcaauacauguuaauuagaucauauuucucuugcgcgcuuguaucguuuagauaccaugaagcauuaaauaugucugaugcucucagccacacacaggaaguggcuagacuucuccagagcaggaaauaauugcacauccccaucuagugcucauaauccacccccaccuccacgcccacaccccaccauguccauccugcccugcauguuacccuucaugggagccccauggcagaaggggauuucacccgauaaacauugucuggggcucuaguuuugccuaaugguucuuuccuucucuuuuuaagagacaagaaaaacgaaugggcuguuuuauacccuuucaguccucugaucuucagagaggaauauguugaaaggcauggugcggcugcuuuauguggcaguuuauagucuaauuaaacguauuuuacgcagaucauuauggacuucauuaaagcuggacuuuucauaagaacggugaugaguaagaugaauauagaaucaucugggucuauuaaauuuugugaucauaucagaagaguccaaauuugccuuugagguuuuguuggucauuuauuuuuggauaggucuugcuucccguuuggcucuuucauuuuuuuuucccagugagcaaacaaaaugauucauagaaaggcuuguugcuuggagagagugccauugggagugugcaugguggucugugugaaagcuucugucaugggcugucuaacucguggagaguaaaauaccuacaguaauccgucaugaucgaugucgaagagagaugaaauugacauacccuuccugugauuuuauuuuuuuccccuuuugugccauguuagaaauccuuuugugaccuuaaccuuaacugcuaauuauuuccaguguugguggaagccaucuauaaaucaguauuugaaaagagaaaacgacuccuguuugucuuagcuauagaagucaacuguaaagauuugugaguaauuuuauacugcauuggacaaaggccaacuuuugugagacucccucuuccaccaucuugcaaaaagaaaguaauauuugguuguauuuaacaaaacccuucuuauuccaaagaaccugcaaaaaaugucugcauauaccgugcagccagcgcaggugcccugaauuccacaauggccuccgauguuugguuucuguuucucgugacucugugcuggguugggggucaucuucuugcaucucguggccuucacuuccuuccucagccauggcugacguugcuccaguggauagcuuucucucucucucucucucucucucucucucucucucucucucucucucccucucccucucccucucccucucccucucccucucccucucccucucccucucucucucucucucucucuuguuccugcuuugguuugagaaucuucucacugcaacaagaauaguaaccaguacaagcauccacaccaagagcuggaaggcuggguccugcaauauucacguuucuugauuuacaccuccuuucugacucccgcuggggcucacuggucucugcugucccuacuggcacuggguagcauuccucuuucucuaagaccucaccagcauuugcuccucauuguuuccuaaugggacauucugacauugguuugcauuucuccuugagugaaggcuguuuuguuguuguuuauuuuuguuuuguuuuugugauguguucauugaccauuuuaccuauugugaauugucuguugaguuuuccccugaucacacugcucucucucucucucucucucucucucucucucucucucucucucccucucccucucccucucccucucccucucccucucccucucccucucccucucccucucccccccucucucucaguguuuaauguuuugaguguguuagaugagcuucugcuaaaacuuuucccauggggcaggcuggcuuuccauccugauggcucucuccucugcugugcacgaccucuaaaauuucgcucgccaauucuucuuauuuucuggcccaucagaacacuauugagagaggcacugccaauaccuauguaugccucaucaugguuuuccugaaacucagggguuucuggguuucaagucuuuacauuaaagucuuggcugcagucugaguugauguuguauggagugagucguaagcuauuuaguuacauuccuaugacugcccagcuuugcccuuacuguuuauucaagagacauuuuucucaacgugugauuuugacccuuggcugagaaucagacaccuguagaugcauggauuuaaauaugaaccucaauccuauuccuccauuauucuugaugaaaugauuaucuucugaagccucuguauggauggccuucuccucaacuuaccugaugauuucuuagcaaauauguuguacauugagccucuuuauucucaucucugugaaguguuuguguguguguguguguuugugugugagugagagagacagagagagagagauugauugauugauugauugauugauugguuugcaucuaccuaacuggacaacagaguagagcugcuucucacacuugaagaaguuuaaaggcauauccuuuuaaucagggaaaugaagaaaggcucaagaugugggggcggaucuaagaaaggccuuugccgaacuucugaucuuauauuucaaagcaagaauacuguuuuuucucuuauggcccuaucugugauuuauaaaaggcuggcauguugguugcauuaauauguguaucucuguaauauaaagcuguuuuccuuguuauuaucauuuguagcaaugucagcuuacauugggcuuuacucaguacucauugcuuuuaucucaaaaugugcauauuuuguuuugguggaggccaguuuucaccagugagauauguaagugcuaauuaauuauuggaauuuuuacacggauuauacagugucuuacuccugccaagauuuuaugaaucauugaguaugugugaaaacaguuuccuagacuuaacucacacauuagaaaaugcucauuugagcagggcguggugauacaugccuauaauucuaggauuugggaggcuggggcugaaggaucauagcaaauucaaagcuaauugggcagcauggugaaugugaaaccauacugggaauccaugagaugccgacuuagcauuugucccucucaagaggaggaggaggaggaggaggaggaggaggaggaggaggagagcaaagaaagggaagaauaggaagagagggagggagggaggaaagcaaaggaaagucacugagugacuuucugcccauuuucccuucauacacauuggcuuaucagugaaaccuguuuagggcaggaucccagcccaguucaguugaauucuauuaaguauuuaccugugcuuucuuaguuucuuccaugaaggaagcacugacaaacuguggugagccacuacacauggucacuugauggccuccaguucucuucaugcucccgaguguauccuuacaggcuuccccuuaaaagccucagccuucuguccuugucucagucuuccaggguuucugugccaugccucaugccugcugugaucccuucauguuuuccuauucuuacacgcguuugcgaccggccaggaaagacgcaacaaaccggaaucuucugcggcaaaagcuuuauugcuuacaucuucaggagccagagagcaagagagcaagagcaagagcucuauugcuuacaucuuuaggagccagagcgcaagagagcaagagagcaagagcucuauugcuuacaucuuuaggagccagagcgcaagagagcaagagagcaagagcucuauugcuuacaucuuuaggagccagagcgcaagagagcaagagagagaaugacgaaaccccgucccuuuuaaggagaauuauccuccgccuaggacgugucacucccugauuggcugcagcccaucggccgaguugucgucacggggaaggcagagcacaugggguggagaacuacucuuggcacauaagcagauuauuuguuuaccacuuagaacacaggaugucggcgccaucuugcaacggcgaaugugagggcggcuucccacauccuauaaucccaaccaagucuacuucgcuuaagucauuacugucaccucuuauuugguuacacaccaucaacaaugauguguuuguugugguuuguugggccagaguccucagggugaggucuguacugucuuaaaaccagaguucccgggagacacaugaucaugauaguuuucuggaacuggauucucaagaauauacuuuuuugguuggaugcagaauuugacucaaccacgguagcaaccuugugaaguccaucuugucccuauuuugcugagaagaaaaugguggaccagagaguucaaacaagccacuagcacaagugaggcugggauguagaagguacugccugcauccuggacucuagcuuuacauaucccaguggaagaaaauacuuuuuggaaaauguguuauuuuauguauaauccugguaucugguguacccuauucugaccuuacuaauaaacauucccagaauuuucccuuugucacccaaacauugcuggaucaagcauucugaugcuuauaucuuuguacccugccaccuuauuuugagugaaaaggcccuaaaauacaguuuucuguucuuuaaagacuauggggauuuucucacuuauuuacuuauuuaugucguuuuauuugucucuguuuuugagacaggucuagcucucugguccaggcuguagcagaacucacaauauuccgacuuuagccucucgugugcugggauuacaggagaguaccaaguagcuguggauuuccuauuauagaagaugcuguacuuccgguauauaaggucaaaaggaagccuguugccuggcugacagcaguguugggagaggguggaaauauuuuugaggcgggcauagcuggaggaagcaggcagcugagccgucauuuuguuuuuuugugucuugcgcaugacugagaggcaguuuaauuucuaguaaaacagccuugcucaugcucaucugaauggcuauuguugcaaaugaacuuugaaauuacuucaacggauuaugcaagauucuuacuaggucucguggaauuaauuugucuauuaacuuuagaaaguuugauguuuuaggggauuaauucuuugggaauauguuuguuuauuuguucauagaguuuuucauauucuucaaugacauuuucuauuuuuuguaucauuguuagauaguuuccgucggauucaucggguucauuuuuuauaucuuaugauauauguuaacuuuuaaaaaguauuuucauuugauccuuuuaucgauuccuuguauuccaaaaaguuaaaguuuuguguaguuaucucaaaccugugaacugacuaaauucucaguaguuuaguauuuuuuuuuaaauuucauuuucaaaguauauaaucuuagcuguaaagaugcaaccuauuuauaucauuucuaaauaacucauuacaucaggcagacccuucuauauagucaucugucaaauuucuucuuuuaaugaaguggcuguaacguuuuacccuuccugugguguuugcuguugaagucuaggaggucgucuucaccauccucccuguuuacgugguuuuaccugguugauuuauuggccuaauuuguuguguuuguguucuucugggaccucauuaacucuccuuugcagcuuuagccagaaccgugagcucuucaucgaacugguccugugaaggaaggcuggaaauuagucugcaugcauucuuuccccuuaaugacccagacucuagccucucuacugaacaugagucggagcccgacucauuaguucuuuaauuccuaaaaugucugcuugguguauauugauauggacuuaaguuauuuccuguuaguuggccuaaaagucauuucaacuuucucuacgaaauaaauccaaggaacaaugguguuuuacaaaaagaacuuccuuugaucuagacaaauacacagagaaccaauucaaauuaagucugugucuaauuauguaugcaaguuucaaguuaggaaaaaaugggauauuauuuuggggacugguuuccugucuuuaaaauagaaacucuggacuaaacaaguuucaagagaaccuuacagacgucuccaagauagcagagcucaaggguaagguucccccugucuccuggacguacaaggagcccacaguguuauggguaauccuggccgugucuaauggagggugaggucagguucgcuuucaccuggagguccuggaaauucuuugugggaaucauucuguccuccacccucugcacgcaggguuuugccucuggcagaguucuaacuucagugugcaugagaaaggaaaauacuuaccauaauggcuuugggcagcugccagggaaaaaaacugguaccuccaacaaucacuuucuauuauucuuuacugcucauaugauacauuauucaucauucccaaguauguucauuauaaaugcuguuuaaucacauuuuaaagguaaacagcauuuaucaaauuaucauccagcgucuugcuccaagucagccuuauucuucgcuacaagucugugcccugagggagaacauguguguuuauuauuauuauuuuuuuuuguucugucgucuguccaaagguugagagcugcaugugugucccauugaauuauuccccauguuucagcccaucccccgcccugauacgaaaguagccgucuuacuuugcuaguguugguucugcaucaagacaauuuaaacguggguacuacuucaguuuucuuccugguccucaucgauugugucauugaaaccuuuguuguuguuuagacuguguaaguaucuuaauucacuucgugaaugcugguauuauuuauuuaacugaaugauaacaguguaagugggaucuuguuaaaaugauggcauuuugugaagacuaucaaaaauuauuaaaccuuuuuauaccuauagcccaucuuuaauacugaggauaguggauagagcugaguaauccacagauuaaauaacuuaaauguguggcuucaugcauauguuggcauguaauuauuuguauauaguuaagggugugaagaucaagcagagaggugcucuguggugcauccccuuaaucccagggcucccaaggcaaagcugagugaaucaggacuacacagugagaccuugucucaaaacuaaauccaaaacaaaaaggugugaaaaauagaaaguucccugcaugcuuuuggaaaucauguucagaaacucgggcucuuaggacguuuccuuuauuccaucaaauauauuaauuaagugucaagagaauaaucuccguucaaagaacuggaaauagccuccacaaaaccaaacacccuugguccaauagacaaaauuccagggagaauaugcggucacgagcuugagagagcaacuuucaguuucccggaguggagguggggaugggggugggagaggcaagcauggaguuaguacaggaaggcuuuuaaguacugacuuagucuugaagauauaaaggaaauuguuugccaaaagagggaggaaaggagcucuggaaacagcuuaaggcauuugugaaugauaugauguguguguguguguguguguguguguguguguguguguguguguguguguguguucacucucacucucuucuugcaggauaaggaggagauauuuuuaaccuaagaugccauccuagauggcuauuccggaguuaguucauagaguuaaguccuuacuuauggauagauaauugagcacugccuacauggacaaagauucaauuacuguugaauagucuuuugauuugaaacgucugucaacugaagccacgcaugucuugcuucagcugaaguuaggaauuuacagacugagaugagguucccucuuugaauuaaauuuaguuuaacugguacauaaacacuuagaacuaacauguuuugauauauucgucguguaauucuugauucugguuaguccuaucuaguuccccaaaugguuuuuguuuuguuuuuuuuuuuaaacuccuuauguagaccagacgggucuugcacucguagagauccaccugccucugcuuccacagugcaaguguuuaacaugucuuuauggcuaaaacuuuuuaaaaagacgaugaugaugacgacgacgacaaugguuauauguauaugagcacacuuuuaaccacugagccaucucuccaguccauggcuuaagcuauuuugcuuuguucuagcacauuguuuuccauggucacacucauguauuggcacaucaggacuucugucugccauuuuagcaguaccauggaaagugcaugaauucucaugccauucuuagucagggacuguugugucuguuugucaccccacucgccgacucuaugcccaucugucugagaccuugauucgcacggauugaggagggcccacugagccccgucucuugcauuguaucuguuugucacccgccagcucuaugcccaucuguccgagacucugauuuacacggauugaggagggcccacugagccccgucccuggcaagggaccauguuaaccguguguuuccagcuuuaguauguauauggccggagugagcggugagugguuucugaaguguggcuuuauugagaaaccuauggguuucccccaccuuggcuuuuuuucuugucuacagucauuacuucuccccucuccugagccauauuuacuaaaaggaaccucuuacagaugcccagugaugcuggagaaggcgagaagugccuugacugauuuauacaaggguuaaauaaaugcacagaagugguggguucccacucucccucucccugugcuuguggcuuuauuagaggaagacaagcggagucaggcagacaugcgagcucauccuuaccuguuggcugucacaggacucacaaugaacucuuuaaacuuuggaucuuccuuuuucuccacuguaaaacaaaagaaaucaggcuuguggcgaauguugugacaucgucacccucaaugcugcacgaguuucaguagcuguucccacgacucgucucauucuaggcuuaucaauggugauaaaagcccauuuaaauugcucagacuuuuuuguuucugauaaaaaaaaauccuuaucgucuagcucgaaugagcucugacuccuucugcauucacccuaacagaggcuguaaauucucugguucuccuccaaaaucagaaaucauggcuuuugugaugugccuugcuacucugacugaacagcucaugugcucuccuuugaggacuccuugccuagagaguacagucauugcuggcuuauuuuauggaugcuuaagcaccaccaaugcaaggcgugcuugcagaaagcacacguccacccacacccuuuuguacucuuuuuccacauaaaaauucagcucugaacaaacaagauaaccagaaguuugcuaugggagauuagaaagauguugugugcauuucaacauccaugaaauuuugucuucugaucuuucuuauucccccccccccagcccccucccaagccacagugagggaagagagaggggaacaucugagcuuuucucuuugcaggauucugaguuguuuguucccaccuaggcuucuguuugucuaccacgaguucuucaacaccuggacaucaaagguagaaaaagcccagccaucugucuugcaccuacuugccauucaugugauguuuuaugugauuuucaaacaaaauucugggcagugaauauuaagauacauuagaaucaauggcguguagccuacaaaacuuuggagaucuagagacacuuagaaacccacaaagguguguuuucaaaguauuuaaauggacaaccccuccucuugcaaauaucccuuuuuauuuuauuuuauuuuauuuuuuaaaugaaagaaaauuccauuccgucauugcgaagaguauauagcuagcuauugaucuucugaaaggagaggagccccuaggggccuggcuguacuaccucacuuccccaaccccacagcccuccaccuguuguugaggaaugugggaguugcuaccuguggugcuugaggaauauggcuagaaacuacugcucuaauccagucacuaauccacuaacuguuacagucccaagcauuggacccaauguggccaaacacugauuauugcuuucuuuagguucuagauuuuugcauuaaccuuguagauuucugccaggaaaaauaaaguauugggcuggagagaauguugggauguuuuauccgagagaggugaaacaauggaugaaccccauuccaaucucaagugggugcacguguaaagagaagaugaacagccugaacccuccugaauuccauguggucaugggaugaaggagaggugacugaugcuggggugucaaugccaaaaggcuauuguucucaaucucccuugucuuuaacucauuuguuuggagaaaauuaaaccuacuuauucacuaaaucuauuuuaauauuuguaugucgguaauauucuaguugugugugucgugcaguaaagauucccaaagagcaccccaaauggucagaaagcgucucuuuguagaugacacgacauguuugacagugggucguaggguccuagagcacaccucuuugaagcaugagcaaccuuccgguuuccuuguaggaucuucuaagguuaagugaaugguuucagcuuaacagaacccaggggacauugcauagucacagaucauguuggaccuucgccauaacuuagaaagugguacuggguuaaugauauuuugccaaaguuuggauucaacuacccuuuccuccuuguaccucuucugaugagguagcaagauacugagaacucccaggacuggugcaggccucugaauuacgauaaaagcagcauauggaaagaauggacuugccucccuuccuucacacguugcccggugaugugggaagauucuuccugcuuuaguagauucucuuuuuaccaauggguaucucugucgcuuguaaguuugugcccccacugagcugucacaggucacuucuaccuuuuuaaucucaaaggacauucuugcaaauuaacugcuugguaguauuuagugaagcaauuacuuaauugauacaccaggucucugacuuuauaucaguaucagugugagggauacaggcauagcagugauuuauggucacaugccagaggcugccucaguucaucccagaugaaguacuuacuaauaagcauugccuuuuuccucagagucuauugacuugaaccugagacaccucccacagaucauauuuugaaugcugguucccuugcuggugcuauuuugagggaccuagcugauaggucacuagccacaggagugcugugggcauagcuugcucacugauuugggccuccugugcauccuauucugccaugaugcaagcggccucuagaguacacucccauagccauggacuaagucuguccucuaggacagacucuaaaacugugagccaaaauuaaccuucuguccuuuaaguuucucccacugaguguuguggucacgauggaaaaauauauagcauggcuacuuuaacuuuguguguuggcuuugguaaauaucuguuuucuauucugaauuuuguaggcaguauaugggacuuagugggcuuacaucugaauacacacauuuacaucugaaugaagagaggaauaaauauccgucuacguaugcauaucuaugagaguaaaguacugcaaccaacaaauaacucaagcaaggaaccugggauugcuguuaccuuuuucuauuuguauuucuuagacuguaaagccaggcuaaagccucuagauugccccugucuguauuuuguccuucaccuguccgugccucuccuuaugaugucaaauacagaaccucagagggagacuuuuggauucccauuuuuuuuuuuuuuagagagagaaagucuugacuuucucuguaaauaauagauauugauaauauuuuacuuuucaucuauuucuaccuaguacaauauucacaaagguauuugcguuuuagcuugugaagacaaucacaaacuuaagcuaagagccuugauauucuggagcaaaaccccgcaggcagcauauuuaggucuggagugaaaacccugcacaucccuuggugagagcugcaggagcccuccagcugcuggugguggcaagcugccgggaaagggggauagaauuaucgaacauucuaggaguucagaccuggauaugauuugucaaugucaaugucaaaugucuuauuaacuuuuaaggucccuuguacucguguguacucauguagggaguugucuuuugagguguaggggauccuugguuucguagggauaggaacuucugcuucagccaggcacuugcuuuaucuuaugcauuguccucuuuccaugaaagacuucaccugacaggaaaguuccacucaguccuaggaggcuggguagugucccgcugagcauccugggagaguggauucaguuccagguguauuuucccucccuugaauuuauugugcuuuugcagacucuuuguucucuuucuaaauguguuauaaaaccaaaagcuauagauaguagacaaauuucaguauauugaaauaauucuaaaaaaagauugcguaauaagccccgugacaucacagccuucugggacaucacagucuucgagccuucgaguguugaccucuucccucugugagcugaaaauguaacggaaaauagcccaguagaaaaguagacugcgggaggguauguugucucugucagacaaaaacacagcucacauuucccccaaaugauucaaaucuagagcugugcacgaaggucgaagacagacuagugugaucaccagaaaccaacagagcaggagcccgcuacaguuuuugggucugaaacccaaguagaggaucaggcgcuggacuagugggagcugagacaggggaggauaggaccugugaucucggagccauggagccacuugaacaguagaaauggaaacaaucugagugggcaagaaauacccgaggccacauaccggagcucccagacacagaagccauguuauguuguccugagggucagccuccaaggaaccaggcaacaggaucuggaaguccauuuauaacaaauguacagaagaacaaagcucuacugaauucugaaguuuuacuggugggcucgguaaaggacaaaaggcuugguaguaaacugugccagagaaacaaguauuauucagaaaagguaaauugggggggggggagacagacagauagacagacagacagacagacacacacacagacacgacagaaaaacaaacaaacaaacaaaaacaaacaaaaaaaaacugggcugguggcgcaagccuuuaaucccagcacucgggaggcagacacaggcggaucucugaguuugaggccagucuggucuacaaaguaaguuccaggacagccagggcuacacagagaaacccugucucgaaaaaccaaaacagacagacagacaaacaaaacaaacaaacaaacaaaacccagagacaugacagaaacagagagagaaagauuauuucuccagcugcagauguaaaugcucuuugacucagcaguuaugcauagaugaauauuuccuauagucauuuaucaaauacacaauguggcagauguaugugguaucaaccacaccuuacuuugcaauaggaaaagcgcugagauaguaucugaaaguccaucaguacucaagcugucguaaccgcuucugggaacuguaugacacugugcaaaguugacacuaagcugcuuugauaagagugcagacauucacaugugccacauuaccaugguuacuuguguaaaaggaaagggaagaacaccuaaguguguuuucuugucaaugcaggauguaaaaaaaaccacaagaaaaguaauauugucucuggauauagaaaccacuaaaaaacgauccuccuuuuuuucuccuucuuuuuuuuuuccuucuuuccccuuuuccuuucuuuuuuugcuuuguuuccuguggccagguuucucacuguggccccagcucuccuggaacuugcuugguagaccaggcugcccuggaacucagagaucucuaccccucgagugcugggaucaaaagugugcgcagccaugccuggcucauccuuuucauucuuauuugagaaguaaaggaaaccuggcccccguuuguauccagccuuguguagcuuuacacugaaaccucuaauugagaugcuucuuggauaaugcuuucucgaaagaaaucggcaaggcuguuugcagagccagcauagugcgauggcccagguggcuucaacgugcaagcugugacccaucugcccaugcccccgcccccccaaccccauguucaucuccauccugccucuugaaucucuguguuccccaaccuucuggaaaccaguaaugcugcguauucguagauacaguuccacugcaggcccagcuaacacaguugugcguaccuaggggccugauggagcagaaugcuugucucugcuuacaaugcacacuccccuuagcuguucaugcugucucuugaauauuuauuuuuauauagagcaaguuguauaucaucaauaagcaaacauuuggacaaucugaagagcaaaguacaggaacaaaugugcacuccucaaaucugucuccucugucuuucuuuccucuucugggcaagauuugccagaaguggaagaaacugaauguggauguugcacacaauuuucaauuaaaauugcuugcaguaggaaaguaggcaaagaaaguagaugggggguggggggauaggcagccauaguugagguccccacacaugccagaucccaugaacagcagcaaacaggcucccgcagagaaauggaaacacuguuguccugugacaagagguuccaauuaaugugacucacaugcaucugucuuucaguagcucaccucaggaagcaacaaccuguccugcugcaggagucggcaaaaggcucauuuagugagugcaccaggaggcaaucugggaccugugcugaguggucaggacccuuuuccuuuccauuuaccucaggucaggaguagcagcugacagggagauguggcugucaggcuucugaggaggaggcccuucugaaaguguaugcuccucagaagcaaagguauagaagagaucaacauggcaucaacauggccagaucugggucacuaaaacaaaaguauauuuacccuguuaacaucagagugaggacuuuuguauccuacugcagaauugaugagcuuaaacaggaccaucugucaauuauguauacuggacagugaccugguagucagagagguucaagauuuauucuugaagcuagcuauuacaugauucaucguguauuuauguuggggggaauggaaggggggaggagagagagagagagagagagagagagagagagagauagguuguuaugcaugucucuguguguacagagaacagagaagggaguccuugccuuaaucuuuugagacaguguuucucacugaacuugaagcucgacuggcagccaauaagcuucaaaaauuccucagucucugcucccaacaauacuaaaguuaaagcuaugcccguggccacauccaaggugccaggaacccaaacucugauuuccaugccugugcccaagugcucuugccuuaugggccguccccucagccaccuacacacauuugaugaggaacacuggugggacccaaauuacacggcucugucaugggaaguaugguuugauucucuuucuaagucuagauuuccagaaaagccccaggcaucaaggacuucuaugaucaaguccuucuugugaagcuagagucccauuugguccaacaguaaagcuccgugggaacacagccaggcuguucacaccuucuuaaaggggaggucuugacgagugccugcuauucuguuacugccacagacugacugugagaggcaguuuuccauauauuuaauaccugcuuaaauaucauucaguuucauguaucgcuuaaucacugccgugaucuucugagauguguaguuuuaauuuccgugagugggaauaugguucuuuugagggccacacagacucccaugugguuaugagauauaauggaggaaacacucuggaccuuucaucugcuuuucuaaaaaggucacgucuuugucuugguuuuuaaaugucacucuagggaugaaauacaggcugucacacaugcuaagcagagccucacacaugcucucuacacacucugcuccucggcuacaucucuaguccugguggcaacguugugcaagacugugauguaguaccacagucagaaccuuggcauugauggagcauguccaucuccggggggucucucauguggcucucauacagcggcgcccaguuucccaccacaccacucucuccuuaguuuugaaaacuccggauccauuccaaacuauggaaaacacuucaccccccaccccuuugucuuuucuagaauggccuauaaauaaaagaaaacaaagcauguaauaguuuagcauggacuuucaccuuuagcaaaauucuguggagguuuaugccagcucuugcauugguucagucuauucuguuuguugcuaaggaguagucccugguuuggauggaccauagcuuauagcuuccuccacugaagugcacuuggguugcuucugucaggucccagagaaaccugggacaagucucccucaguacccgaggcuccugauggcacuucucacccugcccccuacccccucccccacaccucuccagccccucccccagcuucugauuccuacaguuuggccacaugcucugugcucacuccugguccucagcuccucucuuugccuacuugcccucucuugugucuucuucuccucucugcucauggccucgugcagucaggacccuuccagaugccucuggcugugcucccccacacauuuacgauaaaaccuuucuccuucaccaccucuaggagcgaucauguccucauucccagucagcucccaguuuuugccucuugaauaugaaauuucuaaacaccuuuuaagagguucuaucggagcguaagucuucuguuuuucugguguacauguucaggacuuggaggacuguagggcaguugcauauuuaguguguguugggguuuguccuuuguuccugcauugggagcuuggucccuagugugggaguugaugcaacauugaagguguguguccuagcaggagaccuugggucaguaguguaaguuaucagaagggauggugagauuccagccucugugacuuuuugagauaccugugaccuucuuccucuaccaucccagcuguugauaauccacccugggaugaugauacagccggggagggagguguccuucacuucaacucaugccucgcugugagcuacaucaugcucuuuucuucagaaaagaaaauguucucguuauuacaaggaaauagcuggagcaaacugagggcaugcggcuuggauugacccgaugaagugucuuauuaucuuuauuguucugaauuauaagugagaaagcaaaagcccacaguagucaccuugcugaaaggugagcuagcuaguaaauuguaaaacuuaagacuugaucugaguucugucugacccucugacuuugcuuguacccugucccuauuacaggacugugcuguauaauguuuucuuaugaucuuauuaaaaucacuaaaacugaggaggugaauuuguggacauagguuuuguuuugaauuuuuacucaaaaguugaaugccagggcagagaugccagacuccacgaucauaagauucccaauaguuuuaaugcauaagcaagaaaaggagccuuaugaucucgugugugggagaggcgauuggcaggaacuguuugcucaaggaagcaaggaucuuggucugagcucuccaucuuuuugaugcccaccugccuuucuuucugcauggacauccaccagggcuggugcacagccuaaugacugccagcucucaggaaggcaggugcucucagucacugcugagggugggagacagguggggauguggugggauggaaugcauaggguguucccaggaugggcugaugugggaguuguccuaggugcccaugaucugaguugggagcugcccuggugcugcugguguuuguuuguguuugugagaugugccauauuggaauugcagccuccacuuguaaucuaaagggcugcuucugggugacaucuugacaggaagcuaucaugugggagaagagggcucacucucugaccagcauuuaaucauuaauacuucaugccuggucaguagaaucugccuggacauuuguauggaaccacugacuuuguauuuauuucucucaucccccuacccccacccccacccccaccgaauaaaaggaaaagacuaguauuuagcaguuugagaaaauuccagccaacaaauuucacauuacgguggcaagauucaguguaacuuuagagcggugggauuugugcuacugcaggaaguaucccuucuguuucagagauuuuaaacaaaggcaggugguuaccacucacucugauuucugcagccuaaauauugcuucugaauuaaagugguugguuucaguuuagucucuacagacugaaaugaagcuaaggauaaaaacagcccaguuuuguguuuagggcugcaaagacuugaauucagcuucaucugccauguaacuaaccugaaguaauggucccuuccaaaggucagugcuguuuauaugguaauaauggauuuuccccccauuaacauuuaauuccauuucugaucccaauauuuauuaaacauacaaagauuccggaaguugcucagucuaagcuggugcuuuuccuuuugauugauagauaauaauuagguaauaauuguucacugcauuuuguuacgaggaugaucauguaggugaugucucugugauuuccuguggggacucuauuacagagcugacagacacuguuagacacauagauaagaaagccuggucuccgacccucguuaucuaacaaugaguuccguguacagcagguaagcccacauucaguuuuaccugggaagcagaaacuucucaccagugauuuucagguaauguucccaggaugcagcccaccuccugccggcacccauacaggcacaagcccgccugcuucuguuacaguguaucauuucuucuguuacagugugucacuucuguugcaguguaucacuucugcuucugucacaguguaucacuucugcuucugucacaguguaucacuucugcuucuguuacagugugucacuucugcuucuguuacaguguaucacuucucuucuguuacaguguaucacuucugcuucuguuacaguguaucacuucugcuucugucacaguguaucacuucugcuucuguuacagugugucacuucuucuguuacaguguaucacuucucuucuguuacaguguaucacuucuucugucacaguguaucacuucugcuucuguuacagugugucacucugcuucuguuacaguguaucacuucugcuucugucacaguguaucacuucugcuucuguuacaguguaucacuucugcuucuguuacaguguaucacuucucuucuguuacaguguaucacuucugcuucuguuacaguguaucacuucugcuucuguuacagugugucacucugcuucugucacaguguaucacuucugcuucuguuacagugugucacucugcuucuguuacagugugucacucugcuucuguuacaguguaucacuucugcuucuguuacaguguaucacuucugcuucugucacaguguaucacuucugcuucuguuacagugugucacucugcuucugucacaguguaucacuucugcuucuguuacagugugucacucugcuucuguuacaguguaucauuucugcuucuguuacagugugucacuucugcuucuguuacaguguaucacuucugcuucuguuacagugugucacuucugcuucuguuacaguguaucauuucugcuucuguuacagugugucacuucugcuucuguuacaguguaucacuucugcuucuguuacaguguaucacuucugcuucuguuacaguguaucacuucugcuucuguuacagugugucacucugcuucuguuacagugugucacucugcuucugucacaguguaucacuucugcuucuguuacagugugucacucugcuucuguuacaguguaucacuucugcuucuguuacaguguaucacuucugcuucuguuacaguguaucacuucugcuucuguuacaguguaucacuucugcuucuguuacagugugucacucugcuucuguuacaguguaucauuucugcuucuguuacagugugucacuucugcuucuguuacaguguaucauuucugcuucuguuacagugugucacucugcuucuguuacaguguaucacuucugcuucuguuacaguguaucacuucugcuucuguuacaguguaucacuucugcuucuguuacagugugucacuucugcuucuguuacaguguaucacucugcuucuguuucagugugucacuucugcuucuguuacagugugucacuucugcuucugucacaguauaucacuucugcuucuguuacaguguaucacuucugcuugggauuucacauugucugcuuuaugccacauuauucgaugacacauuucuacucacaaccacacaaaauaaauaaaauugaaagcuguagucaagaugcuugauacagguuuuaaagaccaggucauuauugauacauaguaaauaaaugauaauuugugugcggguaugaauuuguaaccuguaauacaggccuguugaucguggggcuuuguagaagcuuuucugugugguuccuuuuagauuuuagaaguaagcuagccaccgagaauaugaagguggagauuggagcaguggcuggaguccacauauguggagaaggauuagaucuuaucgcuagcagaggucgaagauguaccuaaaaaaaaccuaaaacacaaccuagccugucaguuccccgagaaaagaagaaaaacuauguauuuuuuuuuuuaguuguauguuuuggggcucuguggccaaaguguguuucuuuauauacauagaguguguguauaauuaugagacaugauuuaagugacagagucuaagaguucuuuauguggagaccaggggagggcaagagaaaggacugugcuuucuuucuuuuuuuggcaaagcaagucauucuuuuuaagagauggcucccugcagagcuccugagacauuugcaaacagcucccgaaguuauuacaaauuccauggcuuccugucaacagcaucacuaugucucuuucagguuuaaucguaaauccacucagaugacaaggggagcuucugcucuccgccacuguugagaugaggccugggccccaaucucaggauucgcugagucuuugaaaaugauuucugugguagcauugauguucaggucaugcagccagcgucuccuggguaacaggcucuuugaccuaacacaauucucucugugauucaguuaauuuggagaccagggcccucgccaucccugguuccugauuuuuauuugcagagagacauuauacauccuuauauucaacacaccuuuaaagggagggaauggagccuuuugaacgaacauguucauguuuauagugaucuauuucuuuccuacuguccccugggugagauuugucaccaguuccuuuccagauguuguuaaaaacaucuuccuuucuguugagauuauacugaauuuucucuuuuucuggaaacaguugguuugcauuauguuguguaacucugacaguauucuagaauaauuccucuauucugccuuccaugucgucuuaugacaaaaagcagaaucuuuuguggcugaaaaauagcuggcuaaaauaguuguuauaaguuugaaaucucuauuuccuuauuuuuucuccucccacgugauagugauaguauuuucagaguaguaaguucaucauuauuccuucauuuuuacuggauggccaauaucugccaacugcagacuugucucugaaacaguagauagcaguacuaaaugcaugcuaagcacuggcaaugguguggugucuguguguguguguauguuuuuacauuauccauaaggugaucugaaggagggggucugaaguuaaauaacuuacccaacaugaagagcuaggauguagagaggcauaucuaccuucuguaguguuugccugccugccugccucccucccucccucccucccucccucccucccucccucccucccucccucccuuccugccuccugccuuucuccuuguaccacaguugaaagccauggcuucacuuuugaaaggaguccaaccccagaaguugaacaauucauucucagcaucaucuuuaagaaagacgaacagaaaagaacaaacuauacagcuuuguuccuuggcaauccuaaaguaguaaugacuuaggaaaauggcauagaaugacacauuucuggagacacuguggaggggagugacagcaacucaggucauuuccagacagccagugcucucucuucagagcuuugaauuuucauccuagcaacaagguucugauucaguggagagagcuugcuaugcuaauguucuguugcccagucacugauuuuaaaugacuguagucaugcagagacccgcaaagcaauuccccagggccagggcuccuacuucuuccauaguuuucaaucaucucagcuguucuuauucuccaaggagccugaagccagucaggagcaaggucuucuugaguccgacggagaggggccugaggggagcuaagagaaugugucaguggaaaaacacagugagugguaugugucaugacugccucauucuuucuagguacuguccuuaggagaaagggcagugacagauuuucucagacuuaacauguagaugagaaauuuugggguucugaucaauagugcagcuguuucuuauugugaggguaucaugggaggggucagucuccaaucccucuuuucagggguccacuaucauaauuuggcaugucuauggccaucuuccacacacacauggagaauauuucuaccuacuuacuacuuacaacuuaaaauuguuugacuccaacauuauucaagacucacguggucaaauucaugccucgaauagcccuggauuugauucccagcagcauauaaacuggacauggugguacauccuuacggucccaggacucagaagauggaggcaaagggaacccaaggucaugaacauguucugcuauauaaauucagagauucugucauuuuuuuuuuuaaaaaauaguuucaaugucaugucuucaugcuaauaaauacugagugcucuguuuuuuaaaauguucacaugaauaguauaggagucguguugcucgaccauaauagcuaauuaacucaacucuuauuugucaggcauugugcuauuuuuuuaaaauauaaacucuuuauauacagauaagaaacuaagguucaaggacgucacuguguagggugacaccauugguauguugaacaaucaaggauguuuguuccaagaugccugucuccugaacccauguucugacccuuucaccaugcacugauucauguaacuaguuccccacagagagccauuauccucucauuucucacagcaacaaauacuucuagaaugagcaccuuugugcacagaugcuuaggaaagcgugccugugauacaugcauucuaaugcuuaagagccaaccagauuuuaugauguuuuuuagcccacauugaccugugcaaagaggucagguucguucuguggaggagcuggcgcugugcacucaguagcuaucaccuugauaauggcgauggguuuccugucauguaauuagacucauacuuguuuuuaaaagacccagaaucucugcucuuaguguucuuggugccagaaucuauguuuuaacucccagcguccuuuaaguccaagaggaucucugauuguuuaauaauuuggacgaccucuugggagucaagccugugaagaggucacagaacaguggccacaaaauaaaaaccuuacaaaggggauauugacgccucauucucagucacagcgaaaggacuguuucaauuuuccauuuuccauuucaauggguuuuaauacgcugaaaaauaaauuaaaaaaauacacaaacaaaaacuugaugugggauauuugccuauaucacucagaaagcaauagcaucauaaaaccaggguggcuuuucaucaauggaaugauuaauuacuacaccagacugcagggacggggaucaauaauauagcgauggguaaaugaaugucacgcacuccacaaaagcaucuccugguaggccccacuucugcuuuccucagagcugcauggcaggccugugcgcggggccgauggcuugguuggucugguggguaauuuucuggauguaggaaucuaagcccaugaacucucuggugagugcuguucagucuuccacugcucacccagaugcugccuugagacggccuccguggacaguagaggaccaggauucagacugugccguccgcaccacagaagaccgaauggauccuuacuuaguuaccaugguuucuugggcucgcacccagaaccucacacaugccguccugcagaccuguagccccgagucucaggaucuuuaacauguccgagcucugguuugcaccaacacacaaaagcauccuggaguucuguacccaugcacaguugcagaguuccucucuguuuccugaagaugcagaugcaggguuugcccugagguagacggaggcgcaguagcaggagcuuccagcuguggcugaugagcucgcauaguuuccucagguuaaugggucucuuucugcugucggcauccagaguugccacauguuaugcucacaaguaaaugcuguucucuuuagcuuucauuuuggccauuaaguuggcauuuaccuucauaaaccggcaaagacccgugcuggggaugcuccguaagugccgucaaggacuugcuugagaccuuagccuuggugaagaggggccuugggagccugucugaggcugucaagccuuguaaagguuacugaagcuuuuguuucuuuccccaucgaagggaacagcuccugagugccgaugacauaguucaccagcgaagcacuuucccgugaggcaagggacuggguucaauucccagugcaacaaacaaagaaaaauaaaaacaaaaccagaaaacuccaaaagcaaaaagaaagcccaaaucaacugcugggcaugguagucuguguuuauaaccucggcgcugggaauccgugcaucugggaaacagaagcuaggaagucaguuacucaaggccagccugggcuagaucacaaguuuaaagcuaaccuaggcuacaugagacccugucuuugaaacacacacacacacacacacacacacacacacacacacacacacaaagacaaauaaacaaaaauaacaguucuuuaaguguaaaauacaacccacagcguaaaugguuuuuaguggauggggaugggacaacgauuaggucugugagcuuuauaaagcagcugucugauuuguuuccuugucuauaaaguggggccgauuagaagagccucuuugucgaagguugucauuggaucaugugaguuaucacgcacagcauuuagaaugccaucccguacauuugaagcccuuaauaacucuuaaaauauuagccgcuguuguguuaaggcuacauucauuauuagcauuuuauauuuucaacagacuccuuucuuguagugaguggggaagaagacuaacacguuugaaauggaggcuuuaacauugugaacaccaagccagguuuagugcuuguggaaugggagauggaaaugaccaaauaugucaacuuuggaaaccuaaggacuggaggacuccaggucuuuaagucuccacagcucauuagagaccacuagaggucucugagugagcuucccagcuucuccuugaaaacuguacgaauuaaggaugcuguuuugccucuggucauuuuugaaagccauagcacagaagaaggggggggggacccguuugcugucagcccauaggucuaucuuacuguguguauucugcucugggcugcaugccugugccacaguggucaaaguacacgucccaccugucagaagggcaggauuauguucagauggagcuagggcaaagauguuaugagauacagcucugauuggguagaugggauccgacaaucccuugguuuuaagaauugaguauuuugaaaaugacaguaaacuauucuggcaggccaauaacaauccuauaagcaccaagauacacguugugugucgagagaaaaaugcuuugaaauccccuuucuuuuaauauaucugauacagcuugugaaauuuuucucauguugcuucgccguauuucuaagaucucaauuucaagaaagcaaagcuuuuauuuucaauacugccuuguauuauuguaaaauauuuaucuuacuuguguauacuugcgcuuauuuuaaaauuuuauuuaaccugauauggucuugaagagaauuggacagaauucuccauugauuuucuuugucacuggcauuuagcaccauaccuagaccagcuggaucggcgcacuuggcaacgugacagacacagguagaucagaggacacccuugauugagaacccaaccaagaaacuucaccauggaaagaguaguggcagcauuucucauuugacuuucugacuccgcauauauuauagaaggcuguguugccaauaaauuugcaaaucgaaccucagauuuaaaagagaagacugucauuaccucagagacauuucucuuuuuagccugucucuugucugucugucuucuucagaaguggauggagugaguggcugacaagcaggugcgcagucuugagccggcaccguuagccuuggagacuggguugugccauguaaggcauacggagcaugccuggugcaugcuggcagaucacacaacugcacucagucacuucaguaaaacacauccucagacacugucagaauacaagaccaucucagcugaaaguggugcaguaguucaggagguagagaugcuugcugccaagcccgacaaccugaguucaguccccaggacccaggugcuggaaggaguggucaguuccugcaaguagucaucugaccucuacacacacacuaucaguauagcacacaaacuacacacacacacaaacuacacacucauacacacgcacacauguacacacacagauacacacacacacaugcacacacacacauacagauacacacacaugcacacacacacauacagauacacacacagauacacacacacagauacacacacagauacacacacacagauauacacacaugcacacacacacagauauacacacaugcacacacacgcagaugcacacagaugcacacacacgcacacacacacauacagauacacacacacagauacacacacagauacacacacacagauacacacacagauacacacacaugcacacacacacagauacacacacagauguacacacacagauacacacacacagauacacacacaugcacacacacagauacacacagauacacacacacacacacacacacacacacagauacacacacaugcauauacuaugcacaggcacacacgugccccagaccacacauucaugugcaaguaaauaauaaauaucaaaaugaaucaucccaacuggagagguucugcagaugguaauugagacacccagggaaaaacagugaagcuugacugcaguggaauugcugcagggaacucagguucucuauauccauaaaauaaaaguguuuauuauaaaaaauaaaaacugggcuggagagauggcucagcaguuaagagcgcugacuguucuuccagagguccugaguucaacugucuguaaugggaucuaaugcccucuucuggugugucugaauauauuaaauaaauaaauaaauaaaucuaaaaaaaaaaaaaaccaaagaugucaggaaauuacucacaacaguuaugacaaagaguugguccuucaccacauagagaaugugaacccaucuguaagaaauggcuauguggagauagauugggaacacacacugagaaaugggaaguauucaaauucaccuauaacacucauaaugccucuuucuguuuguuuguguuuuucccccuugggggugguggugucuuauauuuacuuuguugguugguugguuugguguuuugaggacagggaucuauacccuauguagcccaggcugccuuagaaguuaugcucuuccugucccagccuccuaagugauuacagucguuaacaccaccgugggcuguucuuaaugucucuauagcuagucuauagaucauugcaugagguagagcaguuagggcuuuguguugggggucugugggagggcucuaggggaggauggguaccacaguggcucagagcugguuguuagaacugaaggagagugaggacacucccuuggucacccuggagaugagaugacuggaagauggccauagccguggcuugccauuuugggaagaaggcaguugaaugaacccugcucgcuggagaugcuaccguggacucagaguguguagcagagacccuggauuuucaugagcacacuugugcuuucuuucucugacucuuaaagacuuagguugaugaaaagcaagugugcaccuguccugacccguggccucucagugccaucuccacagaaagugcuucuugugaagucugagucacagcugaaacaguaaaaggcaaacauugagccugggaugcacugucccguaacacaagggaauaaagcaagagaaggcugugcacaaaggacgucggaggcagcuuaaagggcucccacucaccaagucuggaugauuugaguaucaaaaccaaugauacagcacugagggaaacaggaacucgugcauccagaauggucuugaauaaagggguucucaaagucugggccugaugggaaaugagaucuuugaaucaucucacgguaacuuccugggccuccaaauguuacagagggaaaacuguucagaaguugacaguucagaaggcuuguguacugcccaaacaaaagggucaaagguaacagaccaggggcaagcaugauucguaucccuccugcaccaccugagaggguagcaugagugugaaccuccucgcugcagcaacugcucuaaagaugcaucaccagaagcagccgugagcauacguggagcaaaagccgggaggagaggcaugcagagccucuccugaaagucaagguaagaagcuuugagcuggggccuuuugcucugacaaagagucacuggggagugguggauggaccuugaauagcaucuaaugacuacauuguagcaguacauauauuuuuuggcaguucugcaacuuuauuugacauucagcugguuaguucucauccacauugacugucuguagaguaugaaugugggaaaaggcguguaaguuaccagugugcagagcuuguuuggggaauccucauccucauuacguuuuucuggacaaacaugcuccaaugcgauauggaacguuccuuauucccuuggcccagauggcuuuauugagccuggugucagugcgcacaucuggaguccccaucuccuucauggcaaacuuccaaauuucucugagugcccaaggggcaugcuucuugaagcccacuccaugcaugugcuugugaaugcuaaugguguguucuugggucaccaccucguugauggcagaaaggcccuucuugccacccuucauuucaggagccaucuaaauggagacagugggaaggcuucugccaggcccagguuggaaaggacaggugugagggguuaugggaagcaauaugaaauugcuaacuccuguuuuauggugcuauuguggaacgauacuauuguguacagaaaugauguuuggagaaaagggggguagcccagugcuauagcaucugccuagcaugacaaggcccugggugcaagccggggggagggcgggggggggggagagaaagggugagagaugaaggagaggggaagagaagauauaguuugcagguuaugguauucaugguucauaaacuaauuuucacauaguucagaaaaauaaauuguaacuuuucuuuaaguuugagguucuuucuaaaugaaaacaaaaauuggguagaaccaucagcagcagucguauuguaccuugugauagcuugugugugacacauuaacacaugccaacaaccuuggcugugcauaagccgucaccuguuauucuguugugauggagcagaagcacucucguguuaagguggcauuauuagcuauacaugcuguggguucuuagcuguguacaaaaauucauaaacaaacaugacacaccccagugccacccuccucuuacugugcaaucaugaagguaagggcgcucugacuguccacaguguccccaacgauuucccaucauuucucuccagcaucuccuguuaguguaguucugcuccuguuccugcccauuguucuuccuuuuuugcuuccucucauccauccaacuaacuauucuccucacuccgaugccaucucugcaucgcugguccuuuuccauagaggaucuggcugcuucaucuucccaaggacagggcugcuucuguuuccccugucgaaacauuuucagcugugugcggcguuuuucacaguguuuucuucccuggaaccgugcugauuguuuauaggcagcauguuaaugccuuucuguuucugcaacagacagaugcuaucuguccagcauggccagcccacaaccccagcugucauaucaacagagauaguuccucggggcuccagagcuuaacuugaaaguguaguccaguuccugaagaauuaaaaguaggccugcaugauccagcaguucucuaucuggguagacgucccgaagccuugaaagcagguucaagccugucugcucaccuuuguccauagcagcguuugucacaacugaccucaugguagaagcagccugcacauccaacccaacaacagauaauacaauauauacguaaaauggaaggcagccuucagcaaggaaauucagacaggugugggcgaaccugaagguauuacacugaccgagauaaaccagcugucaaagguggguaaacgagagcugccuagaauaauccagcuuguacacacaagagagguggagugccagccacugggucagaggggaauccagcuucucacuucuaugagaggagauguuucuagagcuggaugggugguggccagaugucauugggcauggaaaguaguuauucacugaagucauuuauucacugaaggcaacauuuauuccaucuccuauggacacaguccuguucuauauucgcaaaugguggcuuuacaaaggccucuuuuauauuuuauccuauugggaaacuagagguuauuauggugagugaggcuaaaauguuaggaugugguggugucaggguaacucugaacgaguucaccuccuucauucaaucccauuuccuccagaaagcagguggugagcuuccugcuugcuggcaugccccugggucagucaaaugcugcuguucuuugcuuagaacagauugguuccuucuuguggcacaaaccugcuaaaaaucaguuccuccccugccuugaaaugccaggugacgauuuggaucuucucucugcauacucucuuuaucuucugucuauuuguuuaaaaaauccugcuaaugagauucuuuuguaaucuggauacccagaaaggccucuggaguaaaguuuuccagccuucagugugaauuugaacauuugcucuugucauggggauacaggaacugcaugcugccccucuguggugcagccugggacucugaguucuuucccucacuccacucaucugcuguguagaaugcaguuagagucccucuccagaugugugcgccagacggccucauaccuggcacaucccuuuaggcuucugauuugcccaucagccaguuagauucuauccuugcugaguuggccaggcuuguuuuguuaaauugcccuguuuuuuuuuuuuuuuuuaaacaggcccucgaauucaaaauuaaauaaauguagucuaucaaaccaauaacuguuacauuacagccuagaaaucauacaguaccugcugccacauaauaaaauuaugcaagugaauuaaaaaaaaagagcuauaagucuugaaugagagauacuuaccaugguggguuugugguaguuaaaacacacgcagaaagccuaugaaaugcaaucugucuccuuggcacauuugagacauggucuuggauucuguuuuccuuguggaaauguaauucccgugaauguccguuccucucagauacugagcgugcucuuugggauagacgagugaaaugaguguguaccaaaagauagacaguugaaauuuaaaaaauaaauuauuuuauguguguggauguuuugcccacaugagugucugugcaccacaugcauuccuggugccugcuggggacaaaaagaaggcaucagaucccccgaaaccagagucacagaugguugugaacccugaugugggugcugggaaucaaacccagguccucuggaagagaagccagugcucuuaaccacugagccaucucuccagcccccuuccccaccuuuauuauuuuuuuuuucuugaugugacccaaaagcacauuauuccuuucuggaucuuugugugccguucaccuaaaauguuccgcaggaucaggugggguucauguaugucaccucgcaugcacggggacagguggggaacagacgcggcugcagucggugaaaguaaaaacacgugcuagaucuguucuucuucuguguuugccugcagugguguuuccuuaaggaaacaggucuugccuacaacaggcgguugugugagaagggcuguguggaccaagaggguggccauuggcaaaacugcacugacgaacacugaacauuuuucuuguuuguauuugcauuuauugcacagggacacacacacacaaacacacacacacacacacacacacacuguugauagagaugauugcaugaacucuuaauguccuuaggagcuuuucuuguuggggguaagagauuggggagggaagugaggugaaaggacagauauaaaauuuccagcaucaccuaguguuuaaaucagauucuugcuucaaguccuauuauauaaacacaggggcaaacacuggggguugaggggugucaaaaucucuccuaagaaauucucucuguguuuaucauuuuaugacuucaguguaaaugggcugucaauuauagguuuuucaguguccagaaagaagaucuauggaagacaugcacugaguccugccaacacuguguguaugugucagcacuuuucuuucuagcacacuauggugcugauggcucuccgacuuguuugccuuuuugcuccagaaacaaaauagagaugucuuuuuagcuuaucauuacagauaaaaacuuagggaaguguuugggccuuuuguuaauggcuuaggucugucacccaacaagcagcugauagccagucauuuuaauugcuguuuuaguuggaaccugcaucagaagaauuuccugguaacaugcagguuccaacugcaucaggguagcucugggcgggguuuggugcugaguuuguagagugagauaaagggggacuagcagcaggaagaaaugccagcagauaauaaacaagugcacagacuuccucuggguccucugaggcauccgacuacuggcauuucugugcucugugcucgcuguguaaccucuguaugaauugaccccacugaaaaccauguagcugggugggaagcaacacacggccaaggaaaggacggagagucuuuggaguucaagcucugacacugcugcugcuuuuauggcacauggcagguccuaugugcagguccuguugaggagagcuccccacuccagaugaaccauggccugccugguccucuugauugguccccuuccuuauauugcuuuuuaaaucucuaccuacagauuuccacgauugcgcuuugaaacucaaagaagugaaagcuaaagcagaauaguaaaagaaaauguagaauuagcgugaaguuacaguugggaggcagaagguacuugaaccugauccuuagccucugguaaauucuuaagcuucauuucuguaucauaaagggagaggggcccaggucaaggcagacgagaagauguagccucuccugcugcugugggcguacacuugcgauucuacuuuuguaaaucuguccuggucuuuacagugcugauugccaucccaaaugcagggguuaacguugcugucucuggauuacguguggcuaagcggguguuggggaugacuucccuaguccuccucuggacacgugauucaagcaugugccuuggaacagaacgcuccagucuagguacuuucaacaagcuuggcuacuuccauuuuuuggaggcugagauucuaaaucaggauagucuccuuugucuggcuucuagcaugacccuugaugguuaaacucuccugguguugaugcauggaagagaucgugaggaaggaagcaagaaagaacaggccaaggccaggcuuacucauucagaaaagaucuaauugucuccugccagaccuacccaugcugaaaguccagcauuuaccucuuacuguacuggcucuuaaaggucccacauccuucagaugccaugacaucugggcaucaggggacuagccauuuccaaaucaguucggcgugucacauguccuucaaaugagagacauccucuaaucuuguauuuuaggcucacagauaaaccaugacaaacacagcucuucuuuggggauugucacugucccuucagccuauugaacccaccaugucuaaucuucagcauugaugucuguagaugacacaaagaccuaccaaugauguggcacagucacugucagaugccguccaacagcuagaucucagaggaauuacuuuaaaccuccuaaucauugaguguggauacauuucgugaaaucugagaacuauuuuaagaugaggccuuuacuuucccccaccuucuuuucuugcccccauuuggacuuucucuaucacucuauuuauucugugaauaggcaaagagaauucaguuaacuccuugccaaaaaugcacucagauuucuccugcaagcacuuauuugaauuaaaucagaguaguaguaaaugaagaggcuagacaguuuauggacuuuauuuuagucucccugacuucaguaccgggcucuuggggacauguugaucuggcugccugcuagcuuuagcagauguuuuugccuagggacaaaagccaucuucugcucuuugagcacuuugugcuggaguugagcagucccucucugaguggagacacuucugcuguguggccugcuggugagcuagggugcagggguggguggcaugggacaagaacagagaucaugcuucaaaggucccuuuuuaugucuacacaggcagaucauugccuuaguggacaggaaaacuaauucuaucauucuaauucucaggaauccagaaaaaggaccaaaacaucccaaaagagccacaugggccaucuccacugcucuuucuucagucuccccaccagauccuuacugauggucuccagagagccuuguaacacauauacacacacaagugugugugugugugugugugugugugugugagggggggggcggggagggaggaguuggaagguuuuuaauaaagaguugguaaaaccuggucaaagaggcuaagaccuaagucucuugccaacuucaaucuaacuuaaaaucuaaaaguuuuuuccacuuuauaaacaaguauuaucuguugcuuuauuacccucauauguguauauaugugugcauguauuuauagacacauauaauaaacacauuucagcauuaacuagagugccaauuaaaagcacgcagucguaaauauuuccaugacuucgagaaaagugaaaucucauaguuuauuuuaaaaugcauuaaaauugagauccuagacucuucccagaaguggaaagugcacuuuaacuauagaauaauuaugaucucuaguuucagccuguucagcaucaaaagcaacacaggcaaaccgguaaagccuuugcaugcugguguuugcccuauuaugggagcccauggguauuuauaacuucgccccgagcugugugcucauugagaaggacacugugugaaaccgcuuugaacauggucuccuugcacagcgcaagguuauucacuucuguggcuuuucugugaguucugcuacguuaguuacaggcaacauccacugugcguggccugcauggggcccuggcauugcccagcaacuuuguuuuccuugguguucagccagaaguaggaaaccaggagacuuaaugacuugcccaaagucacgcuaccagcagcccgagucucuaugaucuuuaaucaguucagaauguggcaccugagaagguccugugggauuugcccucugcuggccuaaacagaauuaacccuuuggguuacaguuugcuugagugggaguguggggagagagacacucuuaaaaauaaaaucaauuccuuguauagauuauucaucagugucccuauauuuuaaucugauucuuuugggguuaggucccugguauauuucuuaucauccuccuccugccucaauguuuaucucccuuucuugcccuuuuaggugaaacccagagcacaucuuuggguaucuuggagguaggaggaucuuuauugcucccaucuguauguacucccuucccuuacuuugaaacucguugaguuuuggucaacuauccagauuuuuuuccaccguagucugguuauuaaaauuagccuauuuuaguuuaaaguuucagucuugaaucucacucaggucuugcugacucccaguaggcuuuggggucugucucacucucucucugugcuaauuuguucuaguaccugugcugugguggguccagaagaaauaccacccagggcagugccauuuuuuucuuccugaggaaggugacacuuggucaucugcucagauacccucccuggagcaaacgacauguugucucagcacaugccugugugugugugauuuggggguccauauuccccucucugacucccauuauccgaccacuguacauugauaggacauaggcgcguugacuuuggcuccaggggccauccuuggaguuuaggguucaggcuucagcaaaaugacugaagcccagcuuccuucuuuggugugcguguacauuuaugacaaaucagaguguccuccaucccagaccacugcugcucuguccaguuuucaguucucacucccuccucggguggcaucagaaggcuggccacucaagaacauggcugaccauggaaugugccccagauguucuggguaauucugggaaugggaaacccuuuuccuccagggaacuuuuagguuguauguuuuguuuuaauuucauuuuguguuuguuauuugaugaucaugguucugggaaccaaacucauccuugcccuugcuacccaaacucuccaccauugagagccuguuuuaauuuuuuaaacacucuccccauguuacccaggcuggcuguaauaucauucaguggcccagccaggccuuaagucuccucaguagcuggaaucacagcugcaaucauggccccaucuucucaucucaccuugaacuucuaaaacuccacaagcccuuuaagcuccugcuguuuauagagugagcaggagcaguguggucuugggaaaugguggcugcauucugcucagcuagccugugaaguggagagaggaguggggguggggggcuuggggagucucggccuucauugcuggagcuacacuaacacucucuuuaguauaugggggcuaucacguccuuccucagcucugguuccuuagaggagauugcucugagcagaguguaacuaugaaagcaagauggaaagcaaaaaacguuacaacaagaucaagaaaggaccacguucgugaccucuggccuccuccagcugcaguucucucugcguuugaacuucacaguguuauugcuuuugugucucagagaccccucauuccuucaucuuguucgcagucagaucaccaauagcugugcccugcguguucauuguauuagggauguuggcaaaacuagcacaguucuguggucugcacugagagcuacugagacgggcaggcuucuguugucugugcaacuucugcgcucagugggucaaaagacaggguuuugcugugcgagaggucgggguucgagagauggggcucggcauuugucaucuguuuaaagguugcucaaugcaagcaccaggaagacuuuggcugaauccagucuccuuuugguuuauuguguuuuacucucccagggauaaaaagaacccagggcuuuccguguguuccacaagcacuuugucacacaacuguacccauggauucuuuugaaaauaaccuuaagaguagucagaauuauacaugguuuguguaucacagcccacuuucuguacauauuuccucaauuuaugggagaaaggcgggucuuucucggucucucucucucucucucucucucucucucucucucucucucucucacacacacacacacacacacacacacacucauaaacuauguaacaucuuuguaugccaggccuccaccacacauccuuucaccugugcagucaguguucauuguuuucuguuugagaaggacuagcaguaaguaaacgggccauuaggguguauuguuuuguuuccuuguaauauccuuucgacucugccuccuccuuuuguccuccagccuggccuggugacugcuggcuuucagcaugcuggaggacuggaacuccccaaggcugcauucaucuccucgaguucacauuaucuugucuuugcuuccguggcagccucuguauggagauggagugcugucuccuguagaugagcaaaccagagcuuaaggaaguugucuaaaucuugacagggagugagcugaggaauuaggauugcaaaucaaguccaggucgugaugaugaaauugcuccaccauaugccgaccgcuucucagccuccagagcuguuuugguuaccguaaggaaaagcugugcuguguaucuugguucuuggggcaaugagaauaguuuauggucuuucuguuggacuaucaguugacaaaaagauaggaggaguuuauauuuguuaaacaucucccucuuuuuuccuccccuccccgccccccagcccucccuuucuuuuccuuuucugacaggguuuuacuauacagcccagacuagccucaaacccugaguucuccugucucaguuuccugagugcuaggcuaggguugcaguuauacccccaacacgccuggccuuuauuuauguugcuguggcuucuauuuauuaaauaaaugauauuaucgcuuuuguuuuguuucugguagcaccuguaccgcgugggccucccagggaaacaguauuuccuuucacuguaucuuaugguccccccuccccccacacacacacacagauccacacaucuuaccaguuggcccauccacagcucaaccaggccucaaccuuacauagccuucagggugaccucugauucucagggcuccugagagcagagcaucccacagcaugaggaagcccgagagcccgaaugcguuacuuuguuuaaauucuugccuugaaguuccuuuagugaaggagccagauuggcaauccuacgagaaacaguuguguuucuuaguuacgcuguaauggagggacuauaauucauggccauuaaauugcuuccuuugaaguauaagaaaaaccagaacaacauuuacgguccuuuaacccacaggauuacaguacacaugaauuaaagucaaauguguuaugaacucuccugguacuguggcuggcaggacuccauccgcaccccucacucauuaacugguugacuuucaaguagaaacugggcuggcggauggguugagagucaggauuucagaaggguuuccccuucucucaguuagaagcaaggaauguaacucuggcagcucaacuaaaaauugagacuuguuacuucucugagagaucuguucagaaggcagcagaaaggaaaugaacuuguagcauucccucugcugauaggauaccuugucucaugaaauccucgcaccacacccaucucacacacaggcaugagacuaacaagucugugguucuggauuccaguucagaccuaagccaaacagaguaugaacuuuagcaccccccacccuguuuugcuccccagaaucaguaacagaagacacagaaauacugaugacacauuugggacccauguuuuauauggccucaaacucagaaauccgccugccucugccuccugaguacugggauuaaaggagugcgccaccacgccuggcuuacacugucgucguauuucuuauuggggaguuucaugcggaaauugugggugguaaaaagccgcagaaaauggauauuaggaccuaguuagugacuauaucugagauagcuauaccucacguguaugcuaagccuguguuauugucuuaugacuuuuuucacugaaugucucgauaaggagccaacacaaaaggguaacuauggaaugguguugaagucagacuguagcuaugccucccuugucuugagaaguaaccuauaagacaucaagaucugugagcauguuuauugauaagagcguucugucacccuaacuuagugccuggagucuuuucaauguggguuugauccuguaugguucugaagaggucauuaaaaaauaauaauuccaccacuccacuagauggcacuguggucgcauagauacacuagaugccccacuguggcuccugagaguggguaagagcauccuguugggaugcccugaagccuaauggagugagaacugguauguuuugcccaucuaucccagcaccuccuugugucuacauaucuucacucgacaacauaucuuugaccuuuacagucuucuucuaaagcccacccaccagucuucucuaccaaugagcuuccucuucucuucacaccucauuuuucuuuguugaaucuacagcacacucacauugcaaagugcaucaccaagaugucuguguguggacccugcagugggagcaggugggaggagacuccaaaaacauggucuuccugcccaguagacuggaaucucucuucacaccugauguagcaagcuuuuuccugcuuaauuuuguagagaacucagugcugucccauuaaugcuuuagaaauucaguccucaaaaggauagagacacucucucugcagguuagcuucugaauguuugagauguuggagauaucauacagagcucccgugguaucuucucaggaccaucuacaaccacagcaggaugggggaggggggcugccagagacugucuaaaucuuuucuuuuaaagcaaggagauaggguugcagaggaugccaggucucuucccuguauaacagcgcucugggcuaaguugcugccagcuccuuagaaagagagccguccagugcagaggcaggaccgaucuggggauauuaguuauuggggagggggaucuacagaucuaaagauuacagaacugcagacgcgaccucugccugacucucauugguaguucaaaagcgggaucauggaagacauuuaaggcauuuucaguccccccuugcaaugcauuagucaucgcuguggagauuuauccucguuucugucuucaaaccgcagcuuucagggccaggaucaugauacaaaagaggcaugcuucuucaacucgggaaagggcgauuaacauuuaaaaacuccccagcuccuugucccaauaacgaaguuggacacugccucuuccauggcaccuagagcugggagaaacuugcaaaacacaaccagucuggaagguugaagauggguuggcaagaagaguagauucuuaugggaaccaaaguuguggguaggcaggcauguugggacuugccugguguuauuuuuucuucuuggcgcauuucaucuucuauugacagaaagcuuccucuguagcagugcuucuugggaugucgcucagcucacacugcugaguccagagagguucaggugaauaaguuggaauucuguguuuggaacugacccgacccuaacaaugguucuguggcggccucacauggcaucaucucuguucccucugucagaugaacaggacacuagaccuuucuuuccucagacugggcugugaauauguugccgaguaucacagggagucagaaaacugaccucuucuuggcuaggaugcagugaagcaguggccugcaccucccggcuaugugcaguaugcaugcuaccaucucguuucccagcucucuguguauugcaagcucagugagaggauuuaagaagcacucauugauacuaugugauaccaagcacgcccuuugaugaccugcaguuuaccugucaagacaaacuuagugauuuaucaaccaucagcgugauacucucaggcaaugugccugagaucucuguuaucuugguuagugaauagccuagacaugaaauuccuuaauuuggcuguguugauaaauaaaugguuuauuguuuagggugggguacaccucuuucccccucucccccaagaaggucuuuaaaguuugggaauauucaugucaucuuugagugggacccucugggauguaguagggaaaaauggaaggugagaauccugacaccaccaccacacacacacacagggacacacagacacugggggagagcuaggcaagaaugacuucagucuuugucuucacuuccugcuuccaaauuucuuaucugcucucuuucuuucuuccuuccucccucccuuuuuccuuccuuccuuccuuccuuccuuccuuccuuccuucuuucccuuuccuucccuuucauccucuccccucuccuccccuccccuucucuccccucuuuuucccuucuucccuccccucuccuccccucuuccuucccuccccuccucuccccuccccuccccuucugucccuuucccuaccuaccuucuuucuuccuuucuccuuucccaccccuccccuccuuccccuuccuucccaacuuccucuuccuccccucuucuccccucccucccuucuuucuuccuuucuuccucuauucccuccucucccccucccucccucccuucuuccuuccucccuuucuuuuuuucuucuuuuucuucccuaucuacuccaucucuucuucuucugggaagaauagaaaagaauugacuuauuggugucccaucugccuggcuugaggguaugaaacaggguggagcauaaggaacuaagcgacuguuuguguacgccugucugcagccuggcagucacaaugccuccauugacagggcagauaccaagauuuacguaucuuaaucauuaucaagaauucuuguucugaggaauuaggcaagaacaugucuucagucagcaauugugaagugccaacuaggagucaggagcagucgcaccuucugccugugacuuucacaccuaucuucugagguagcaguguuaaucccguuuaagagcagagggaucaggacacaggccuuuaggacaacccacuggcucauuaccuagugucuugcagaguuaauaaaugcucucugaauggagaaauaagcaaaauuagugaucaagucaggcuuuaaaaucagaucuuauagccucagacccagcuuuuuuuuuuuuuuuuuuuuuuuuuuuuuaccucauugcuucucuauaagagauuugggugaaccuaaaagacccguugugcucuuuacuguucccuguacaguuugcuugacuuugaagaccauguuagcuucauugacuccuucauucugugcuuuagccuguaacugcuaacucucuccuucgcgucccuccuauuuucccacagcuacagcuuccuuguuaaaucuauuacuucuggagucccagcuuccuggguauaaaucugcgauuuggucugugaucuggaugaaugacuuaaccacugcaucucucagaaucacuagccuuaagccgaagauacuaguauuacugaccacaagagcuucuuacgaaauugaugccaguagacauguaccuaaaauaggucuuugucauugugauggcugguuuuaugucaacuugacacaagcuauggucguuagagaagagggagacucaauugagacaaugccuccauaauaucagacugcauagggcauuuucuuaauuagugauugaugggggugggcccaacccauugaggguggugccauccuggggcuggugguccugauucuauaagaaagcaggcugagcaagccuguaaacagcuccccuccauggcuucugcaucagcuccugccuccaaguuccugcccugcuugaguuccuguucugacuuccuucauugaagaacagugaugaggaacuguaagccacauaaacccuuuccuccccaauuugcuuuuguucacaguguuucaucacagcaacauaacucucacuaagacaacuacuuauuuauucuuugagacuuugagacaaaaauauauucauacaauauacuuugguuuuguuuuuuucuucccccaacuuuucucagccccccccccuccacuucccuaccuacucaacuuaaaguucuuuuucucuuagaaaaaaacaaauaaacaacaaaacccuaggaguccaguuuguauuggccacccacucauaagugugggccuucuuugugaugugggugauaacccucuucagugaagaaaacugauuucccuucaccagcagcuaucaguugcagauaucguccugguucuggguaggacuucaugcccacuuccuuucccucggaugggcugggaucuugucuggccugagcuugugcagaucuugugcauguugucacggucucuguggcuucacgugcgcaucucuccuguugugucuagaaacugccguuuccuuugaagucauccgcuucugccucuuaaaaucuuucugacccaccuucuacauagguccuugagaggagggguaugaugcagauauuccaauuagagcacuucaaagucucuucuuccccacaguugaccaacugugaggcuccguguuaauuacuaccuaauacaagaagcagcuuuucugaugguggcuuagugaucacuggucuguguggguauagcaacaugccaucugggccuguuuaauuacuauguucauuuagaaauaauaggaguggauguucccuuagggucugugaucuguugagccuccgguucuugccuucagugauaaugcgagcuguguguauggguguuuugucugcauguauguauguguccacaagcaugcucggugcucauggaggccaggagaguuauuagaucccugggacuggaguuacaguuguaagcugccauguggguauugguaguugaaccuggguccucuggaagagcagccagugcucuuaaccccugagccaucucuccagcccccuacccucaaugauuuuuuucuuccuuuuuaaauuggugcuggaauggacaccuagagcuuccuguggcuaagcaaguaugguaccagugacugagaccccccauauaccaaugaaguaugccugugucuuagagucacucuuaggguucuugaguaauuucauccuuauaacuuucacaugauucucucccugauguuuugaauuuuuugcuggugguuugguggcauccaggcuguuucugauagugucugagccauuccccgugcuccucagugugcuccuccccauugcauggguuuugcaauuucuccacauccucaccaaauugauuuuuuauuuuuaaaugauagccaccuaguggugguguugugguauguccuugugguuguuucaaggugucuggauaacauauaagagcuguguccucuuaggagccaggucggucacaucgugcuuuugacugagagucagugaucuucuugccuuucccaaaggcaggugagagaugaauggaugucacuuaaacggcggcugagccuggccucagaggggccagcccgugacuccucacucuggaaucuacuuguucacagguguugcaggccuggcuccagcccagcacaacauuuucccuggaggaaugccacgcuguggauuuucuugucugcagacgcucuuguugccagaccuuacagacaggcucggggagcguucggucuggcgggccuugccagcuagugccugugcaugacccuuugguggagcgcugccagggaagccugggcgcuugcaggcacaugugggcguggcugggcacuccccgccucuuccaauuguucuuagaugggcaaggcuucucuucucagcccuuaccuuggacuuccuccugugucccaucauucagcugccugaguccccacuuccuuccuggaacugaaggugcugaccuucugcagaagggacuggaauuguucacauacacaccauuugcauggcugagaggcugggaggaagcacuugacaggcagaccucccacuucgaccugccccaguuugcaucuuggauuuccucagggaaaauggucccuccugcuauugauucacagcuaagaugagaugugauuacauaagcugaaagugcacugcuggccaagaaaugguagcucuugucagagaccuccagcagcuucucaaagaggcagccagccuucugugaugcguuaguuaccaagcaucaugggcguuugaugagugaggcuuaggaacauuuagauaaaugcuuuguuuuguuucauuucuucauguuuucuaauaauuuaauuuuucaaaguagcaauuuuaccuguguuucuuuuauaguggguuuuuuuuuuuuuaagaauuuuauuuuguuugagauaggguuucauuauauaguugaugcuggucagaaacgcacuauguugcccaggauagccuuaaacacacagcaauccuccugccucaguuuucuaagugcaugcacccauccaguuuuuaaagugucuucauguuuuuacuacucacccucacaggccgucccauuauucuaaccuaccugguguaaggggaggugacaggucaacuaagggauccauauucccagccaaggaugcaaacuugacuugcugaccaggaucuucccugccuuugaaacaagcccagagcugccugcagauguuuguaacucagaugugggaggugagugacugugugacaagaaauaagcuccaagcacuuggcuccaaaacaugucaggggaaaaaaugcccauugcagaagacagacagggaaaaaacaugcgccccaggaagcuagccgcccaugugcccucuaacagucgccuagucagaaacccgacugccaggugcucauucgcuguguguguguguguaugugugugugugcaugcgcaugcacgcgagcucugccuguguguguacauggguauguguguauuuuuuuguauauuaacauuuuuacugcucugggaguuucaugucaugcacucugaucuuaaucccuucacaguuccaugucuucccgcuugccccuaaaagaaguaaaaaauaauuuuaaaacggggaggggagaguccauuuuugugauaucuguauacuugcuggaacaucgucagauucuuaguagcaugucccuuaaauagagcugagcccuucccuccccacaccucugcccaaacccaucaauugugaagaguugcucuuuggcuuuuugacacacuuuuuuagcucaguuuuccucauuggauauucgggcaaauuuuguuguuguuguuguuuuuguuuuuguuuguuuuuuuguuuuuguuucugauguaacauauggccaugccccaguuuauaucagauaaacuuaacaguuucuuugaaguagcacugucuagucuggauaaggacaguuauaaauaccaaagagucagcagucaccuauaugagaagaaaaugaacgaguauaugguuauugccacaauacauuucuacaagcuccguggcuauuaaagccuauaaguuaucaccuucaguuucguggaccaggaauccagccuuugcuuuucugaacuaaaacucaaggugucagcacgagguucuaggggaaaugugcacgaggacccuuaccggcuucugucuaccauuguaguuccucagcucagggccucucccucugccagggcaaggcaggucaacuuagugagaaaucuggaccgcaggacauguccucucccaggggauaaaguggaauaauggacuucgaaucauagauuccucagcugugguuuggcgugcacacucccuuaguacaguucuaaguacuggugucaguaacuaagucacuucagaaaccugugcccaagguccccaugacuguaggaauagagggauguagaccuagggaagaugccucuccuaccaguuuucuaacuaaaaaacuuccaagcaagcaaacaagcaagccgaacaaauucaggagaaguaccacucugaggaaacguaggaugauguugaaaucuagaguuggaagacagauaagccauagaugucuuagugugcaucuguuuccauugagauuuuauaaccuacagcagaguaugguaggacuugagguuuggguuugguuuuuguucucuuuauuguuucuacaguaagcucugaauacuuuuagggagauuaaaaagaguaaaaaccaccuugagccccacagaccccuccacagcucaguugaacugucagucucuuagaaaaaccaaccaaccaaccaaccaaccaaccccauuugugauugaacaucuguagaagguggagagucuuucccuuuguccuuugaggaacaagggcagacacuuagagagcuauggcaaagcacuugcuauuguaucuucuuacugugucugaccuagcacgcacauagcauucccuggacaguuuauccccuggcuguucauugcaagccugcucugugucugguugcacauuagacacuggcacaagcuacucugccucccaguuugccugccaacaguagugccaagggcugggauagggacuucaagggacucacagucuaguguaggaagagaaggacaugaagaaaugcacauagaaacuggggaccaaagggagggacaggaagugcugugggguacagaggaaacugugccacagaggaggcauuugaacuaggccuuggagguaaggaacggggagggcugugugcuuuggguugaggaaacagucaucauaaguguuguaaauguucagacaggagugaauucuaaaagucacccgagaagccauggcauccaagguaggagugaccuaauggaugcaucucaccacccccaccccaccccaggggcuuagaguaacucaaauugcugucagucuuggucauacuuggucauaaagaaacaacuccaagccaucccuauuuguaauuuuaacuuuuucaaaaccuacuuuuaaugaugguucuuaaaugcuuuacccucccuuuuagcccauuacccacgagagguaguggaaaacaaaggguacacgggaaguguaccuguuuagaaaaguucuuuggagcaacucccaucugaguugucuggaaaucagcaguucaguucacagauuagcaguggcagcucaguccacucauaaacaccucauggauacaccagcaguccaguucaguagucaguuagcaacaguaguuacaugaccuagcagagacagccaggccucagccuuggcucaugucagcaggaaggagcaccaggaaaaguucuugacugugccucucucagggaagggaagaucagcgaagaugugaggcccacaagcacugcacagcgagcucucuauauaagcaagccuagcucagccuccaucacugucuuauuuauaaccuccaaauaucacauguccucuacuugccuugccugaacaagugcauccgucucagcuacaccacucugcuaaucauccugaguccagaggaagcagcaagaaacugcagcacaucaccagaaguucuuuggugcauuucuauggagucccgacaaaugcagcucaacuaugcaguguaaggcggaccaauacucgugugcuguuagcaaagaauucuucaucaaguguccuuucacauaauugcuauagcagaacaucucuucaccugugccugcuucagcuaaacauuccuucacauuucccccugcaaagcaccauuccaaagaaccuauaaguuuccacuucaccaguuaaugugaguucuuggagggaugagggggcugccaggcuuaggagacucaggaagccuacaugacucuuaugguacccucaggaggccccucugccauccaagcuucugcaaucaggucacccaggcaggagugugcagugcaguaacugggcaugaguugcccgcaguggcuugggcuuuuaagucaugcagcugccuuuggguugccaaugguccuauaagaaguccuagaaaauguguuaguuuacccacuuguaaguggguggaacccucuucuuggucucuuguuagccucucuggaaaacagacauuucuuucauucucuccugggaaaguuauacaacacaagguucuuggguuuauucuuauugggucagucuagauauccagcuuuucucucgagcuggucucuguggucagagggacacacuaacuacugauuguucuaaaccagugguucucaaccuaugaagcccuacccuuuggggguugaaugagcuuucacuggggucacauaucagauauccugcauaucagauauuuacauuauaauuuauaacagugaugaaauuacaguuaugaaguagcaaugaaaacauuuuaugguuaguggucaccauaacacaaggaaccauauucaaggguggcagcauuaggaagguugagaaccaugcucuagacucucauuauuacuauuacaguggaaagggggaccagaugauggaugguuggcauguauugauggguuucauuauagcacuuagcauggcuccauuuagcauggcugcugccauggguguggcgaugguggguaagggguugaugcuccaaagucagcugguagccucuguuucuagaaaccuggguagaugguuaacuuucaagaaaauaaaugucaccugauaugaaugaagcacucaccauuugcugaacaccuagcacacaccagccgauauuuugacguuuaccucauuaucuuugauucuuaacagcucugugauauaaauguucuuuaauaauugcuaaaccgagacucagagaacaauaauauccugugugcucugaggguaacauuucucuguauaaagaaaaggugagacaaacacucacuaccuuggaaaauaccccauguuguuuuaauuuucuucugagaaguuuccaguggaagaucacaggaacaucuggauuuuucccguuuggggggagugguggaggcauuggccuaugcugugcuuggaggcauggacacaaggugguuucaucaugaaaagugggcuguuucucacacugccaugauucaccuuaucugguguggaucugucagcauuuuccuguuuggugacaagugaugacuaaccugaaaugagguaugcucuugcacagagagccagcuugccccacgacgugucugcuggcauuuacagagaaugcacgugcgcuccccuuucucccuugacgcucaggcacguuuguaguacucacuggugccauuuaucugucagaugucuggaaggcgaggcuaagccugggggucagcuugaugagggucacacauauccuguucugagacacucagcauccugucccagugaggacacaucacugccugcugaacuguggguguuagcaggucaccuucacucagagagaacuaagacuggaaagauggaaagugugcagugagcacuucuuaggguuauaaaaccuucucugaggacaguggaaauacccaaaggcuucguguuucagcagccaacaaagguguuuaaggucuaaaaauuuugcauaguuuuguuuacaguauuacacuaguauaugugaaguuaauugauaauucuagcuaaccuauauaaaagacacacaagucagauauuuuacuuacaagcuguaacagguuuggagcuauucuaacuugcuucccagcuaugaagucccuucuuacuugcuguuucuccuggccacaugcucauucaugguccaucuccucuccuggcuuccuccccaaucucugggucuuuucuccuuuccccucuaccugcaacccccucacuugauucucaagguccacccuccucccucuaccacccaaucacaacucuagccuuguguugaccagucgaauuggggaacaagguuugcauagcaucacuugguguacaugaggaucugcuugucagcacaacgagaucuugagagccaguguuuagcacuagaugaaaagcagcaucagacuaacccacuauaaguauauaaaaucagccagguucaggaggguuauggaagcaaucuguugggcuugagcccacuacgggauaggugcauguaacagacaugcaucucaaggcugcucuuuugacuagagggucagaaaacaagugugugucuuuuagaaagcgaagcuucccuaaagccaguguuccuuaguucccuucuuccuucugaugaugaagaaaaaaaguguuagcaugggcaaauugcauucuuaaacauuuccaaguacaauucaaugucuccuuccugaauguauugaagcaaugaucuggacacuaagccuguucugaaauaaacacgcugcugguugucugaaaguuaggagaaauagagugaaaaugaaagugauucugaaauguugugugacuuuauccacccugcccgggggaugcaccuccuuguuuagaggcuuugauguaugauacgugacaugucugaagguugugacuggauagugacaggcuuagaagagcuucacuuuagcugagguugguucaagcagaguuggaggcggaaugggaccugaauccaauagucuuaggaaagaguaaaaacaaaacagaaugccgaugagggguuuuaauaaugaauaauuuuccaggaacaugguauuccauauagaguauauuuacuauauauuuuuauauaugagagaucauaauauguuuaaauaugcaauccacucaguuguagagcucagaguaugaggaagaaggcuacaauaugcaguagaaaugaaaacuuaauucaauaacaguggggggccauuuuagaauuuuucuagagaauuauuugaaauugcauggcuacucugucuacaguauagagauugaguagaugguuucuagaauaggcucagaugcagguaucauguugcauggacauugcacugguccgaaugaaaugauacugguucgcauugcagcaguggucauagaggugggaacaaagggacacauuuuagguagauguuggggugacuuggaugggauuuggggugacuuggaugggauuuggagagacgggccugugugaauaaucagagaagccuuuuuguuaguagauaauaaaggacggagagaugggugagguagaagcucaugaauucgcugugggugauuuugggcaugccugccucacagaugaacugucuaaacgugacuaguaaaugcauuggaacuuugagagaagucuggguuuaagaggcacccaggcacagacuagagguggaauacaggcaugccugagaagucucagguaaaaugcacagcaugaaaaaagaaagaaggauagagcuugaaggaaugccaacacuuuaggggguagcagacugcacacaucccuuuauaaaaagacucaagggggcuauugagaggguuaggaggcccugggguagaaagcagaugucaaacccaacagguggaagcaguguguggacaggagaaagauaccagccauugcagaaacgaugagauacagagccuucaaagcuauccauuggccuggaaaugacuagucagcaggaucauagaauguaugauauucaagaaguugguugagcuacuugaacaaggagggguucauggcaaggacagaauagguguacggugaacauccucauaagaaguugggugugugcagaaagacagggaaaggugcuguauccaucccccauaaagacaaugcggaguuuuguugcugaauuaagaugguagguagauauucaacccuguuucuguacuuagagaagggagugauucaaagggagcgacucaagaaugaagagugagaaaagauucaguauggaacauccucguaucaguagcccugggaauuuguuugagaaguaaaugauccaccucuacuucagacaaacccaucagagccucuguaaucugggcccagcaacucauguuguaguucaagauggagaacugcugagccagagcacuccccaguugugcacucugcacuagggccagcaaggcacuuccucgggagccacggucaaauagguucgugguagaugcugugagauugaaguuuacucuugauucucccaaguuuucucccuaagauuuaaagaaguucugucuacugcagggccugggauaagagccggguugcuugaauccauccaaauggauuucuaagccuauucuaggcuuagaaauaccaccaucuaggcuuccuggcugaacuacaaggauaaguuucaaguugaaacguuugucuguucuccccuucuuuccauuccuguccccguucuuucucaucaggagcaaacuguucuacuuguugaugacggauuccuugcagccaagacaguuccaucccaccucaugucugaacugucguuauccaggaguuugaaguuuuuaacaguugugauuucuuugcgccuuuauuagcugcucucgaaagguuccugagaucauauccuucagaauaagcaagaacaucggacaagcauccauccaucugcauaggagacuugcucauaugugcgagaugucauuaacgccuccacacagaaggccuccgacaaaagaaaacacgauguuguuuuuaagacaaaaagucaaaaauuaaaaaaaaaaaaaaaaaaaaaaccugcugugggugggcaucugguugcaggacucagugcuggucuuuugaucuccucagauuuuuuuuguuuguuuguuuuuguuuucaagaugccaugagaaggugcuucauugugaauucaguguuuacagcacuggccaggcuggcccucagggaaaaauggucagucugauguaauuaaucacucauuuucuuuuccugucuugauucucauugacaaaaauucauuugcagugugcauuggauacaggcacaggggacugagcgcccccccccuggggggggggggagaugguggugaaagggcucagaaaaguugucauguucugaaaacagaaguaaaggaagacaggccaucuugucucugagggaccuucugugucaagcccuucucuucuggaggcuugggggcaaaggucauguguacagcaggucaccugucuucuuggaggaucauggcuauuuaaauauucauguagggaaugauccaaggguugaaccccaaaagaaguacaggcagcugccucugagcagaccaacacuccaccgagcaccgagguagugcucauccuauggaauguuuacacuguccuuacugagaagaguuugcgagccgugugcauuucccccuaggaccuggaacgugcuauggacaugaauugaauaugaauuagguaggcuugcaaaaggauuaauuuuagaaagcacaaagccaaaauuccuugcuaauauucugauauucguuucuuugauacagcacuuaacuuacaaaccacacuugaucaucacaaucaaucagcacucagacauuuuggcuauuucauauuugauaaauggagauaaucugaugcuuuuauuuaauuauaaauaggcuguuauaacuaaaauuaaaacuuaacauugcuauuaaaguugcacuucuguauuaucuuaaaaaaaaaacuguaagagggaccaugccaggauuuuguguuuuaaacaaacaaacagucuccuaagagaagacguuacaaugugcuaugccuagggccaggcuugggggaaauggaugcuggagaauucccugaccauggcuaaggaaacaccccauggaagcaguaguuguucgggagaaagcaaaaagaaaaaaaacaaaaggagauaaauaguaucaaauucucucuuugugcagaaaguucuauuugaucauuuucaaaguuaaagguccaguccuucuuugaaucuaaccauaaacuuuaugggugcuaggacuuggaugugcuucccguacaggcgccagaggcuuuaaacuccuuuuccuuuaaacuccuguguuguccacucuacuugguuauggcagaguggguuggcuuuugucuuuaagauggagauucuuuuuuuuuuuaauguuuucacuccguaccuuguuuauaaauguuuggcuuuugccagauguuuuggguugagcugagugggggagccuucagggugagccgauuuccaaguguuuauucuacagcauuucuaauguaaauguguggcauggaaagacuuugagugcuuuugcugcauuaggucuguccugacagcuccauguuucugaauucuuauaaugauucuaucuggcuggcuguccagccugguuuucacgaagagcucccagauaguuagccaaaggacacucacacaaaacaccucaugguuugaaaaggcagagcuuugggacacugguacagcucauggggucccugccuccagccugcugcaggcucuuccauccuugaaucuuugcaccuuuuuagcugcaucuccauucuuuacuuuaaacuauauuaaacaccugcuaagcaacaggcauucuuugguugcaguggucugagccagauaggcagucuuuuguccucuucagcuuaauuuuuuuggucugaucacagcgggagggucggaacuagaaggugugggcagccuucugggagagccagaguggcaaauuuuaggcuuucugaacucugcagucuuugucacagccguucugcuauggcccugucacaaagaauagccuccaauaaagugacagugcauaccuuuaaucccagcccuugggaggcagaggcaggcagcucucuaugaguucaaaggcagccuggucuacaaaagugaguuccacgacagccaggauugaucacaaggaggaaacccugucucaaagaaaagagagagagagagagagagagagagagagagagagagagagagagagagagagagagagagagagaaagaaaagcaagacuagaugcauucaaacaggcaaggcugagaaacaauggaacuccucaaaagcaggagcuggcugguauaccccaggcuauaauccacacuuggucgugguacugucaguucaguggggcauugcacaugcaacacacuguggacuugggcuugguguccagacugucaggcaugccuccuguuggggcagggcagcuggggagagcauuucugagcauccgaugcuaucgcagaauuacuaagcacugccuuggucaucuucuccaacuguucucuccucccugggcucacuaggcuuccucacaauccgggugauggagcagcccccuccuuucuucucugugugacggguccgugagaagcagaaacagucagacccagaucuuaagcaggccugggagaaggagacacacaugugcugacucugccuuccacagaaagacuuucauuuucucuguguggccccuaccugaugcggggcacagcuggugacacugggccuugcccucacaggucucacagucacuggagucagucauugaaguaaauuccugcucggguuccccagcucuauuuggccacccagcacauauauucaguaacaauaguaggcaugaccauggccugugccuagagagggguuugcuccuuuauaauuacaauagccacauucucgauaaaacacaguccuguggaguuugccaccuuguccugaaucuuugguuucuuucuuaggaaagaaaguguuuuguuuuguuuuguuuuguuuuguuuugaggaagguagaaaagacauugagcagugauccuccuaaucucuucaguagugcuagaggaaggaagagauccugagagcagacacaggaagagggagagagggagggagggaggaagggagggagagagacuggaagcaaggggagagagcagcauggggcugagcuagaagaaauaacaaagauaacuagaaggagccauuugucucuuaucacaagagaugcugcuggaccagccugguuccaaacugaugggcugaugcucauuguagaggauuuaagacagugaagaacucuugaaguagcucucucccccuccuucccucccucccucccucccuccuucccaggcucccucaguccuuucacuuuacaaaacaaaacaaugaugaaaucuaccuacucacuccaacuuucaacucuagaaacacaaagacuaccucuagaagcuggacagucuauaagaaacuuuuguuguuguuguuauuguuggaacaugauuaaauuuuccuuggucaugauuguaggcaguugccaccucuaucaugcaaacuguuuuaagucccuuuguuccugaugggcuccauaagaggugggugaaccaugagucuugacugagaggagcuuauaaaucagaggagauaagaugaaugacaccugacaagggcuggucaaggaaucuagggugucaccaguuucugugaaugcccuucguuucuccauagcuccucauucuguccaauguucuuugggcuccugcaagagacacgugcccugguauguggacucuaaauaguguaauaacaagaguaaggucaccuucaaacagggaugcucuaucacaccugcucuacacaucacuggccaugugacuggggagggggccgaugcuucacuucugucuuuaucuauaauguggauaaugaugauugccauuagucucuugaacacagagauuaagagagaaugcacacguguguuuauaagccaagaacucugagaguuguauggucacugccuuccaguagcuuaccuucagggaaauuagcaucccaauggugaaacagggaagagucuagaguuguuuugagugaagguaaaaggaagauacagcgugaugaaggaaaggugaaagccggagucuaccucaggcugugcuuucuccagaagugguacccaaguucuugugccuugagucagcuuggcuggagaugcagaggauguuugauugguuguuggauagaggauagauguggucaagcagagccuccuaggcuuugggcagaaguuuccacuuaauuguuaauugcagagcauuaggaagccaugggggggcgugggggggugcaaacaugagugugaucuaagucauuccuucaaaaaggugauucugagaguguguugaggagaagaaauggcucaugggagacagacagugacuuuugcugaggcaaaaauaauucuaggaggcagaaauaauuaaauggauuuaagcugaaggugaauuuccagcucuucaggaggcugagacaggaggauuacuuaagccuaggaauugaaggcuagccuggauaaccuugugagacuugguuguaaauaaagaaagaagaaaaaaacacccuaauauauucaagcuacacucucauggaacaauuguuaaaauugucaaggacuggauggcaugaguuagaggaaaaaaaacgaaggcuucuggaauuuucucagguuucuuucccgagacuuugaauugauuaucugggaauggguaaggaaagaugagguuuuggguggaacuuaauuguguuacaugaaaaaugucacuagaaaaccaugcauucgcugaaagagaguuuuaggguagauaggaucagaacuuggacacuugccacgggacagauggcuuugagagacugagaagcgguugccucagaugccucaauagcgggacauuccagagccacagugucuggggguggggcauggggcuugacugaaacuguguaggcauguuagccagguauuaauaaugacaaguuuguuaaugugucagagacuaugcuacagaaugacucucaacugagacgauauucugaaauggaauuaauuugacauccagaacacuccuaugggauugauuuaagcuuuauuuuucuagacauugcauuuggaaucguauaguaagagaugggucuguggccaagucuaugaaccagaaaccggggggcagggguaggguggcuaauuuacgugaaauuacuuauguugaucaacgccauggcuaauugacacagcugucauugcacugggccuucucaugccaugggauagucuggacacacgagcagcugacugguagacauugagucuuuucacuggaaaaguguuugugugugugugugugugugugugugugugugugucugucugucugucugucugucugucugucugucugacuccccucacaaauuggcuagcuauugccuccaucccuuuuccccauccacauguacacaauaaacuauguacuuuagcccagucauauuuuccagcuguaaaaugaggaaaagcuucagcuauaagacugcuguuuggcagacaccugguuccuaguugguguuuaucaaauagcugcaaauugacuauccuguguacagcacagacaccccuaauuauacaaccucccaauuucccucucuagccgcagccacaaacuuucuucaaauaacuucacaagcauacccagaaaaaggccacaaaucucuggcuacccugacgcaguguuacguccuugaguccuugaguagggugcgggcuuuaagccguuucugccacagcuaaugauguuugucuccagagccauuccuuacuuuacuaaucuucucuuuauaguccagugggcugugaccacaggcuguucagucugugugggacgucagaugcugugcacaguaggucugaugguaguccgacuguacacaugagcucccuuggacauauugggugagcccaggaauguggacgcuggcgggcaguuaacaaccuccacugaauccuucgauguagcuggaccugcacauuuugcagguuggggauucaguaguucauugugucacugaccacugugucugucacaagaucccugugggguuuccaguagagcuucauguauaucagcuugcucauggcuucagaaacagccaagucuuuacuggaagacauugcugcuuagcccacggaggacuuuccccaccugguguggcagugaacauagaguccaaaccuaauggagccaauuugauuuccuuccugccguuugagcagcuaguggugaggacaagaagccaagcuggguuugggacuuaggaaaacauaucauaccguaacacacgguacagagucagauacauucagaucccugcaccgguccaggguguacgauuauagacagcaguucucaguagccaaggcauuaccagauuggcaucacccaagggaugggagaugcaauugucagugaccacucacgaacagagcuuggugcucaguuuugcaucaguggcugugaauccaaaucuuuuagucaguugccagguaugugaccuuagaugagauucuccgucuuccugauaguucuguuugcaaaauggugcuuauuaaaccgacuucccaaggauguuucaagcuuucucaaucagauaaguaaugggccuaccacagaacagcauuuaguuagaugaaaccugccauuauaagacaaaaccaaccccagcaaacgugcacugagugccuauuaugugcugggcccaagugaaggcacugggauuucagagauguaaaaacagcacuugccagccucggggacaguuuugaauaacacccucugcucagguguucucaggaaggauaauguagucucauuagacuccagugugcauccucugaauagcuuguguaaacuggaauuguacagagacaguuugggugucacaagguguucaaaugaaacacugacauuuuuauuuguuguuuuaauaguccuuaugauaaaugccaaccaaguaauacuuuuuagagacacuugguuuuuacacaugcucugagaggcaauaaaaccucccauuaaugcuaauagcguucugacagagugaagacgguugugugacagagaguaggcgccuugcccuccuaauguacucugaguuucaaaacagcacaaaggcaugcucuggguguuuauucaaggaucuguaugcacauuuaauagauaccauuuaucuuuagccagagaacacauauuccuggugucuuuucuccuccuagguuaguugggauuuccuuucccuuugcaagagcuguguguuauuaacuaagggaauggagcacgguccuaaguuucuguugacugauuuacaauagguugguggguggcuucggcacagaaacaguacugacaauggagucagacaaaggcccaggcccugaaccacagcugacuccaaugggaaagguccaggaugggggcugggaaucacguguccuggggcccgggagagugccauacuacguauugucauuguggaagcugugaaaugccuguguuguuaaugauggucauauucaagagaaggcacacguucuucuguggcauuuagcauuaguagcuuuagcagcacaccauaucaaccuucaaaccugcagaguuccaggcuuuagaccaaggaugcuuucucaggacaggguagcugaugcuagagccuuggaagucucacugucuuaagguagagaauauauuugguauaggcuaggggucagaaauugguggagcuaccaugaacuagugcuuagaacuagacuccuguuagugaguauacacuaauauacuccuaucaggagauacagagccagacccaacauuuacaauggaagaaagcgauggagagcccagaauuacuaaacaggauguaugaaguguguguuuuauauuuacagucuccacuugggauguagguauggcuugacccaauucauagagaagaggacugagcuucagcauggcuggguaguuuaucugagauccuaagacuaacaagggucagaguguagcucacccaugugugucaggcaucugaguaugaucugugauuguagguaauaguguuuauuuugccucacacuuccuuccugcuuuggaugauauccuuugcagcguacuguauauucuguauauuuuuaaaaauaaaauguucuacucaucauucuuucuauugaaagggagaauuuugggcuugaaggauacugucaugucaguagucugacuaagguggaagcuucaccauagacagggcaggaggaagcugcucucggaggaagaucaacuuguucagagcugugaucuaaagcuguccccacagcaguguguagacaggagcagaaaucagccaagggagaguagccugauuuguagaggcuccgagagaguggagaaguuuucaucuguuugcuuaaaaagucaggaacaugguggcagguauuuccuggguguggaauguagacuguguggggaagaacacaugaucuggggaagguaagaacaugcccuccacacuguggaucccacaagucuaguauucaccggaagcggugagucugcagugcagacacggaucacagcuuucucccaccuauagucucacgccagccauucccuugaagccagacuuauguauuugagugggaucggcuaccagugaaucucuuucugggaaugauaaaauugccuuuuacuuaaugucccaccaucaugcugcaguucuuguguugauuucuuugacuuuacuuaagaagaaauucuugggucacuccugucccaccccuaaucccagggcuccuagaaguacucccuauacagcaagcagccuaguggcuggguauggcccaacacauaucaaguuacguacguucuccacauauuaucacaggccaaccuuccuugcuucucacagacucuauacuacaaaagauuuuuagggacaguuccuugcuuucucacgugccagugcguguuugauuugucccaaaugacaugucacugucaccauggagacaccagcauuuguuuuauuugucuaggauuucauuaggaguuuucauuuacuucugcuuuucugaguuuuagagacgcaaugccuacgugucauuuuccucuguccuguuuggucuccucucuacuuugugaaucugugcuuuggugucuaacgucaguuugggggaaauucuccaucacugcugucucacguguucuuccauuuucucuccggggaucaccguugcuugugucuucugugauaguccuacagauguuagauagccuccugggucuauuccagucuuuauuccccaccauuucauuuaggaaguuccuggugucggguguucaagcuccaagauucucucccuggcucuccaguccaccgagcccaggaacaguacuuuucacccgucacgguguuuuuggaucucugucauuugcuugaucccaucuuagaauguccuguucugaucccauuccaccucgucggugcaguaguugguuuuccucgucuggggccuucgaaaugcccaagagaauaguaaaguugcuugcugccaagccugaugcccggaguuaaauaccuacaacccacaugguagaagggagaacaccucccucagguuguacuuagaccuccguguuugcacuccugaugcuccgcacaguggauuucuccuuucaucaagcuuugccauuuuguuguuguugcagagugaguaucgugcuaugcuggguagaaggaacauuacgugugcugggaagccucugguagcuugcuggucacaucaggguaaggggacauucauccagugcucugauuccauguugauuuuucagugagccuaucguccccccaccgccacccucccacccccacccccggagcugcaaacuucgaggugggucucagagucaccccuuagcugagaagauggcugaguauuccucacucuccagagcagcauuaggcucuuaggagaccauggcggauuaggccguguguagaggcagguguuguuaagaacacaguucuuggguguucuccaaaugacuuguuuuuuccugguaaacucaucugagaaccugguagaacucuuggagaugaaacuaaggaagugugucccucugcuucuuugaccuaguccucaggucuucugacucagauacuugcucacccugggccucuaacaaguucucauuuaugcugguuuuucuacccuaguacugucccguguagauugcugcucugaaaaccugcaacuaucuguccccagcuccccaucacuccugucugagggcagcaguuuguccugugaaaucaguuuguggcaagaucaaaaaaugucucccuuucuugucaccuauuugagauauccugucaugcccgagagaggcauuuaucagggcuugugguuucuuuuccucuccagauaucucuggaaguucguugaaacacagagacaaucgguuuugcaguuacugaggucaaaccuuggcucgcaguuuugcaucuucguuuucuuucacugugccacgggaccaacacgcaggcucugucucucccuccccuaacucaucuagcugcuguguugauagcagcuuggcuaggaggcuuguaacugaaaccaaagccaugugggcuuguccaguugaggaaaaauguguagguuuaaaaucaccagguggacagccccaggcagagacaccagauuugaggaggcacucagcagcugccucagucagcccccauuucauaguucuggauuugacccuagcauaaccauacuuuggguccuaucagaauacccuaaucauuucauccacagugacccugcuucaagaacaguguuagcauacacaaggagccugaagucgaaagaaauuaagccacuuggcuuaacguuucaaaugggaaaaaacaaagugacccuguggggagggaauugaacacuuggaaggugugccuacuggguggaagguguggccuaaugggcagggguguggccucugggugaguggggguguggccuaauaugaaggagguguggccuaaugucuggucacuaguucauugagugguugucccugcaaaaucuuaaagaauucuuuggaaguucucuuuuuaaugaauuaauuuugucaaucauuucuaucuaauuuuucauacauuuugaucauauuucuuuccccuuuccuaaguccucccugucucucgacccacccaauaccauuuccauucucuaucucucuuaacaauaacaaaacgaaaaaccaagaaaacaagacauaauuaaagacagaaagagaaaaaucaccaaaccaugauguuacagaaaccugauuuugaucccgccuagcucucaccgcuuccuggacccugacuucagugagagccugcaucaugccaucuagccucucagacuaaagucagcuaaacagaccuuuucuucauaauuagcuuguauuggguacuuuguuauagccacaaaaagucuacgccauuucuuuacaguguuaccaugaagagcagcuggaguacccauguaguaaacgcacgacucauucccuuguucauugauauuuuuguuuauuuauuuaucuuuaugaagccgcuuaguauauucuaggccuugcuuugagcccaagguuagggcaaugaacaaaacagaucucagcuuuccagugaacucacuugauacauauugaugcaguaaagcaugcuugggcguuucuauucauauuacucuccucuggcuccuaaaagcaccaugaaaacgcucuggacuaagccaugggacuuaauauucuucacaguacaagaagaggcuuuccauggcggaguuuacauuuuccauggcuaaucuaaacaagcagagagaagaacagugcccacauucgggguccagucuggccagcucauugaugaucuguuugcuguuucuuccuuggccaucuugaaccauagcucugggucuuacagugcugccugcgcacacucacauuuuggggugaaaaaguggaaaagaaauugggauccuauguagccgauaagauagaguacacgcuccacauauccauucuccuaaaauugaaguuaugacccagagaccuuuucugagagggcugacaggaggaaaguagaaaacucacgaaagcccuggccugaaaguguuccgggcagcaggauuaacugucagaucagcccugcugagagggagcaagagaaauguuuuugcuguaguaugugagaaugaagaaagccagggaucucuguuugcagguucucucucucucucucucucucucucucugugugugugugugugugugugugugugugugugugugugucugugccuguguguuucuguguucucucuguguauaugagggugucaguuaauuccuggggcacaaaccaugagcugcacccacagagugacuuugugauucucuuucuuucuucagauacucacaaacccuuaagccauaucuaacucugucucccucuguaguucucagagacacgugguaacauuucaucaauuugaguugaucuuggaggugaugaggcucagcggcuguuaucaucuuaggaauauaccacacagccaaccuccuccaaacacauagggugugcucuaggagagggacagauuugccaacggaaagcgcuuuguagcccuuuucucccuuaaaaaauccaaaaucaacugagaaaauuuaguacuuccucuggccacuuaaugccucugugcauucgguuugcaacacaucugcaucauuuccaagcaggaaaaaaaagauccugucauuuuagcuaaguuucugcuuucauaacagagccaagaauagcagagccauguaaaucagucauuaacugauccccugcauccaauguguggaacucaacaacuaagaguuuuuucaauaaaauagcaagcgaugacaucaucauggaccuuuaucagcaaacaaagucaaggacgccagagucuaaauguauggaucagagugggugcucccggugaguugcuuacauuuuguagguucauaccaguuuccuauuauacucagauuuugcuaguauucaucuuuuacacuuuaaguguguaccugugccuuugcaugcgcccaugcguguguugcucaguuuucuuugugaauuuuauauuucuuuguuuagagaaaggggccauuaaacaaagaaggcaguguuggugaaggcagaggacuuuggaauccaugugcccugugagaacacagugcaccaugcauggcaaacaaaacuuucccuagacuugcuuugguggcuuuagagaucauccaguugguuuuaccuccucucucccuuuauuuuagaaacagggauagauacugacugacauggagugaguuauccccccaaagucacucagucacuucagaacuugaccccacucuucugccgguaacccuguguaacuacucccauugcuuuugcacuguuggcuuacuuaaccugagaacacacuugucuuagucagaguuucuauugcugugaagagacaccaugaccacaacaacucuuauacauugggaacauuuaauuggggcuggcuuacauguucagagguuuagucaguugucaucauggcgggaagcauggugucuugcaggcagaaugguacuggagaaguagcugagagaucuauaucuugaccugcaggcagcaggaagagagagugacacugggccuggcuugagcaucugagaccuagaaagccacccucagugacacacuuccuccaagaccacaccuccaaauccugccacucccuguuaaucuaagugagccauuuucauucaaaccaccgcaacacugaaugaagcugaggaugugggacugggaagaugcgcagguccuagggcaguaccccucacccaggaugugguguccuuccugauggauuguuaucuaaccucugcuuagauaccagcuccugagauagcucacuguagcucccaaaggcauuuggauugugauuccagauccaccacccugucauaucucuuccuuucucugcccuuuucuuuggggccacugaauacccaugaucuaucagccacugugcuauacacaagaggaacaaagcaaaucaagugugggguuugccuccugggaguuggcaugguuugugaaacagacaagucagccacuguggccuagaaggacaagugcuacaggagggccugacucugacuggugguggaaagcggccuccugacagacgugaccgcugagcugaaugugggccugugagaugaacagaugaaggcugucucucacacaggaagaaggccaacaggaagggagagcaucaucucccagagagcaccauuuucagaggacauuggguguuucuuaggccuagaguaagggaaacguauggaggugaugggagggaagauagcagaaggaggcgggaguguagagggcugucguugaucagcagucugagucguguuugaugguauugucagaauguuaauuuggaggcuucagucuccugaagaugccuucagauucaaccugucuugccuugcaguguaagcagcagacaaauuuagcuucaauuucugacaccuuugcgaagccccuuugaaccuaagaacccuugucugcgaagaggaugcugugaacucuuccugacuugugcagugaagaaggaggaugcacagcagcugagggaggcccuggcugaggguucauaccagaaagauucgguuuucccagcguuccauccaaaauaaugcccaccaaaaauccauccugccucggcuguugugaccugugacauuagcucugacauuugacugagguugucuugcaacugucccuccauguuaaacaugacaguacaacucugccuucuggagugaaauaagauccgaagggaaauuuucccugagcacuuccuaagucuugagggaggauaccgccuaagucuuagcuuuucuagaugauugcggauuuuuaguagacagugcggucagaugguggggauuguugcagaagaagggaaguagacaggaaaguuggggagggguggauauuguacuugauugacauauauggaagagacagugcugcugugacagggagcuuuuguuugaagaaagguuugggccuccuuaaguauggaagcaauagcucuguuauggagagcaugcauuggucaaagcagguguaggaaaugugugucuaugaugacacgguagcucaaauuagauaggagacauuccccagggaagcuggggcuaauuccauccaggccuguuaaccaagagaggcaagggagaugugggagguggggauggugcguucaggggacuguugggaaagggaaagggggaagucaaguucuugaaauaggagggaagggaaggguaacguuaacaucaggcuuuguuuguacuguuguguuaaaauaaugcccaccuccuuguuaugcuaauuaggcauacccacggggaaacguuguaguuagagugagauggacuucugugaauaauauuugauuuuuauaggaaaaccugucucuaguugguggucuuguguuuccccauuggcuuuaauuccaucccacaguuucccgugccaguucuuugugaaggaauuggcaggugcugcgcauggacacaugucacuggauuugguauaauuugucucccuuugcagcuuuccuaaguguguuacgcuaaggaugaguuucuacuucaguaaaaugagaagucuagaccaacagcaugcugggguggugacugucuuucugaaguuugguuccgccaaagagugugcgcgugacgugucauagggauaagcaggggucccuucaugccuugcaguggguggacaguguuugaccaagcgauggcauagcgaaagacaagucacuucaggcaccacacauuaucucgggguggagucagaauccgagaugagaaggcgggacucaaaaagccagacaaucccuccauccuccucaggacaccacaggacaccugguggggggcacuggggacaggggagagaaacucaggugaaggauggagagaaucaccccaggcauugggggaagaaaaucauucuugugcaucgcaguagcugauggggcuuaaaggcaagcagacagaauuagcuccauaaaagcaauccucugcccgcuuagaucagagcagacgccaguacaucauggcuacgacuggguuuccguaucugucucggcugagauaaacaugucugucuaccucggggucuuacgugauguuguggauguuucagaugguuacuaagcaacugaccaugaguggguucuaaggagggcguagccacagugaggcaugcuuuccaucagaucucuuuaccaucuccuuuuuacaguguggaggguacuaggugauauuucagaagcacuaguaggagagggcuuuauauacccuccugguaagaaauauuggggugcuuuuuagggcuuugguuuuuauuuuuacauuugcaaaaaaaaaaaaaaagagaaaguuaguuuggacauucuuugccuuaaaugcuuucuagaucuggacacuguuuuccuuauguauuuuuuagaaggcacuugacaucaguucucucagcaccagaauuauagcuacaugcaccgucauucauggaucccaggaacaguugcuuauuuaaaaaguugugaaauaauagauaugaagccaaagcucuucaugcuaaacauauagauauucauauaaggacaugagcauaugggauacacauuauagaaaugaagagauuaauaaacuuaaaacuaagaauagugauuacuuccagaauguggaaaaggaccggauuguauggaggacaaaggauauugugugauugugucaguacuugaggcgaggagacauuucucuuccagugggcgguagguaaauggaaccuuggccuaauauaaauaucaugaugcagcauauaucucaguaugcuuauagaacauuuuuauuuuuucuuugaaugcauuucuucaagggaaauaagggucgugaccucaagguacuuagaucuuuugaauaggaaaagacauuugcacagauaaauugcacaaaguacucacaaggcaagagagucaagucuaagccacuuaauguucagugauaaagauuggcuuuuucauaauuagcuucaccucaaaggagagacucacuaggugcuggcauuaacgugcgcgugaauaaaccgugaagaagguacguggaaucauccagcaggaaccuuucuugaaugauaugaaauuuaaacuuguacaugaagaaugaguaaaauuaugggauagauacuuuguaaaagguacauuugggggcugaagagaugguuccauggguaacaguacuggcuccucuaacagaagaccugaauucaguucccagcacccacuuuuagccuccuugagcaacagacacucaauuuggugcccaaacauacaugcaggcaaacacucauugacagaaaguaaaucuuuuaaagaagcauaguuucaggagguaugaugguuuguaugugcucggcccaggaaacagcacuaucagaagguguggcccuguuggaguagguguggcucuauaggaguagguguggacuuuaagagccucaucuuagcugccuggaggucaguauucugcuagcagccuucagaugaagauguagaacuuucagcuccuccuacaccaugccugccuggaugcugccauguucccaccuugaugauaauggacugaaccucugaaccuguaagccagccccaauuaaauauuguucuuuauaagaguugccuuggucauggugucuguucacagcaguaaagcccuaacuaagacaggaggguacucugugaacaaagauaaaacaccacaugagcaugggucaugacugaaaauugacagagaggccagaccacagagaacuguagugaguguucgguucaguggaaagaugggcuacgaacagguucugcagggacuuucccaucacacccaaguauuuugucuuuaugcuguagcgcugggcagaacucauauuucucuuugaaaaacucaacccauucuuaagaaauauuuaucugguggcaguuuaaaggcuagguugggaugaauggagcuagagaaacguaaaacugcaggccagagaugaugacaagcaagagcgauagagacagucagaaagggaugcuuucaggagugacagggaugggugguggauugacagggagucugaaguaacuuccucuaccauuucuuacccuucccuguggcuauuccucacugccuccuccaucuucucuuggaugguguccugggcugguuaagggaaggaggcagcaaucacaguuaaccagcguugguaaaugcccacuugggaaggauaagaaacauuugacuaucacauacccauacuguccacccaacccauaccacacuacgcacaagggguggggggugcacaccaugcacacaaaaacacauuuagaaacuuuguaaaauuucaguaagaaugauuagagauguuuuggaauucugcugugccuuguaaauaggauuugcucgacacacuucaguauuccucacuguugacuucuaccuuugccuucugcuuagauaaaagcuccauaaaacccucucagugcauguugcugccaaugcuucauuugcucagaauauaagcagugcugggguugaggaaauaugccuuucaccagccauuaacaagagauauggguggccuccaucacggucuccugaaguucauucaguuagaccguuagugauaaugggacccuucagucaaagcucucagcguuugcucauuggcaggcuccgccuuuguuugcuucugacagccagcuuuccuguuuacugcaguuacgaugacagugagcugcacuaucgucuggcagcuccauccgucacuguauuauuauguaauuuccuguucuuguccaucuuuucucuuugcaucagcacagauguacauugacagguauccuuauggcuucuggucucauuucuucccuugauccuucucuucaugccugcuucucuuucucucuuugcucacguccccauuggucuucacauucuccuuuuuuagacuugccuucuauugauaaugcuuuggcuuauuuuuccccucaaaugggguuuccaaugaucucccaccucuagccauauuaaaauacagguuauacaaaguccuacuuacuucuguuuuauuuuugugaccccacacgucuuuuccugucauugguaccuuuuucucagaagcaguauugauucuggaccuuugcccuuuucacguugccuuugacugccgagagguuagaagccucgagucuguaaauucaccuauguuugcuguaauuaucaagccuaauucuuucuguauguucuguuuuguccagaugugagaggaaaaucaggagagcgugcguugcaaaacaaagcuggagggaaagaggaucauucgagauguuuuucguuaaaaauaacuaagugaauuuagcucaagucacggaaagcuuugcucuuuucucggugacgcugaacagucggguggcugguuuacauaggaagcuuggacuucucauuggaggcaacacugagaguaacuaaauaggagagaacaaagggaaagagggaauugcaaaggucagaccacaggcagcacaugcaggcuuaggagcuaggaauuguaaauacuugucaaauauauauauauauuuuuaaugccugcagcacaggaaccugagcauuggcuagauaaggcacucaggucuguacaaccagcaagugcagcuggucccugggcgccaaggacugccugguguuuuaauuacccccagaucaccgggaggaaguagaaaugaugugacccuaucuacugcugugugucucuguuucuauaaaguuuuugugaauacccuuuucuguggcuguguuuaagucugagaucucacacacgugcuagguaagcguucugcagaggagcaccacccagguuucagaaaauguuuuuguauuuccuucuccagcugugugacuuugauggccagcacacucuguaacaaauagccaccuaauuccagaaaggucuuuaccuggcucuuccauuugucaggcuaaugaugaaugaccgugaaauccguccucugaaccucugcccauucgaacccccgccccccaaaugccucacuugauuacuuagcuaugcaauggguagaaaagcaacgcaaacuuggacuuuaagauaacucguuuaaauucagcuccaaaggaaauggcaccgcuuaacucacuauggaaggcggaugccuggagcugcagagcauugaguuacucuggagugcagccacauuuggcaagucccucuggcuuggcagaagcgcuguaauuuuauacagguuugggauuugagugacuuauguuagucuguuccauaauggccaggcacuaguuuuugcuuuuuuuuuuuugcuugcuugcuugcuugcuugcuugcuugcuugcuugcuugcuugcuuuauuuauuuauuuauuuauuuauuuauuuauuuauuuauuuaacuuugguggagcagagguccaaggagggggccaaaacugcccagccuuuuagugagugacuccaggggagagagagaugguuagaaacuugaccucaaguggcuguagugacagacauagcuguauacauuucuacuuaguuuccuccagaagccuagaggccucucuagugguacugcccagcacuaacagaggauuuugugcguuggaaucuguuugacaacugguggccuggaagaguucaguuguuaaugauuuuucucagcgaacuuagcauauugugccguucuagcuaaggaugucuucuaauuaaugggcuauuguacaagcugcugccguuugcuuuggucccugggugucgggacucauuccaaggccucuuucugucuucucaauuaauccucacaauaccucuggucuauagcuuucugcucaaugccggccuuuuauuucugagccuuuccuauucaaaaugaauugguuuauaaaugcaggcacgugagcaaucgagcauacuuguccccacgugaaaagccuuauucccccaugauuuuaaaugugucguagcggguggcggaaggcaucugugaaacgagagaaagcgguagguaggguuuguuggaggggaggggagaggcaagugggcugcgaggauggauggguccgugugggaauggccacagacaccaaugcucacaaaacaagugucgaccucauuuucucuuucuuccuucagcuacuuguucuuuuguggcugauuaaucuucccugcccucuccaggagggaauaucuuucuccccguggcacuaauuuaggaauggcagcugaguuaguuagcuucgguaucuguggccauucccacauggacccauccauccucccagcccccucuccucccauaccccccccuccaugccucccagcuggccuucauagcccccagcaacccagcauguggauggucugagcgaacguaggccgaguacgucccagggucauugaagagcuguagacucuuguguuucuaaauugauccgacagauuagacugucuucccaaauuauugcuguuuguauuaugacagagucacugacaaggaaauaugaccaauagcuagaaaaucaucuuuggcugaggaaggcuaaaaccugucaaaaucagagagaaauguaacacgcuucccaaucuuacugagccuacuuggagaauggaauaaagcaaaaugguaaaggaggaaaaucuucucuccuccuuagugccuauaauugcucuaggcguaucaugggccuuuaauaaaugaauaagcaaaucccuguugcaaaugguccuaagccccaaaccuucccucaccugguccucucccuaggaguccuacagaauugaguuuucucagccagcguauggcagcacgucagccaccuuaggaaaguguugaguucuuugccuuggguuuguggaaauccugaguggcaccuccugguggccaggagaaauccgaaugugaccggcaucaugguguuaguggcagacaugacagauguucuacucucaaacagugugcuucaguuuuagggagcccuuugcuccagugaacagugggucacuggcaugggcucggggugaacaagucccaaggagcaugcccaggacaaguagggaccugacaugcccaagggugucucugcucuccucuucagaucacucuugcaccugcucggcccuuccuguggaaaacagucaucggcaucauacuugaccuuuccacuuucugugacguggggaacagggcacaguucagagacuugugcaucuuuuuuagucaaggugaagaugggaaauuucacuuacuggcuggggcagaaccuggugccccugcucuuuuuacuuuuuuuauugucauuucuggugacuuuggaugucgugaccuugacgguuagaaggucaaagucaucugucugaguguuuacggcauuuuccauugcuuacgacgccagccuccgggcucucucccuuagugccccuucuuacugagcuuucuccgacugucuuagccacucuggugaccuggaucuagucuauugggcacuaugcaguuggcaugggauauuuuucuuaaacagcagcugagaaucuugccuguguagguugcugaguggguauuuagucuaggaagguaggggaauaaaaugaaaggggggaaggaaagaaggcagugacaauuuguucuguccacugaggcuugaacccagggccucauacauucuaagaaagcauucuuucuaacacugagcaauacccccgauuccuuucagauauuuuaaauuuuuguaucagaucuugcugaucaccaagaugggccucacccuugcuuugcuugucuccaagaucaccauucugcuuuagccucccaagaaacugaguuuauaagcaugugccagcgcacgugucacggagguuaaaugugcccagcguguauucccuacagagcaaauauugagaucucagcuuggugugccaaaugcugggguagaugugugacccaguacuguguuucguaagcugagagauggcccucuuccagcggggcagacccgagacccugucuaaucagcacccaaaagaucaguggugaagaagggaauggacugcagccauguuuagagguaccuggcagcucugcugggacuagaagccaugaagagaagagaauccagggucagugugaggaggcagucugcguaagcaaagaggcuggaaggaugggccaggacugcacguguguucagcauccguggccugggauguguaucuuuccauggcuuugguuuguaugucuuuuagacccaugcuuuggugauucuuuuucacucgcccuggccaacagcuuuggccuucugugagcauggcucgaggaacaagggacggacugugauaagcaacuucuagagaaaggagcauggcgggggaggaugcagcugugauuuguuuuucuuccuuacacugaaaaauaauagaauaggguuugagggaccacagggcaacuggccuggggaccucauuucuugcagccuccgcaccacacaguggcgggauccccucugguccgaugaacagccuuuccucccagguucuugcaaaugaagcaucagggcaguguccaaccacagaaggacuggccuguugaggugucucccauuugccaccauagcuugaaagauucuucaguguaaguucacagaagcccuuccuguagagccacgcucgucacagacucaugcacacuucgcagccugugaugaggacuguaugcuucuggguaucacaacucaauguauuagacaugcccaguaaaagcccuugugucagaaguccucuggggacaguuuucaccuuccuuucugcguucugagagcgaccuccucaagcaucaggauuaaucuuacaguugggaguugcacuaagcaguugguuagugcucagucuugacuucuccguggaacauuuuucuguaguuuucuccauucgcuugauugaaaaacacagaugguuugagccacacucugcuguguucaauccagccucauucgggugauguaaaccacucagcacgcuucauuuagggacucagaccagaccuaagaaccagggaccagaacuaagaccgauuccagugaagagcacagacccuucuggggcuggauuucuauacccauuauaugaaaagaaaauaugaaacuagauuaucauggaagaggauguuuauuucuuuugggaaacugaagcuacacaaaagagcuuuaagugggcucugugggagaaagcugaguuuaucgugauggacuuuuggauauggacacaucucagugaaacuuguaacacaagacuccacggcacaguucuagaaacccgugacaauauauuacaauaaauuauuuaaggguaucauagcaacugugggcccggggauaugagaggaagauuacaugauggaaacauuaucccagagcuuccggcuuuuacguguuuuuugauggacauuuccagugaguguuuccccaucagauggcuuuaaugagauaagacgccagguaauagcaccccagaaagaaccaggaaggggcucggggaucuccuguuuuucuuucugucuucauagacagggguuggguguggcaaggaauucuauggugaggaaugcccuuaggcaacgagaagcuggguagcuuucaccaagccaguguggcauccacaggggcuucaugugcuugcacuuggcacuguggccuugggagggaugcagagucuacuggcugcugccuccucauuuacaguauuggcuuugauguugacuuuggccuuggccaagcauuguugccuauguguccuccgugcaucucacacuuagcuauagucacagcuugaagugugacagacacauugcuguuggggaaucagugguauguacaccuguccaaguauauugccuuauacguggaauaacgaaauuaucuuaagauuauuuuauauucuauuuggcuuguguuauaaagguaauuucaaagcuauuugacaaaauuccuaauauguaagauuuuuuuucucuuuaauaaaugacauacaaauaguuuuuuggcuaacaaaauuuuguuguauugggucuucaauaguaucuugcacucaaugaauuugguguucaauauucuuaccaauuuuuccuuaagaaacuaucuaggcuagggcgugggacaaauaccuauaaccccacaacucagaagcuggaggcaggaggaucagaaguuuggggccagcuugggcucuauauugaaaccuugacuuaacaaguaaauggaaaaggaaaacagcuagguuauauuuuauaauuuucaugcucuuuucauacucuaugagauaaaagaguaguuuuaguggcuaaauacaagcacauuaccaugaguacucuagaagcguuggugaauugugugggccagagauauggcucagugaguaaaggugcuugcagccaagccugaccaccugaguucaauuccugagauccauaugguagaggggagaaccaaauccugacaacagacauaagcaugcauggacuccuuguauauacacauaugcauauacuacauacauugaaagccuuuaaaauagaauuauuauauuucuaacacguauuuuuaacgucuucaaaugcuuuggaagaauuucagccagagaaaggaugucaugaaaacauuccgagacaaauuuauaaaacugucauuuuuuuucugucauugucuuccaggacccuugcuuuugguguugaaacuuuuaaauguuuaauuggcaagcaauaauugcauaugcuuauggaguacaacacgauccuuuugauacaaauauucacuuuaggaugauuaagccaagcugauuagccaugcccacugcuacuucaugagucuuccuaguaaaggggcaaugguuguuuuaguuacugcuuuggacaucgguauugaaaaguuugccuuuaauguccuucucuuagaaacauucuagagaagcaugaaccccugggguuugugaacccuuguuugagguucccaccaaacccaccucagucuuggacuuuucuaggcagcccaguuaaacacuguugucauuuccauuggagacaacacacccuuggggguaacaaaagauuauucuuuaaaaaaucuagaucuguauuuaaucaaaugucauacacagcuagagaagaaugugcccgacuaacuaugcuuuuaauauuagagaaacggugguuauaggcgugggcuggggguggggugguuauuugucugaagaggucugcguuuuccuuuguaaucuuccaguccuuccuagcuccauucuccacucagagaacuuaacagaccuaacccugguaagcucuauuggaaguucaccuuuagugccacuaauuagcagucuguguguagaaauccugugugccaaaaccuuguacuugggcauuaaauagagccucuauaaagcaaugcagauggucuucaaggaaccacuucaucuuuauauugugagaguuuccgccuauuaaauguuugaaauuucauuauguuauuugaagaguggaacuguuauuacuugaacuaggcuguauagccuuuaguaauuagaggaugcaggaugggaagugacugguccuuggguccugguguaggguuacucugcucugguccaaugaagcauuaucuugcagaugccagcuuggcucuuccaagguaauggcacaguggugauccugccuccuguugcaaauccuucauccauuugcugucauggaagaaaagauauaguucuaaaagucugaggaacgauguggaauuugaacacauaguaucugaaauaaauaaaugucuuugugguguucagguuguguccuggcaucagccgauguuugcauuuauccuacagggggaauuuuccacuucagagcaugaacaugagguuagaaaccuggagcauggaccaaaugacacaaaagccugguuguaguuuauuuucaaaugcaccuuugaugguucuuauaagaugugggaguuuugaaaauauaguucagcaaccaacuugugccugcucccuagacuuuugcaucugacaaaggaugccaugauauagacucucagccauuuuaaagaaaaaaauauaaaauguaagcauaacuuuacauucaauaauaauaaauuauacacuguaguuucaugucacagaaaauauuuuuaaaguaauaaccauacuugacuuuuaaaaggaacucuuuagcccagugucuuucauuuuuccugaacuaauccucuuuauacacauuucuagaugugccucuugcaugaaauacccacucauuaauauuuuuucccuguguaagauuucugaagaaaacugugucugcauagcuaaugcuuuaaaaugugcaaaauucauucuuggacauuaguuucauccuuuuaucccuuaauagaaagaggaguuacuuucaaauuaugggcaugugucaugggcugagugcucguggacacaugugucgucugccuguucuuccaacagauaguagcgccucugagcugccaucuagccaugguggcugucgggaccugagugaaaaauauuuuuggucauguucuucucaauuaauguggugcugaauggacucagcauuuuaucaucgucguugucgucgucgucaucaucaucaucgucaucaauuucaucauuuugugugcauguuauaugugguggauacuggcacaugugcauccuguggugcauuuagagggucagaggucagaggacaacuuuugggaggugguucucucauuccauucuaugcaacuuucagaaauugcucaccucuccuaucuuggguuggaggaucaaacucaugucacaaggcuaauaacagcgcacuuuaaccucugaccugucucacuggcucuagacucggcauuuuuaauaaaagugggaauugacaaauaacuucauguuuucauucacaagaagacuagcacagagcucucaaaaugacacugaggaggaacuuggcaagaaucuguuaagcaacauuaaaaacacccuacuucuguuguagugcguugcagccuggaggguggcagauugauaacagugaaaaauaggaaaaagcggcgggaaggaacagaauagaagaauuucgagagaagcuugcagagaggaaagaagcccgcccauccacgcauccagcagaugcuuauucugugccccuuguaguauuggggauggaagucaggaacucacacacaguaggugagcauucugccaccaggccauacccuggucagcucucuacuacugggcuugucccuugcuguuaagcagagcaucagacaaugcauacauaaggcuguauccccaucccuggggcuagaagcaaagagaggggaacaaggggugaguuagacuggagauguagcagagcuaucagcaaggacacacggguugaguggaugggagauuaacuucuaccuuauccuuggaccagcugccuccccuccaacccccaagccaaagagugccuaacaaagauuuguuucuggccuuuuccugacccuguucuagauagugacccugggaaugcuuaggagcacaucugugaugcaguccaucugucugaaugucuaggguggccuccgugcaccacacauugcacugggcaugaggauacaagaaguggagcacugccacucccuaccgcucccuccugccugcuucuacaaguguaaaugggugucaugaggucccuguguuggaaacagacaaugucagaauuuauuagauaagaaauucacaagccaaaagaguaucaucgacaucacuuugccaaauaauuugcuuuccuugauacccucaauugcuaauaccaacucucagaucacacaauauauaacacauagcaaauacauauaugauaacuguguaauaaauaaauaugaauguacauuuuagagugauguaagagggcugaggaggcagagcugaucaucggauagaauuguaaaguggacuuagugggggcgagguaacacacaaaacccagguccaaaagaaucugaggcugcuggcugcuggcugcuggcuguagagucagguugcggugucagaguugagcuucaggguaaagugaaggguggaugauauugguccaaguagauggguggacagcaguuccagacagugaacagguagauggugaugugagugggccaucacaacaguaggaagugaccuaaauggaggccucugugacagucaggaguucuuugccugucagucccuugaagcauacacuggauggucagauuauagauuguuggggcugucacuagcccagugccaggcguccaacccuuaaugugguacaagugagggaguuguacccuuuccuuggucuggugugucuggucuugggccuaguuuuuguggaaugcuuuguuucuuuguuuugaaacaagguuuuacugucuaauagcucuggcuguccugggacucacuuuguagaccaggcuggccuccaucucagagagauccaccugccucuaccucccaagugcugggauuaaagguguguaccaccaugcccggcuuguggaaugguuuuaauaucuccaguuguacuccuauacucccaauuuaccucaauaaguuuauaggguaauacuuguccucucaggaauaagucauuuaugagcgcaugccaugucgguaaagaaauucauguauccaccuagauccagaguuuuucuccauccccaagauggauuuaaaggcugcuucauaaaauggagucucugggggcaaagcaccaucuagaaaaacaacaacaacaacagcagcagcaacaacaacaacaacacuguuuuaaacaaucugagcaauuuagggcaagguacugguaggcaguauaguguagaacauuggcagacaguggucuagugugcuaaauauugcuaacagcaugaugagaauugucaccugaguccagagguaaggaagugugucccagaaaaagacaccaggcugguguuucuuuguuagauuuuuauccuuacagaauucaucagaaaaaaauaggaaaaaaaaaaaaaccuuuaguuugcuucaaaauucaggaaaaaaauuacuucauucgaauguuagcaaauuugauuugcuuggucugacuuuuuguuggugguuugcuuucccugcuguucugaauauaaaauacauuuaaaaaugugaauucuguaaucauaucccucaaauucacagccauuugagaauguuuaaaaucucaaggaccagccacagagccuuuagccucguauuuuuaucauccauguuauauaugggucugcccucuugcaggcacuacacucuugcagcuuaauacaaaccagaugccuguaaagcaauauaaccagaauuuguuuaaagugugucugugcaccgguuuacuuucagauuugaagcugugguuuuaucagacuuugaaggggggccgggguggggggcgauaaugccacgcugccuagcuuucacuaagaauuguuuggagcagcagaggcgcuugcgaggacugcguaccuuuuccuauucucuucccuucuguaaaucugacagagagauuugccaucucagccuuuucuguagaaacucucuaacaagucggcauucauuuguagucauggucugucucaaacaugguugugucuccuuuccucucaaugggcuuucuauauuucuuccuaaauuuauaucucuggcccuaccugcucuccaaauuccauuuguucguuccuagucuggcuuggaaguggcccagggccauuugaaauucacccuaacaaaacaaaggggcacauuccuccucaacacacacacauacacacacacacacacacacacacacacacacacacacacacacacacacauauacacacacauacacacacuuacuuggugccagacuugucccuuuugccuucuuccuccucccaauaaaugacagcaguggucagccacuuagaagccaaacaccaaguuuauccacgacuccuccguuccccaucugcagcuccccagugaaggcuguggcagaggugccagcuccucccacuccugucaccaguguccaagccaaugcgugcauuaugaagugaccucugaccugugugcuacacacgcaugcucaccauugaacaaacagcucguucugugcauagcagucagagaaaucccuugggaacagaaaucagacccauuuauuccuuggcuuggagucucauuuaaaauaaaauuccccaccuggauguaaaguccuguaugauccagcuaccucuucugucuaccaucuaaacugcuuucuugggcuacaccagcauccucucuguguacgugcagucuuaccucaaggcuucugcacuuuuuguuucuuucuggugacuuacaccucuguguguggaaaauauucauguggggaaagcaagcuacaucaagauuaacuaacauauaaagaaaguuggcaaagauuggaagcccuuccucaccugggcuuccuaaggaacugagcauguucaagaaagacccauuguacaaacgugguggggaguguccuguaaagggucauuugccccaugucccagggccuuggcuuuccucucagcucacuagcuacuccucuccccaggaguguauuuccuuuccuaauaaacggucucuacuucucuuucuaaccauguguccccacagcgguccuuugguccagaacacaagagcccuccuaugcuauggacagcugcagcacuuucucaccaacgaccaauucuccuuggucucuuccacucccaguuuacaugccaccuuguucuagugguuugccucuuucucucauguccaugucacagaaacacagcguucaccucaaagggaauaugagaugguuuguuccggaggccaaauaugagcagccauugcauggaaacccagauuuaaguuaccccagauuccaugucccaauguugaagcaguuucgugcaguucuuauaguaacagaagaaagcaauaaaucagaggguucuaaucaugcuuugccggaaacauggcagaaggguuacagcaggguggggugguuuccgcucgaggccucccgugcuguuggauauaaugcuuagcccuuggacugguggacaguagaguuuugcuacguuaauccguuccagagguuucaucgguuuaucgggguguuaggucugacaccaagguaggccaggagugccucagacauaaaccacaagaaacaguaaccaggcucuagaccugcagcaucccaacuucccaaggucaguggucagccagucagccugcauuuguagaugcagcuucuuuccagggauuccucacguucuucacugaucuucucuccuuggcccuuccccacaaggauaagcucucugucgugggaguucuucuuuuaaaaaaugucugucguuguguagagcuuaaguccugugagagcagggaccucgguguucuucccccugcccccauaucugucugggcauugucucgugcccgggucuaggcuacgauucaagccuagcgcucuuugcguauucuuuguggccucuggcacaguacaucaccuccugcacaaacacgguucuaaaguuccuuguguauagggauuauauguuuucuuucuuccuuuccuuaucuacccagagggcaccggaacaugccacaggccggugaggggaucuguguguccggugggagcuauggcuccacugcgcagcuuccugucuucccuguggucaaugggcagcuuggaucacaaacucccucagggugcacuucacuaugcaggaauaaaaacaaacacacugcuguauuccuuagauaaaggggccuuuggaccaggcaggcagucaggaaaacaugcaugucacaggccccucauuuuuaaugaguacuuuaauuguauuuugaauuuugaacauuuuguggaguuguagaauguggcuuguggagagguuagacuacagucaguacuuucugcgcuccuugaggcccuguguuuccccaggguugaggagugcaccuuagagauguuauucuaaagucacccaucaucugugcaagcagccccuaaaacgcuccgggucuuugugcuccugccugugagauuucuaaaguggacaccuaacaggccccuucuuauuuccacaggugaucugcaauucguucacuaucugcaacgcggagaugcaggaggucggcguuggccuguaccccagguacgguagacauuccaaaccaacucacuuccacccagcuccucagccucucgggggucauuagaaaggcuucuguagccucuagcucaguagccaaacucaagacauagcacuacauugcaugaggcuauagaaaugguaagucuuauaacacacauuauacacuaugcuauuaagacaaggcaggcuucacaccuaaccacuuguucucaggcugacuuugggguagguucaggcuuaugggugcugggauucaguuaaucuuuacaaagucuccccugagcuuuggccuccaccucuugagcagaagcacacaguuaucccuccagacugguggcaugguaccaauaggcuaaguuugacuuugguggucacacacuuucuaaucaccucuagaagagacucaagagccuucagaaguagccuauuucuuagccaucucuaggguagccucuauccccgagcugacuuuuguucugucuuuaugccccuaggguucaaacaugguguuucuuuucaguaauuguaccugaggcucagccuccucucuagccuacacacauguuguugcuugcaugucaugucucuucauagcacagguuucugaaagcagcaacucagagggcuucagagcaugggcucugagcucaggccuccugguuccgguucaguccucaguugauuugugcauccuuggauaaaccagucccauccuucagcauuggucucuucaccuguaaauaacccccaccagcuuguuguggugacugaaucuggucacccugcuccaguccugagcagguacuucccacacaguacaugcccauccuaaaugcugucaguucauggugacaguguaaagucauugcauuucccccaagaaaccuccaagaaaagaaagugacuaggcuccuucccagaaugcaucaggacacaccagugugagcaucuagcagugccacagcccuucucuaccagugcucagcagugaggcccucuguaggucaggggcaccuugggagacugcuguaacugcacccguacccuuuaccccagagaugaucucuucgugaguuacuuugucaguacccccaucauuuggguaaccuuauuggguggaaucuacugugacccaucccccaaaaggacuuauuaucaaacuuccccaauuagcccgcauuaugaggagcagcacaggggcagccuguaagugcuccaagaccccaaucuucauuucuuccccaucaaacccaucuugcucccuaccucccaccuaggugucuuuugacuguuguguccuuuugaugaaguuguuuaacucugcgcauugaugguccccuugaguuuucuuucuucuuucuuucaguaugucuuugcugaaucacagcugugaccccaacugcuccaucguauucaacgggccccaccucuuacugcgugcagugcgggaaauugaagcaggagaggaggugaggaaaccugugccucccgcugcuggcccuccucgcucggcagcaccuuucccagcuuggcucccuccgaccaccggcuacagcuaacuccuuccuguccugacaccaagaaaacgcucaaaacagucacacaccaaauuguagaugaaucuaugcacauguuuuuggucuuggucacuggguuucuucaugaugauaguccugcgacauguauuugaaagauguucuuuggugacuggggcugucuaucuuauauacaugaugggggucauuaaaucaccucauuggcagcaacagcccagcugcuugcuacaucccagcacaugggcauucugagaggcaacccagcuugucaguaccguuccccaggacuugcccagaaaacaggcgugguuuauucucucuggccuucccacugggcuuuuguaaccccaccggcauuucugggugauacuuucagcacagauacaauggucagauaggauuugcaaguguggcuuuguguagauguccaagcaagcugcuuuggugaaagaccuucacugaggcuugagaucucacaggcaacuacaaauaggccaguucagagcugcugggccacacagaaucagcguggacugugugcgguuucuacuggugcugggcucugcuuauugucaugauuuccagaagucucuuuccuccugccuuccaauuugcuaaaguggauauuuccugcaaggaaacuggagagccauaagcuuuuauggcauuuaugcaguauuccuccaauaaaaccuaaacuuagacaccauauuuuauagagacagggauuuggccuugacaggacucauuucaaaugcguuuucaaccuaguacucugccucuuacacaggaucuuuugcugaauuuccaguugucaggaccagucagucgguccacacugggauaucugcugaugcuauggggaauuuuaaguucuuucucugggggucaugugacuugaaggcggacuagaaagggaacgucuuuguucagcccuguuagugugcuugugacuuuugaaccucugugacuugacaucagcaacuuagaggaaugguuuauugaaugccaugcuguacaggguucaguccauggcaaguuagcuccauguuccugagcccaucgugacacagcacauuugcagcugcagcaucacauaacaaaggcuguuuggcucauggccaugaagacaacugagauaguucacaucaugguagacaaagugaagcgauaaugagagaccagagcuauguugcuucccagugaccuacauccucaacuaggucccaccuucccuaggugugccuuuccucaauagucuauucaaaauuugaauacaucaauugauuauuguuaguaccaggacauuccaaaccuaugagcuaacaacgugacccacaaccugcaggccaguugccaagccaacgaccaccauaucccagaacccacuuggcucaccucccagccuuacuuguguuaugucacuuuccauauaaauaaggggaacacccccuccucuuuuucuucucuuucuuucuucuuucccuuuccacuugcccugucacuccuuuucuccucucccccacaauaaaccucucucacguggaacugccuuggccuggugugcuguucggguauauccacuauauauuauuauuauuaauacaucaauuauacuuguuuaugugagagcucuccucaucugcuugucucugaaagcucccucauagauacuagcagagguaugcuuucauaauuuccuagucauaccuuaauacagucaaguugacaauuaagaugaaucauuguacaucaucuaaaggcaaaagugacuguugguggugaugauguuuuaaccaaacggggcuaggguaucucucagugguaaagcucugagcauauacaguaucucggauucaauucccagcacuggacgaugucaacaaacaagaaaaucuaugagaagggguugggguuuucuaaacccuuauaacuaacacauugguucaucaucuucuggggccucaucacuuggguggauagugauuugcaugaauugaacauauuaguaucccuaaugucaauguuuguuucaaguguuuggggauuaggguucuucauucaguaaucucuguuugcuggagcaaauucacagagggcuuucugugugguaggggcugguuggcuguuccagagucugaggaauccguguaucagaaugaccuucuuguguggaaggaggagacagacagaaggcagcaacaugauacaagaagcaugguagcauaggugugccaaggcuucauagauacucugaacagacuacccaaggcauauacaggugccaggguugggggggggggucaguuaaggggacauauagagaaguggccuuucgaucugaaagaaucuauagaaauaaaguuaggugaggcaggcaccaguguuccaagcaaggagacagaagccacuggcagagugcugaguucagugagcaagaaaugguucacaucgguauugaggaauccacuccagccaggaauggagaaugcaugggggcuggaccagucuggggcuuuucacagaaugcuguucacccgaggauuucuaggugucugcuaugugggaggaacgagggccaggcagugggucuccuugaguuuugaggaaaggagguaugguaagaucuuaugccuauagacaagauuaagaggagggucagucugucccuccgggcaagaguugacaaugacagucugaagucaggaggaggccaagugguggcucagaauacagaaugugaagaauacaauauuuagaaaccaaaauuaguagaauuugugugacaaagaaaagggacaaaagugacuuuaagaugaagugauuuuuuuuuuaaacuuugagcuaguauuggaaaaauguguaacugugacaauauacuacaaaaaugaaaacaagauuugguuuuauucugcacuccguuguugaugggaaagaugguuucagggaaaacaguuuucuccgcuaugugauuugaacagaggcaccauaaccaagucccugaaaccucugcaauauugcucuaaagcuggaaaugauuuaugcauuuuuuucauaagaguuacacuuaaauggcagagcaauggucagagcauuaauauuuuaaugcgauuuuguucugugccauuaaagcaccaguugaucaauggccgugguuugugugugugcccgccccgcauguagugagcagugacuccauuuaaacuuucaaaucuaugagccuuuaauaaagguuuuuaucuuugcuugauaaaaugauugagcugccauuucaagcuagcugcgugcuuccggaauguucuugcugcugagccccucagcuuugguacaguauaguuugcaaacuucaguggcaugaaagaggcacagaaaagauaaggagucccuaucccagagggagggggcguagacagcuguauagucaagacucuaugaggcacaggaaaagacaucugagacgaggaaguagaccuacaaucagucuaggagaaaagacuuguggggcuccauccauaggcaggaagaagcugccugaagucuucacauagaggaaugacucaaccagcuauggguguuagggagcguguucucccuccuccucccccucccccuuccccucucccucauuuucccccucccccucucucaucaguuuagaagguaaaaagguagaaaaagccccuaggaggcaaguuagaaagccauugcuuggguaaaggcuucaggcauuacaggcuacccagaaagacugugagacccuauuuauuggggugagacaaaauaacuagucuccugcccggcagucacacaugaguuguaguccuuauaaugcaguuuuagagccagacacuguugaguugguggcuucacaguagcuuggaauuacccaagagcuucugcuugaccugacagcgaugacuagugacuucuggucuuuaggcugggcugagaaacggggucuuagaaugaauucuacagggagcauagucaccagcugcccccucaccuguguggggaucuguccaggaccagagagucugaggauacaggaugaguguacagccccaaacuuacugauaaagauguucucgaauauacgcuuugagacuaguugcuuggucuguggaaccugguguucuccaaaaggcaugggaacuggccuuguacuguagcccuuucuccucugcccugccuucaaaugcaagagagagauggaggaaaugaaaagaugaccauugucuuagccaaaagagccagccaccaccacugcucuguguagcuugugcuguauauauuccacgguggggcuguagaggcuccuucuguucguaggcuccacugccaccccaagaaggguaccugcugcaguccaggugaaagagucaggcuugaaucgggucaaaugcagaucccagcuccuuuuagguuuuuuucuguugcaguuacuucaggagugcagcacucaccagagguguuccugcaagaccagaucuauacucuuggggcagacauuaguucuucuguggaagaaggcacccacagcuuucuaacaugagccucugugaugagccagggagucagcucagguucugucuucugucacccuggugacagugagucugacccauguggcuggccagacuuccuccuccucaaggaggccaccuuaaagucauuuucugucagaggccuucucugcccuaccuugacuucaaacaaguauaaucauguuuaguagacacggggugcuuuguuuucaguuaagaaaaaccacauggaguguuugcucuggggcauuuugucaagucuuucaacagauaacccugcccccuccucccugcaauauccccaacucccccacacccauaauuauguucugcauuugaaaacagauaaauaagucauguauacuguauaguacaagcugguauccauuaccagaguaaagcaaaggaagacaagggggaggggaggagcgcuggguguggcaggagccaguuguuauuuuaaauaggcugcagguuaggccuccuagagaaaaugggauuugauugaaauggaagaggaccagagaggccaccuugguggaucugggagaacucaggccugaagggaaaauaugaagggacaacaaagaggccagacuagccagagcagcaagagccauggaaaagggggaagggaacguacagggagggccaugcguucaaaggagugggugcagcuuauaugaagcucuugcuucucuguccccagugaugaaagacccauauuuuacuugggucaucagacuuaauauuuuugacaaauuugaaaaaugaauauuuaaaaacaguaaccauaacaaaacguuuuaucauuagaaacacacacacacacacacacacacacacacacacacacacacacacacacauucuuaccaaauaguaaacaaguuucuaaaugaggacuuuguauuuccuuccuccaauucagcauugagccuaugcaguccagaggccacacucggguugcucuguaagaccuuggcuuuccucagacaaaagggggcgcuauugcaguauuucaaacugaagaaagccugucugacuucaauuguggugaaggcuagauuguagaaugcagagauuccuucuaggagagaagggccaagggugggguggggagaccauccugagauggugguuggccagguugggauguaacagugggaaagauuaaaaguggucacuucuggaugaauuguuaauguggauacaacagaacuuccugaugguuuuggauguuagaguccagggagacacaaaggguucagucuagacaacaugaauagagcuacugccuccucuccuaacuagggaggcucugcaggugaguaggaaggggagaagaguucugauaacugugaacuugauucuuguguguuggggaaacauguuuaugcccaugguguuaccugaagaccagggacccagaacagagugaaacuggccucucuggucaucaagggucauagaauuuauggucaaaccuuagugacaguaaauaugaaauaacuccugagguuuuucuguuugauggaagaaaaacaaaagacaaagauaaaguacaaaauuguguccagguuauaaacgugauucuuuaaauuaagcauguaaugucuguauguugacagugagccagacuagaauaagacacauuacagucgccaggggaggaggcuguagguggcuccuuucucuuccucccauugaugucuuacucuaagcauuagcagugaugauagcaguagaagcaaaugaguguaccagucaugcaagccuuuccuucgguucccacagcucaccaucugcuaccuggacaugcugaugaccagcgaggaacgccggaagcagcugagggaccaguacugcuuugagugugacugcauccgaugccaaacccaggacaagguagguggaaugagagcagauugaagcuuuccaugguggugucugaagggucuggggagcucggcuguguucacacugcuccaaagugcacagcuaaguagaacagggcacuugcugcacucuucauuuccugacaaggcgagauuuacaaucuguggggcuucagguaucauggaauauagacauuaaacacaugacauuaaacauguaauuaaaaggauaugaaaggccagagggcuguugagagcauacaguaagaagccugaauuauguuacgauugauaacaguuacugcugagcaauaaacauaccaagucguauuuugucuucuuaguucuuuuaaauugguuccaaaaggcucucuucugcggcgccuuaucagauggagcucacuuaccucaggacucucacucuccaaggaaggaagaagagccaaaacuaaugccauaaacauaauaaacugcucuucaguuacucaugcacuguccucauuuugaacuuaucugcuuugguuugcacgcaaucagguuaugcgccaucaucuuccuucugcgggguguuuguuuacguuguuagaugucuuuuauggucaugaucucauuuuaugucaauacuuauaaauaaauugugaagccaaacucaaggcagccucagagauaugccucugggaugauacgaagaaagaagggacagaagcagcucucccauucaggucaacuggcucagccagguuguucuuguaccaugcuggggccaccugugguugucucaucacuguggagaggugacugcucuucuugagaaaggaccgugagccccuuugaauacuggaaaccacagauauaagugguuuugcaugaaaaggaauuuuaagaacugggagugguggcacaugccuuuaauucauggucuuuuaucccagaagccaugggugggaugugccuuuaaucccagaauucauggugguacauaccuuuaauccaagcacuuuaggaggcagaggcagguggaucucugaguucaagggccgccucaucucuggaggguguuccaaaucagccagggcuuuacaguugaggcccugucucaaaggaaaaaaaagaauuaaguaggaaaaguuggaucuacuacagauagauagcaccaagauucagccuacuuuaguguuaugcuauauaaaugcucagcuauauguuuaaugcuuauuaauguauuuuaauuuuuauuguaacacggggugucacaaaguuaaaaaaguagugucuuccugccucagcuuucugaguugcugugauuauaggccugcaccagcagacugaguuucuaugaugguuugaaugagaaucgucccaguggguucauauauuugaauaucugguacccagugaaacuguuugggaaggaucaagggguguggccuugucggaggagcuauguuucaaaagcacacaccagguccagggucuugcucucugccuguaguucucaucuacugccccaaugccaugccuaccuggcugccugcuucccaucaugcucucacuuugacauucaugaacucucugacacuguagucaaacucccaacuaaaugcuuccuuuuauacauugccuugaucauggugauucaucacaacaauaaacaguaacuaagacaguccccaggucauuucuuuuucugcagcaguucauagcauguggcuauguuccuauguccucuuguucccaagauagcugcugucuccaguaccuaguugguguguucaagcuccagauagggaaaagaagauucuuuagagauuagggagcaauguagauacucuuggggauguggacuuacaguccauguuaaaagcacuucauagagggauacacuugucauuagguaauuuugucauuguguauguagaacaugguauacuuacuauggugagcuuguuuuauagaguauagucacugcucugaaauuacaagauauagcauaacgaacaauuaacagucauuuguugacaacuguauauuauacuugauugugcauauacuugauucuauugccagcacaguaggcuucuuuauacugauaauauauuaugcaguaaugcuacaacaucuaugguaucacuaugcaacaguccuguucagcuccaucauagcacuauggagcucuuaguaugaugucaauuaauuauaaccaacucucaacaacauggaaguuaacaaaucauaagauaugauacucagauggagacccaagagagccaacuggugugaauuccagaccaaaaguuuauagguucaagaccaagaguucguauuuaggucugaagccaggaguaaccaauaucccuguuaaagcagcagguggauacuguucccucuuaacuaaggaaaagccagcccuccuuauucugugcaggccuucagcugacuggacaagguccacucacacaggagggagggaaaucucccuuacuuaguccauggauauaauguuaauguugguuaucuuguggccagucagguuggcauguaacaaacaugacuugucaugagugccauguuagagauaggccaaagaguggaauccagaaaguaucugcuuaagcuacugaagucuaguccaaucuguauguggcauauugauuauucugucuguauuauaagggacacagacuacgugacuuuaaggccucauccagccccauuguuccauauuuguaugaaguguuuccauguggagacaagcaggguauguacuuacauguauaaaccuguuauauuuucaauuucccauuuaucuggaaauuuugcucugcuuaaugauaucugugaccaagucuccauaguguuaauuugcccagggggaaaacuauccacaggucaauucacuacuuagcacauuccccaaaggcuguaaacucaaauucucaggacagucaacauuaacuguguuucaguccucgauuuguguuugucuuggaaccugggaagcccauugucccagcucuccuagucacgcaguaucacgcugcugcacacaucugccugcugcuggaguucaccgguuuccuguuucaggaagucaggaacccuacuuccaacauguacaguaugcacacgugaauuuucccuucuaaaccagcagcagcuuacuaucuggaagaaauaaaacugcccaccuuaaggagacuuugaaauguuaagggaccucuaugucuuuccucaggucagaaccuaagacagcacaagcagaacagaucacacgggacugaccauuuccauaaguuuguggcugguacagaacaaacuucccucaaggccacaugcuuuauugccuccccaacccaaagaagaagaagaaaaaaaucuguguuuacuggucaugucacuuuugcuucccuaaagccaacuguauuuaauucuucuauuaaaucaccacagcuaggcgcugaggagauugcucagggcguaagagugcuugcugugugagcgugaggaaccugaguuugcaucuccgacacccacauaaaagcuggaaacagccaugcaugccuguaaccccagagcugagcgcagagaugagaggauccugugaucuugcuggacagcccagucuagcuaaacagcagcaagcuucaaguucagagagaagcuuugucucaagaggauaaagcagagagcaacagaggaaggcauccaguguccuacucugacuuccuccugugcauacacaggcaugugaaccugcauacacauucauacacacacacacacacacacacacacacacacgcgcgugugcacgccccaaauaccacacacacacugugcacauacccauauaccauaccacccccaauaugcacacacacaccaccaccaccacuacuaucacacacuacacaaggcacugcaugcauacacacaugccauacacaugcccccaauacacauauacacaucacacacacauauauaccacauacacauauacacaaaccacauacacauauauaucucauaccacauacgcauagacacaccccaguauguaauuuauugaaauaauaaugggcugccaugucugucaguccacucauagcucuuguuuccuacaagaucaugaaguaaccccugccugcucuccagcucuuucuucucacucacacuacauccuguuucagagaaggcuuucuugugcaccucuguuuuggcgccuuugcucugcucaggguuagugcucaagauaaacuuucaacucauagcucaguauuuuguguuuuccaaggucauggccccaagagccagauguuuuccuuacuucuuucuuuugcaaauaccaauuuccuuuacccaaaauaugcuaaaauuauguucaugaacaugugugugcacauacaagcauguauuuauacauaugugagacuaucugaguaugucacacaacagccaagcauuuuuauauuuauuugagagauaaaugagaugagacaaaaagguaagacaggcuaguccccagaauguaugcccaaugauccuuuucauaauggccuagauaaaucacagauucgcucuggacuuguuaguacacacagcuaacagcaguuucagaauucacaaaaaccacagaauugagcacacaccugacuuucugcuaagucacaguucuccucaaacugaggcagaauucuucucagaccccauggccucugaaauaccugaguuuuauauuccucagugagacuaauugacauaauuuuaaauuauaucuuaaaaaucaaagaaugacaagcaacggugugauccugaggagcgucucucuaaugguuuguucuacugcaagaauaaauuuucaucuuccucagacaaaaccagugugcaaaaaugcuucagguaacccuucccaaguguuguuuguuacaacuaaggccuuacacuugucaccuuuacuaaggcaaauugugugcauuuugaaaagucaaaggguccuugcaugguugauaacaucagggcucuucugguuggcaccaaaguuuggcccuucugcaguuugcaccccacuuguccuuaguucauauugugcugagagcguggugguaccaugcaggaugaccagccuugauuucugaaggcgcugggcauccguggcugugccuccuaacugaggcaccugggcaggaggcugcagaaagaagccaugcuuggucaggagagaaaguaaugcuagguuaaagcuguguucaaagggaagcaggcguuucuauccaaggauauuauucugguaacuugaguccacuugagaugugagcaauuacuacuuaaaagucauuaguaaaccaagauguuuuucuuuucuuuuuuuuccuguugccuuccccuguuuugcuaaguuaauuaugaacagaacugcaucguggcaggauggugaggccagacaguucugaauuguuucccauuccaaguuuuaacagucuaagcagaauguguuuccuguuucuaaaguuuucgucauaggcaagguauguuaucuccaggaagauaggagagauuucgcagaggagagaagaaugcaaaacagacacacacagcacacacacacacacacacacacacacacacacacacacacacacacacacguuauccaaggauaaccuguggaaaucaguuuuugucuuccaucaugugggcucagggaaucgaacuuggguccucagucuuggcagcacacaccuuaaccuacugaaccaucuuguugaccucuucuugcuuuugcaaguaagcaggggauggcaucucuaaagugguugcagggauggcugauguucauguuaacaaggaaagguguucuugacuucauaacccagacuccugcacccagggcugccacaaagcacuggguaaccucuaagcaggucccauggaccaucucuuuccugggaagucauuagugugaccuuuauguuugucauagaauaugcugucccagcaccacaguguucgaugccacaguguguuucucuaagcagaccaguaggaaucuucuugcagcuuagcuggguuccagaguucaccauacauuuaagaagagugucauuccauaauccguaaugacacaaacaccaccuuauaaccuuccaguuucugcaaauaucuacuggcuuuuggcauauucuaaggauaucaaaacucuggcuucucuggaccacacugggcaagaacuguuagaucauaccuguacuggcuggcuuugugugucaacuugacauaagcuggaguuaucacagagccucccuugaggaaaugccuccaugagauccagcuauaaggcauuuucucaauuagugaucaagggugggagggucccuuguggguggugccaucccugagcugaaaguccuggguucuauaagaaagcaagcugagcaagcuaggggaagcaagccaguaagcagcaucccuccauggccucuguaucagcuccugccuccagguuccugaccugcuugaguuccuguccugacuuucuugggugaugaacagcagugugggagcguaagcugaauaaacccuuuccuccccaacuugcuucuuggucaugauguuuugugcaggaauagaaacccugacuaagacaguaccuuaaugugaagaccccaguccaugguucaacaaccacugcagauacgaugcagagaauaguuuuucuauuaauggagcauuguacuuaccccagugcacuguccacagcuguguguaagaaacagaaaguauaucuucuuuagaggacaugauagauuagaguagcugcugaaguuuuggcaacaccaaauacuuuggaggugcuugacugaguuccuuauaugccacaucuugucuaauuucugcaucuuguguaagcggugauugcucuauucccauuccauacaugagcuaacagggaucucuacuauauggccuuuuccaguuuguugugcguagcuauaaaucuguagcaaauauagccauccacauuuguuuuaaaaaacugaaauguaguuuauguuuagcaaaauucacuuuaaaaaaaaacuauacaauucuuccaguucugacaaaugaaugaaauugcuguuaccacccuuuagggguacaguucuacuguaugcccuucaaaauucuuuauuuggcuuuauugauaauguuuaugcuugauauccaucuggguacugugucacauuuuuaugcacguauguucuauguaacccaguuuuagcauauuuauuuucucaaacauguuuaaguuugcuuucuauugcuguaauagaacacuaacuaaaaacaacaugugagaagcaagguuuuauuucauuuuacaacucccaggucauacuucaucaccgagggaagucaggucaggaaaccaaggcaggaacuuagagacagaauuugaagcugagucaucaaggaauggcgcauauaagcuuuuuucugagggcuugcuuaguuaccuuucuuauguagcccaggcuuaccugcccagguaugguaccacccagagaaggcugggcccuccuucaucaaucaucaguuaggaacaugccccauagacacacauaaccauaguccauucugagggaggcaauucaguugugauuuccucuuuccauguaugucuagguuuuuguugaguugacaaaaaauacuuaugggaaacaguuaucaauauuuuauggcaaaacauuuaaaauucuuucuucuuuauuuuugagaucuauaguagccacucccugucuguagucacccuaccagaucuucuaauccagacucaacuagaacccgacacccauucgucagucucuccuuggggcucccuucccuguugucccugguugccaucacuccauucccaucuugguuuuucaacgguaggaacugaacuuaggcaucccuaacaccuauugaggcaagugcugcaccacugagcuauauucccagcucucuauuuucagcuuccaugagaucaacguuuuuuagauucuacaugugaaugagauccuguggugagaucuuugacuggcuuaucuuucuugcuuguucgacccauguucagaccaacaccaguaguuccuucuuuuuuucucauggccaccuagcauuccauugcauguaugcauacaugcauucguuuguaaacauguaugcacguguagcgauauucuuuauucaucagaauauucaucagguggaaggcacaggcugauuucauucacagcuauugagaauacugcugcagagagcacggaacagaauuacaucacugugguguccugaucucauuccuuuggagauagaguagaauccacagaucaucaaguaauucuaccuuaguuuuugagagccccucccuccacccccguagguuuccacccagacugcaagagaugauuguaauuuucauuucaugcagaucaauauuuaggauugggauugcuaguaauauggcaaauauauguugagcuugaucuugcuccguuguuuuacugagugacagacacauuggaauucccaccaaccgugacuuagaacucuguagacacucauucuugucagcccuguucuuuauucucaguuguccucguaugugauguuaugcauugucaucugaauuuggacuuaauuuguauucauuaauggcuaaugauuguccuuucaaauauaucguauacccauaaguguguuucacaugcuuaucucauuugaagacacauuuguucauaucuuucgccuauuuggaaaaagucuaauguuuucuugcugaaugaugagagucuuugauucuguauagcaaauacacgucauguaauuuguuucucuccaccugggccuugacuuuuagccuguugacagucuuugaggaguaggaauuuggguuugauugcagccugcucuaugagcauguuccuuguguagaugaggccuugauguucuguguaagacaucuuugcccaauccaagagaacaaaguuucuuuuaacuugugcuuucuauucaaaauuuauauuuuggggcuuuaugcucaugucauuauguggcacaagguuucuuuuuuucuucuuucuuuuuuuuuuugcauauggauauccugcuguucugguauugcuuauugaaucagcauauuauucauuguaacucauuuuaaaauucuauucguugcauguguauggugugggggaggagggcuugcaaaugggugccuguggagaucagaagacaucuuuuaggagcugauuggccccuuccaccuuagcaagggugcagguccucacgcuugcucagcaaaugccuuuaccugaugugucaucccagcagacccucagucucucuuuuugaagccccaggauaauacaggaguagugcugagguaaaucaaggagaagugggaggcauggugaguaacuggcagugagaucauaauauggaaagugagugcuugagagcacucuggcucuggguccugcugcaugcgggccauggcaggcuuucuucuccccuuucucuccuguaauugggagacuuaccgauacuuggccaagcuguuuugcuuccaauuagauaauguguguguaacuugggagauggaagaugcucaguauugcuggcuguuaucauucuaaaaugauccauuugaaaguuccaagaacuacaguauccccgguuccuguuauuugaugauaagaaucugaauugcucgccuaggcuucuuggcagcuuucgaagccuuccugcuucagucauuagucaucucuuauucccuuccauuugccaucugugggacuccaguggucccuguguuagggugcucaauauucuucauccauaauguccuucucacgcccccccuccugcccagcuuauacuucugagaagcaagcuggaucuggcugcccugggcuuugaggauacaucacugccuuccaccacuaccaccuccacccuggucccccuacaguucccugcauagcucugagggcaaaguggacgcagauguauguggaucuauaccuugauuuuccccaaggucuccuccaucugagaccuacgcuucuuucaggguuuucugugugaggauugcuuuucuuagccagcuguggugagagcacccugcgcucccaccacucaggaggugguagcaggaggaauugcaguucaaggccaaccuuacuacaugcugagcucaaggccagccugggccacaggagaaccugugcuaaaauacaaaaaaggagggagauaacugauuuccuugcuggaugaggccacacuuggacccauuugcucagaauaagacagaaguugugaggcaucaugggauaaaccucccugcuguuuauuccuuauucauuguaguucaggaaggagagaccacauuuugcuggcccuaagccugaaacagacuaugagaccguauaucuauucguccuccuccucuucuuccccucccuccuccucuuccucuuccuccuccuucucuuccuccuucucuuauugcucauccuccuucuuuuaagauguuugagucugugcacgugugaguguggguauguauacagugugugccauggcacauguguggaggucagaggaugaccuugaaugucagcccuuaccuucuaccuuauguagaacccuccugugucugugugggcccuggccaugugagugcugggauuacagacacucucuauuugguuuguuuucccuuggguucugggcaucucaauguuuucacagcaaguacuuuccucagugugucucugcagcuccugaaaauacauauauucagugcucacagcuggagcaucacccucguagucagagugcaaguaccucacugcacagcagcagugggcagcagagggcuccagaaccugcagguagccacucucaugacagugagaagaacagcucagauuucagagaugggaggaugugcucuaauccccuuccucgucuuacucuuugcagaaguggaaugguucagaguuacuuuuguuugguguguuuccucccuuaccuacgcacugaacucaaaagugaacuugaacucugacccuuucugucugccauacucgccaaugcccuuacagucuguagaguguacuuaguuguacucccaccagcacagccgucuacuagugucucuguuggaaugugggccaaggugagagagugaguuuucuagcugcuuggguggggcuucaugguuaauaggcauaagcaguuccgaaggauggaacugauccauuugaaagaacaacgugaaccccauuugucuccauuucagaaguugaccccgugaccuccccagcacccaccaaugaaauuuuagauuaccuaacccacccuauaaauacagaacaacucacauaguagucaaucaaaguuacacuaauaucaccgcuuuggccccuaccaaucauauuaaagauugccuaauccuucuagagagucccccugguucccuguaagaaagccugugugccuuugucuggggucgacauuuuggacagugguugaccccgcacauuggucauuucugcagaauaaacgcucuuugucuuugcauacuaucugagucuggggucuuccuuuagcaacuuucagacccuuacacauucacuaguccccgggaggauccauagugucacuguguaauucaggugugugacuuaccagguguguguccccccuucccagaccccugacugaaaaguggcucugaggcuccaccuacauagcaaacauagcaucuacaguccauccuccauuuucuguccaaagcugcugacaugauggccagagaggcuuuuugcuauacacugaagaucccaggcacagagcauguugcuugcuuaaauucauaagcagagaagacagggaaaguuguaucagggucaguuugaugggaauagcugcaagagauaggaaggcucuaguucagaauguccaccguagagagggaggaagugaguagugccauguauaacuaaauaacuggaccguuagguucaguuggugcagccaucauaccguaccccagaacucccaaucaagcucagggcugcccuuggaugugggggucaaaggugaaagguugaggaagaaauuggucuacgaugauucucacggcguuguuucgagaaaggcuucugagaacucuucuugcauauccaugagagcaguugucuguaaacacagaacgccagccuggucugaucaccagccaggaaauuggcagauggcauguuucagauacucaccugcuuccaaggcugucccugggcgcuucuggacagguuaggacacucacccguuacacugagguguggcugucagaacaugugucccugcagcuguacccccuuuagugaggaagcugcuuggucuccauggcuguuccagccuguuuucuguguucuuugcaccuacauugccagucugcauggcagaucccggggacugcaauaauuaauaaugaagcuuucucugacucuuguuuaaaauguaaaguagggaucuagaaucacuuuagccugucuauauuguuagaacuggaaagcugcagcuaaaggcccuuaaacaguugucccuacacuugucauuaacuagcucuaggcaauaaauacccucauccuuaacuuguaaacaucuuguucugcucggaauuuaguuaaucuaggcauuuucucaauaccuucuuaaugcuaauuucuuaauuuauugugcccuuuaaucuggaacacauaaaauagcagccaauuaauaaauuaugcuucuuacaacugaaacaaaagcacacuaauuauucuaaacgauuaggcugcacucgacacaguagagggccucaguguguaacaaucucuccagaagaugagaguugcccaaauuuuacauccuauaacugaauaucuucuuuucaaggcagcuucauuuagggaggucaauucaaaccauugugcagaugguaaguacuaacugcccuaauagcgugucauuguguccgagcuccacaaaagauccaggguagcauucuccacgagcuucauccuguagcugugugcaggcggcucucuaacuuaaaaagucagagaaagcugccgcagucagcggagaaagguggaaagcagaagugaggacagauuaaggaacugggauugugcaggcucacgaagaguccuacccggggcugucugagcuuccuggcuuccugagcuguggaaacagacagagacuacauguagcaugguugacuuuguuuuuaauaggcuaccauuucuucuguggaugucuucuaagaaaagucuuucccaaccauuuggccucugaauuuucccaaaguuuccccucuuccuaguuucacaaucuguugcucuugcuggauaacuccuuggaggaaugagauguuuugaagggggggggggggagggagaaccagacauuauaccaaaaaauauuguauaaaauuauuuuucuuguuuagaucauucuacuuuauuuguugcuucuaugacaacagucaacaagaacuugugcaucccacugugcucuuuagagaccuacaaggagagccuuucaccuaaagaccccuuaaaagcaagucacaguuaauaggaagggucaaugcugcagggccaugcccacauuccuacagagacagucccacauuccugcauuagucugcucucuguuguugugauaaauaccaugacuaacuaaggaagaaagggguguaucucaucuucugucagcgagggaaguccaggcagggacuagcuggaguuaggcaccuggagcaggcaccuggaggcaggcaccuggaggcaggcaccuggaggcaggcaccuggagcaggcaccuugaggcaggcaccuggaggcagacaccuggagaaggcaccuggaggcaggcaccuggaggcaggcaccuggagcaggcaccuggaggcaggcaccuggagcaggcaccuggaggcaggcaccuggagcaggcaccuggaggcagacaccuggagcagugaaggagugcugcucacaugcuugcuuucagcaugcuugucuucccagcucccguagaacagcccauugagcuuugagcccucaaagucuuuguuagaccaaaguuccaaagaauuccacaauccuucccaaagcagcauagucagaucggucacagccagcaagagcccauuuucugguacugaauuguguuagucaggguucugaagaguaacagaaccaaugggacagggaaaauguaugacuaggagaaagugacacgcugacagagugccugggauuucagaccuugugcuuguguggguuccugccuucagcaagaugcuucugucagcuuuauuagagcagugcuccaucugagagccaggaccuacuucagauguuaucucagcuaccacuaccaccacugcuaccaaagaaaucugugcuacagcuuggaaaauguagcuugccauaaugcuauugguuugauaaucauguuacgagcuguuuuccuucuggccccaaguucccgcucuacugacuuggacucaaaauauauguacaaauaccugggacauauagcugggcuuguuccaugacuaacuaauaauuuaaaauaacccauuuauacuaaucuacauuuugccacguggcugguuaccucugcucaggcacugagugucaguccuccucacaucuuccccagugacucuucccccaggucacucucucccagaauucuuuccaccuaccagaugucccaccuuuuauuccaaccuuuccuauagaccauagauuuuuuuaauugucaggugaugcauccauaugaaacacaaguuauucucucuacaauucucccuuuuaguccacuuaaaggcucuuuuucuuaaaauaauaaccuaugcaauaauaacaacuaugaaaacuauuagguaagauuuacauucacaauguucaguucauauguauuuggcaacuuaggagaaaguauuugauuaucuaucuuaucuugaugauucagaguucugcaccuaaauaaaauuccauccuaacuuguauuaucauccuaaaaacaucuucuuagaccuaaaacacuuucuuaagucgugaacaacuuaaauguaauugugaggcuauaacuaucuagucuucagccccaucagagacuugagaaggaauaaauauuaccugaguaugcaggaaguacaagcaagcagccuccacaauuauagaagugacagagaacuguugccuggacagucccccaaaauuguccuuauaacuuuggagcauccgucugcagccuucuggccuaguauaucuggcagacuuuuugugaagcaggaauuaggaaaggcugcuuacccuguccuggcaaagcucagcaauugacuuccauguaucucucuuuuucuggacauuuugucuacaguugcagaagggcaguuuucugccuaguggcagcuugccacauauaaagcaaauuccauauggaacuucuucaguucucaucaacuagucuccaagaguacuucagcaaugggcagaagggcuuuuaauaagguccgggauuacuuauaauuacuuuguagaccuugaagauugagcagacagguuaagcaggaaaagucacuaacugucuguuuagggcaauuacugguuaucuguuucaauuucuacaccacucugaacccugccacauuaaggaauggaggagcgccacccaccuucuccagaaagugugauggccucuguaacagccugcccguggaagucccuuuauugacucagccauucacucugcuaugagcucaucccaauaauuuucaccugggaaaauuacaacugccaccacccagucuuucaauuaaguacacugcgcugugagauguaucauguagauuuuuauuaauuuaaauauuuuaugucaacagaagguagaucacuauuuaccggugcaaugcugugucucacagaacacauacaugucaugguaaagucaucagcccaccucguccuacugcagagcagaugugugcugaacggaagcugggacccagggcgcugucaggcauuucuuuacuuuucagucauuagauaguugacuuagagacuucauugacaguuucuuaaauuuuguucuuuuucauuucagcaugccuccccuguuucgggaaauauuuaaaaagcggcaccauccuaugcuauacccagcuacucucugcucccggcaguccucagcagucucgccaccacuaggcuagccccaugcugugacccaucaugguucucuuacugcggauuccgcucacauucccagccguccacccucuguggucagcagucccaaaucccaguaacccuguaaaaccaaaacucuagaagcuucuaauuuaucagucagauuuauauaucaguaaauucucaauucacaagauggccauaccauucauucagagccaguugauauugauauaaauugccuaccuagauaagacaaauugucccguaauuauccaucccuuauaugauauucauagcuaccuguggcuaaggccacgcagacccuggaucgucuuccucucccuccaucuuccuuccuucuuucucuuccuuguuuucucucucuguuuccuccuucuuccccaaucuuuucagcgccaccuucccuuccgcugcccaaucaccggcucuagccuuuauuuuacaauuuacaaguuaagauggggagaagguucacaagaagucaccugacucacuccuguccacaaccccuccugggaaaguggaauuagcaucaaaauacaaacagcaccaggacuauccacagcacuccccaaaucuaccaucucaccaccuaucauuaaaaauaggcguggagucauuccuccaaauuaucuauugagguuuggcuuauuguagucacuucaagccauagauggcccaacaggcuguucauguagagaggaggguuggugacuggggaguggaggaugugcaggccuuuguuguugaaaacuuggagaagauuucacagcagcuaagugaaggcagcaggcuugauuaaugugaguacuggaaaccuaccuuuccugugcaaagaggaaguuaaaugaagcagccccaacugaugacaggccaucuuugcuucuuggugucuucugccuacugcaguaaaaacugcaauuucuugaggauuuucuccagcagcaugcucucuugcuuagacucuauaaaggugcguuuuaaaagccugcuucaauggagcccuucuaggcuuguauuuuacauggagaccucaagcugucuucuuuuaggggcuucuuccgaagcucucauuagcaagaagcccuggccucagaaggguagccaguugcuauguggucuagcaucuguguacuuucaggcucagcccaggcucuugccugccccagggacuuuauacuuggcucccauggccugaaacucaaacaggcccuuccugaagcuuugugccugccuggcucuuuccuaugcccccaccuucagcuugagccucaccacacugugcaaauugcuugccucuagaccaucuuuuuagauuauaaauuauucacuuagcacaagcauucuggaucauuuguauuuaacgccuaacuguuuguauguugacauugucagcccgguucucuggugugcccuugauauccacgugguaucuaauaaaucuggauuccacagaagaguaagugcaucaauaucauuacuagaaugcucuauguuccaagcaucucuauuacuggaugcuucaugaugacuuuugugcguaguacaauuucaugauauuuuaaaugguaagcagucaggaagggauauucugacccuucaucccccauuguaaccguugaacauggccugucccacuuacucauaucaagacucacacccuaacacauaagacaccugcuggaaagguagaaccuuuuuuccagugccauuuugauagaguccuuccuccaagcaguuuaugcccugguguuauucuucucagaaggugcacauuaccuugggaagccaagcuguaguaacagaccaggggaaugcacagauaugugaguuuucuaaacuauugaaguucauaaauacuaccugauaaagaucuguauaguuuuauugauuuccuuguuuguuuugguguuuugagguagagacucauuagcccagguuaacuucagacuugcuauguuguugagacugaccuugaacguuuccuaguccuuuugccucuucuuuccaagugcugagauuauaggcaugggcugccacgcccagcugagaucugaacaguuguauaguugaaaaaggagaucuauuucauagaugcucauaaaccuagaaagggaggggacuguggaggccccccucugauaucaggaugcucucccacaccauccagguugagcaagcacuaggcuccuacagaaccuuuaaugaaggucucagcacuuugccuuugagcagaucacucuccuguuggguuucucugguagugagaagugauuacucucaugaacugaaggcugccucaucugacuuccaucaggguccuagucugucccaugcagcugcaaaggaagaauaaauaguccuuagcccuccugccaguccucaaguaggcagaaucuggaagcacugugccauagcaaagugcacauaggcuuagcaaggugcacauagguuuagcaugauacacauaggcuuuggaaucacacagcugggacuuaaaucugucucuaccucuuugcagcuacaugaguuuaaguuacuuccuaucucaaccacaugcuugucaucuguaaauuagggagugaacuggcuuuuaacuuuacugagaugacaaaaagagauaaagcauuuauaauaauuaccacaauaaaucucaauaaauguugucagguugcuagcaucauuugauaugcagcuagccagcucuuugaaacuuagccuccucuguagacuauggaacaugguuccaaccaaggauagauuccaguguugacacuagucagugcagaaauacaagcagaaauguguccauguaucaucucauggcacaccaugaagaacucuguaauaccuuguugaaucagaugaauugugucucaagauuuuauuuauugaagacauuugacacacuggguucagacuggcuggcuuugucgguaguguuuucuagaaaacaacacuuuguuuauucaggucuuggugaaguauuggucauugguagacagguguauaugccacaaaacuuccguucugcagacugcaguugccaacacuaggcugcugcuauaguuuccucucaguucuuugagaggaacuuugguaauuucaugacugcauucacauagucccuuccauagcccagacuaugguucaucuagaauuaaugcugugaacuuaacccauaucaguauacaguauacuugauuauaucaacccagcucucuccucucacuuccuccaccccaucgucggcauauuccuucucaccuuuauauucucucuucuuccucuuccucccuuuuaaauaauguauuuaguuccauuagaacuaccuacauauugacauggggccgucccagaaauggacaacaaccaccccaaggcccagaaaaagaaaauggcucucuuucucccagcaaguaucaguuaccucagcuaggggugaggccucgugaacuccuccccaucuauuuugggauguugacagguuugaucaucuucuguaggucuuacauagggaacuguaaacacugugaguuuaugaguguaacggccacgccauguccagaagacagcauuucauggcuuuccucccaccauuuggcucuuccacucuuccuaccucacauuccacaauauucucuaaguccuggguaggggcugguauagauauuccguuuagagcugagcaccaacagucgcuaauucucagcacuucugucuggacugcugcccagcacaaaaagacgcuucugcaaccgagguugaaagcagcauuaaucuauagguauaaacauaaguauuuagccuggaguuugguagcguauccauguagcaaaacgacaaugguagguccucucuuggggccuuugauguuaugagugguaagcuuuuacucaggucuauaguauaauguauaaauccccuccuguggaacaggucucagauccauuagaaagccuuuggugaccuccauaagucaccccacuauugcaccccucggcacauguugccugaauguuuauauuauaguauacagguccaccauugggaauguccacugaauaccuuucucuccugggggccucuauagcacauucuaaugcuaggaaagccagcuuguaccaaggaaguucccaguacaguuccaguuugauuucucuauguccugcagccaacauguguuguguccucagcaguagggucuugcugugucauuaugguaggcagccaggagcacuggccacaaucaguguugucagagggcccccugggccucacuauccaauaccucauagggaagugccccaugccugguacugagauuuuuuucuuaaugaccuguguuaucuggggaaagacuguccaucuaugcaagguaccucaguucaagcuucuucuaaaaagaaucuuauuuuuaauagcuuagcaaguaguaggcuuccauaaauguuuucacagagucuuaauuuuggccaacccuguccuagagcucucugcucucccauucccccucucccaccugacuuaagccuucagcucccagcaugucuuccuuauucuaaaaagcaggguuucucccuagucucucucagcauuccuuuaggauugcguaucuuagcaacaucagggucuuucugucagccgccaugucuccucuggaauugcacugcuuccucacaagagcccaugugagcccaugguucuggcuggcuccuuccaggugcccugcggccuggguccucuaguccugcuccuacugggaagcuccuuggggcugguuuccgucagcagucugaggguuuucuguagaugcugaaccaguguguuugcacaggcuacagaugagccaagcccgccugcucucaaagugaugauuggacagcuuuauaaacuuagaaucuccucauuagcaaacucugcggcuucguuguuacaaaacaaaguucuuagauguggugugguagcaccauccaucuuccaggguuagccagucaccaggcagccacagucccguuuuauaaggcaaaucuuagcuggagaaaaggaaggucauuugcuucugugagcaaagucucuucucucuguguuuggcguccucucuucugcccagccucauguucacuucggcucacacccugagcucugcuuuucugcagcccccugccuucucuuucucagccgaggaugacgucagcaguguguucccacugcucuagcaccuguaaugccggagcuacugaugaaaagccccgugugccaccguuggacaccguagcugcuccagcccuuccuucugcuaggcucuugccuugccaagcuguccuguauguccucacuuggccccuccuucaccauagccuccugaguccucucuccuauucuacuuucuaagcccuugcuccccugaugucaguagaucagugguaaccaaggcacaaugggcaaggacaucaaacaacuuacugcccuccccagcccauugcuuucuucugauguugccuguggaccagccaccaucucugcuucugugcucuuggcugauucuucugagucuccccuacuaagccuucacuccaaauccugggcagcaaagguccccauuccugcaccccaccccaccccuaccccuugucccagagcguguguccuaguugcaaugugugagauuuagaaaggagacaugugagacauguaacauuguagccaccugaaguuaccaugugugagguuuagaugagauguaacauuguagccaccugacuguaagccucuccaugccaaaacuaccugucaucugaaccugcaguuucaguuccuggccuucauguacaguguauugaaguagagaccauuugaaggguacaacauucaucauggugauguguaucgaucacucuguauaucuguuguaaauaaacuaauuugugcaaacccagaggacauggaagaacaauuuuaaaucaaguagacaaaagaaaacaaaacaaaacaaaacaaaaccccaaaccaugagcacuuucagcaagucauaaugauguugccugaaaugcugcauauggucccggagaucgaagccaaaggcugaggguuagagagauggcucagccauugauaaugcuugcugcccuugcagaggacccagguucuguccugagcaccuagguggagcggggcucacagcaccugugagucaagcuucaugggaucagagucccucuucuggccuccucuggaaugccucccccaacacauaaauaaaagccuaucuuuaaaaaacagaucaaagagccaugcagugguggcgcacaccuuuaaucucagcacuugggaggcagaggcaggcagauuucugaguuccaggucagccugggcuauacagagaaacccugucucaggaaaaaaaaaaaaaaaaaaaaaaaaaaaaaaaaaaaaaaaaaaaacccaaaccaaaccaaaccaaaacaaaacaaaaaacaacccuaaacagaucaaaggcugaggcccuccaaaccugguagucuccagacuugauuauacaugagagucacaaggaaucugaugucacuagagcaccugucugucccucuauugccaaggugaccugggccuauguucuuaggagaucuugcaggcaauuugcacacacauccacugcucuaagaucuugaggaggggaagagcugaaggaacaaauacagucuuccugaggggaagccaaagcgcucggcaacccggaaguaccucccugggauguggaaguguguguguguguguguguguguguguguguguaugugugugugugugugugugugugucugucugucugucugucugucgucugucuguguagagugugcaugugaauaucugugcauaguauaugucuauauguccuccugugcagugugugugugugcauguguguguaucugucugucugucugccuaccugccuguguagagugugcaugugaauguccacauaguauaugucuauauguccuccuguacagagugugugugcaugcaugccugugugccugucugccuguguagaguguguauacucuaugccuauauguucuccugugcagagagagagugugugugugaaugucugucuaugcaauuucaguagaguggagagaaagaugcugcagccuagcagaguaaaccaaagccugugacauacaaagacaagcagauacauaacauuccagcuccuguuugugacgaguaacggaagccuucacauagagagcuuucucagugcccugccaacccauguucuugcacugagaaagagguuuuuauauuagcuuacuucaaaaaagaaacccuuauacauuccaguuuaugaacacuuacuaacacuaaguuuuuacuuucaaugucaucuggaauguuaaauggauaguauaaugguaauggcuagggccauauaauuuggacauacaaagaguauaacccaaaaagaaaauaauuaaaaagaagcaaaaaguaagaucuuacaaguuuccuuaggugacaccacaguaccccuggcacuggggacccugagaugagaagagagaaucacagcauuuuguguaccccaaaugccauuuuaggacagccaaaguuugaugaggaccuuauauuacagcaauauaguuuauacuuauacuguuuggagccaaaaagauuugauguugucagcaugcuggguuccagugaaauaugcccaggacccuggcucagugaacacccucuuuggggagcuaaaauguucagagaaugcauuugagucuguauuucuagaucuccccacaguucccagcagguccugugugcgaucccuugccccucuccagccuuucucguugggggcugugaggccauagggacaccuccacucacccucuggggacguuuuuuuggaguaccgucagaccucugucuggaaagcucuguuaacagucaugcaugcucaguuuauaagacgguuacaaggaaauggaggugggggcagggugccaaacacagccagagcuuuuaucuuugacauuacaaagaggucucuggcccggggccaggcuggaguuuacgggaauauaaaaugcagacaugugcuuucuguugguggggcgccaggggaaagacgggccaugcagccagacagcacuucacuucccugggaugcacaguugcuaagaagagcauccgagucuuggugguucagagcagggucacuuguggcuaugagguaggaugaagaagagccaugccauaugcuggccuccucucuucccaaggugaaaaagggguggcccugucaaccccauagccugggagugauggccuucugcagugaccccugcaccccucaggagcaccagacuccggaaguaugugucugcauacuuauugaaagacaagauagaccuccucuacuuuuaagcaaaguuuugauguuguaccccucaaacugugacauagucuucuugagcuuuuuguucauuuggcacgaggucagaggaguccgauguggccucauuaagcauaaggaaguucuuguggauuugugcauccaagcucugaaaaauaaaagagagaaagauagauuagugugcuaccagaaguugcacuaacagauauuaaggcguggcuucugauucccuaaugacauaauuuucuuugguuaccccagcgcugaccuucuuuaaaagugucucuacacuugugucacaggacugacugguuaucugaaauugcaagugugggccccagccaaacucaccacuuguuuggggauuacagguuaaguaaucugaugugcuugucuuaggagauaaacaaaugccauaagcugccuggguuuuggcuaucaccccuacugaccguuacaaucauggaugucaggggaagcacacaaauuaaauacccuugguccaagucugggcuuggcaacaggcggugccauguugaguacagucuuuguucugugccacauacucucucuguucuggcugggguggugcuggagaaaacucagcuuaaaauagaaggaagaaggggaagaaagaaggaaggaaggggcuugcaauuugcaggaccacacaugcucaaagucucuacucucugagucuaagaacuguccucaggcaccgcagacaccuaugugaccaauggacuggaacgauuaguuuccaucuccaugguaaccauaaucgaguuuucaccgaggcacugggucuagcucugagucuugcaacugacuggccaacagcagagcugggagcugagucccaacuccuugaugcugcuuucgugguuucugccacacaaugccucgagccugcgaccuaaaauuguccagugaucaauucagugcuggggaucaagccaauggccuggcgagggcucuagcacacagccagcccucauccuauuuugaaaugucuuuggaacgccugcaucuagcccauccuaaccuucaccaucaggauguugccccuuaaaucuguucuguuguaguuugaagcaauuuccugucuguauguagaggugagugaaagcagcugcucccaguaagggacauaaaaaagauuaaggagcagagagcugugguuucagucuccauuaaaauaaaaccuguccugaaauuuggggcacgcagggggcgggguguacuuuaucuucauggcugccugcauuaggacaguuuuccuguaaaaaucuuugcauuuuucccagagucucaaaccucccaccucgugguguuuacaaaaggagacuggcagaacucggccugagucacaugcauuuacagccgcacaagccauccguuggauaguuucuccacaaaugugaaaagaauucguuugaaugugccuuugcgagccaagccaguagccucacgcuuuguaugauccccacugugcguucucaggcgcuugacucugcagcauggggaagaugcaaagaggugcucccuuaaauauccucccagaauguuuaacugccucugcauguugguccaucaugccuguucccugcagaaugcugccuguaaaaacggaucgucagcaggcuccacugguguggcucagcucucagaaagccccaacuuuuguagaugcggguguugccaguguaaauggcuuuggugguugcaggagcuucgcugugacgugaacguccccuuccuccuggaacuucuccgucacuggaaauuuaaccuugaaccugagauggguugcacggacauugccuuguaaaacuguguaguuucuacaaagccgguuugugccagagugaaaagcagacacaccuuugcucccuaaugccugaucggggcacacagcaguuugauucugucuuaaguagcaagcauucuugccuuucccuccacaccccuucgugcccacugugcccauuggcugccgugggguucauacaauggugaaugcucugguuucagccuuuuuucccauguuaugaaagaaccguuuucucccccuaaguuaaaccuggacugcuuucagguauuuuugccaaaggaaguggaaauugguuccaguugauguuuccuguuaaucauaaagguucuugaaugagccugugagcuaaucuauuagucccaguauguuauccaugaaccaaaguacugcagucaaagacacugaagauuagacuguucccauccuggguuuuauuucagggcucccugccccucuccagaggacaggcaugcuauuugaaccguaugcuacuuucuuuuuaauauaaaguaacagaguaccccuucuuccuuuuaacacacuggaauuguugccucacuagggaaguuuauaaguguuccuuaauuccguuccgauccuauccuccuccuccucucugaucaaucuaauuagaguuuacguggggaucggauaacaggaaacacaggaaggcagaucgcccuucucuuucuccauuuuaaugagaaccaucugaaauuaagcuagcacaagaguuccaacaucaagcgcuugcaaaccuagcaaguagaguugucuguggcuuccuguugcaagguaaacccggauugguaccucuaaugcuucaucggauguugccagcagccacuucccaaggauguguccagccaccugugccaggacccuacccuauugaggaaacuuggcucucucauuccuggugacuacuggccccugaaaggcaccgugucuacuuugaaaccagaggaagccucuggcuaguugaauccagcuguguugacuggcaucuuuuuuuuuuuuuuuuuuuuuuuuugugguuguaagauuuuuguagaaucaucuguuuuuacauucaagaaaccaacucugggguaucaguuuaccaucuuuguagcaggggugugugugaccuuaauccauccagggagaagaggcuggggaacuuugggcaagagaacuugaagugacuucggaugauguuuaaguagaagccagggaaguucacugaccccacuucccagcuagcccuugcugcuguuguuugagaauauggauccugagccagugcgggauuuuguguuuuaaauuguggccaguaucuggguauguggcaaauaccacacugcagugggaacauauccuucuccaacauuguuacagugguauaauaucagaaaugagucaaggcaaaaguauuguagaagaaaaaaaaaacccucaacauucaguuuccuugguuguuacucucaauguuguuaaauuaagucauugauuuuguucuucuaauacucuuagccaugggucauaaaaguuaccaucacucuccuuguucauccguugcgcccacauguuguuaacugacaguguguugcuauaggaacugugaagaguggcuuccagggcuccauggucaagcugauccacagggcagucauuaacacccugguggagugcagaaagggccaggaacuaaagggacaaugggaagacgccaacacagugagggggggcgauagaggcagagggaugaucaguaguguugccccacuccuguaggucugcagguaggaggcucuguuuggaaaaguaggcaccagauugaaagacaggccagacacauaggugaugcagggcacauagaugaugcagagcacauaggugaugcagggcacaaaggugaugcagggcacauaggugaugcagggcacauagguaaugcagggcacagaggugaugcagggcacagaggugauacagggcacagaggugauacagggcacugucuuaaucaggguuuguauucuugcacaaaacaucaugaccaagaagcaaguugaagaggaaaggguuuauucagcuuacacuuccacacugcuguucaucaccaaaggaagucaggacaggagcucaagcaggucaggaagcaggagcugaugcagaggccauggagggauguuacuuauuggcuugcuuccccugguuugcucagcuuacuuucuuguagaauccaagacuaccagcccagggauggcaccacccacaaugggcccuccuuccuugaucacuaauugagaaaaugccuuacagcuggaucucauggaggcauuuuucucaagggaggcuccuuucccuauaauaacuccagcuugugucaaguugacacacaaaaccagccaguacaggcucauaggauaacugauggauuugauggaauaugaagaacugggguggucaggagggaagggaggaaguaaggauacucagguuuaccugauggcagcucucaggucagcucccacuuagcuauuuccacauuuuuacugauagcuucaagacuggauauugaggcaucccaagcucugcgggaagguuguuaccaggggcaggacucagcuggcucugugccaucucagucuccagaaugguccagugggagaugguugccaggucaggaugcuaaggguaaugaaaaagaaggcuucuggggacauuucauggguuagcccuagggggugcccggaccagucugaucuaauuguauuugucaggguucuguagaucagaaccugauaaaaucacuguuucuauuuaaagauaguugauuaaauuagcuuauguaauauggauggacacauccagcaaugauuuucaggaaccagagacaagaacaugaaaguugcucagccuacaaggccuguaagauuucugaaacuugcaggucuucugucuacccuggaaacccaagaagcugguacgagaaucagugaaggaauaaguaacagcagcagcagcagaguagaugaccucacuacuagugaaggccaggccaacaaagacacauuuuuuaaaaauuaaaaaauacccucccuuuuuccauccuuuaucugggcuucuguaagaaagugaccaauauguagggaugaaucuuccuauaccaaucaaaguagucaggaugaccccuccccccaccccauauacaugcccauaaacugacucaauauagacaaccuugcauugagacucucgggacuccuacagcuuguguucugaauuaucuuuugucauuuauagaaaacuuguuuuguucuguuuacuuuugcagugcuggguaugaaaucuaggaccauacacaagcuaggcaaacucuuuaccguugagcugugucucuagcccauaguaauacauugaauacuuuaaaucuauauaagcaugaaaugagaauuuuucaaucuuccacgggcaaauggggaggcacuuguucaagcccuuuuauauuaauuaguaaagcuacaauucaaaacaggguuuccucuuuccuagauaaguuguccggaacgauugaaaguuuuauucauguguuuggauaaggaaaaauagaaauguagauguaugcuuauugauuucauacuucaggaucuggaagaugaacauauuaguuuucucugauauuucuacaaugaaaaaaaagaaaaggcuuaagcucugcuucccuaacuggcuuuucuguuuauauuacaaaguucuguuauguaccuacacaaucgaaaguguugucccguggccuggugcuaggagagaugaggcagacgccacugugggcacagaugugaggagcagauaggagugcagugaguuagguacucagagagcagagacauugacuacaguggaacauuccagcaauguuaaauucagcccugagcugugagcauggccuucuccagcucagacacuaaguccccaucacugucaucaaaugcuugagagcagguuucagagacucugugccuugguuaaguaaauaaaggcuuagugucaaccagcaagcaccgcugugcuccuguugucacaguuagcuguaauccccacaggaaauggcuuucucacccacccugugcacaccuacuggauuugucuggaguccauguuagcuuuguuguuuguuuguuuguuuguugucuuacuguuuuucagaugcuaguagugagucacgguugaagauucuuuagauuuucuacucacugagaaguuucacccuugaagcaaacccaggagacaggcaaagacagaccagcagccucgaaucccgccuuggcagucagggauagaagcugugugugucuguuccucaggcuucgggacugucugggcccggacaucccacaagugugcugggggcaucgacaucuagaaauuuccaaguacacguucccucuucuagauccacuuucaggucauccggcugagcucuguaccgcucgaagcgcugugcuagguguuuggaagagaacuggauaaagaagaguuuagauuuaggaaacugaagaccuguguuuggcuucaguaaacguacacuaagcgauggcuuaugcacauccacaauaaacuacagcucacaagcucagugccacauugcccugugcacucuuaggccugccccugccucagcacguuacaacuugcuguccuucucucuaugacccuuaucugcugcuccuucaucccuugcagcccucugucuaagaccuucccuggacacauccuuuaaaccccacccccaccccaccccuccucccucagucugucauucucaucucuucuggauaaacaugauuggcugacuuguuuuucugcuccaccccagugauuacaacaguuccuaguaggcacacauuacauguuaauagaguuaaugagugaucaaauuaauuaauuucaagaucaaggaggaccgugugcagagagcugcaguagccaaaggucuagaagauaugugugcuggguuccacucgucacaaaccgagaggcuuagaacaauacaauacagacuuuuauuuuacacuuuucuaggucagaagccugucucuguuucucugcacaagaaucaaggcauccauccacaaggcugccuuccuucccacuggccgcagugagagucugcuuguuugcuuuuccagugucuggggcuauuuauaguccuugacucauucaguucgccaucuuuaaagccagcaccugcucccauugggcugggaugugcagaagugaaaagcuacuuccccuccugccucuucaaacugacccuacacacacacacacacacacacacacacacacacacugacguccucuucagccuuucucuccuaccuuuaaaaguuaccauaauuauauuggguaaucuggaauaguuugugguuuuauaagcaucuguaaagaacucaaucccaucuauagcucagugcccucugccagguaaucuaguaucacaucucugggcagucaggacguggaucccuguugagaucuacuauucuguccacuagagggauugacaagcaagauguuuucuuuagagcaguaguucucaaccugugggucaucauuccuuugacaaaccucuagcuccaaaaauauuugccuuaugauucauaaaaguagcaaaauuacaguuaugaaguagcaauaaaaauauuuuuaugguugggggucaccacaaccuuuaccaugaggaacauguuaaaggguugcagcauuaggaagguugagaacgacugccuuagagccuaggacuugaauugccauuuaauaaauauaaaaugggcauauuuaaucaggggugacugugguagcugaagugggaggaagagauggucaaaucgagacuuuuuuuggcagcggggggggggggguguucgagacaggguuucucuguauagcccuggcuguccuggaacucccucuguagaccagguuggccuugaacucagaaauccaccugccucugccuuccaagugcuaggauuaaaggugugagccaccacugccuggcaaacugagacuuuaugaacaugaacuuagagcaggaacacugagagagacuggcaugcacuucuccacagagauuugcuccccuccgucccuucuguguacaggaagagcugggucugccuguacaugugugaagucuuuuucuuuuuuuucuuuuaaauaauuguuuauguauuuuguguauaugaguacacugugacugucuucagagacaccagaagagggcaucauaugguugugagccaccauguguuugcugggaauugaacucaggaccucuggaagagcagucagugcucuuaaccacugagccaccucuccagccgcauguggaaucuuuuucaaagccaucuucuguugcucgugcacauagcacagacagagaacagauaaagcccugguucacagauacaugguguuuacuuccgugugcacagcaucuaccuuggcugcacaugggaucuuguucuccuggucuucauugccuuuaguuuuuuuuuuuuuuuuuccugacccuaacacccacaucauguguaucuuccuacuggcaacauagaacuuacucccacagcggcucucacagggauuggucugucuguggggaggcacaucuccaggaagaugcuggcccuucaccuugacucucucgccacgacucagcauccuggauagcuccuccuggacaccaggcagagcaguguggauacugaaugauggauugaguggugucugaggugugcuauccucuaauuggcuucuuugcagcagcacuguccugcaagacauccuguggguauagcacuguccagugggcuacaggcucuugaaagguggcgaguacagcugaggagcugggcauuuugcugcaugugguuuuaagcaacuuaaguuggaauagucacaagugacaagugcccacucuguuggaugauguaaggaaguaacaacuuguugagcaugccagagaggccacagcgggauuuguggggagcacaugaugcaaacacagccuuuuggggaucagacggcuuaagcuuugcuucuguuauuuugugugguuuaauuuuuuuguuguuuuguuuuuguuuuuguguuuuuguuuguuuguuuucugagucaaguuucagacucaaaacuuucuccauguaguacugggcuggcagggguuggggguggacagugacaccagacauucuuccuguugcuuuuauaauugcuuuccaguaucuuaaagaccaggaggacuucacugucugguccaggguguagacucuguccacaccccacccaugaauauaccagggauggccuuuccuauguaagagccaugugaagaugaauugggacaguauuggucacacagcacagugccccauaccuaccugguacacaacacucggcugcaugcugggggcacauugacaagcuggaaacauggauagagagucaaggugaagggccagcaucuuccuggagacucucaaugugccuccccagggacagaccaaucccugugagagccgcugugggcguaaauucuguguugccaguaggaagauacacaugauguggguguuagggucaggaaaaaaaacccugaaagcagugaagaccaggagaacaagaucccaugugcagcugagguaggugcucaugcacuaagagcacgcauuuaauaaaugauagcccaucaucuuaauggguuuuuucuucauuuuuuucacauuuaaaaagucauuaaaauaugaaaaaaaauaauguuaagauauuugcuucuccauaauuuuuuugugaaugucuggauggguccacaugaguguagcagacuugccuuucuucaucuuagcucugcugauaauccaugcuuggguugcuguacaauuuccuaacaaauagaagcucuuggaagaaauuuuuuuuuuauuuuauauuaugaguguaugugaccgugugaaguuguguacaucugugagucccgguguccuuggaguuuagaagagggcacugcgucacccaggguuggaguuacagugguugugagccauccaucauaggugcuggaaaccaagcuaaaguccuuuagaagaacagcgaguguucuuaaccacuuggccauccagcccccccgccccccaauaacagcuuuauuuuaaaagucucucuuacucuucccuaaaaacaggcuuauugacauauaacucacauauuguucuguucacuggguuuacaacauauagaucaguggguuuuagucucuugguagaguuguacagacaaagucauggucaguuuuagagcauucuuacuaugacugaaggaaucccaaccauuagcagucacuccccaguucccucaauugcccuugccccacucaaucaccaguuugccuucugucucuauggauuucccagucugggcauuucauauuaauggaaucaugucuuuuaagagucuuuuauuauauuuuuauuugagagagagagagaauaugaauaugaauuugagaaugcauguuauggagauuagagagcaacuuaaguucuccccuucucccauauggaucugagggccaucaaguguggcaacaucuacauuuaccuacugagccaugucaccaacccaaaaugacugucuccuuucacucagaauaguguuuuucagguucauccauguuacagcauacacuaauacuuuguuaauuuuauuaugaguaauauucugucauacugucuuuaucugcccaucaucagacaguggauauuucaguuacauccuuuuuagcuaucauggauauuugugcacacauuuuuguugaacauguucucauuucucgugguugccagccuaggaguagaacugagacgauaaugcuauuaguaaugugguguuucuguguuuguuagaagcuucauagcaaacaggccaggagacaucaacaauguggugcuucaucacacauuuucuuggcaucaugguaagaaacacaaauaggccaacuguuugaggagcugagaagcccauuuuucaaagccaugccacucaccauacauuccaccuguggagcaucagccuccagccccucagcaucccuccuguuccuugcuucucaguagcaagucggagcuguguugcugggcaggagguggcaucucacugugguuuugacuugaauuucccuaaugauuaaugaugcugagugcguuuucaugugcuuguaggccaucuguuugucuuucuuggagagaugucuguucaaauccuuugcccguguuuuaauugggccauuugucuucuucgcccgucuccccauuuggccugagcaggaugcugacaugcuaacgggugacgagcaaauauggaaggagguucaagagucgcugaagaaaaucgaagagcugaaggcgcacuggaguauccuuucaccugcaggcugagcugcaguguuggcugcugcuuugcuggaaguucggagucgguggacccagagcaaggucugaaagugguguggggagugguccagugguggggagccgcccaggaagacugaggugaggucagcacugaugcucuacaaaaacuaucaccaguuaauaguauggcccaguaauaccacugauugcauaccuuacuaauaguggcuguacuauuaguauacuaauaguagggagguaaguuguagguguuuuguuuuccucugugugcaaaagguaaaacucauagacccccuuccaccuauaaccucucuagucucuggaaaggaaugugugaauccuuauaauuuaacaccgcugacccucagcccuacaaaccagccagggaacagcaguggugggauucucgguuauacacuuucuuggcauaaaugauaaagaaugcaaauaggucaaaguucagagccaagagagacagcaugugauggcauugucuaggauucccggacggcaccuuacuguguaaagggacucccaaaucagggacaggauuccgauaggcauaagcugcgacaggcagaaggcacuguccuuagaggauuccauguggacacaagugugauggggaacugcagguaugaaagaaacuuuaaacuaugaaaugaucaccagaggcucaucagacacuuugugcugaccauacccccaggcaggaaugaaaucugcaaguaagcuacccaaucaguaauguuagagaaucgugaaggacagagaagauagguaggugagcgguucuccucuuaauugugaguuacagaaaucaguaguuagguaaguuuguuaaagagucugagcaaugaacucauaguugguuaauaagaaauagaaaagaaggcugccacguccaggcugcuguauggauuuacuacgagauguaaaguuugcaucuagauuucauuagaggguuugaaaagaaguagccaggauauuuggauacuagcagauccaggcaucuuacucgaugaucaaaugauacaaacgucacucuggggggcucugucuccugcaccuuugauucaguacuucaaagagacuuuccaagcauguguagagauggaagggaaacagaggagagacaguagaaucaagagcucaguagauccuuggccacuuaaauggcuauugaauuccagaagaugaacuucaacaagaauguauagaaagucuucuauuuggggcaagaaguugaaggacauaaaucugcauaaaacuuggcagcugaacacaggaaaggacccuauugcuuugguaaauagcgaaauuuaauaaaguguaugaguauguucuaacucuccagaggcaacuaugaucuugggcuguagucauagaaauuuagaauauaaaauaagaaaggagguagcacagggcugagccuauguagacucuccuagucauucagucuggguauggcuuuaauaagucggccuguagagaaauuaaauucguuaugaggaauggaacagaauuaaggaggaauuugaaacuccaccugucagcuugauggaagcuauggggaaaacaguuggcucuggguuggcauucauagacucgaaguugcucuucugccauggaugucuuguucucugagguccuacacagcagaagucaggccauagaagacccugaagccuuucggucucaccuggaugagacuuacauagaaacugauucugccagguauuuggguagucuucauccaccaugugauagaggcagaaaugaccaggcacagucuagcacucacaccucccacacagugggacgguaaucaugccaagcacgaggugcugugguucagaugagucgcucucaaagauccaugugucagaggcccagggugccucuagugaggacuauggcugacgcuuaagaggugagacccgcuguggccgugggugauuaucacccaguggcagcagcgcauauuccucaguacccgcuccaguguccuggauucccgaaugaaagacauacacacacagcuuuauauuuuaauaugcccaaagcaguucagugauggagccacucccaaaccuccaagaggcuagcacauuuucuccuucgacauuccugaguuauuacuuacuaaagucuauaguccaucuuugcugcccuagacccagugggugcgggggugugugugugcuggggccgcuccucccuggcucuugaaugauugauauaccucucuuuugcagcucucaauccuggaccuuacuccuuucccagcauggugauucuaaauccuccuucuucucuccauuccccuugcccacuagucccaaagucccaccucugucucccugcccagccauggggcagccauuguuuaacaaucagaaucaacugggcucagggacccucagcaugggcgggauucuccugcaguuuugggaacccaauuaacauaauacaaguguuaaccuaaaugcacaacagccuccugugaagccauugggagaaugccuuuaaggggaccucaucugugccugucucugcuuccaggcuugaaauaugaacgcuuauucugacacccacucccaccagugcccucuggugcccucaccagaggccaaaucaauggggccccugaaacuuggacuugaaccuccauaacucacaagccugucuuugcuucaugugauauuuugcaucagauaguucauuuuaaucaugcaaaacagaauaaugcaauacagacuuugguaaacacacauauacauauauacggggaggggggagagaggagagggagaaagacaaagacaaagacagggauuaaggcuuuuuaaaggaggugauagcuguacuguaucuggggaggugagugggauuuuuggcaagccaugagggagagcaucucagugguaagaaacgugacgauacacagaaggugacaugacgugaugcuggugcuugccagcaugccacccaugaggaaagaagcuagcgggaaugggcacagaguuaguuuuuauacaaagcggcccagaaugaugcuaggcagaguagcaucacuagauguucacagaccuugcucuggcguccugucuuaagaagcugaacuaauccucaagcgacuucauucccaugucugucuaucugucuguccccacccuccuauagucauuuggagcauuugaaagaaagcccccauccugcacucuggucccuucaguucagagcucagcaccucaaaagaugagcaguuauaguagaugccacagguggcaaggcuaaaucugagcagaucuaugacugcauuagcuuaggaagagacuuguagcuaaaauucuuccucccucuggacccuggagcgguguacaugagaagucucaccuuguuugccaggagaugguuuccaacaauguggagggagguugguaugaaguccuuugcugcuugguggaggugggggggcuagauucguuccuaugagugaguacagauuaucacaucugguuuccacuugcaaggcaccccaccucauccucuugaugagacagagcacauuauggaaaugagaagacaauaacaauggggauccagcaagcgauguuacaacaaggcucaagccuugccacagaaaugucuggcauuguguaagagacagccauuccuccugacaguuugucaaacaucuaauccuggaaugaaaagccacagagguuagcacggcaaucuguuucaaaaucagcguauugccuaagaaaccgcuuucccccaaccucugggggauucguucagcaaacuugaaacguccgugucacacacauacaaaggaaaaucaccaacugucaauaacuucaaaucacugucuucaguacgcgaaccccuucugggauccgagccaggacucacccuaagaggugacauaaagggcccucagcuugaaauucucccuaaggaaauggcgcucuggaguaaaguggugugccucagcugagaggaaacgucucuccugggagcugcuuacauuccugguucccagguguggcuuggucgcuagaaggugccacuguugguguuucaggagcagggcuaugcaggcaccagcaguggagaggaguaaaggagcuuuguacccaugggcucaggguguacacaggccacagggugagguugcuguguuaggacacugaugaagaggaccugagucaaaguuuaggggaagugcaugggacggaggagaaaugacucagucuuccauuccucuacucuucagcuugucaggcucagggguugugaccggaaggaaagaggaagguacaucucugccaugugcucugcacacuuuccagccguauccaugacaccugagaacuccgccuagcucaugagaggacaagaaaagauuucccuccguuuuaagacucauuguuuuauuugauuuuuacugagacgggcacuuuauuuucagccuaccucaaagcauuugacugucucaaagcuccaacucugacggaggguggaacuagcuuagauuugaaccaagcuuaaucgaagaugaggcucucuguaccauuucuucuauaguuugagucuucgaauguuuuccccaaguggauuucuaacaucaaagcggaguaguggugggagagggcagggagaugcccagggucaacacaucagggugccagacugcgaugaccccagcugagucccgcacgugcacacacgcgccuccaguggaggaagccccaggacuccagcugccucucuaagaggauggaguuucagucugcaaaggugaggauggaagcuagaccagauaccacaccccuguaggcccaacuacucgggacacugagacagauggguuaguggagccaguggucugaggccacucuggggaacauggagcagcgcauggggaauggaaaaucaccgaagccucacaaaacucauuacugccuuaauuggcacaugguuaaucagaaagucagaguuacuaagcagugggucuccuuguucuuaaaacagcauguuuccuucuucaagguacacuuaaauaacucuucuuaauaauuucuuucuaucuaucuaucuaucuaucuaucuaucuaucuaucuaucuaucuuuauugaggccagaccaggcaguccucugcuguguauguguugggggccucaguccagcuagugugugcugccugguuggugacucaguauuugagagaucucagggguccagguugguugagacugcuaguccuccuacggggucacccuccuccuuagcaucuuccagccuuucccuaauucaaccacagggguccccggcuucuguccauugguuggguauaaguaucugcuuuugucucaguuagcuguugguagggccucucagagggcagccaugcuagauuccugucuguaaguacaucauagcaucaguagucaugucaggcuuuggggccuccccuugagauggguaccaauuugggccugucacuggaucucuuuuuccucaggcucuucuccaucuuugucccugaaguccucccuuccucccucccucccucccucccucccucccucccuccgcucuuucugucugucugucugucucucuacguaguccuagcuguccuagaacucacacuguaggccacacuggccuagaacgaccaacuaccccugccuaccaagugcugggauuaaaggcgugcaccaucacacccagacuuuaauauuuucuuucaguguuuggguuucaaguaagaauacauguauucaguuaaguauagguuuggcucgccuuguuuuauaacaaacaaauguguuucuucagacagcugcaccagccgcaggccugugcacugguguagguuggguugcaugcauguccgggacucggaugagucagaagcaagugcaugcuuccccuuucucccaagggauucuuuuaaacagaaauaauuccacaguaaacaauuggaagcugaacuaaaaacuccaguccaguuuaauaaacaccuuugcucauuucucaacuaaguugaaaggaaagauauacaagggugaagagggauuguuuguuucuuugggaauuuuaauucugcuaaaguacaggccggguuagagacucguuuguugguuaaacagaauuuauuuugcuaagaugucacuugaauggguuuuugucucucaaguacguuuuccaggcugcccuucugugcaaaauaaugggagccuccccccucccaugccuggaaacucuucaugcuuuagacggcucuguucacuucuguguuuucuugaugaagacaaugaggccuuaacuaaguuaauaacagagugggagcagguucuggcgcugugccaggcgaucauaaacagcaauuccaaccggcuucccgacaucaacaucuaccagcugaaggugcucgacugugccauggaugccugcaucaaccuggggaugcuggaggaggcguuguucuacgccaugcgcaccauggagccguaccggugagugcugggcagggcagggcagggcugggacucagcugccuccacugugggcuugggaugggauggccgcuguucugacugauauaagacugcugucccaucaagcauuccuaccagcaguuagcauacaaaaccaaaccuucucucauucauucccguuucuucacauauccgacagucacugguaaagcuguuuccaggauccuugaccucugcuuguucugaaaugaguuaaauacuguugcugugugagaaugggugauuauaauacuguauguggcuugcaguguaaggacaaacagggaggggccaaagaggagcacauggcucaguccucucuuuggaucgacuaugcaggugagggugauagaucugaugcucuuaggcuaacagugguggugggucuccucugucagaauucacauuugucagugauugugugcacacuguuggcccuuguagccaucuugugaccagguaagagaaucggaggcuauucuucuccagugagucauuggaucagagaagaaacuauuggugaacuacgagugauucauuacauuauguguugugcaugcacacaugugugcauauguacauagcaugguguauguguauacaugugcauguguuugaaggcaggaccuagcuuuauggcccaggcuagccuccaacuugugauucuccucccucugcccucuuuccuagccugggcuacaagaauaugccaccauagcugauggagacuuauuuuuuccugccuaugcucagcuccuccagguguguaugugcuagguggucuuguaauguggaagagcuccgagaggaaagggaggcugaagucaagugcuaaaggucugggcaguacagcaacaguuuucccuggacaaagaagagaaaucgagguugagaacaagccagcggugaggaugcagggcagaugaauaaucugagagccgaguuacucagugcccagcacagggcaggucaccacaaugaagacaguggcuacaugggauauaaagggggccgugucugcagagcaggacaccuuuccuggguguagucuuccccauucuacagaugauacauacauggccuagccaaagagggugaggcacggggagaauccagaccuagaccucugggacaugggacaacagguacagggagugguucuaagugaagcagguggggcacugccuguccucccuggaggggagccucgggugacagacagcagggaggggaaauuaccucaaucugcaugucaagaauagaaguagguuuaggauccaggcugucacuaucaagagagauauccauccugugugacccuaggccagcagucagaucugggcugagaagaaccugaagauagccaaggccccuguaaacagguaggugucagagacccacaagccagccaagcggcuccagacccauggguguuuccagacuuuggcagcuggcugcuuuuguucccuuguggugaacagcuuuggagcugucugugagucagcucuaaucuaacguguaagaugcugccuggagggcugagaccagagacuuucccaugagcaguggaaugucuguuaggggugaggaaucuuguggguuuucuggaagaaugaaucaaauacagagagauaaggccgcucucucagagccgcacugagcguugacguggcaagcagucugugaugguuggcgcagucucugaaggcuggggccuggccucgggagcccagaacacaugcagcacagugaauggauggacccaggccaggagcugcagacugagaaauucugccuuucuccaagggcucuguggcagcacagucccccauccuugucuggcuggcuuuugaagcagauucuugccuuaucuuuuccuucacuuugccauccagucuacccugccaaggccaacuggaaauggcccuuuagauugccccaccaguaagcucucaaaguucugauugcauuuuaauccucuuuuguacaugugcagagacuucugcacagcacugacccagccccacuuagcuggcaguucaaccagcgagcacucacgucaaacagaaacuuucugcauagaugaggccacguccuccacagcauauucccucgugugugagaaacuuucaauuacguuuucguggcauuggccaaucacguucucccgguaaauguguguuuuguccucguacacagagacagguuuucaagccuguuucauucucuucucccuagggcuugcucugcagcacgcugcccuggcccacuuccacugaguaggacucgugccauuugccaucagagggacuguagagccaacuugaugagcagucuagaacccacacaguuaagagacucaaggaacacacuuugcccuuucccuuuuagcucaggacagcgauauggggagcacagaccaaugggugagaugccccaugagccccugucaaccucggaacaggaagggaauggcagguggcgauggcuuucaugugcugucagucaccuacacaguggccuguggcugcucuaggccagccuuugcugccguuuagccaaggacacggacaguuagggaggccuggguuacugaucugugacuggauuaccaucugcaggaauaauuugacaaugucaaugugcuauuugucgugcccggauugaggucaagccucgacugagcacuuugucaccguaaccuuggguaagcuucaacugcugaccuuggaggacaguguguccagaucccaucuuugucgagcccacuguuuucaacccccugcuuugcaacucacuuauuuuuacccaauagaucucacuuaacuuuauggugcaauuuacuacagaccuuuuuuuuuuuuuuuuuuauuaagucuuccacaaggcaaaaugucugaggcaaaauguccgaggcaaaacauaccucauucucucaacagauauacauggugcuaucccagaaucgugccguaguuugauuuccaaucuguucacugugucaaaccaugcuacgguucagaucaaaccauuugauuccucuucgugugcugauguggucugauccucauggcauaucaguacaaacucccaacugcuugccugcucuauuucaagucaugcucauuuuaaauuuggguagcuaucauccccaaauuuuacccuacccaccacaaggucacuuuguccacaagggaauaugaauaagaugacucugaucauguaucaucaucauccuuaaguaguaguaguaauauaguugccuugaucuaaauuuauuucaaaauauaucauggccuucuccauccccuuaaucaaagccuauggugagauuuguugauauucauuuuggucacaauaguauuuugugccccugguaaugacacagugugagucaccugggggcaaugcagagaagaagcaauggaaagaacacuggaggccugggugcaaauguccaugguccuaugccauagagagcugggagaaaggaggggugccggggagaaaaagccaaugaaaggagccgauuccagcuuagacagguaucuguccuuucucgucagggagaauagggucagcaggaggagaaggaaaguauggcuggggacuggcagccaugacauguuuacaagucaggagguaucaguaacccaggagaugcugacauuacauggcuguggcaucaccugccauguugcuuguccuuuugugacuagcccaucacuucugcguuuucuccagagaacaguuaaccgagagcccaaggaaauggccggaccagugagggauacaagauacaauuuucuccucggaucucaagugcuuuuuuuccugugauucauugacagaucuuaauauuucauucauuuuucuguugccuuaaagccugacauagacaggacugucuacagcugagaccaucccuauagcaucgcugacccugguauagacugggcugucuacagcugagaccaucccuauagcauugcugguccugguauagacuggguugucugcagcuauuagcauugcuggcccugcaugccaguuugacaucagucugcuacagucugauauagccuaguaaauuauuucacaacaacacguucucaucguguccccacauggcaccccucugcacaggggugccccagagguuuuucugucugucucaaucucuuuuuauaaagccacagauuggauuaaggcccaccacaaaggcuucauuuuaacccaauaaccucuuuaaaaauccuacccccaaaugcggucucauuuugaggucugcaaauaagggauuaugggaggauuagaauuuggcccauauuuuugguggucuauaugcagcucaaacacuggcucuucccuauuuguaaaaguuacccaucccaaggauugguccuuuugcaucuacucaagucaucaugaguuugggccuaguagaagucaccugucauucuugaaagaaaaaauagccuuuuagcuuguagggcuucuauuugaguucaggagauccaugguugugcaguggcccuugucagcaugaguaggagcaacuagagucacccuggagacuuccuuccuaaccagccauguagacacuggcuggcugagggaagaagccagcgccuucaccuacugccugccccgagcuccgguuccgcaugcucaggacagagucuuacugcugaguucugcugcuuccugugccagcuccuggggcagacuacagaacccuguuguuugccugucugacuugucuuggugggcagucuuucuuucuggcaucucuucucugugcugggucaaagauccuaauaccacuuuccuucaaauccuaccacugugggcagacaagcaagaagaaagccauccuccacccuuggggccaaaucacuggaaaccuguacuguuugguguuccgccgugucugggagcagugcgugugcccugagaaauuaucucugggcuuccuacucaugaaagcguuccuggaauaaacacauuucccaucuccauucacuuuuucucucacucuucccccaagguauuacagaagcucuuuggcucuccugacagagaaucuucccuuucuuauuaugacaaauuguagcugaucugagggaaucuuugggaugcggugucuuccucccauugaaucaaucuugugguuacagcuacccacaaagcuaacuacaaagcugccauuucuuuuccuuuucucaccucuuggaagagaaaguaggcucuguguguguguguguguguguguagagaaagugauagauaaaauguugaaaggcuuaaaaauguuuaaaacuaauuugaauuacauauaaagcauauacuuuaugauuauaaaaauuuggucaguaccaaauuccuugccauuuguuuguauauucugaauaaaauccauauugaguuuuuuagaaguuccccaagguuggaugaauggacuaucaacuaaauugcaaaucaaagcaaacugauuucucaagccucauaaaugugaugagaauagagaacguugauagcauuuguaaaaaacagugagagguccuugagagaagcaagaaaauggcaagcaaauguccuucaaaauuguaguugcagcuucugagauagccaaguuauucugagcaagaaaaacacccucugaacuaguuaauaaaaagcccuugagcuuguuaaagcagacugccaugaaaaaugguuaauauucucauuguucaauguauccaagggaagaggugcagccagcugcuaagauagacaaugggcagccagaaccccagaacaagggaggccccagcuccgguagugguggggguguggagacagcacccugcucugcugagagugaaauggaugauagaaauugcucugucuacacaaaggacaccaaucauacuaacacugcccuucagaauuaaagaggaaacaaugugcucucacuuguaaugagaagcaucgcuguaauguccucccaaagugagauaaaucgaguucgccaacuauaaaagcaucuuaagcuauuuguuagccucagcuuucuagacgaguagguaaaaggaccugaagagcccuccuucaccuuucggcauucuuaaacccaaggcugauugcugugauuuauuaagagccugcuguggucuaagcaacuugcccauccuuguaacccucacagccccaccgaggaagggcuuagccgggccugccuuccagaggaagaagcugauauucucaugacuuguucuucaaugauagagccauggccgaaagcucaaaccucaggcacauuuauuuuacuuccuuuagaaaguccuuugagucagagggaauuugaguucugguuuggauaucagauguccccaaaggcuuauguguugaagauuuggucccacaguagucaaagauuuggucccacaguagucaaaguugacuggucaugguggcuuuuuauauaucaagagacugaucuguuaaugauuucauagcugaucgacuauuggaaggugggacuuaauuggaggaauaugccuuugaagggugugucuugagugucucuagccgccuccccucucuucuuuucucccucccuccuucuuccccucccucucuguugucuucacugcuaugagguaagaagcuuugcucuaccucacguaauugcuuugauguccugccucaucuuaggccccaaagcaacagaauaaggcacccguagacagaggccucugaaaccacaacccuaaacaagcccuucucgucacacaugauugugggugggguuuguguuuggucacagugaggggaauguugucagauacaccagauuugguugauuauaaagcagagagucaccacacucacacugcagagagcuaugaucgacuuuccucuccccaacccugccuucccacuguagauggacuugaaccagcccaucaugauugacagaaacccaacuugacauguacacacccagaggggcacuugcugcccacugagcuuuacagccagggacaggucaaaagucuccaggguacaaagauaccguccaaguuauauacuguccuucuuucccuccuuucccacaguguacaagaagauagcuuucagcaccucugguucacacccuuuauccccaaaacagaggguguguucugugcuccccagagccauguuuaacagugugcauuuuacagagaccacuuuugagucucucuaaauauauuguuauaagagagacaggcacuggcagccccucaggacuguagguuuaguaugggaugcccaucuuccaggagcuuagaggauaaguagauuccagcagcuggaggaauggugccuacaauguucuuccacucagaaauaaccuggugaagugucauguagaaaagaauugaaagggaggaaagagauccaaaggccaacaagccagaccagcagagaaagcaacaucagaauucugcaagagccaauuccuagacucuagaggcagcagcaaagcucacguggacuaagccggcugcuucaaaggaagacuuaauuauaaggaaaagguggaucugggauguaggcaaggucacaucugugggacacaagucacagagcuggcaugcccacuuaguucugcaaagguucuuggccccuaguguguaucaucuauuucagucaguagacagcucuguucauguuggagaugccgccaggagaguacaccuggauuucagcaagaagucugaaagcgucucugguacauuuucuauagauagaaaaauacggacuggugagauuuaguuacaccuuugaagcagcuguuucugcucccuaguuauuagcagauggauggacccuuugggggaaaugaguggggauaugccucuaaguggccuuuaaaaaaugguccuaagucaucauuuuuaucugagugaauaaaaugaauaaauagaacuuacacaaucauauuuuucaagggauucaaagcugggaagaauaaauaauacuucaggggacaaaaccaagcucacaaacaucauuuuagucagaaacauuugguggguaucaaaaaugagcagggguuauaucagaagucuacacuagagcuuagguagcaguaaguuaacaaaaugacaucuacuucuacacaguauauaugcaggguaucuguguauauacuaauauauacaaaucauuaggauuagcuguauggcauauauuuuuaaauuaaaaugguuucuaaccauaagaagauagauuuuagguccuaaaaccauccaagaggacauucuaggcaggagcugcuuuuuuaaagcuggcauuagguuuguaagcucgguguugccugccagcacuguguggcccuuuucacuugaccaggaugugggaaugggaaagccaggaggguccugcucaggcccucugagacccagagagcagaaagaaagcaaguacuccacuuguacucccgaguuuucaaugagaagauagcuuuuaaucuaaaaauaacuaaugagaacagacacuaaucccuguugagaugggcagauacaauguaguuuaucuggguuuauggaaacacagcaucccuuucaaggaaucuuauuuagucccuuugcccugcuucuugaucguccaugagcccucuguccccagggcuccaagcacaggcacaugccuuuguucuuuaaacaguguucuccaaaguaaguuucauggagauaauguccccccuagcuugugaauagugguuucaggucacuuugcuguuaccaaggccccaugcaaagcccgcuacaugguuuccaaauaugaaaguuugccagcaguugcuugucagugugguuggagcuuuacagucuggaugccugacaccuacuagcccaccuacccagcugccucugcugcgguucucuucucuucacugcuucuuuugaauucuuccugacaucauuucuauuuguuaugauucccuaaguaacauuuucaaacuuuuaucuacuaaugcaauuauuuucacacacacacacacacacacacacacacacacacagagagagagagagagagagagagagagagagagagagagagagagagagagagagcgcuaaguaagccaaggguggugguacauguuuguaauuacaacacugggaagauggaguugucaggaacugaaggucaguuuugacuacaucacaaauucaaaaccagacaaacaaacaacaauaaauaagcaacagguaagccuaacuaacuaaauguauucuauuuucccaacccucaucacauuuuacauuaaaaagaaaaaucauucuuuuauuggcuuccuugaaacaucaaacagcauacugcagauuuucucauccucugagcuguagcuagcuucccuuguuucugacuauggaagauggaggcuugucucccucacucaccacagaggaugugaauauaaaauucucaauucaaagucauuuucaaugacaggcacaaagaccuguugccaggcuccugcgagcauugucucaggagccugucggacugacuuccuuugaucugcccacuuuguccuucugcgagaggucaggaauggcucuuugauguguuuaggccuaagcauuuuuuucuuucauucaugcaaguccauuuuauuuuaaagacucuugucuugcuauuaucccuguugaaauuugucuauuuucuuuucuaauuuagucuucucuguuuuucugaagaugucacuuguuaagcuguuucuaugucuugcaucucuuguguucuagaggcuaucugggauuuuaucuuccaggucauuaauuggauuuuguauuucaucaaauuuauuuuuuaauuuacaggaauacaaucucgaucuuugguguauagcuccccuccuuauguauguauuuauuuauuuuaaacuuuuguagauucugcaucuuggaaaccuaagguuuuuuuuuuuuaauucccuuucauuugcuagauggucuuaauuuucuucaaguucaguuuuugcucuauuugcucugauuucuugguaauuuuuguuggcuuguuuugaguuugggguuuuuucuucauugcuuauauuuuaaaacaacuuucuugauauaaauuacauauacauaaucccuccauguaauaagcagucaaguggcuuugaugcccccccaccggaaguuuaugccugcacucuccaaucuucucaaauacaaccuguucccacccuuacccuaggcgaugacuauacccucauauaugaaauaaagggauagaaagccuacguuauacgucugggcucucagaauggaaggcaguaagaagccaguggcagggaaggaaggaaaaccagagguggggaucaggacccuagaggggccagagaggagcuagggcaggcggguuguccugcugcucuggguuugcuuuguggccaagguuagagaacauucuguuguagaagaugaugugguagaauagaguuuguucuguuuacaguuguuuccugcaugagugaccuagcacacaguagguauuuugcauugguagauucagugcacauaguagguucaaugcacauagugagguaugcauugaauuggcccugggguugcuguaggugggagagauaguuccugaacuaggguuuucuagacuuuagaguuacugauaaaaugaaugacuauauauaggcugccagcgaggugugcccaagaauaaauguggaucuuccaccagaaaaaaaaucugaauuaaagguauaucuuccuaucucaaaagacccauauuaaaagugggucuucccaguucaaauuauuuaauugagaaaaaaaucccucacagguaaacccagccacuuggguuuuaauuaauuccagauguagucaaguugacaaccaagaauagcccccacaaccaccccauauuaacuugacacacaauaauaucuccuuaugccauacuuaauuucaaaaugaaaacaguaaccuggucauauuuaugcuuaauauaaguaucccacauacaaucacaaacauuugcauuagguuguuauaguuucuuauugaccuuuaucacaggacaugguaccauccuauacuuuagauauuaucuuucuuagcucuauuguggagaagaagacaauccaguuuuuccuuaguaaucugaaucaaucaucucucuaaacacuauuauuccuuucauagcuuguuggcuuaaggccauuagaaccccagcguggccaggguaccaucugugucccguccaacggaauguuuguugugguuccuugcaagagcacauaucacuuguagaccaaaacuuuuaggccagcagaauuuugggucaagggaacagaaaucaaaauuuuuucaagggggccacuagggauaauugugaauggaacuauuccucuuuucaucccuugaucccuggacccguggauccuagcuauggaaaaaaaacuuuaccguauuauugaacacugcuuucaaucauacaccaccuucuggagaacccugccccugccauccaggcugcuauuaccuaguuggcaccguaacugugucuucaaaaggccauuccaucuuucuaucaggccagcugcuacagggugguggagagcauagaaagaccaguggcuuccaugaccaugggcccacugucacauuccucuggcugggaagugaguucuuucaucagaaaugaugcugugcggaauacaguggcaguggauuaggcauucuguaagucuaccaguggucguuuugccagaagcauuacaugguggaaagcaaauccgcaaccaaaauaagcauccgauccaauaaagacagaccauuauccguucaacagaggaagugaucuaguguagucaaccugccaccagguugcuggcuagucaccauggggaauggugccauaucuggcuggggcucagugucagucucugcugcuggcagaucuggcauucagcagcagcuguagccaagucagccuuggugaguggaaguccauguugaguccaugcauaagccccaucucugccaccauggucacuuuguucaugggcccaaugggcaaugacagggauggcuggggaaagaggcgcaugguccacagaacaggucauccuaucuacuugauuauugaacaccaccucugcugaagucauuuuuugaugaccauuuccaugagacacaagccacuucgcaugcuucagccauuaugaagagaucuagccgcaugcguuucccugaugucuuucucaccuauuuuccaguccugcucuuucuaggucucugaccauccaaccaauccuuugcuacagcccauaaaucagugaacaacuguauaucuggguguuucuccuuccaaacaaagacgaugaccaauuguauugccuaagguucugcccacuguuaagauuucccuucccuguuaucuuucacaguugucucagaaaguugcuauaaugcugcagcugcccauuucugagugaugccugcauaauauugcagaaacaucaguguaacacacccuagucuucucuuccucagucagcugaucauaaacaacaccccaugaggcuauaggaacaugcuuggcagcagacaccauuguaaugggaguaaaaaccauaagcauuugggcaacuucuacauguaacuugcuuuugcuuucaggcccugcucaggccugaucauguauauaccauugccaguugguaauggauugcugcuguacacauacuauuuuauagcuugguggaucagauaauguuggguagcucaugucauaugguuacuuaguagcccauuauaaaacauucagucuccacuaaggcccaauagcaagccaagaacugucucuuuaaaggaauguaguugucuguagaugaugguagagccuuucucuaaaaucccaaagguaucuuuugugauucuccuauaguggccugucaaaugcuccaaacagcaucauuaucugccacugacaccucaaguaccaugaggucugcugguccaagugguagagcagacugcacagcauccuggaccuauugaagaggccucucccuauuucagcccccaccccaaacaaagcuagcagcuuucugccucacuugguaugugggcugacuaacgcauccaagugaggaaugugcuguguucacagugcaaauaggcccacuaaacauugugcgucuuucucaguggcagagggaccagauacaauaacuuaucauucaucuuagaaggguuauaucugcauguccaaaaccacuggccuccuaagaagaauuuuacuuaucuagaaggcccuugaguuuugguuucauuuauuucccauucugugauauacauauauauuaccaaggccaaacugguugcuaccuccugcauacuugguccagucagcacagcgucaucaaucuaguggaccaaugugauauuuugugggagagacagaugaccauaaucccuuguaauuaauuuaugacacagggcuagagaguuaguauauccuugagguauaaauguauacugcuggccuugccaauugaaagcagauugcuucugaugguccuuauggacaggugccaagaaaaaggcagucauuagaccaguagcugcagaucauguaccaggagauguguuaaucuacauaccaccucggguacagcagccguaaucagagucaugacuugauuagguuuucaguagucaacuaucauucuccaugguccaucugucuccccacuggccagauaggagaguuaaagggauaugugguggaagucaccauccuugcaucuuuuaaguccuugcugguggcacuagcuucugaaauuccuccugggaugugauauugucuuuaacccaccauuucccgauagaagcaacuucaguggcuuccauuuggccuuucuaaccauaauagcccucacuucauaggucagggaaccaaugugaguauucugccaacuuggaaauaugucugucccaaucauauguucuggaauggggaaaaucacuccaggauaaguuuaggcaccuacuggaucuacggcaaguaaaacuucagccaaaacuccauuaaucaacaaaccuucaugagccccuacuuuaacucuagggcuccaauguuucuuggugucucccagaaucagcgucaauucagaucuaguauccaaaagaccccagaaagccugaauucuuucuuuuuucccauuguacaguuacccugguaaaaggcuguuagucccugaagggaaggacuggagaacagcuaacagcaaaaccuguaggcauuuuaucaagcucuuuccucaggggaacuugggcgucccuucauuacaaaggguucugggucuccaaacuggcucaaaucuagaaauugguuuacaagcugagauucccauuugccauaguccaauguagccuuuccuucauuuguuugagaacuucucugcuuauacagaucaaacacaaaugcagcaguuuguguauuuguuuguuuguuuguuuacucuguuucaugccuggaaacauuaugauugauuagccaguaccaaagguucacuuaggucacacugugauaaaaaucccuuugcuggugcuaugggucagcucauauugucauuggguugucuaugcugcaauuacaauagcuaggaucaccuugcuuucggcagcuuuguacugccaccugaccccugcuacucugggacccaauggaagcuguugcauuuaauucauccaacugagcaacaacagcagcaucuccaacccucaggucagccacaaggaaaagggcaacaacaaagcucuucuaaugugcuggugccccucccacuauuuugugucuuguaggauuagugaagggcauauauucuagcccuucccuuuguggaggauuagguuuuauacagagugcccucucuaacauugcaauuuucccaagccuuaaaaaucucuucaucgacacuaaaccaaggauaucaggcaucuccaacuccuuuccaguaggccaucuuuggacaaaugcuuaaaccagccauucaaauuuuugacacuuuuuuuuccccuuaucagagugaccuuccauauuaaaccuagauccgucccgcauacaacagaugugauuugucuccauuuagauugaaagccguggcugggagagcugaaugccuuaccaaggccacacauccagucaggggugaaauauuucacacuugaagcauucuucccaccaccuguccuucaagaugacggacagcuucagagugaaaccuguguccaugauccuaggacaaggaacagggccuuccucaagguggcccuggcauugcuguggguggagggagccugcccuuuugcccaggaggaacugagccaagaaaccugcaugcccucacauaccucaguuucaguuaugaaauaccuuugaaauuauuuucucugagcaacagaaauacugacaccuccucuccauuccaguuucucagugagacuuuucaucucguguuguuucauagacuuuaaauaaaauggaaguuccguggggacugaaagggcucggagaucacggggaugggacuuccagccgccagcuaauucagugcagcucccaggugggaaaaucaaugucugcccugcagaggugaaucgcgcgugccauagugucaagcugcagacucgucccggagaauugacugacccuccuugcuuuucaacuuuccacugaagcauaauucaugcuugccuuucuucagacacacucuguguguguugaguagaaauaugagcugguggcgccuggaggagauggcuucugucugccugccugucugucugucugucugucagaaggcugggcucaacuauucagagcuaacagacgucuccaggcagcuccaagcagagauaccccuuguacugaugggugaguuucacacucaccaagccccuuaaucugaccuugucacuccaggcugguaauagugacccauucagagguaggucugguguggugccacaauauguggagguccagcacucagcccaguagguggcuucaggccugcaagcuccaggccagccugugcuauacaaacaaguuccuguggagagagacaagaauuuaaaaacaauuuagugcggacuuugcugaagcuaauuuucauccccucucccccugcguauccuugucucuacccuuccugggaccucgagucaccagaagucagcucacugcagcauuagaguaauugcuucccacuuggugaauaaccguuggcuccauccucaugcacagccacguaggacuuucccacaaucuaagaaccaagucgcaaggucucccuacacuacaggagacuucauguccauugcuguucugauugcucaugacuguaucuuaauccuuggcuggauaaaucuuccuaugugggcagauauagaugcauacacaugcgcugggcugggaacagaacccaggccuucacaugugcccuguaucaccgagccacaucucuaccuucuauggcauauucaauauauaauuauuaaaauauuaauuaaaucuuauguuauuuggaaaaccacucccauuccugauaaacucugacugcuugggcccagggggauggcagugggcuucauccuggcacccugguaacuuggcaaauccuauugaaucccucugcuuggucgaggguuuucagcacugaugauagcagaagccucagaaaaaggggcuggagccagccuacauccacauuaaggcaucguggugacucuggugccaguuccuagcuggaaguuagcaagggcuaaguuccucuuccucucugugugagacuuagggauguacgcccacauacagcagcaaccaucugcuagcagcuaacauaagcagcucccugugaaguguccagcagcagauggaacacaagaccaugacuacacaugugugccuuaggugcucuuuagcggaaccugaaaucaaccuuccugaagaagagaugccauuugggaagaaugaucuacccaauggcccaaagcucuguaguaugaccauagcuuguaugugagcacagaggagauggaaaacauaggacugugggugggggugagggguaucaggaucucagagcaguguuuuauuugaagucagugacccucagcuuuuucagucagccugucuuugacugaacuggggcucaccuuauucucucucacccuccuuaauccccugccuccguaucuaguccaaacaggaucacccuccugugcuggccacagaaguauauguaacuagccaagagguauaaaccuguuucuaacuuaauaaaaccagugguuugggagaguccuggguggugacacccugcagaauggcuaaugaucccuuggagcuaggacccuuguaucugguaggaaauaggcugacccccaggcucacuugccuucuagaagcuacacagagagucuauccauugaaaaggguuauccugggccacccuggacccaccuguggcucuggguaggcaacaaagcagauaaagucauauggagugugggccucucauuguccacaagguuaguuggugaccugaguucauuggugcuagugauaggcaagucuggaauaaaguuggcugaagacacccccgccuucuuuuucugucuuuucuguuuguaccucuucccucccaugucacuguuccucuggaugcugcaugaagaagccuguauuuuucucccuauggauuuuuuuuuugacaggguuucucuauguagcccuggcuguccuggaacucacucuguagaccaggcuggccuugaacucauagagauccaccuguuucuuccucccaagugcugggauuaaaggugugcaccaccaccacccugcucuaugggucuuucuaaagcgcauucucaggcccaucuguuucacugggucuuccgacugguccuucuucagccugccuuuuagggacauccauauuauaagagucagugcugcuuaaggccaaaguguggaagcucugacugucaaagucuguuugcuaagcacuagcaaugcagcaucugcuggugccuagaagguaagaccucuguggccauccacuugcuugggcucagacucaccuguguuuugauucuccugcccuuccgguccuugcauagauuaaaagaggaggcuuggcuccuaccacccccauucugucuauuuggacucuaaccuauuuaaguuuuagucucauaaguccuguugucaugguuucuuugguuuuucuagcaugcagggccgggucuaaagcucauugguacagcucagcucuugccuggcaugcaggaaguccugcgauuuuccauucccagcacugagggggaaaucccacaccagucuucauuugauaaaagacaacagaugaguagcuacccuuauuuaucucugaucaccuuaucuuauaauuaaaaacgcccaaauaccuauaauggggaguucccccagagacucccugugugagcuguuuauuugauggauggccccgaaaaccuguguguacacgccgcaugccuaauguugucauuuacgaggacagacauaauuccauguccucaaagaccuugucaguagcugaggcagagccugggucugaacaacauuggguuuccucuuuggccaugugcuuaugagcugaaaugaagauuaccucgagugcugcuguaguccgaagaggacauuugucccuucaggacuuuaaucugaggcugccuaggaugucugucaugauuuaguuucugcaccuccaaccugccagaagccaagugugucauuccucagagauggcggccaaagaugcugaagucaacucuucaagagcccagaugggucuugccaccuacaggauagggaaguuggugggggugcugguauguagccuaucccuauuuauagugcuaucucaagcgguucuagugugaccuugggaggggaaggggucuuuuuuucugggccuggcugcccauguagacuaguuacuuuuucauguguuuccaaggaacaaccacuccauaggaccuugagaaaguccacccacccacagccccaauauaucagaggccauauaaauucauuuaaauguaucaguggcuaaggacaucagagguucucaagagcaacuuuuaggcaaacagcccagucaguaguuguugagaggcccuggcucagcccccuuuccucaguucucacuucacuagaugggguuagucaguuuuguugaaacugucaagggcugucaagggagaagggcuguauggucacauuaguuuguggaguaguaaguauuguuuacuggaugacagauguggugugggacuagggugagcaugggggauaagguucaggugguaggauccugggagugacuguaucugguaucuugcuccacccccaccuaauccacuggcuuuguuuaaaaugaaccugccuaucacuaagcuggcaaggaaggguggaguucagaugaggggaaaagagccuguccuuaacccacacaagagguagggaccuuggccaucuucaugaauaucugccuauugcuauaguagcauugagugaguccuuaccauaacgagcccaccaacuugagcuuuaaguucaagugagccuuuuaguauaucuuaaaauguauuuuagaacauuagcaaaaaagggggaaaaagacagcuaugccuuacaguagagaaacuuggcaagcuccucccacaaguugaggcuagcuucuuugguggugggagguggguauguauucucucggaucucauacaaugagaagaacagugcugagcauugagagaagcgagagaugaagucagaaguuguugugcagagcacccgacaccgcucuucacaacugucagggaagacugagacacgugcagggcaguggaagcuggggagacaggguggaugauacagauuucagaacagcaagauugcacuaccaagaaacuaacaagagucgguuagcaucuggaguuaaucaacaauaacauuccaauacuaauuucucaguuuugguaaguguugcucgguaguguaaaucauuccuggaaggaacuugaggauggggcucauggggacucuucugugcuacugaaaaaauauucuguuaauguaaaaucauaacaaaaaaaucccuaucuuuauuuuuauuuauuuauuuauuuauuagauauuuucuuuauauacauuucaaaugcuaucccgaaaguucccuauacccucccuccgcccugcuccccuaaccacccacucccgcuucuuggcccuggcauuccccugcauuggggcauauaaaguuugcaauaccaagggguaucucuucccagugauggccgacuaggccaucuucugcuacuuaugcagcuagagauacgagcucuggggguacugguuaguucauauuguuguuccaccuauaggguugcagaccccuucagcuccuugggugcuuucucuaacuucuccauugggggcccuguguuccaucuuauagaugacugugagcauccacuucuguauuugccaggcauuggcagagccucauaugagacagcuauaacagcuucagcaaaaucuuucuggcauugugcaauagugucuggguuugguggcugauuaugggauggauccccagguaggguagucucuggauaguacaucuagucucuggauaguccauccuuucaucuuagcuccaaacuuugucucuguaacuccuuucauggguauuuuguucccaaucuaaggaggaaugaaguauccacccauuggucuucccucuucuugauuuucuuguguuuugcaaauuguaucuuggguguucuauguuucugggcuaauauccacguaucagugaaugcauaucuaaugccuucuuuugugauuggauuaccucacuaagguugauauccuccagauacauccauuuguccaagaauuucauaaauccauuguuuuuaauugcugaguaguacaccauuguguaaauguaccacauauucuguauccauucuucuguugagggacaucuggguucuuuccagcuucuggcuauuauaaauaagguugcuaugaacaugguggagcaugucucuuucuuaccaguuggaacaucuucuggguauaugcccaggagagguauugcuggaucuucugguaguauuacguccaauuuucugaggaaccuccagaaugacuuccagagugguuguacaaguuugcaauccuaccagcaguggaggaguguuccucuuucuccacauccucaccagcaucugcuuucaccugaauuuuugaucuuagccauucugacugguaugagguggaaucucaggguuguuuugauuugcauuucccugaugauuaaggauguugaacauguuuucaggugcuucucagccauuugguauuccucaguugagaauucuuuguuuagcgcugaaccccauuuuuaaugggguuauuugaauuucugguguccagcuucuugagcucuuuguauauauuggauaucaguccccuaucagauuuaggauugguaaaaauccuuucccaaucuguugguggccuuuuugucuuauugacagugucuuuugccuuacaaaagcuuugcaauuuuaugaggucccauuugucaauucuugaucuuacagugcaagccauugcuguucuguuuaggaauuuuuccccugugcccauaucuucgaggcuuuuccccacuuucuccucuauuaauuucagugucucuggucuuauguggaggucuuugauccacuuauacuugagcuuuguacaaggagauaagaauggaucaauucgaauucuucuacaugauaaccgcaguugugccagcaccauuuguugaaaauggugucuuuuuuccagugaaaaucuuuacuuuuaauuagagugucaccaauaggaagguuauuuuucugucacaugcaggaaguaguuaaaggccucuaagaaauggaagcauuggugaaacugacagguagcgugaggguuccuggaaagcugguugcuccccaugaagagcucuacuuacuacccagcuucccauauuugggacaaaacaccuaagacuguaaacuaaacagaggaaaagcuuauuucaacuagcaucuuuggaggauucagugaauggguauaugacuguugcuauggcaacaugguaugacaugaugucaugugguaggggaggccuuuuuacuucauggcugucgagaaggaaaaauuccuuugauaggcauaccccagugaccugacuucugcccacuaggcccaacuuccuaaaaguucaccacaucccagcagugccacaggcugcugaccaugcuguaaacagaaaggcuuagggugaucugauaaucuacacuguagcaccccaucuccaagagucugucugucaagaacucccagcuaacacugaagccaagucaguaccccuugaacaucccuccuaagggaugcucuaaaagccaaagcuucuaugaguguucagauaagaugcuaccgugugcaaaaugccaugcugugaaacuugcuuucagauaugaaauuauuuagaaugucuauaaauugauacccaaacuaagauacaauaugaaacauaaauaaaauguguauuaggcuuucuucacaaucuaccugggaucacucuuuucauauauaugcaacuauuccaaaaaucuaaaaaucuucaaaauucagaagcaucuugccaaaguccaacuggugagccaauaaguuuuacugggacugcuuauauaaguugagaugagagguuacaggaguaaauaugaccugaagacagcugcaucaccaaaagccuauugcagcauggugacggcuugcaagagcuagaacccuggagcacacggcacaguuguaaaugguuuggaggguauuucuuccaggcaguuacgugcucugaaguucuucagguagcuaagcuugucugagaaggacucuccacauuccuauugcuuaaaucuauuugcagagagaggggccuagugaaccuggucaguuucagggacuuccugaagacucuaguuuacucccagagcuugcugagcuuaccugcaggacggaauguuugcuucucuuuagaacaucuuguguccugaucaggagcucugagcaaggaguguuuccucucagaggaacuggcaacacaacaacauaccccagugcagacauauaauuaaaaaaaauuuaaaacaaaacaaaacccauguucuuguaaccaguugcccgacucugcugcccccaucaaaaaggaggccuuuguuguuacauccacaaggagcuuauaguugaggguuuuuagaaccacagaaaggagacaagaauggagcccauuuuacuaucauuaacugcccauggaagcgugggguuccacagaucacuuuuuggggaaggguaucccauucugcucgcuagaguagggcuuuucagucugagugcuuccaggaguucagagagcugucagguacggaaaggaauguguugcacagcuguguuuguggauuuuuuuuguuuuguuuuguuuugagugugcagcuguucuugugucagcaagccgaacagaguauggccugaguacuuucaugugauuccggaaccagagaccaguuagaugaagcagaucccaugaagaccaaaguaggaaggauccucagauuuuuuuucuuacucuuuuaucagaaaguaaaacugaugggugugggugggagugaugggcagaaaccucccuccuuuacgaaguaccucucugggaaccugguaccugucaccaagagcagaaacaaagcccucuuugugcacgucuggacaaacccuuauaaagauuccaguuugcaugcccacuccuuccuccuucggccuucugcagcaucagcaccauuuuagccacagccaguuugaugacugcccacacagacgugguuggugguauuuccgcuccccuggccagugaugaguuaagcugucacuacagugguugcccucacaggggcuuuauuaauaccagccccugcuccagacuugaccuucaaucacuggaaaacaagaaaacauugaaaacaacuucaaccaaaugaaaaauccucugccaagaacucagucuaaacguccccaccuuuguaugagugauacaggagagugagccgccuggcagguacauuuccagcugauggaaaccucgggcuguuaauggcucuucugggacaaggcugugagggcagagcuggcaccaaccauggcgaaguccugaugagagaggaauuacucaaacuugugccuaaaauagccagggacaaagaguccaggaagacccauagcacugacuagacauccucgccaaaggcuagcuccuucccaugccacagaugaggaaagccacuugauuucucacuguacacaugucauggcuagucuuccaucacugugaagagaaagguacuucguagcuaaugcauccuuugggguccuugguauauuuccauugugaagaacaaucauauauuagcccgggcacucuuucaugcagcguauuuucaaaauucaugcauguagugacauauaucaguacuuuguacugccaagucauacauaaggcagaagccuguaauuguaggaaaacaguaacuggggugggcaggcccucuuguaauguggagcgugucauucacucagguguauggagccaggcuucugaaguucaagcuuuuuuuuuuuggacuugggauaagcucgcuugguugagaggccugugccgugggugacguuauugauacugcuaugugugaugagacaaagcuaagauuuaugaucguggagaagccaggcugggucuggugccgggaugcugcucaccaagccaagcacauacaucuugcuccaaacgcaacuucugaagugcaguacaggcaucgcuagagagaaaaaagaaagaaauuccuguccaccauuuguuagaucgugaaugccccucuccacguucccagccuggagccuuuaucaggugggguccaguggaggaagucagagcauuuguguugaugagacuaugaaccuccaaaacugggggccaaauuaacuuaaacauuuccccuuacugauucaauugucucaggugcucugccauggggugggaaagcugaccaacacucugucucuucugguuuagagcaaguguucuaguuaucaaaugaaauguucuuggaccuguauguagguccguaacuccguugucuuguuaguggcuaaguguuauuuggggggaaaaccugcccuuuguaagauuucuccuuuguauuauagucuggacaguguuuguugcucagucucugugacaacucauuuggucuagaaaguuccuccagagaaguccucugauuagauugguggaaagaugacgaguuguggcauuuucuucccacucucacagccgugaaggacaucuuccucagcucucggugugguuuuguuguagacugugcuuucugacaguuuuauugagagguaauuugcaugccauauaauuuacccaccuucaguaugcagcucaguggguuauaauguauuuacagaacucugaaagcaucucuaccgguuuagaacguucucaucacuuccaagcaaacccccacccauuggcuacgugcuaaugagcuguuaguuccccagucacuggauaaccacaguugcuguuacucuagauuuuucucucacagacauuuuauauaaaugcacuaauauaaaugcagacucuuucauggagcguauuuuuaaagaucauccauguugugacauacaucagcacuguguguugccaaauuacauuccauuuuauaaguauaccgaauuuuauuuauccauguaguaaaugaugaucauuuggauucuuucccccuuuuggcgaagaaugcuacugcuaugaaauccacgcauaaguucuuggagagaacaugcuuggcuguucugggauguguauugaggaguaaacuccuugaucauaugguaggcucuguuuaacauuuuaaagaacugcuaaaccgcuucugaaaaugugcacguaacguuacguuuccaucaauaauauguggagcugauacuugccgcauaaccucauuuccacauacugucuuugucagggucuuuauuguaugcauguacgugcauauauguaugcagugaugcucacagcucacagugccuguguguauggaagucugagguugacauugggaguuuuucuccaucacuguucaccuuauuuugugagacagucuuuuacugagccuggagcucacuaauugguuagucuagcaggagagcaagcucagauugccagaugccacccccccccuuccucuaguuuacaugaacagcaccauggcugagugcaggggaucugaacuuagguccuuucauccagagcccgcccuuaccugcccugauucucuccauugucucguugggauuuuugucugcauuuuccuguugggugaugcuaccgacuuuguucauguacuuaguggccacuuguguuuguucuuuagagaaaugucuauucugauccuugacccauauuuuaauugcauuacuugucucuacauuauugaguuguaaugguucuuacuuuauuuuauugacuuauugauuuuggagacaaggucucaguuuguagcccagaccggcauucucccugccuugguucccugaaugcugggauuacaguuguauaccacaugccuggcuuaaaaauucuuuacagauuuugaagacaagucuuuugccacauauauaacaugcaaguauagucucccauucugugaguuacuguguuuuccuuuuugaaaguauauuuuuaaaaauauuuuaaaauauuuaacaaagucaaauuuaugggguuguuguuguugcuuguguuuuuggcaucauaucuaagaaaccauccgcucaaacaaagauaucaagacccacucuugcuauuccucugacauuuagguguuugacuuauuuuguguuaaucugugugucuaaaauguacauucugugcggauacuaaacuguuagcacuuuuuuaaagcgggaaagaccagcucaccuuucuacacagcugcauucuguggcugggacuagguugcaugagaguacggugguuauugucacacccaucuccgaagucaggcuaacugguauccuccauccucccagcucccuccgagugcugacuuacacccauucuucagcacaacugagcagauacaagcucacgugcuacuaagcaugcgagagugcugacagcaccccuccccgcuuccgagcacaggaaccacagggaggugcuuagcuucucuggauguucuucucucaucugaaugaugaaugcuuugcggggucaucgaggaguuaaugggguaucauaaauggcgcgcauuggguugcagccugaagccuagcagguauucccuaaaugacagcugucauuauucucgugauacugccuugccucugagccacuugccucauccuuagaauagaaacagagcaaggaugucccuggcuuugcuuaauccgauacccauugggccuaguacacugcucaguguacaggaagcuuucaguaaauauuuguugauggguuaaauauauaauacuucuuccaucccuuaaguauaaugguaagcauuuucuaccaauguauucagacaucugugguggcccacagugggaaauacugaugagcuggagucaggaagaccagaaguuucagguuagccuggguuacacuguauauguauguguauguguauguguguguguguguguguguguguguguguguguauguguauguguguguguguguauauauauauauguauauauauguauauauacauauauauauaagcauuuugaaaaguaugagacaguacagaaauaacuuucuguguuuuuaaggaagauguggauugauguaacaauauagcaaaccugcaaaugaggugaauauauauucucuggaaggugugauuucauuuucaagauccuaaaagaaccagagauccuuuaauaaaguuaauuuauuaaagaauuuugaggucauagaaagcuaaugccccucucguggcuuucacacuuuuccuggggagagaacggccuucugcccgacccuucuuaggagcagcuauauugaggccagaaguggggagggagagacacgcagagaugggcugucuuaggauguccaauaucugcguaaggagugggaauuugcucagcucucuagucacaucuuucuguuucaucuccccccucgccauagaaguaaaaagucaguacuuucauaucaccuuaaaauaaaugaauauagacuuuaaccccucccugugugucugccuacucagggccuuaaagcacaacucugaugcugacaaauccacaggaaucuuggguagguuccuuaaagucaucagcaggagaggaccaaccagugacaaaagccaggguucuuuguauucuuuauuaauuaguucugaaaagucccucauaucucuagguccauuccaagcuggacaaugagugcauugaacccuuagggccugaccagcucuuauuccuguggcauagccagucagagguuguaagugacuaccgcaucuccagaugcuguaaagagacaucuggauaacacaagcccacccaucccuggagaacuacaggcacugugcaugguaccaccugugagcuuaugugcccugcugcacuuggccauacagaauguaggagaggcagaguuuagggaugucugugagaggcucagacacacugggaagaagucaauacagagcugagucugcacauguuacuuaucgagaagaaaaaggcagagagccaugggcuacaaguuucuaacucagggcuguacccagaacuguaaccaaaaaggcagcacagacauggugcuucaucucuugucuuugccucuguauuauucucuguaggucagucaauccugggggcucaccagaagaugacaaauacugauaagucaacaggcuuuuggaaaggcaggcaaagcugcagaaaucuggcgugcuauccuuggaaacucugugaccuugagcauucucugcaguuuccauagacuuguuuuucucacuggugggugacagaaaugaccuugaaggguugcucugaaggcccacugggaagcucagauacaacuugaggcccaggagcggugacauggcccugacagugcuauucuagaauggagcuguguugaaggggcagcucugaggaagcagccuguugagaucuagaaucuagacaucccacuggaguaccaucucaccuugaaagcaagagaacccugucaccuucuaccacagccgauagaccuugaagacaccacaugggguugagucagccaaucaugugagaauaaaugcugugguuucuguuacaugagcagccaagccugugggauagaaaaggcuucugggagcuggaaggggagaccugcuccaugugguguccaucuugcaagauggagacauucuggacaccugccucguagcacugacucuacuggagauugguagacugauccuuuaaaacugguagagugagccugaugcauuuucuuucauuuuuauguaagaaacaucgaauuuaacacaauacauaagguguugugcaagguguuaaauugagaccagagagagaaagaugagaggggcaagggagguuccugccuucagggaguugggaaaguagcagaguucuucuagagaaaugucagcauugcugggggcagugagcgagggcaagcuucuggacacuuugaaacuguggguucuauagauguaagacaggaacucugggucuguuauaggaaugaaaggaaaguggguuuggagugguggguggauacucagggugacagcugcuuucuuaccacugugaucagaggcuuacaggaagcaacuuaaggguggaagguuccauacuggcucauggauacaguauucuuggaggggagggcccagagcacauaagguggcuggucacauuguaucuauggaggaaggcagcaagagaggaauguuagcacucagcuggcuccacuguuaacccuuucaggacuccagucucuaacuaccagcauucaauaugauuccccuucucaguuaaaccucucaagaaacacucucagacaugccuccuaauccacuuagguugagagcaaaggccacccaucacacucaguaaugucacacuuuuucuugccuuuaccaucaaguccucucucaaagggguuuguaaucucacagaagagggaaggaaaagauaaagucacaacaaacaucacagggcauaaggaaaaguagacaguagcaugggcagggugugcagggagggccaagucuggccucagccuugaaacuguggguucuauagauguaagacaggaacucuggguuuguuauaggaaugaaaggaaaguggguuuggagugguggguggauacucaguucagacugguggcccuuuccagucugaaggcagagaagcagaccaaacagaggagucacccgagaucucauacagcaacuucucaauugucagagucuccuucugagagacaggaagagaaggagggccugagacauagcguuccagcuguggagacacugggcagcucugaucagauuuuuaguaugguagaaauggagaccuggagaggaccagcuaacaugacagcagaggcuaccagaacgagacaggcucuccuuggaaaacacaucugucugaaggcaugucuggcgaggugguuuucauggggccuucucaggguggcuaucuagaaggugugugcccuggagcucccggccacugcugacagugguuaaagggggcagaaucugaaagucucugccuccugaguggaagaggaggcugccaugcagaugagaaucacaaauggcccuagccuuuggaucccuuuggagccgaggcgaggccugcugucaccuuguccacacugugcccucaugucacguugugagucuuucuggcaguguccugcucucccuuguacagucaguuugaggaaguggaaucugggaaccuugccacccuccaguaccugguggccugccaggacuuuggauacagugcaguuuuauccuggagcaaauuugaugccagcccagaggauccuuuccaauuuccuucuuccaccuggcagucuugcuguucugccugucccugcaucggaagagaagagagcagaaaccugugucucaggggcugcccuggaaggucacccaacagcuaaagugaaugacgcgauggggcuggcguuggaggugaauccacaacgugggacuugauuaguaaaggcuucuugagugaacuucucagaaaagcauccauauggcugaaacugaggggcccugcugggaugguucacaggcugggagcuucuccuggacaaaagcaguuggccuaugacauugcagggucuuuagauaagguucuucuuucccucauuucugucgucuuucuccuaugggcuucuaaggcuuagaugccuagagccuuugggguguguguguguguguguguguguguguguguguguguguauguauguauguguguguuuguguauaugugugucuucauguguauauguauauauguguguggauauguguguuugugcguauauguauauaugugugcuuuucauguguauguguuuauauguauguguuuauaugugcagagguauguguguauguguauacauguauaugugugggguuuuguauguauguauguauguauguauguauguauguguauggguauguguauguuucuauauauaugcauauguaaguuuauauguauauguguauuuauguacacauguauguuuuauguauuuucauuuguauauuuuuguuuauguguuuugugugugugugugugugugugugugugugaaggagagaaaauaagaaaacaggacaagaucaagaaggaaagaaaaauugauuuucaaguaguccuaaaaaacaguggaaguauuguaaucuguuuucuguugccacaacaaaauacucaaggcuagauaauuuauaaaaggaaaaagguucgaagcuggaaagcccacaagcauaguccaucaagggccuccugcuguuuuaucagaagccuaaggaggaggaaaaaaaaaccuauuacaugcagcuucaccuuguaaccacguauuuggaggugacuaauccugcaagagagacaagaaaccaugcaggggcuccauucucccuccccaucuugcugcagagucuaacacauggguaggggacacucaaaccccaccagagagcaagagaaugugagccaggcccucuacacugcuucuucugauugcagucccuuccauaccucucugucuggcacuagcccucugaagccagaggccucugucagugcguauuucacaucaaauagcugagcuaccugguuggcucaaaagccuugugauggcagacagacagugcaauaauuagggaggcagaggcuaccaguccuacugacaguauuacauccucugccuugccucccugugcuguugggaaaggagcaagaaaggguuuccccucccccuuccuguuucuauuaaugcucacccugacucagccuugcacugguagauuugaagaaugauuuuacaggaagaaugaagauuugaagaguggcuuuacacuuuacgcagcaugcguagugcugucuuugguuguagaguuaagagaagcuaggcaugccaagcacaaagugagccaaagggagagcagggcuggacccgcaguggacugugaucagugggaucgccacagaagacgguuggagaguccuuguucucagcugcagagaggccccauaaugcagagugccacacagccacaguggcagcuguggcaagaacugaguuccugggucccaggccccagccaaguagacucuuucuacacaguggaggaauacaucaguaguaacuuggauuggcuuacauggcucuuacuguggcccaaccaagugucacuguaugucagucuucacauucugaaauguguuagaaucaggccuagaaguaaaagacaagccccaaaccccgggguccugaaauccuuuucuucccacuaaggggugcuguugucuggguuggggugaggggacuauucagaggauugguuccuggugaggaggggccccugugaccauaagccugccuucacuuccacaggcagaaaaggugcacagacucagggccacagaacucuggagucaaagcaccauauaagccuucuaaucuguccuuaggaguuucugguuggaaagaaaggccuacagagcuaaggugucuggcugccaugggacugaccuguguggccugcugccagauuguaccaguggacggauuccuggcagaggucaaaccaggcucaagccacugagaauaauuugucauccacuuccagagugacauucgacaucuugucaauggaagguccauuuugaaacaagccaggcaaagaggcagcagcacauucaaggggcuuuguaggaaaacagacccacauccagcccacaccugccgcuucacagcugacucaucucaaacagugaacggucucaggcagugugcauaagcucucagaagggcgauuuccuacauuguaaaaugaagaagacggugaugugaugggccuuaggaguucaucagcaaaacugauaggauaccaccuuggagccccuggacagcacaucacagaauagcuaccauuuagaagacaguaguuacuagucuguagugcugagagguggacacacucuucacugauuuguguuuccaaagaguuuucuccaaacgugaggcuuguacgugugugauauauauauagagagagucuggaaaugucaacuggguuugaaaaggcaacagccacauuguaucacuaacugcccagaaaacuuccaauagugccuuccaguucugcaacccucggcuccuuuaaauaaauagcauuaaaaguauaguguuaagaagcccaggacuuccuguauuuuagaucugucuacgagugcagauacuaaaagcauaacagguauuuaauggaaucugucuuuuugaugauaauugcaacauucugaaguagggcuuuaaacacaucuguauacgcaaacugcuacuuggaaauugcuugcuucaagggggcauucaguaucucgccaaacuuucaagucagauaacuacuguuuaaauugauggcagguguuugaucuauaaauaagaguugggcuuugcacugcgggggcucuguuuaccugaggccauguucauuugcaacacaccaggaacuggaaaggccagaggcacaagcauccaugguacccauccauggcagccgcgaugaugcuucuauacuucugaauuuggggagaaucuguuucuuuggacaagggaggcucuguuggauuagaaagugaaccagugagccugaggagaggugagaucauauggaaggauucugagcagugggaguuggcccagaacaucugauagccccaguagccacugaaaagaucuuccccacggucuggagacauagcucaguggauaaaguucuuugcuauacagcaggaaaacuugaguuuggcccauagaauccacaaaaaacuauaugcaguggcacauguauuuaaugccugcacuaggaagacagaggcaggaggaucuuuggaauuuauuagucaucugguggagccaaauuaacuagcuccagguucagugagagacccugucuagaaaaacaaaguuaaggaagaugacugaugccagccucuagccuccuccucugcguaccagcaugggugugcaggcaugcugguacacacacacacacacacacacacacacacaccucccauaauuuuguucuuguuguuucuuccucuuccuccucaguuuucuuucuuccuccucuuccucuuuuuuccucaccuuagcauucacuuucuggcuuuagcaaccucauuuauucuaguauucuauauuuauucuagcagaaggguugucaaaacuggcucuguccccaugacuccuagaucgcuucugauguuccaagugcccguuuuaaugcuaaucuggaccuugcauagccuggacaugcacgcuaucagggcuuuucaaaguucucacaccuacaccuacaucucacacccaucaccuaaaaucagagagccagcaacagcucacuucugaaggaugguggcuuccagagucacucccaccucuagcucugaagcagaggccaugguggagagggagccuuuggugaacccugggcagugcacuacuauaagacuggcuuccuaacugcucacagauuacaguauuguugguaccugucugucuaucuagagacccauccucaucuagagagaacugaggaaacugugaaauagauucaugacucccgggcacugaggacaugggagaccauuccccagggaggaacuuucaccauagauugugacgaagccagcaggcucauaggcacagagcucucaggauccccaggucugucuccugugacagcacuacucagugagaggccucaguguagagcccagcagggaggcacacauccaggcuggcccagcaccagcugugcugucuuggaauaaaauccucaguauccugucaggagaggcugggcagcagagagggugguacaucagagaaagcagugucugagcugagacaauggaauugagaaggaugcucccagucaguaagguggcugacaaccuuugauccaagacucacaugaacaaaggcgaaaacugacucccccugaccuccacauaugggcaguggcaccugugugcauggacacacacaauaaauauuuuuucuuucucucuuucuuccuuuucuuucucucuuucuuucuuuuuaaaaaauguugugguuguuguuuuuguuuuguuuuguuuuauuguuuguuuguuugguugguuuguuuuuugaccuauaauguuuacccucugagaccaguguaagcuccaggggggacauucugacuccugaacuaugugacaaagaaaaaagagagcgugcuauccauugaaaaugaagacucuugugcagaugguccuacauauucacaaauaagaacuugcugaguacauggagaaagguaguggcaaauuagcuaaucacuuugccccuggugggucacucacacucacugcaccugcccaggagcucugaauucucaaguaaaagacagacagacacacaaacacauagguauacaugcgcacaugugugcacgcacaugccagucacgugacuagcuuaauggcugggcauuucuaauccuaccugcugauagcaaacacucccaguauuccuaaguuauauauuuaaaagauauagaucuuuuaaaaaucuauaucaucucugcuaccccaaacacaauuggggaagugguccgugugaccacuuuccuucauucuuacaugucagccagccuuuaggucuggucuuucuucuuccccaucauaaugaucucugcuccuuccucucucccagucccuagccugagcaaaucuaaaggucccaccucagucuacuugcccagccauuggccauuggcucuuuauugaucaaucaaaaaccaaauggggacaaggaccuucagcauuuggacacagauucucaaaagcauuagacccaauccccaacagagaaaccuuuguucuguacuccuagccccuguagucuucagucuucacuaaacaguguagcucugagccauccacuuugcugguuagggucugguccuugucaauaucuucccugccauuacaggugaucaggguuugggucagcuguuuucagaugcacauagauggcaaaauacacagauaacuuauuaaaagcaaagcaguagugcagauuggaaagauauacacccaagggugacagugggccacaggagugaagaugcuaagagcccugguuauuguuggguccuucuuuuuauggggguucaaugggagaacuuuguuugcugagggauucagugaagguagauuaugaugaugaugauguuauuuugauugacaagagcagauuauguaaucuuugccugcugagcauguuccuucucuuggugugucugauuuuaauuauaggugugcccaacuaugcguagccuuaagaggguaaauagaggagucucuaaaaguucacucagaggacacgguccauugagcaaguaucuaaagucauucuaagcuggcugugcuuguuacccauaguucucagcuugugugccaggauguguuugaauggaaaggggacauuauugauggauugcuaagaggaguuacuguguuuccauuguuuaaaggagguaguuauacaaccugcaggaggugggcccagguugcugauauauuacuagguucauacagagaggggaauguggauagcacaaagccaaaaagucccugguggcuaucccugugcuggccuguaucacugcuacuacaagcuuggguccuuuuccugguaauuugagaaaaaaaguuuucccaauauugcuccuuuuuccucuuaccugagcaguuaugggggucuguggaacuagugaaccaucccucugagucagaagcaggcauccugagaagggcacucugaauauaaaauuagaccucuucccuucuacccugugaccccauggugacgaaagggccuaugcugugcguuuauagguugggccuccaugcuagggguagaaaucguugguccugaggcagauagauguagaucuccaaagcuuaccacagcuagagucaucugggaggagauaacuucaguugagaaaaugccuucaucagauuugccuacagucauuuguaugggggcauucucuucauuaauaaucaguauggggaggccaauuaucauuauaauucccuggcauuaucauucccuggcaagugauuauggauuauauaagaaggagcagccugagcaagccaggaggagcaugccaguaaauagcacuccuccauggucucugcuucagcuccugcuucagguuccugccuuggguuccugcccugacuuuccugauggacuacaaugggauguguaagcucuguauucccugaugaacuacagugggauguguaagcuccauaacuaguuuccuccccaaguugcuuuuggucacgugucuuuaucucaguaauagcaaccaaacuaagucacagcgugugugugugugugugugugugugugugugugugugugugugucaguguggaggcagggagaaaggaaagggguacccaguugggaaaagugaccaaugguccuaacacagcugguguuucuucuccuauuuuccaggcagaugaacuguaaucaauuuaccaaaugaucacuaguaacaagguccacgcuugcaggauguuugaggguagcaaucagcaggcagcaagggcaguacagaaucccaaauucuugaagaccauagaaagagcccuaauuuauuuccaggcuggcuuuuaaaauuauaacccaauuauuuucuauauacaaguuaugaaucgggguaggagaguauccccaagaagagauuggauauucuguggucucauugcaaaugcacacacacacacacacacacacacaccaaaggacaagaaccauaaugaaguuagaaggcugcuguauaccuauggagagcuugguuagcuuaccacucuucacucucccccuucccuugcccacacacacaugcucacacugcuucccaaggcaguuggcucucugacacagugacaguguuugaaggcuaacauuauguuguuugaaagccucgccaagcccugcucauuucugacuuugcuagagguuucagcggccaugcuagccuuuucccuuuuacucgagugcaaaugggggccaggcuugcaugugcacauuaaaggcaugcuggcauguggaggggcugcgugccugugucgguguugaguucugaugaaccaaagaaacaaguaugccuggguuuauucuggggaguguguguguguguguguguguguguguguguguguguguguguuggggggguaugauagcccauucaagagccuuuaucuguuuaauguagcagaacucaacugcagaaacccaacuccauauuagcauaucaugaaauggggcagugcagcugccugggaauggccaguuuauuauugcugggggcuguccuggguuaugaucuggaagaauuugaaucguccugugcauuuuuuuuccugcucucguuugauuuuggcaguagcagaagaagagaguauucccaugagauucaauuauuucccuucaaaauucucuuggacucauaaugacuauuaaaaauggaaggcacccauaucucaugcuauucagcuuaacugguaauuaaagugcaauuaaauuuuucacgguguagauugugucuauuuuuuuuccaggggaauuacaaaccccgagcccuugagaauuaugggauuaagcuauagacauuuaauaauucagcuuugaucggaugccgccacugaugggucucuaaaagggaaugagggcaguguguguguguguguguguguguguguguguaguguaguucaguuauuaauggugaauuuaaauuuuauuugguuucuuagaaaccagagaauaacuagcaggcuaugaaggaaaggccauugugaguguaguuuuaacuuggcaguggucacugucccuaauacauacugucccuaagccaauaauuaucucuagccuaccaggccagcuccccucaaguaguuuugugcaauuuggaacauuccugaguugcuaccagugaacaaagcaucagcauuuggcuggagguuggagacaggauugcuuggaaccucuguggccuuggccaaauguucauacuccuacuuccccucgcucaucuacauuuuuuuuccuuguugauugaaaaugauuuucagaacuggguugaggcuuuaaucauguuucaacuuuugaaagacauuuugcugaccugaagccagaacaucaccaggucuuugugcugaggaggguaacagggguuggucuggcuggaaagagcagaaagggcugcuuccugcagcccaccagcaacacaacacagggguccagccccagcaccugugcccccagauucuagagaagcagagguuaccacaguuuagcugugugucccacuccugaugguggugauugccauccucagguacuguccucgguccugauuggugaugcuagucaggcacucuacucaguccuagcucaucuguaacucuagggaagauaugacucuccauuuccugaaucuauuguaaaaauucaucuuaaaggaaucucauauguuggggguagggcgaugaucagucuuacuacucaagcaugagggccugaguucagaucuccaguaacuacccagaguacuaguaugcacuuguaaucccagugauggguaggcagggacagggauguggucucuggagcucacuggccugggcaaucacugaaagacuuugucucaaaaauuaaaguggaaaguggcugaaagacauguuggucucugaccucugcacacaugcacacaugcaugagcacacacauagagugagagagagagacagagaagggggcugaccaugucucaaguugacaagguaugaguuuagugaauucagacagcauaccgugauuuaugguauuauugugcuucuugucaauccaccagauuuuaaugccugcaucuccauuguggaacucuagccuaaaauguccuguccuuucuuuuccuuuucccuuuuuccuuuuuccuuuuuccuuuuuccuuuuuccuuuucccuuuucccuuuccuuuccuuuccuuccuuuauuuucuaggaguagcagauaaguuaaacagcucaaaagauucccaguucuagucucccaggaguuaauaguggguucccuggcacauacuaggcacucaguauguaaauggcuguagauugaaaggaguguccuggacacguuagaugguguaguucaucuucugucuuaagucacucauucauucccuggggugguuauaagaacucgaggcuauacgucaaguuagagcugcagauucuugaaguccucugcccaggccuggguguaguugucaggaagggcagcagacacuagcucacaggagaauggcauagccacauagugcccauauguaugggaauggcaucuaguucuuucgguugccuggaaccauggcgagggugaucgcugaauauugguuuuugaaacagugacuaauaaagaugguaaaaagccaaauacuuguugacuccaaccuuucucuuuuggcugccauagacuuuggcaguaaacuaaaucaaccuuuaucaguugcccagaagagacaaauuagaaggacagaauuuaggcagaagauguggaacuaagugggcagguggcuguucuuucauacguggcaaauacuuaaugccgcucagagaagacaccaagaguugggagcauuuaguccuucccugguagcuuauuagaaaccuuaaggacauccuaauacacuucauccugugauaaauaaguuuggccauucaggcccaaguuuacuucgugccuugugcugauuuuacuucaugccuugugcacagcucuucaggccuccaguuuccagccuaugaugaggacacacuaagcuuaucagucuuacauccugaagacuaaguagccugauucuugccuucucuguaguagaugacggcauagcugucaaaucuaccagugaaagaaauguccugguuuaucccucauguuuggacagaauacauguuccuuuucuucuugguccuugaaucuugggaagucaucucaguguguuuuuaauggccaugaauuugcgagucagaguagaagccuaagcucagaauuugaauaugaggugugucccacuugcugugugguuggacaccugaguuugcagcaucagaaguuuuaaaauauagguuguggcuauuccuguauguuugcauguaugaggauguacagcuaagaagaagucuguugccaggcagugguggugcacaccuuuaaucccaggaggcacuugggaagcagaggcaggcggauuuuugaguucgaggccuggagugaguucuaggacagccaggacugcaccgagaaacccugucuugaaaaaccaaaugaggaagaaguggggggagggaggaggagaaagaagaagaagaagaagaagaagaggaggaggaggaggaggaggaggaggaggaggaggaggaagaggaagaggaagaagaagaagaagaagaagaagaagaagaagaagaagaagaagaagaagaagaagaagaagaagaagaagaagaagaagaaaaggaggaggaggaggaggaagaggaggaggaggagguaucaucaucaucaucugucagcccauauagcaggaaaguccaugagugucgagguuuaaggaauggccaccuccagagcccuaaaaacacaccaggacacugucucccuacacuucuguuucuucuugaguuggcuccaugaucaaggauacugaacuugagacauugcuuuuaaccugaugauaugcaaguuuguuguuuucugucuaacucuugcugucucuagaagugauuuguucuuuuccuuaagaaccuuccauucuggaacuucccagagggaaucccuucauuguccuuugcuguauagaauccccucugccucuguguggccagguuuugcauuuggacuaucagucaaucuuuuuauuccucuuuucugcugucauucugcccacguggaaaccugaagaauucuacuuucucuagccacuccaggucucuguagcuugcacuguauaaagcuguugcucgacagccauuucugaugacugacuuggcagguuccugcagcucagccuaucaacagaucaggaguggcggcggugcgucucagcagcaguaauuguguauaggaaaccuuccauucauuucugcauagaugcuuucucccguuuuguuuuuggugacuugucucuggccccucuccugaaccucggugggauguguacacagcuggaggccaaugacagaguguuggaacauaugguaagccauucauaaccggauccugugcccaagauggugaucuuucauguugcugguggagguucugcacaacagucuggaauuucacauuaaguuagcuucugugacucgaguaaugaagaagaauaggaauguucaggcauuaccaagauguugggcuguguaugccagggcaguuaacaggggauagaauuucagagcuggaaaggacagucuggagucagaccccugcuuguaagaugagaccauagugacucagugcacuguggaauuugcccauagccagaacugaagcccaaggcucuugcuccuggaccaucuucuucccucucagcccaccaucucccagaacagugcugccuucccgaggggacagucagaugcacuccacccucuucauggaggcacuggaaacugcugcuaccuuaguagccagggcucugcagagucaagggccagcccgugggcuauagcccagagcuccugaccugagcauuuaagugcuauagugauacuucugcuuuggaauuuguacaauucuuuuuaaaucaauauuuugaaaacaacuaacauccuagggauaaauagucaaaugcucaaaaucuucauaucuuuguacguuuuaaaugcuguuuuaaaauuaauuauuucuauguauaugugugguuuguaugcauguauguguguacaucauguguguaccuggugccagaagaggguuugggggccccugguacugaaaauagagaugguugagagccaucauguagguacuuagaaucaaacccagguucucugaaagaacaggcaguguccccuaaccacugagccaucucuccagcccccauuuuuauaaaugcuuaauaaaaaaaaaucuuagggcuuagggagaucggugacuggcacccugaugugaaguuucaugcuagaacaucaggagacucauaacaguuggcuuuuaagaaucuugugaccauuauaaacuucgggaguuccuccuugggagcacuaacaaaucccaucucucucgcuccuuagguccucagagaucacuuucuccuaauggaggcuuuuacugagagcaacucaagugguuacaaggcuggaucaccaaggggcuagguugauaagcgugcugaugauucgcccacaggcagcuccccaggaugaagccuuccuuuagccaaagggauugauugacaggcauagaaggaccuuccugaggucugcagauggcacuguuauauucucaaaggacaggauugauuuggugucacccuucaauguccgcuuccgcuuuggguagguuuguuuuguuuuagguuuugucacucuguuuccuccgugugucauuauuuuguugguguugguuguuggguccuaaacuagagucauuuauuugaagcugugaucucaguucccccaccccucuuuuaacuuggaauaacagcuuagucuuggccugcuugucuaaacugagacuuaaaaaauguuuccaauucuauugcucuuggugugaaggaagauacccacuuaucgguuccuuuuauaacccuuccguguugauucuuggugacucugagaaugggccccauuaucuccgcuuccucggugaggaacuggagcuccuaguaggucacugaggccaggagcagguguaaguccuucugagucuguggcuguacaaguuugacaaaggcguccucagugucuucauccaaaccguggcuaaagaugcugaauagcucucagccacacuggcugcuucaagugccccuguagacccuuuucugggaaguuagucaaccacugcgguguaauucaccuugucuaucugauauucucuuuaucggccucauuacuguuuucuugaaaauucuucuacauguaaaagcaucaggcacauuuuaaaagucuagcuauuuuaaauauuuguagcugguucugguuuaauguaacauagccagggaaaguaaaccccuuuaugguucuguucucuaaacagaacuguuuacuggguuucuccccuagaaagcugccuauaaaagccaaaugagaccccgccagcucugccucugcacagcaaugccuaacggguuucuucagcucaggaucuuccgugaugagcaaagaauuugcuggggauggcuccacccccuaugcuagugaaauucaaucuccacugagccauaagcacuuccuauuguggucuuucuccuuccaugagaagaguaccauuaaucuuuaaccacaguggcuaagaaaagccacucugucuucaggcaaucgggaauuuuuuuccauuucccaggguccacccucuaccucucauuccccugugguggugcaggaucauccaugacuugcucucuggccccuauuacuacuagaguagaagcuuuguucuuuuccuaugcgugugcacaaauuguucuuuaagagcaaaguugccaugaguccuuacuccagauguccuucucaaccaauucgaucuacagaaaugauuugccuguucacugaggcacaucugcauggcaggcacaugugccacauacugcucgauguagcauugacucuuuuaaaagucacacacaaaccuugucaccacuuagcuaauccugucgugugggccacagauuauagugauaugauugcagacuguaacauauaguuacaaauuacaucaaagaaagaaagacaucccaucaugggaucuucauacaguaggccccaaggaggggcugccaugggcacgacccaccacaaacagccucaguccauccucuagaagaguaugaaaaacuggugucuuauucaggaaaaccuggggaugacagguuuucuacugucaccugcaagcagagggccuuggaaacuauauagcaaaagcauaggacaacugagcagugcuggggucccaagcagcuccauguguuaccccuccugcccugacccaccugcucaguuugcagcgguaggaccuuguuaccaguaaacuaggcagccauuuuccaaggcuacagagaaucucuucugugcuucuguccucucccuaugggccauuccucaggggucugcccuauuccugucugguuuauuccucgggacucaucaucucuggccauuggcuucauagggagcacugggcugagagugacuugcucuuggcuggcaggcauccacgugcccgccuguggucugaggaagagggcuccuugagaacaagacgugaaggaaauggucaagacaaaugguucagagcaggucgcaucacagagggaagcugcauagcagucuccguggggaucuguuacgacuccucagaguggugggguaaugccagcgacccacauaguuucugugagucccagcacacagaucuaggugaggugccccacaagcaguccucuggugauucgcuggccuauuauuaaacaucaaggagaaacucaucuagggcaggacagacagagccuccucugucacugucuggggucaaaguacaugaagagcagugugcgguauguggcccguccacucgagggauugacgucccaaugcagaauaugcucgcuuacauaaacuugcucuucacuguguugcuucccagacacucugcgcucaaaggggaggagagggacuucuagacugaagcuuucaccucuauggugagcacagaggaagcuaaacuucaggcuaugcuugcuaaagccacugaccccaagccacaggucacagaaagaaaggacccgggggcugcugcauucacuucaaacagcuggaucugagaauccccaggagccuccuagguuuugaaauagcccauacuagcugagagcugcauuuuuuuuuuaaguaggaauucuuccauuuucuagacuaacuugcuucccccgagaaacauuuggcauuugugaguggucagcgaagcuuaccagguuucugugcaccagacugcaaauccaagccgcuuagcauccuugaacccacgucacaaaaagccacauaguuucugaagaugguagacuucucuagaagguagaggaagcaguccuugaguaagaaacaucugcauucucuggauccaccuccuuuagaacucaaaagauaacccggauggucauuuccuuaggaaucccagcuugagaugagacaggaucucuugauggcaggggacuugcagaagagagugaggcuccgggacacucacugucaaucccaacagaaugcuuaagcaucugugccugucgcauuuugucaaucuagucucacugaauuucaaccugcgguagcuucagauaagcacaguucauuacaggcagccucuuccugggguuagugcuguccuucuaguugucagugcuaucagccauugcuccgaacucuugugcagauucacaaggaucgggcuccacuuugcuaaaagaauccagaccuuuuuaucaccauccauucagaugucuccuccuccuacuuaguccuguguaguaaaucugcauugcauuuuauuuucaguaaaguguuggcacagcaggaucuuugcuucuuguacguaauuauuuaaguuccagauaaucuguucaucuaaguccugaaagagaggucagacaucccaucccaagaagugugcuucugcucgcucgcucucucucucccccucucucccucucccucucccucuccccccccuuccccucccccucccccacccccuaccccuccccucucucccuguuggcacacuguagauacccuuggccuucauguuugugcauuaacuuuaauguccuugauguguagggcuuuucagaaggauggaagccugucucugccaugugggggacaugugauuguuuguaauguggccugaagaaaauugaucaguuacuuggaguuggaagcaacuaagauggagugaucagaaaacaagccugugagagaaugguguuuugacuggaagagaauggcugaaaagagcaugugguccugaggcaaagaauuccagguggaccacggaacuaagaguugcugaugcugguacacauuggucaaaggaugagaugcaaucagagugggcagagggcuucucagucucacggcacaauuagaacccucuuucagccgcaagaggcaaaguagaucaaugguaagcgggaagguguagccagagccaauaacaggaugaacagucaggcugaagaagagaccggugaagcagggauggggccuguaccuuggcugcuuggcccugugugacaacagugagauuccuggcacccuggcuccugacuugugcugguuacuauaugugcacuguaugaagugggauguaagagagccacgucacccguguugggaggugcuaaugccaggaggcugcuggcccugaaguuaugacuccugugaagccuguguguguccuuggggguauaggauccggauguaagcugauccagauguggcuugauccaggccagagacaagauaccuucuaccugagugacaggucuccaucugugucauugagaguaggauaccucaacccaccaccagagauucuguucaugacaaggaaagagagcuguaacuuuaauuuuucaaagccuacuuuuaaugauggcucuuaaacguuuuaaucucccuuuuagcccaccacccaccagaggucguggaaaagaaaggauaugagggagguaggucugcuuaggaaugguucuuuggagcaaaucccaucugcacugccaggaaaucaguucaguucaaggauacacaguggcagcuugauccacucgcagacacuucaugaauaugccugcaguucaguucaguagugucaggguagcagcagcaguggcgcuaccuagcagagacagccaggccucagccaagucagcaccagucagcaggagggaccaagagcgacaccaggagaacgucucugcugugucucucucagcaaagggagaccaagaagcuauacaagcaacccaagcuucacccccuucacugucgguccagucucccuccaaacuucacguguacuucaccggucuugccucagcacaugcgccugucugagcugacaucacucugccaauccaaucagcucgagucuguggaagcagcaagaagccucagcacaccaccagaaguuuguguguguguguguguguguguguguguguguguguguguguguguguguguguuucucuaugaaguccugacaaauggaacucaacagugcauaugaggcagauggauacauuugugugguuagcgaagaauccuuuaucacguguccuuucucgugcuugcuuuagcagaacauauucucaccugugucuacuucaguaaaauguucuuucagaagucugccuuagccuuucaccugugucuauuucacuaaaauguuccuucacaugucugcuuuagcaaaacgugcuuucaguuguguccacuucaggaaaacacuccugcauguguuugcuccagcaaaacaccguccaacaacuuuccaaagaacucugacguuugcacuucagagagcaucaaggacagucagaacgaccaacagcagcaaauucauuccauaugaaaacaaaacaguagacuaaaaguccuaaauauaaugcaaacacuuaaagagaaacagagccuucuggagugaguggccaaucaauuaaaacgagaaugggagaguugaauagaacugauuaaucugaaagcuguagucaacagaacaaaacaaaacaauguuuauauauuaaauugcauuaugacacugaggaauucagucaaacagaaaaaucuuugcaaaaaucauuuuuuaaaaguagcuaggaggauggagagauggcugagcgcuuaagagcucugacugcuccuccugaggaaguucaguucccagcacccacagugggcagcucaguacugccuguaacucagcuccaagggaucgggugccuucugcuggucucugcagggaucugcgagagcacacgcacacacacacauacaccacacauacacacacacacucacacauauacacacacacucacauacucacacauacacacauauucacauacucacacauacacacacacucacacacacacacauacacaaguuuauuacuagauuaaaaagagagggaaaagaaaggcacagguguaugccauauaaaaauuaccgugguccaugugaugaaugaguuaugcuaaaggaagcugugaccaagcaggacaaccugauuucaaucucugggacccuggggguagauggaaagaaccuacaaguuggccgugguugucuacaggaacgugauggcauaugugugcauuaaauacacacauacauacauacauacauacacauauacauauauacauacauacauacauacauacauacauacauacauacauacauaaggaaagugacagcuugagcuuugaaagucuuaauacaucgggacaccugugguaaguaggucacuggucauuucccagagagcuuuggcacugcuccauccuggccagaaaugaggcagcagguggaagucuccugaacaggacuacagagagcaugcugcuugcaccucuggaaagcaagccuuugccagggaguguugcuccgugugucagagcuaugaggggacauauuucaucaucaucccaacccuggguggcaguagccacagaggugaggggacaaagccagaggagcccugugaguguccuauguaccuucccacgccaaccccugcuugauggcucccuuucugcuacaagggucacauuuauuaaaaacaaacaaacaaaaccaagcuaugugcuaacuacagacuauuugaccuguuuaugaaucauugcuuagcaguaucuugacagacucacuuugugccccauugaucugguaccuccaggaaaggauaaacuaguagaacgucaaacucccauguuccugagggguuaauaggauggaaauauggccuccuagauugaauaaggagcuugcuuauugcccaucaucacaacgcaccucuuuuggggucuccugugccaugaagauuaagcauaaaaaccuagaaaucugauagcaaagagaaccccugcuaauagcucuaagcaccccccaaaaaacauuaaaauacagacuuauuuugcaguauguuauguuaugugacuuaagcuaagucaucaacuuuugugaauuuuaauguccacaguaauguuugccuccauccuccauuccuguaacaggaauuuauuguaagcaacaaauaacaacuucuuaaugaaauggaugaaugucuaaaccccucggaggguccuaggauauggucuuagcuguaucaauaauccagccuauggguaggauucucugcucaccucccccgucucugccugccccccuucacucuuucucuccccacucccucucucuuucucucccccucuuuccacccgucuaaacuagacauuuugugaagcagucuaaucaggugguccugugucacugagccugacagugagaacuucuagggaggaagggaguggcucugaggaaagggaaguggcgggcauucuggagggacauaaacauaaccacacacagggaaggaagaugaggccucaggauaaggcuggcagugccacauggggucucugcugaggauuuuccagugauuuccaaaacacaggaugaguggcucuagccaacagucuggcugggagacuagaaaggagcagaggaauaaauugaauuucugcagagccggugccucccgaugcucacaggagguucacacaagucucccccaccccccacccccaaccccucucucccuuucuuuucuaagagauagguaaacucauuaccuucagaaaaugauaauccgcccggcagagcccugcuccauggccccacucaagaaaaacacagacaaugaacauauaaaccucaguuacugacaaagucacagugccacucugcccugacuuugggacucccgcaguuuucauaugcuauuuugcaguguccuggcguucacaaaauaaaccagcccuuugcauuagcaagcauuccaaguggcacuuuggggcccaaugggggauuuggaagaacgcuuccugugccggacagaccucucucuuccuaggugaaauaccaguuuccuuuuccuggcuucacuccccauuagaugccuggagcaauuuagcaaagguauccgcuguggguagggagaaaagugaccagacuaaggaggugucuguguucugggguaucugggaggcccuacaucugguguagacuuggcuuccucauggugcaucauguugaaugugcacaggcagggugaggacucccacugcagccccucucuuagauccuccuaacaacaacaacauccacauuuaaauaauuaacccaccucuguuuucccuggaaaauaauuuguccagaaauauagagugaguugagcaggaagugcauuuacuucacaguggaaaccaguaggcgugcugaugagaugaagcaggcugcaguccaggucuaacuccaggucggaccucgagcuuuagcucagcgaauuugugguccaugaagauguccagccaucuuaacuaaaauuggcacuauccaugcacacgacuccaggggaagccugaagucccugcucugacugcuucuaaacuuagccuggccuuggcuagaaacacgaguguguguguguguguguguguguguguguguguguguaguuggcucuggguuuucuggaaguguuggcauucccagaugcucaggguggcucgacuuggagcuaggcagagguagcauagucaccuucgggaccgauuccggcucucucuuaccuggaccuauagcgccaaagcaguagaucacucugagcuccacucauugacucaguagucuggcauccagugcggugugugauucacacggcaggcauaauggugguauuucuacauccauguuccgcgcucagggcacucuugccuauuuauucuauuucuugaguccuucguaggcacuugaggagcaggguuuugugccugcuguucccacugccccaaauauucuauuucacuuucagucuaauuuugauuuaucuauaucaaccuguccccaaccaaaaaaauuuuuucucuucucgggcugucccggcggguuaggcucguucugccugcuggaugccuuucgccauauuuguuagaaccucucaaguaccccacaggauuuugaaaacccagcuguggagaaaugacguucaccuaacaagugaaccuuuuccaaggccuugaugagcucagccaucuaaaggaagcugggagauguucaucaagggaaagugcccuggggaaggcaauaagaaaggcacuaugaaagucuccagcccaaagagaaaaagcaagguugucaggaagcaagggauggaggggagugaagacaaaugaggcucauugcaaaaugcugaugugagccggccaagcaucagggcuggacuugacacaguggcuggaagcggcaucgcuacuguggaaucaugggagugcaaagaaaugggaacucuaugcaaacagcagccacagaggacucuagagagaaggagacagaaugccuuucccugccagcagaagcgagccauuuagaacaagaagagcagucauuugcacaaguguuaaaaaacccacuuccaacaguaaaaucccugaaauaucccuagcaaggccauggcucugcccaggagauggugugugaucuggaaaaguaaugagaaugcaaugggcauugugaagacgcuguucuaaugaacacacuucccuuugccccuccccgccccuuccagcaaauucuauuacuccaccagccugcuagcgaucaguugggccuuuagagaauagccugugaacgcugaguuacuccacgacaggauuuuugaagacaauguaaucuggcacuucucaauuuucucugauuuugugcagagaaaauagaagagugucauaaauauuuucugcaaauaguguuacaaagagaagcacaauuggcaacagcaguguucugcuauuugcucggaugcuagauucuggguuuucuguaggaaacaaccgcacuggcagacucauugguuucacguuucucugacacgcuucuuuuucucucaggugagugaugaauucggcucugccuguggacuccugguggucggguaauacugggcuguggggacuuccaugcuuagcagauucaggguauauuaggggcuauugaaacugaucggaaauguuauauguuaacccagugcacagagcugccuacaacaaaauguguggggaggggagggguuagugaggucccgagaugggauagaaagaagaacugcuggguucggaucucaguucucugacuugcagacagcguccugggaccucagguuccacuucuguauaacugauaauaaaucacccaaguguuacuaguggucgguggaauuaguggcuuugaaauugcuucagaguuuaaaagcacacacuuaagcccacugugauaacuuaguggcccugguacugaagcccaguuuuuguaacccucuuuaccuucuuaagguuccauuaccuccacuggcccagcauugccaccaguuucaaugcagugcugaguuuuacagagcuuugcucucaacugucaaucucaagcuuaaguagcaacacacuauugucuccaagaauuguuaagacagaaacuugggcuggcaaacuggcucaguggguaaagucacuuucugccaagccuagugacuugaguucaguccccagaacucaugugauaggagagaacugacuccuacaaguuguccucugaccuucauucacacuugugccuuggcacccacccaugacccucccacauuaguaaaucccuuguuaauaaguaauuguaaugaaaagggaaacuuccuauaaaccuagauaaaugcagucgucaaauaugaguguucuagaaggaaucacccaaccacagauaggaauuaggaauaagggaugcuugugaaauacucuauauuauccuuuuggucccccaggaggaagcacacuagggcacauuagaaaaauugcaugugcgaguagaaucauuugugugagugauagaacccccuuuaucuguucugaaacacucccggacacucuggucaucccgcugagguuccagaugugauagaaucggaacgaguuauccaugcuacacucacucugacaugcagauauacaaagugugucaguguagggcgcugauuguuuuacgucuaugcauuugggagugguuucuugaacagccaugaguaauuggagcacauauuguuuagcuguaaaucugggagucccugcauauaucccuaccacgcuggguuucccaggggucaguggaagccugggaacaaagggccaugaauaaacauacccaggacuuguaagagaacacaggccuguucccuuucucaguuacuguucuucugaaaucgauaguuggauaguugggcucccugauggucuuccccuugaagguuguguuguguacucugggucuuuugccuuucuguacaaguuuuagaauucuguggaucugcagaaacucauguugggauuuugauaagaauuguuuggccugguggaggccaaacaucuaucauggggaguucgugccuuucuauaucagugcaugaacucaguguggcuuuccauuguaucuagagugcugauugauuuaaccugcaucaugucacuuuucaacauauucaugccauaccuagaauuuuuaaaacauaauauauauauauauauauauauauauauauauauauauauauauauauacuuaaguaauuuuaacugcccacugauuaggauucucauguuauagauaaaauauauguauuaguuuguguuuauugaauuuguauccucuggcuuuauuaaauucaguugacuucaggaacauucuguuuuguuuuguuuucuugaaccaaagaucaaguccaaggucucucauaugcuaaauaaauucccuauugcuaaacugcaucccuagcccucuuugcucuuuuuauuuugaggcuuaugagguggcccaguccgaccuugagauagucuguaucccaggcaggccuugaacuuacagucuucaagcauagccucucuuguaucugggguugcugguuugugccaccaagccuggcaucuugggaugauuuuuaaaauugcuugauacuuucuguccauuuccuacuuucaaucauaugaucuauaaucaaagacuuugugucccuucucgugugcauugugucccccucuugucccaucuuccugcacugacugcaguucugcacugaguuaaguugagcagaguggagaccgugggcauccuuguguuagcauccguuuuaggggaaaagauucagacuucaguauugccaguggcaucaugauccaaugcccuuucccaguguucuuugacucuccgcaucagaucuguaagugggcagaggaugaguacacucgguguauagcuaguucuuguagucaaauguacucuugucuauuaggaacuuauugacugaaauggaaucuucuguugccaugccucucuaaguagauugaaaagcaagcauccaaaaugcccuucugccagggcgcauuagcuauuagcccugucuugucauauuauuugucucaggguuuguaucaguuuucaggcugacacacccagccucucaguccucccacugcccaccucucucugccuuguuauucccaggagucacagucugugccuagaguaaagguccacguugguugaggagagaauggggcgagaaggcuuuacgacugcugcagaagccacucccacacagcacucaguuguguggauuccugcuuggucuagacuuaaauuucugcuucuggauucagagggugggaggggucuuucccagcacgcaggcaggcuggugaauucauauucccauugcacucagcaaagcuguaguugaggagacauccuggacucaggcacuagacagccccucugucugguguuggucugaguucuauuuuucacuuauaaaucuuucuuuaaauauuuaaaaucugugcuugugucuugguggauauuuuaauagcuaauugggaguucuguaauggagcuaacuugucuggucccauuguaacucugaguauacugaaugauugcuaauuuugucuuauguggccagucauacucccugcuuucaguccuuaagguagggcugggaggguaagucaguguagagcacuugucuggugcucacaaggaucggaguucaguucccagcaccacccaauaaguaauggaguaaguaaauaccagauagcaagcugcccgugcuguccauacauuauacuugagggaaagauggaagacauugccagguuuucucaaaaccaucaaauuuuacucagucuuuggacaaggaggaugggcccaguggauaaggcacauucaaugugaggaugaagacuggaauuuggacccccagacccacauaucuggguagucauggcaaccccuucuaaucccguucuaauccccuucuaaucucugaagacagagaagguagucaccaggcacgcuagcuauaagaguagccaaaucaguggguucuccauucaucaagagucucugccuucuagcaaccaaggaagacacccuacaccucagcuucaugcuuccacauaaauguucaugugcacagauaaacaugaacauguucauacacacauacaugcauaaacacauacacacuaccaccaccacaacacauacucaaaaauaacaaaauaaaauaaacuugauuguuugcuucuucugugaaauguuuaaauuuuugagucauuuuccucuagacaaugacaaaacacacauggcuuccaacagggggacccuuuacuggaccauccucucucccauaucaccuuucugcccuuuaaaaaccauacugcuugccggcugaggagaugacuucagggagugaagguacaagccuaaugacaccagguugaccacugaugcccaugagaaagccaggugcugugguguccaugagugaucccagcgcucuguugaugaggcaggaggcagagaccggaaagcacaagcuccuaggccggcuagccuggagcaugcuaugcaguagucacaagcgacccuaacgauaaaggaagcacuagucacacaugcacuguaacauaccaaccugugcacgcaugcgugcacacacacacacaaacaaacaagcaaauacauaauacaucaaaacacuggcaaagugucugcugcauuguagaaaacuguuaaaagucuuacaaguugaaaguaugaaggaaaauaacucacgacucuaaagacuucuccaaucacagaaggaguuagagugauuuuuaaccuccaaguagggacugguuauauaaugaagcauauaaacuggguauacaaugcuggggucuaaagggagacaugcauuuuggguucuagggaggggcagaaguuagcugcugcaucucccugacccuccgcucugucagaggagcguucauuagcagacggaaaaguaaaagcucugaagacucaaguauugaaguauuggaaagauauauuuccuuuucuaaauccuguagaacucuggggagaucauuaauaagcucacuccuuuuaacucuuuuuaaauuacuuguuuuugaugcaaaaggcuagguuuuuuuuaaucacauagagaaauguuacauuuuuaaaagaauccacuuucaugcaaaaucgggauauuacaugcauauuuugaagucaggacuggugguuugaauuccaucccagcuacaugcuaugcgugcgaucucagacucugaaaaauuguguaccacagcuacuuaaaauuuaagauauagauaaaagcaguaccuauuaaaugauugugcucauugauaacagagaauggugaaugugaaauaauauggccccugccaucgucaucaauaaacuuugcggguuugcugucauuuaacccuuccccucccccuucuguauuaaccucccuuccucccccucccuccuccacagauggagccccuuucccaacuuccauuucuuguuucauaucaccuuauccugcuacucccucuccugccccccaucaggucccuguucacauggcucuuguaguuagcccagguuaugcacucguaccugaagauuuggaaauggaaaccacagagaacauagagcgccugacuuuccuggucuagccugccucacuucucacucaguguagucuuugcuaguccagccauucacuggagcauuccugauuucaguuuucuucucagcugacuugugcacaugcacauuuucacucucaguucauccacugaaggacauguaggcuguuuccauuccuggcuguggugauuagagcagccaugaguauggcugagcgaguauccaugcaguaggauggugaguccuucgggcguaugccaaggagugguacagccaguccugugguagguuuguuguaaucuugaggauuccucagaccugacuuccagacuggcagcaccugcuugcagucccuccaacauggggucccuucuccauauccucacacagcauggguucucaguucuuuucuugaucucagccauacugacuggggcgagaugaaaccucagagauuuuaacuuguauuucccuaguugcuaagguggguuaauacuuucugagauacuucucagccauauuuuuuuuauuuaacuaagaauucuuuuuuuuuuuuagauccucagcccauuuaaaaaaaaaaaaaacuaggugaagucaucauauauaaauauauaaacaacaaacaugaacucagcuggguauguguguguguacauauauauguaauaaugaaaaaaucaaagaaaaagagaucauugauuugagagggagaugaggggcaugagaggaguuggagaaaggaaagaaaaguggaaaaugaucuaauuguauaaaauuaauuaaauuaauuuauuuuuauuaucuuuuauacaauauuuuuacacauuguaugaauuuauucauaugaacauccuggcuagguaaauccauaaaggaagaaggcaggucaguguugccuaaguguggggauagaagagaggauaugaggagcguggcugccacgguuccuuuagaagugaaagaacauucuaaaguuacauuacuuugaguaagcuaacuauuuaaccauucuuaaaugcaggauauaaaugucuuuacaacuccagaaugguauacuuuagaaagaguaaaccugggagagauggcugaacaguuaggugaaguggaaauuucuguuugugucccgugaugcagacgcacaugauguuuugcugaggcaacaugugauguuuggagagauauacaauauauuuugaucauguaauuuccccucccccagcuccucaucaguccuccccacccagcuucauguucucucucucaggaaacauaaauagguagauagauagauagauagauagauagauagauagauagauagauagacaauagacaaaaucuauuaagacaaaaaauaacaaagcaaaacaaaaaguacucaaaaauacauggagucuauuaaauuaaaaaaaagagagagagaauauggaacuggacuucuguguuguaggcucaggcacggugugauagccccuucuuaucaaauaugaaauggcugguuggaagagagaacuguugcagacugaguccugcagcagggagcgagugacacugggcuuccuuaguguuuuaaaacuacucgugcugcuuaggaucagacuguggcuauaguaaguucaucccacagaagaagauggcagacuggugcucaucagagaguggaaagguaaggaggagagauagguuaggaaagugaggaucaauacacaauaagaaaggagucauaaguucuugguuccugaauuacuagacuucauguagacuaaauaugaccacgugugcucuuuuccaagacagccagaagaccuugacgguucccgacauauagaugcuaagugucggaggauauaggaguguucuuuuuauuucuucauuacaucauguacagguauugaaucauuguguuguggacccuaaaucugcacuauuuguuuguaguugguaccugcugccugauccagcucuaggcagcgguacagaugcauaguucuuucuaggaacuucaugugauguaaucauacaauguguaacuugggguuacuguuccugggcugcaacaccgugaccaaagcaaacauggggaggaucaugaccccaggaagccagcacaggaacacgagcagggcaggaaccuggaggcaggagcucaugcagaggccagggagggugcugcuuacuggcuugcuuccccuggcucgcucagccucuuucuuauaggaccagcccagggauagcaccgcccacaaugggcugaguccucuuccauuaaucccuaauuaagaaaaugccuuguaggcuugccuaaucccugucuuaaagaugaguuuucuuacccgagauccccuucucucagaugacucuagcuuuugucaaguuaacauaaaaugagccagcacacaaugcaaacucacaucugccuuuuucuuucacucagcaucacagcacagaggguuguccauauguaucccagcuauugauuccugcccacugcugaacagggaggauuuccuguuagaucccauuggguuuggcagacuugcucuucucucugucagccacacaaucuuaccauccuacuugcuucuuagggaaucccucuacuacugccuccuagcacuuacugcauuuuuaacagauuuccacauuuuacaucauuuuccaagaaggaguaaguguggucccuaaccugcucucagaccugaaauagaacgcaaaguuucacaaauuugaauagauuaaaauaaacauuuucuaaaaucccagaaaacaaacguucaaacucugcucacaagcucuuccauagaaagugaugucagagcgguagagucgcguggguguucagaucccgagggcuucugugguuaugcucgaccucagcguggccuuuguucccaguauaauaaagaagaacaggguagagaaguagggagagguccugguaaaccucuccuucccauguuuacuccagaauuuaauagcuuacagucacuguguaauucguuaucaugguugguccuuuaaaaacauuuacagacauuccucagacauuucauaucuuaaaauggcaccguaagaucugaaaccugcaaaggacagaccaaggaccauccugccaccguuaguuuggaguauuaaccagaaagcuacuaaggugaacugaaaugccauccuguuugcugggggauccaucgguuuguggggcaguuuuccugcuuugugucacgguguuagugggugggggugggggauaggaggagcagguuuggcaggggggagaggaaaccaguacauuuggugagacagggagcacauucgaggugguuuaaccccacacgaauagggacagagcagugggcucuuggcucucaguucauguucuauaaagaaauaucaagucccagauccuuuggaagauuugcuaauuucuauuuuuauuugucuguuuuguuuuaucuuuugaaauuccuuuaaaaagaaaaaagaauuauuuauuuauuuuauguauauaugaauacacuguagcuguagcugucuucagacccaccagaagauggcaucagauccccucacagaugguugugagccaccaugugguugcugggaauugaacucaagaccugaaagaguagucauugcucuuaacugcugagccaucucuccagcccccaaauucccucuuuuuuuuuaauuugagaaucuuaugcaugcauacaauguguuuugauccaauccauccuucuauuccccacuuccaauuucucuccaacucaccccacccccaagcuccuccccaccucacgagcucugguuuuaaacccauugaggccacuuuccgcugugagcucugugguuacggcugugggacugucugcuggaaucuggguuagcaccccaggaucacagcccugaggagaacucacuccaccggcagccgucaccugccaauagcuccugggcaagcggcaggaccuugugagccuuuccccuuucugcacuaaggcuuggcugguuugcuuuugcacaggucuggagccugcaguuaaacagccacugagcucauaugugcagcaguggcccuguggggccuggcaaaugguguuuugauucagaugucaccucugguuccuacaguauuucugcccccucuuacacaaugaucauucauucucauucucucucucucuccccacccccgccuccucccuucccauaccccuuccccucccccuucucucucuaacucuguggcaaugucaagugauuucccacaucuuacaaacuaccuaccacauacuuaucagcccuaagaaugcaggcauuuguguuugaacauuguuguaugcauucccaggccuggccugucacuuuuuuuacaccugggcaaaggugaugugacagaguuacugagcugcuucagcccaggucucugucuccuucguucuaauuuacagcuuccccagauaagucucugccguuuagauuaaauaaaaagauuuuucggguucucaguaucuaauuagagagucaucucaacaguggauccuacccacacgguuccugaucaucagaacugugagguaaaagaaagcccccaccuuuugggcaaggugugagaaccgugaaaugugagauguauuauuuuugugcgcaaaaauggucccgcuuacuaauuuuacggaguaaaagaaacccaagaaagucuucauuguaauguugucaggucuaguuacagugugggcucugugaauguucucauacuaaggcaagugcagaggugacagagacacgucggaccuucugugcugcgugggacacugguagcacaugucacagacacagggaaucagggguuugaggcacgagcaggaaucacagcugaacuccuugccacuguuagagcuguggguggaggggacacugggcagggucgauccacuuggggauuagcagcuuucuggguuacaugaggucauugggcagcauggucugucuuuccucuccggcucuuuccuguuggggguagggggcaacaaaaaauuuuauuuguuacaaaucaaagcuucccugucacacaggcauaaauaaguuccauacagcagcugcuuuacauuauacagagccuggggagcagaggaggagucugugacuucucagagagccucgucccugguccccauggugcuugcugaguccugaagccaagucucccaggguugagggcaagcugcaacuucugccuuuuagcugcagggucagugucuggaagagcgugacaguccaccucucuccuugugucugccuuuccauuugagguucagaaugucauaaaaccccagcacccuuggagacuugauguggugacagggcucuguuccucccucucuccucccucccucuuccccucccucccucccucucuccccuccuuucuucuuuguaaaagguagaguuuuaauaacugcuuuugaugccagguuaucaaacucacaaaauagugcgaaaugucuuugggguaguauugucuagaugcucauuuuuauauaacacaugugcugcucuucuucaggguucaugacuugcacuccaaaggcuucugggauggccaccaucuucccucccagcucucgaacugguuggugaauuguccucauggcacuguggauuugaaucuugcugucuuguugucauuuaauauuugugagguuucuuaggguugaugugucagaccuugcucugcccucuucuccguucucuccugugagauuccagcuagccugcauuccccuucugugaaugacgauaaauacacuccucuggccugcuuccaguucaagacccagagccaggaguaaucuuagcuuaaauuauugcauuaucacuuccagaguuucuauugccaguuuuuaugugauuuugaucuuugcuaauauucuuucuuguuauuuaaauuuucaaacauacuuuucuuucuuucuuucuuccuuucuuuuuuuuuuuuuuuuuuuuuuuuuuuuuuuuuugagacagggucucucugcauagcccuggcuguccugaaucuagcucuguagaccagaauggccucauacucacagaucccccugccucugccucuugaguauugagauuaaaggugugcaccgccacaccugcuuauuauaguucuuucgaaagucucucagaaccuauauauuuuaguacaaaaguucuguuucacgucugcauuuccuuucucucaguuuucugacaguucccuucuccugcaccugguuauaguucugcuguacacagagcauuguacagagaaauuaaagagaugacggggcuuugcaugacgcugugcuacucacagaaguaucucuuugcugcuagccaucaaggcaaaaacauaucaccuuaauucaggcaagacauguauuaagugauucguucuggguaggggccacucuguuccuguucgacuacacgauucugagguuauagcccuuugggagccacugaugaaagucugggauucacucacgcaccuccuacuuuuuggguccucgguguagguugcugcacauccuuguccuugaggccaccggagcuguuuguugcucagcuauuuggccuuccuggcccuggcucucuuuucaaagcaucccaggggaaaguggcuccucacacaaggugcacaccugcaagcuuccagucuuuuccacagucaugagucuuuaggagucuacagcuuccauggucugucuuaccuucacacggggucucaaaaacauuuucaucauuuugccuuguuuguagcaugagucaguccgaagcgagcuaacccaccauggcugggaaaacggauucuggugaagauauuuaagucacaucucagacauuacaucauuuaauauaaaacaggcggacaguuccuuacagcuucaguguaucucauguuaaggucuccuucaguaucugagaacggccuuuuuaacuacuccccuacuugaaucaggaugcaucaagccuauguguuuguuacaucucuuaagucucuuuaaaucucagcuguccuuccccaccacgugcuccccccacccccaccucuuucuuuuccugcugugaccuguggaggacccggugccgagguccuguggauucccacacccuggacuuagcccgaugcuuccacaaauuccuuuaucacuuguguuucccauaaaaugggaucuaauuuuaugagcuccauuagauucuguucugguuuguugguuucuguuugguuuggcaaggaugcuguauagguaaaugcaaaacaauuucagccauaucccuucagacaguacucagugucugguuucccaugucagugacugggcggugcauucaucuugggacagccuaaccuacuacuggaagauucuccaccauccuguccucugccagcuucaccuggcaauacauuuucccccagacuagauuuucaggaguugcaaaccucuuuuucccaagccccaucacuauucuagauuucucagcuaacauccauacaacuaggucuguguauucguugggagaugcaacuccaacagguaggugaagcucucacuuuaggaccagcaaaugcuuugacuuuaggcuucgcaaacaagcccgagcacuaacugucucuuccugcccuauaaaaugucaaagcuuugcuaccucugaggcagugccacuguggcuguagcacacggagagcacugggcacagagcaaagguccugccggugaaggcuucucuuugugccuuuugaauucucauguagucccaauucccugacccucagccucugcugaaaccugagagcagcaagaccauaugugccuauugguggaacuaaagcuacuauauaugccucuccacagccacccacacccugugcaaaugcauugcccccauguacacagcaccaaggcagcuuuuccauccuaggcccagcuuucugggguaugagauggcucgucuugccccuauggaaagaagaauuggccugucagaugguugugguguuauaugacucucauaugugucuuuguggagguguuucugaaucgcgggugaggguggggucaccugugacugcugucucccagcagguccccagauccuguugaaugaacucugaccuuguuugucucagauccuucuuuuuuaaggauuugagacagcagccacugucuuugacaccugggccuuucgccccucccucgcucccccccccccccacuucucuguguuuccuaccuggugauauauuuuccuuucccucaauagagugucaccugauaggaagacuugggaacuagauaugucugcaguggguagccuggccagaaggcaccuccccuccauaucugcauccagccuccccuacuaucgguaggauaacccaccccuuuccaugccccacaucccauccucuccucaguccaaaccagcccacucuugcuguuccccaagucacuguagucccaacuccuguguuaggaguagggagggauacccacgcuccucuuugcguugugacucaaucaucauuucuucaacuuggcucuguguucgccaaggauaagaauacaccuuggacuugugcagaggucugcaaacacuggacuccccuagcugugacacccuagcuccuguuccaccccagaacagguuccaccucagguucucugugcaucccugauugacaucugauaacccagcaggugaagaagaccagcagagucccccacucucucauugcuucccuuugcagguugauggaaaggccacauccuacgugggcuacccagcaggcgugagccuuccccagaacuccuuggggugcuacuccaaccagcaagcaugagucugauuccacagaucagcugggaggccucuaggaacaagaguccccagcagccucuuacuaagagucagcgcaccgaaguugugugugggcaucccccacuucccauaggagccucccgcucacccuccacucagguuuuaaucuucccgugaccgaggcagguacccgucacggcguaauuaugcgccacuuucucugcuaucacagaaccagauuuucuucccuucugcucacugacaugacagacacgcacuuagcagagagauuauuaguauaaaauuacuuuuuggccuuuaaauuuaacuauaccauauucacagcaauaaaauaaaauccccaauccaggugcgcuuuucagggaacguguccggggcaauuaccuucugaugauggcauccugcacuuaagccuuuugucugaggaucgggaaaucauuuccauccaacuccguaaugauguucauucuguaagggacaagaggugaagccacugaccucauagcguacaucagagaugaaggagccuggggaccaggugucugcugcuuuguucuccaccuucucccuuucugggucuuuaaagaggcacgguccgccucccguggcacagugcuugcccccaggucagcaaucuuccuuuuuaagagcaugaaugaauagguuucuauauugcguuucacagagaggagcugaaucagaggaguggggugcugaagaucuguuacacgggagggcuuaagucuggauucagugggcucaguuaaagggcagccgaagcugagccacacagggcuagcauuaucuaggugagcgccugaacugucgcuguggccaugggacaaaggcagguccuccugucuucacaucaggagaauguccugguuggacucccugguugucuaaauacauacccauccuuccauuccaaguuccugggagccagcuuaccccauuucuccaagccacccagccaccaguuuguucucuucaucaaccacugcgucacuuucucccuccacucuggucaacagauuugaacugaauauguauggcucgaaagauucgggcacagggcacaaaagcacucuccuucccauaauguuauuuuugcucuuguaugaauauuuaucugugucuggugggaucauuggguccugauggaaaugcucaugucuuuccagugugguauuucccucucgagccugaccauaauccugcaugggcaucggaagcucaguauuugcuuagagcggcaguucucagccugugagucaugaccccuuuggcagaccucugucucccccaaauauuugcauuagaguucauaacaguagcaaaaucacauuuaugaaguagcaaugacaauagcuucauguuuggggguugcuacaacaugaggaaguguguuaaaugguugcagcauuaggaagguugagaaccacuguccuggaaccuguaggagauagaagagacaauacugugggauccaaaaugaaacgaugcaguauugagcccuuauucuccaaucuaccaccacaccccuccuaugcuauaugccuaugcuaguauuaauuggcagcuugacagguaggagacaggccucugggcacaccuguaugagguugccugaagguuagccucugagaaggucugagggcaauugucuugauuguguugaugugggaagaagaccucuuaaucaugggcagggucaucucccuggaccagacuagagagggccagcugaacauuagcaugcaugauuuaauacucuccucuucugacuguggaugggcauagcauugccaauucucucagacuccugccacuacaaaucccugccacaauaggcugucgccuagaaccgucagucaaauaaacccuuucuccuuuaaguuacuuuugccaggauauuuuauuaacagaaauggggcagggggugggguggggacaaaaacaggacaaugugaaaggucucaagaaugaguuguguuccuucugugugcuggcuaccaugggaacacacuacagacugggcaccucaaccacugucgagagaaagugagcacacaugugcuguaggaaagguggaccaugaugggcucuacaaccaagauucagucgaggggcuuugcagcagauguguggcagcaucucuuuggaaucaauagaaaugcccauaccuuuagccagcaaauauauauugaaaguauccaggcaugcccccagugccucuccuccagaggagggagccaccugccuggauggauggucacauggccaucucuggugacaucucuuagauaauuugagcccugugcccucccugcuugagcuguucuuugucugugagccugggcagcccaugauuaaauguccccauguagcauaucucuuucauuuauucuacaaauacauauugaugaagcugggccgauguugcagcuucauggaagaggaccaggggcagacucauacuccaaaacgcagugcagcauucucuccauguaaaugcacagggccagauggauggcucuucacccugcccuaaaugcaggagguauucuggggauccgaaggaagguuauauaucaucucgucuccauauuggcuucuagaucacaagcugauuucccuucaggagcucauuaacagucacagccagcucuuccccugugucccagucuuccagugaaauacugacugcgaaggugagaacuaccgucacuguuugccuuuuggucucuuccaggauuuuuuucccuggaagccaucccgucagaggugugcaagugaugaaaguuggcaagcugcagcuccaucaaggcauguuuccucaagccaugaagaaccugaggcuggugagugugccaaggcuuggguucggcccggcguaccuuccucugucucuugccaggccucuacucggugauugcuaagcucugcucuuagcguaugagcgcauacaugcccaagugugcugguaaauguuucacagccgucucuaaaaacauuuguaacaguugccaauuucugugggauaaauguacccaaaugaaauuuguucuccacugucaguauagacucaaccugcuuauuuauuaugcgugcugugcaugcacaugugugugcaggcuugugcacaugcaugaagaggccagagaucaacuaggugucauuccucaagagccauucaccuuacuuggggagacaugggaucuugcuggcuugaagcucacugauuaggcuacacugacuccccagugcgcaucagagaccugacugucuccacacucccagcacugggaauuacaggucugcuccucuaaccccagcuucuaacacggguccuagggcucgaacucagguccucacgcucacaugacaaacgcguaaccuacccaacuauuccccagaccccuaaucauuacaauuuuaacagucacuccggugugagucucagaacaccaguacacaugugcucacaaaucacccuuuccccacauccucugagcacagugucucuucuugcgggaggugagaccugcccaucagucuauagucucuguaucacucccccuuccccuccccacugccagggcaggcucuugucaauacugacucucuaacuuugaggucuuuacaaagccauuuccucuaccuuaaauguacuucccagcucagaacucuacugguccuucagggcucagcuccaguguuuuuguuaucgggguucuuacaacucuuugccagcgcugccaguggagaacauucaacauuuuaguguguguguguguguguguguguguguguguguguguuggggggcacccuucccaaccccagcaggccuggaacucaucgcugucauccuuguaacuaguucagcaucaggcaaaauccccaaaauguauuuguuguuggagaaaugggaagggaaggagugagagaggucaauacaaucuuagcagugcauguuggaaaaugaaauggagggccuaggcuagugcucguuacuuugcaaaaggagcacggaguuccacccucuuaaggagucucucugccuggagcagcccagggcucuccuggccuaaccuucccacacuucagaacguccucuugcugugacauggcagucaugugccuaucuggccccuguacuggugggucauaggagaccuagacuauaggcuuucucagggagccuuugauaccugaagggggucuucugggccccaauacucuugugucagagagcugugguagaaugaucaagcacugcagugaggcuucccagggacugucuaaagggacaagcaaggagauaaaugccuaaaggauuucuaagccaacuuguaucgaacacuagccacauugucucuaauugacagcagccaucagccagugggaacaacuggggcuuccuggaggucggcaucucuucuucuuucucuuucuccugcaucuuccccagaugaacguuaggacaaccuccugcagucucacaaaggcugccccuucucuuaucuggucaagagcaugacaacccuccauccgucgagacaaauggcacuuaccauguucugcucugugaagguuuaaguaaaaaaaguaguaauaugucaaaagcaagagaaguauuucuaguccuguuuggaaaaugaaacgucaagguggauaugugcaaaaaccucucuucaagacauagccaguucugauauauucugcuuaauucaccacgaguuguugauuaaaugcugcugcuacucugaguaagacccaguaauacuguccuuacaguuggaggagacaaacaugugaaaagguuuuauaaucuacacugagaugcaaggcuccucccuucucucaacugucucauuuaaguagaagaugcuuucuggaaacgcagcaucuagaauugccuucaagccuauuugaauucccgaaugugauuuuagaagaaaggugggugucuuaguuacgguuuuacugcugugaacagacaccaugacuaaggcaacucuuuaaggacaacaguucauuggggcuggcuuacagguucagaguuucaguccauuaucaucaaggagggagcuuggcagcauccagguaggcauggugcaggaggagcugagaguucuacaucuucaucugaaggcugcuagcagaauacuagcuuccaggcagcuaggaugagggucuuaaagcccacauccacagugacacaccuauuccaacaaggccacaccuacuccaacaagggcaaaccuacuccaacaaggucacaccuacuccaacagggccuaccuucuaaaagggccacaccuaucuaauagugggaggacuaugagagcaaguuugguuccacucuuggccggggacugaaucccugccuucuuuauagagcuucagccggggcaucaaacacccucagcugcaaagacaacccugagaugacacggugugggccuaugggugguguggcuuuuguggaagaugcaggccaugaccaggacccucugaugcuugucauguggcccaugacaccucuugcccuuagucuauugaaguggaaacuguccugucacccugcccucaucuugugagcuuaccauacaucacccagaagcuucuguuggaaaucugcccagcauguccuccuccuggcaccagaaguaagucccagugugagugccgagcaagugaagacuguccugggcugacaugcgacugucugccagacuuuaaaacaugcucucacccaaggugccuguuugacucuagccaaguccuaggcuuauuccaaacacugacauuaaacaaaucucaggagcagauaugcucccuggcaacaugguagagcaucgaggggugccaggguuggggucacaggcucagauucuaguccaaccauguagcuuuguaacuugaagcaggacacuuagacucuccaauuaugacuuuauuuuccagaggauaacucuucuauagaguuuacagaagugguuggggcaguguuauggguaugccugccagucucaagcauuggaggacuguguuccuguugacugggaacuuuauuaauuauguuuacuguuugcgguuacaacauggucuucccuuugaggcacuacauccuucaucuugggguguuaccccaaagggagugggacuuccucaagggacugauauaucuuaugugucccccaauggcgccaaacacagacacauaugccauccaccaaacaaagucacacuggaguggccugaauuucuuaauaaagaacauuaggagccccagcagggccuguucuuugagucaugucugcagcagaccuccuucucaugacaacuuccuagcagaugacuaacccaaaccaacagagcacuucgagaacauucguggccucugggugcaggugcaggcuggggucuuccagcaaaaagcuuuucucccgaguuuccucagcauucaggcaaccggagcagcaggaaggagaccaugcacuucccccuuuguaacagcuacccucuuuugauguaugcccuggguaaagccugggaauagggauuucaaagcccaaacaugaagcagaaaugaccuucagaaacaggcgcaggaaugcgucacagauuguuaggacccugcagaaggucccccguuuguccagcucugauguccuuugcuucucucuccucgccucucaguugaaaugcucuucucaggauugccacggggcagucaguccugcagccccucccugcacaguucuuucucuacucuucgucucuugcccugucucuuggaaggcuucuguuacuaauuugacuuguaggccaucaaggccaaccuugcucagccagguaucacggagaagacuuucccaugggaucauuugcuguagccucccugaccugggucccaggcugguuccuuuacucaugguauuuggccagugggagcuguguuacagucagccuuccuuugccuggguaacuuuuuuacaauccagauccagguucacuaugcuucugcuccucucauguugaggaucuauuuugccuuuccuggucucagauaggaaguucaggcauaggguucugaaagucgcucccuucacccuugugcacuugucgguuacacccacucauccuggcagaucccacagcgcaacugagcuggucucugauccagucugcacccugcgccucucaacagccagagcaugcaauuuuacucuucccguuuccuagcccucuacgguaguuuuuaaucucuguguucauguucacauucaugaaucugaucagggccccugccucaccagaggaaagugaacaugcguacagucuuggauagaagcccucaaugccugagacuuuuugagcacguuuagcccaccugcacgugaugucacaacuuggcaugugggucagugggaaggaagaaaagagggcaagagauaugaagacacgauaggcuguaagugccacuggugccaucagagccccuggcucugguacuuaugaaugucgccaacugaauuccaguaggaaauaguagcaucaggugugcguuuuuaaacaagaaagagaggagauagggcuagagagauggcucagcguuugaaagugcccgcuguucuucuagaggaccuaaguucaguuccuaacacccccuuuaggaggcauccaaccucuuguaacuucgcuucagagaaucuaaacacccucuucugacuuccguggguaucagcacauaugugcauggagugcacgugugcaugaauuuacacacacacacacaccacuuuuuaaauaucaaauauuuaaaaagaggaaguaaagaaaaaaugaugcauagugacuaaacugucuuaaagaaaacaagcacaaaugucccuaucaaagagucuaaucccaguaguagccagaagcugagugggaaaccuggacuugugccucuggcugucaccagcaaggugucauccuuacucccuuuuagagugaugucagggucagccugcuugaacaagguuugcauaaaauccagauucccaaaaugucuauauuuuaguugaaaaccauucaccauacaaagaaccagccuuaaucuuuauaaucgaucaacagauaccagcuuugagagaguagauacauuagacucguuugacagugaugucacaacagccuuuguaaagaugcugcuucagugaguaauuauaaacacuuuugcaacaaacaagaaucguaguaagucucgugaagagagaaaggugugacggaacacacagaaaccagagagccaauaaauucaggaagcaagcgaggagagagaaacucagcgccaauugcacagggagaaaaccauaauaaaagucaaauugaacauggccuuggggacuuggggacugaugacuaguaaugcuagcuuucucacauucgacucccagagagagaagagaaaugguaaguauaaaaaaauacuugaaacaauauuagaggcaucgaagcuggaaaagaaaaaacuaagcagaugacaaaauuuuauguguaaaaugcauacacagaacauauaacauauaauagaguuauauauuauaauuaauaauauaaaguauuauaacuaauaaaucaguuagcaaauuaguaccaucuaagaucaacauucauaagucauuugaauaggaaauugaauucuuccauuuguaagaugauaaaaugcuuggaaauuaaccaaagugaugaaagaaagacaucaaaauauaaagugacaucuugugcuauggaucaaaaaacugaagauguaaacaucucucagaguaguauaugcauucccaucaaaagccaauugcuuuuuuuuuucaaaacagaaaaaucaaucuaaaauucacauagaaacccaagagacuuugccccagcaaaauagccaacaugaaucuuuaaaaagaacuaaguuggagaauucuaauucccaauuucaaaacuuaccauaaagggauaguaaucaaauccauaugcuacuaguauaaagauggauacauagaccaaugcauauacaauaaaaaaaaugcaguagagccucacacacauggaaaagcaauuuucaacagcaccacuuaauaagguaaggauggucaccucaacacauggugccagagagacugauguccacauacaaagacugaugugagacucaccuaaccagaaaauaacccaaauggauccagauaucugaaacacaacagcucaaacuacaaacagaucaaaacaaaagagggaaaccgucaagauauugagaugagcaacgauuucuugacuauaacaacaaaagcccgggaguucaagaccuaguggucgacaaauagacuucaucuuaacgcuaagcauuauguaucagaaggccaccugccaauggagcaaaagguaagcagagacacacaaaagcauauuacucagcccugaaaggagugaagcucucccacaugauacgcccugaugaacucugaagguauuaccccaauucaauacaaccggcaugugcugugugauucuguaugugugaggcaccuagaauggcugcucacagcagaaggcaggguggugguuaccaggaucugggggaaggcauggguaggugcuuacgcacuguauagcagggaagcccuuucaucacggcaugaugcagauguucugcacguggacggcaggcacaguagcguggauguuccugugcaucuaaggauaguccucucaguuagugcugugacaaaaugccaaaagcaacuuggagaggcaagguuuauucuaccuuacagcuuguaaguucaacgccaagaaaaaccagggcaggauuuuagagcaggaaccugggcagaaguuggagcagaagucaauugcucugacuugcucuuccuggauugcucaguuugcuuccuuauacaacucaggacccacacuggacucccacaucagucauccaugaagaaaaugccccacaggcuugcccacaguccaaucugaugaggccauuuucccaacugaggacuccuguccccaaaucuaacuuguaucagguugacauaaaacuagccaacuaacaugguaaaguuuuuuuaaagucuauauuaaaauaugaauuacauauauuauuguaauuguuuuccuaugugauggaaaacuaccugaauuuggcaagagauaaaaagcuaaguaaaugcuccccucccccaaauuaaaaccagaaggcauucucgcccagauucauuacucaaauaaaaaugaaacccaaaacaaauacucagcguagcagaggaugaaaugauuccuugcugagaggggaagaaacaccugaaccagaaaccccacagaauagcuccuugucuucaagugugucuggggaaaggaguuguuaguccccaaacccaaauucagcaaaaacaucguucaagcgcuggaaaggaaaccaagcuguucacagcuauaggaaaacgaaaaaaaaaaaaaaaaacuuggcaccaucaggccucaccuaaaagaauugccaccccaacgccucuaaaacaaaagaaaaauaacacaggaagaaaucuugaagcaucaggaagaaaggcuacaauaaacaaaagucugaaugaguagaauuuccuucucuucaguuuuccauguugauaguugaaggaagccagacacuggcugaggugguucuagaagucuguggugcaauagcuggauacuuagauuugggguuggggauaaagguagagagaagggacguugcucucugugauuccaccugguaaaagugaagauaccaguggacuauaaugaggaaggagggguggucuaaaacaaccacuucuuaaacgccguguaaaggaauguacucaaaggcacuacaggguggaaaggccguguggcucaguugguagcgagcuugcgaggcucacacaaggccagggcuuugaucucuagcaucucauuacaugagugugguggugcucuccuguaaucucagugcuggggagguagaggcagcaggauggcaaggucaaggucauucuuaccuacauagcaaguucaaggccagccuagacuaaauagaccuuuaaaugacaugcuaaaagagauauggcaaaacaaggggauuccaaaaaaaaaaaaaaaaaagacacaucaaaacagguagaaagaacaaacaaaaaauaaaauguaaaacuaauguaguauuaauuacauuguaaauauaaaugucuauauaaauauauauaaguacauauauaaauauauaugucuauauaaauaaauauaaauauaaaugucuauauaaaugaucuaaaucaagaguucucaaccuaugggucauggcccuuuugggagucaaacaacccuuucacggggauugccuaagaccaucagaaaauacagauauuugcauugcaauccauaaaaguagcaaaauuacaguuaugaaguagcaacaaaaauaaucuuauguuugggggggggcaccacacaugaggaacuguacuaaaggauuccagcaucaggaaggcugagagccccugcuguaaauacucuggaaggcaaaauuuaguagagcagauauauuugaaaguaacccaguaugugcugucuguaagagacucuuuaaacauaaugcuauggacagacugaaaauaaaaagagaugauacaucaugaaaauauuauaaaaaauagcuucaguggcuauguuaauaucaugaguagacuucuuacuagagaugaaggaccuagaauggaaauguagucagucuacccauaagaugcaacaacacuaaacauagcugcaucaaagcacacaguuucaaacaguacagacaaaaccugguacagcucugccauggagccugaggcaggaggauuacuaguuggagaccagacuggccacccuagcaaauucaaggccagucuggguagcauagcaagacucugucucagaaccuaaccaaaccaaaccuguagaccugaaagaaaacagaaaaccacaaguauagguaaacgugaagccugugucuacaauucauaagaacaaacagacagaauaucgacaaagagagagggaaauuuauuacuaccacuagugauguuuacgugaagaacacaugucacaggagaacccaggacacauucugggccauuagucaaauaaucaauuaaugugaaugguucauaaguguaagagauagauaaaugcucuggccucagcagaaucaaauuagaaaucaauaacaguacuuggaaacaaaaucaaggcuccauccccccaccucugucuggugugguaugucacauagcacagugcaaccagaggugugcuuuccuucgaugacaccaaggucuugggaaaguacgacuccuucagagucucuggcacuguguuaauauugauuggguugguucugaagagauugcucacaguuaagaacauccacugcucuugcagguuaauucccaacacucacaugguaccuuacaccgucuguaacuccaggggaucauugcccuccccuggcuucuaaaggaacuagguaaacauggagguguacacacaugcaugccggcgaaacacccggcauauaaaacaaauaaguauuucuaaauguugacagauuaaagauaauaacacaauaaugugugugcgcacaugggugugcauuuugccugaauguaugugugugaaccauaugugugcagugcccaugggggucagagaaaggcacuaaaucuccugaaacuggaguuacaggcaguugugggcugauuuaugggugcugggaauggcacugaugucuucugcaagaauaauaguucaggguucuuaaccccagggccgucacuccguccccaacaacagcagcucuuucuggccugguuucugccacugaccaugucuggaagccccuccugugggcaccccagcagucugcuuucucugugaugaugcauaggcacaagcugucugacaaggccagagacccucccacagcaauggcccugaccuagucccuggaacugccugucaguguagcguacaugagugaacaggugaucccuccaaggauaucuagccucccuggagcguagcccucaggguaccugacacuuagagugggucugggauguuguagagugguguggggucugcagggaagcuucugagcucacauggggccucggagacguuggcguuuccugcugccugccucaaucaguggcucuggagccgccugugggcacagcuuugcuugauguccccuacugaaugccacguccaccuccccuagcccacacauggcuuucaucuugggaugggcagaagaaggaaacucauccgugucccgcuguggagacccgauacacaggcucuuaucauguguuucuuuuccuucugauuuuuguauccauauucaaaucaugcucggggaagucauuuauugcauuccccgggcucacaguagaaagcauaugagauccuugauaaacuuaauauacuuauauuaaaaauuaauaagaaagccacauuguuuccagcuuuaaaucauaauuugaucucauucauucuauuuaauacauggucacaauucuaaaauuacguuguuuuuuuuuuuuuuuuuuuuuaaagaugugaugagauggaaaugugucgugggagccuuuucuuuauuucucagagagcccuuugccucucaagcagcugacugucuacauugccauuuccaguguaacauucggaauccgaacggggguguagcgcaucccgcuggaggcuucaaaugaguccuccgugcgagacugcaugcaggcuccuuuuaaaugcuaccauuaaaaaauaaaauuuaauggcaagagagaagcuuuucccaaaccaagccugcuccaguuuaaauuuccuuaaucuguuuuauacuccacuacaggaaauuaaacuggaauuguccccucugacgugcacauguguagcauuugggaggcgcugaaggcagagagccucaguucccagcuaccauugcuauggcuugcccaagauuuacugcagcuucguuuggggggucgaggugagaggaggcaguccccgagcccauucagggcucccuuccaucccaggcacauauuugccccaggaccaugacagacacaaguggcaucccauuccagaaccagaucucguccuccaucaccaggccugcccauucaugucaaaucacugacaccuucagacacauggaagucacuggcagacuuaccagucuuuuuuuuucuuuuucuuauucucaauuucucuucuguauaugacuaucacucagagaaaaucuuguuuauuaauuauaacuaagcucuuauuucuacacacaugcuuggggaaacacagaucagccuuccacugccagggugacaagaagccagcauugucauuaggcugucggucaaguuauagagaaauccaggucccucucuagguagagaaccccugaaacacagccaucagacaaagcuucucugcucaggagcuaugagaagaagccagcagagggcgcuguggcagcugagcccuuucucaagucgagaugcaggggcucuagcagagaacauuuauccucagcaaaucacaagcacagccagcccgagauaaguagaaagggaccagauagacacaguggcuuucaagucagagaacuugccaugaagguucucucugauccagaauccucuauagugaccccaucauucgggucccugucucagaccccggcauguccagcgcagcagagggcccagggcggagcagggaaaagagaauaaaacaugaggcaccagauguugcucucuaaucuucucccagagccuggcugccugcaagguggggcagcuccugcucuuccccacuauuccagcaagcccugccuugggauaugugugcagucacugcaggacagaccugugcagauuaacaagaaacaaguucccugcaucuguccuggccccuccugugggccugacugccagugucaguccagagccauuuucaaauguccuuuuauuuucucccaacauugaucuguaacccuaucuccugccucucugccacccccccccccaacacacacacagguugagggagaaaggcagagagagacagagauaggcagcaggcaggcagauagacagacaguagacagacuacuuucaauuuucuuuuucuccuaacaucuagccauagccacaucuucugccccuccaacauggacacacacacacacacacacacacacacacacucacacagguugagagagggagggagggagggagggaaggagggagggagagagggagagagaaagagagauugauugagggagagacaggcaggcagauagacagucagacagagaacaccuuuacagaaacccgaagagaagccaggagcacaggcuaacagcagccaccagucuaaggcuuucucgcccugccuucagucuuccucucuguagaggccagggcgucugacuugaugaugucguguggacagaggggauucacugugagaccucucagugcuuuccagcuccaaagucucugcagccaaggaggauuugucccaacaaaugccuagcagaguaaaagcaaaagagacacacgcacacacgacgacaacaguagcaccaggagcgaacccagagacugaaagaucuguguccuaucauaauguaagucagcuggaagugaccuaacucuucaagagugguuuauaaaauaauauccacagacgcagcagagcuguucacaccuguacagggugaaucaugcugacuuuagauuagcaccaaguagcagacaauggcugugauuucugggaguuacugcgccuguccucagugggguguggggguaucagguuguccuggaguccauugccuggugcuucacagccaccagcaccaccccauaaagggucuuuagagcacagucacaccggauacaguagcuuugcauuccuuccccucuccacauccugccuuccauugaacaguacauggugcugcugcucgggucauucaucucuccauagcaaaccauccaaagacucaggagagugaagaacaauaagauuauguucacaguucugagccaggaauugggauugaacacagcagguguggugguuugcauaugcuuggcccagggaauggcgcuguuaggagguguggccuuguuagaguaggugugucacuguggaugugagcuuuaagacccuuguccuagcagacugcaagccagccuucugcuaguugcuuucagaacaagauguagagcucuuagcuccugcagcgccaugccugccuggaugcugccaugcuccugccuugaugaaccucugaaccuguaagccagccccaaugaaauguuguccauauaagaguugccuuggucauggugucuguucacagcaguaaaauccuaagacagcaggaaugggucuccagcuuuuccacagugccuggcuggcuucugcuuggaugcugaggucaucuaaagccucucuaggaguuagucacccacagcugcccacauguggccucagcaucuggcuugggcuuucucaggguuuggaagcugcugucccagaagcaaaugcuagugacuaaagcagagacuucuugccucuagguugcuaacuuuauuucugcugugcucucguccuggaggauucacaagcuccauccuuuuuuuuuuuuuuuuuuuuuaaguucuagagguugaaugucaagacuuaguaaaaggcugagcauggaagccuaaggaagggacugucaaaaugucaacaccaugcuagcacaucccuggaagagaauguuaacuauacacauguuguauauagucauuaagaaccuggaggugagcauaagaugcaagaaaaagaauuaccaugggcuagugagacaacccagcaugugagagagcuugccaccaaaauggcagcuugcggucuaucucuggaauccacaggguaggagagaaccagcucccucauuuguccucugacucccauaagcacaccucgacacaggcauaccccccacccccaacauaaaauaaaaaguagcauaaaagcagcacaccauuucuucuuuugcucaacauaauggccuuagugagaaugacuaaaacccuccacuagccaccuaacccuguguaucaguauagucacugaagaucauauccgccccaggaugcccaguguggaguccgccuucuaaacacccagguagcacccaugccaccuguauucuggcuuugucaaccacagugcugccuacuccuuaaagacugguugcucgccugugggccacaggacuccuaggccuuugggaaaccgugagaagccagagagggaccugucuguuuugaggcauuaaucagucaccuguccuuucuccuuaggccuuugacauuaugaaagugacccacggccgagagcacagccugauugaagauuugauucuucuccuggaagaaugugaugccaacauacgagccuccuaaggacccccagaaggacggggaagguggcgcgcccuccaucgaacgccuuacugaggucacacgcucugugguguuugcuguguggaccuucuguagaaauugccaauguguuuauguggguaaaugugauucuguggcaugucgugagaagucuuacucgugauagagcagaaccauuacaauaaauuaaaaagacgaguccaaaaugccacuggcgacuuggcuuugccuauucucaggugguuuugaugguuaagaugucaacauuggaagcaggagcuuuccaaaagaagaauggaaucccaggcagccccugaaaggcagaggcagguggaucuccaugaguucgaggccaguuuugucuacacagugaauuacaagacagccauagccuuguagagagacccuguuccagaaacugaaaaaaaauaggguagaauauguucaaguuuccucuguguguguguguauauagaaguaaacggauaaaaguaauaauuuucacauagacuucuaaacacaaguguauaucaagaagauuuuuuauuguacuuuuaucuuuauugagaugucuuaauuguacuuauuaacaugguucacugugauauuucuauaucugaauacacacacauggcgcccaguugucacugaggaacucuggccuccauuuauuuuccugccuccauggaucaccguuucucucucucucucucucucucucucucucucucucucucucucucucacacacacacacacacacacacacacacacacccuccugacucuuacacaugagagggaaaacgcaguacuugucucugucguccccccuuauuucucuuuguauaauuuccuccaguucuguccauucggcugcagcugacagagcuucacucuucuuuauggcugaguaauagccuguuauuuguauguacuugguaaauguuagcaagcaccuacaguaacugcagccuuggcgauuaugaauggcuuuauaguagacaugucaggcaaguauguuugggguuuaauuucccuuugacauacaccuagaaguggcauggcugggucccauggugguacucuuuuaacuucuuagaugaaccuccuccauacucuccuuggcuuuagguucccaucaacaguguaugagaguuccuguucuccauguucacgucagcauuuguuauggguuuuuuuuuccuugcuuugcuguuggcuuuaaucgcauuuuaacuggcguacaugauauuucaucauaguuucgauuucccugaugaccaaugguauugauugugccucauguuuuugugacuguucagaacaguuguucauuuuguaaucagauucuugccuuuucaauuccuuaccuauuauaaauacacuauguauuguggauaugacuccuucacugggaggaugguuggcagacaguucucuaguucuguagauugucuuuuccucugcuguuuugugugcuguacagaaccucaguguaauuguuugucuucgguucugauccccucccuucuauaaucacauaaagccauugcuuauucuggcuucuaugauacuccauugcccuuacugacguguucccaugcauguucccagcuugaucuugcauuuggucuuugguccaucgugagcugagauccguccgucgugaaaagguucgguuuccuucucuugcauguggcugucugccuucccugcacacuuuguugaagagggagucacacagccuuuaugguuugggcacguuugucaagaaggagcggguucuagguuugugggcuuacuuuugggcucuccguucagucccaugggucccuugcucuauggccaugccguuucugcuagcacggcucuguaauauggcuugcagucaggugccauguugccucuggccucacugguuucacucaagaugauuuugucuguccugagucuguugugaagaagcagaauucugaaacguugccuuuacuccucugcagugaauaacuacguguuauuuccuccugaauaccccuccaacacaggaaucaucaucucaaauccuaggucuaggccauuuccaacauuacuaggaaaacacuguaaggcucacacaaaaagaacaagauacugaagucaacucuuuguauaaaucuuugcuguacuuuauaauucuuuguguguguuaaaacuuucuuaacccccuuucuucuguaauugcucuagucugugcuuugcugugcuggugggcagagcacaaagcucuauugcccugugguaaacuguguucucauccucauucaccuuagccugguuuccucugcuuuuguugucuuuuccacuuccccaaccccuuggccugcuucucuaucuuucugcuuuagaaaaauaacaaaaauauuucccuuguccaaaaaaaaaaaaaaag

SEQ ID NO: 548 - RNA, 18620 nt, Mus musculus
ggucgccgccagccggcugauccccugcagccgggcugcuggucuuaccugggcauccgaggcaaugcaagggcuaccgccgggcgccgggucuguuuccagccccgcgcgcugacauggcggccgacgagcugucacaccgccggcucgggucucccgcggcacuggaggaucggacaccucuagccuucccgccccgccucccucugcgcaacccucccggcuggcggccggaccgaggagcauagagugcgagaccgcggcuagagaggaagugcggagggcgggcgaccauagaguuccagcacggacacacccggagaguccacgcacaggagccugggggcggagccuaggcggaagcggaagcgagugagcaaaggacugaggcuaggucguucgcaugcgccauucguaauguuuacuuccgcccggccuagugugguggugaaaugugugcacgugugauggggugcucugcguucuucgcagaggcuaccuuaacugguguuugagguggacuuuagaggaggaugaggggaccggcgaugcggcuucccccgcggaucgcgcugucagcguuggcccgcggcccaucuugcauucuaggguccggagcggcgacgcggaaggacuggcaaacgaggaaccgccgcggcuucucugacuucaauauagagccguugccugauucugauuuggaggagucguccccguggacauccaggaaucgaucggagccuacgcgucacauagcauguaagaaagcggccaggaaccugguacgggaccugcuggagcaccaaaacccaucccgucaaauuauacuagagugcaauccaggugaguugaacagaagcuuugcccuuagcguuuacgugcccaauauccuaaauuaguguuuguuuauuguguaugcgcgcguguuuaggucagaagacgacuuagcgagagucaguucucgcccuacacuugugaucucaaugauugaaacgaaguguucaggcuuuacgccaaccgccauugcccucugagcguucucauugacccugaauuguauuuuuuucuuucuuaagcaucacuucuuacugacagucauuucguuuagacuugacaguaauuuuuauggcuaaacauucaaauaguccgugaguaagagguagucgcaaucuuacauacuaucuuauauacuuguuuuucuucuaggaaauagugacauuuguuaggacaguaaguguugcugucacugacagacagaaggcuguacagcuuaccuguugagauguuguggguucaagguaacugccuaaucauaguuuucuauaugcaaaaagaauguuaucuggaaacauugugucguugaagcuuguguaaagucgacuuugaaagugacuguggccggaugcaauggcacacaccuuuaaucccagcaagaggcagacugaucugugaguuggaggccaucgaggucuacagagugaauuccaggacagccagagcuacacagugagauccugucuuaaaaauagaggaagagaaagacacacacacacacacacagagagagagagagagagagagacagacagacagacagacagacagauagaaauggagagacagaaucagacaguauguuguuuauuuugcaaauaaaguuuuucuguuaauauaccagguccuggaauccugacuggggcauuacuuaaagcuggugccagagugguugccuuugaaagugaaaagacuuuuauuccacauuuggagguauauuuuuauguuccuaaaguaauauaucuauaaagacuaggaccuguugaguguuccaugcuuguugaguuucugaaagcuugggaguucugaaaucucuuuucuaguuccuacuggggccccgaaaaugauaaccucaaagcaugacucauuaauaauaagugaguauuuuggaauaaaggacaguuggaagcccucagguguagcuucaggaagaaaguguuucugcccuccuguucuucaaaucaagcccuagagagcagaacuccuauucucaggauagacacagaagcuaggaccaccucacugcaaaagaaaugauaggccugagaauuacuguaagcuuucugugugagaacugccuuuggccuaccuugauucauagaggaucgggaguucuuuugucagaagcguucacccucugcccaagaggaacgaaugacaaacguagagagccuaagaaucugaacggagcggcccugggucugcuuccaccuuugguugguucaggucacaccccuuuuauuccagcucauccccacagagcugcccauucuccauugacucucagcgugaaguuggacacuuucucuagaucuacauaggaacacuuguuacauaggcucccauuaauuugugguuacacuuuucaguuguuaaucuaccuuuuguuaaaugaguguaguuuauucccuuaagaucaggaggaacuaugucccaucuuaccuuccuauacagucuagcugaaugauauauaauuggucacuaagcucauguccccaucuucaguacugugcuguggcucugcccugugugaacuuaacuuucaagaguaagugcuaagguuagguuaauggugguacacuguucucucugaguuuacuuaggacuucaagugaaaccaaaaaggguugagauggauaagcacaguugcagaaugcugcuguuguuguuuuuuuucccaaaugauuguuucaguguuucugagucuuuaacugacaguuaaccauuagagaagaaauuaauucaggaaacaucuauaucagguuccugaaagcaagaagaaagaauggccugaauuuaaaggugcugcgagacaacgaaaaucuuguggaaauagcuacaauaucuaaagaucaaacuguuuaaaaaugaaacuuuggaagguugaguuguuuuuggccguuagugggguuaugcucaugguagaacagcuaguuggccuagcacaaacaaggcccaugguuaaaccuggguggugagagagagccuggcaggugaagugccaugcaccuuucauuccucaagucuggugcagagggaggagagugagagccauugguuucaaggcuaaccuggucuauauuuggaauuuuagaccagacaggacuacauggugaaacacaaaauaaacuguuuuguaauugacaacauugaagaaaaagaagaaggaaaaaagcuaguagacuaagauuggcagagcuccuucugcuucugccucccaaguaccugcaauccuggcaugcgggagacagaagcagaauccaucaccuaagaguuggaggguagccucaucuacauaguaaguuccaggccaaccagugcuacauagugagacccuaccuuaacauuccccacaccguccaaaagagagccaccuuuacaaacagcuaaagcaucaucaacaacaauaaaaaauuuaaaaaagaaaagaacaagaaauuuuguuggugauuuuuuuuuucugguuuuuugagacaagguuucucugugugcccuggcugcccuggaacuugcucuguuagaccaggccagccucauccaccugcuccugucugcugagugcugagauuaaaggugugcaccaucaugccuggcuugguuugguucuuaaugugcugaugguuggaucacagagccuuguacagcuacacgaguccugaacuacugagcuccccggccacugcaagguuaccuguguuucagacaucuuuucuuaagaaaacuguuguauuugaucauuucucaugcaauaguugguuuuuauuuccuuuguuagauuugagguuuacugggacuguuuacaucuucaugcaagauuuuugaauuguuugauuugauuugaguugcuggagagccuccuuguuuguuuggccaguguucuaccauuaagcuuuauaaugcaguccagcucuuggauuuuguggaccagaucucacuauaucauagagauagacuggccuuaguguuauuguguaacucgggaccuucuugaauuuauaauucuacugccucaguuucaugagugauaagauuucaggccugccccaccagcuguuguuauuuuuauuauuguuucuuauuuuuugagguagaucuuaaguugucccauggugcacaugaugauacauuucuaaucucaccacugucucuuuagcccuuacagaggaacauggauggagagcuacaggugguucacugugacuucuuuaaaauggauccuagauaucaggaaguaguaagaccagaugugaguucacaggcaauauuucagaaccugggaauaaaagcaguuccuuggucagcagguaauuuucaucauucacuaaagcugauguuuuauuuauuuauuuauuuauuuuuaccaauauauuuauuuguuuauuggauguauauguaauauauaaagauucagaucauucauaagcaaccacucuuucguuauacaugccuuuccugaggcauagaucgucccagcaugggaaaauggccguuccucccucucucccuccuuccuucuuucucucccucuugacccauuuucccccuuccacuguacacucaauaaaauaaauaaaugaaaaaaaucaugccuucccuuuuccugcauauaaauaaccauuuuaguucuauaaaagacuaauuauguacuaaggagagaagcuuaguuauugaauuuuaauuauauauauucauuguacaugggauugucuuacauaaggacauuuucauauaaauuuauguuuaaauauauguucauauaaauucucuuuccuaucaccuuuuuaaaauccuuuuuaaggauuuguuuauuucgugcauauaugugcucugcuuccauauuuuugucuauacaugauguucaugcagugcccauguaagccagaagagggcguuggaguccccuggaacuggaaaugugcacaguuguuagccaccaugugggugcuagggauugaccaaggugguagaagagcugcuggugcucuuagccacagagccgucuccucagccccucuguacucccccaucacuccugcuagcuucccuuaucucuuaaauaguguugcuucugcuuucucaucaucauguuaugaaucuauguaaaucuaauaaccacauaugugagaaagcaaggugaagacuuucugaagcuggcuuaauuugcuuaauaugauaaucuuuguuuguuuguuuguuuuuuucauuucuccacagugacauaacuuuguucuuuaugacugaaaaaaaggaaaugucauuguauauuaacaauacacaauuagauccuguuuuuaaguuuaauuugcugaucuuaccuuuugguuggggaauuuauuagacuauuaagaguaagcauuauuauuggaaugugucuauuucauugauccuguaguuuggaugcucucuuauucauccuuugaucaacuacuguuuguugugacauuuauucuuucuucuagcuuccuggacguuaucuuucuucagucugaggaauuccuucaaguaucuucuguagggcugguuuagugguuauggcugucucugugaauguugcuuguggaauguucuucuuucucuuuacugucaccuagcuuuccuggguguaugcgcugguucccaggggucggucgucuuucagaguuugaagugcguccucccaagccuuccugucuuaguuucugcugagaucugcaguucucggccaggccugcauuuucaugcccuugcuguuuaucuggugcagcuuucccagugcuuccuuugcucuguguaguggguguucucacuacgaugaaaugggaggguucuucucuggccuugucucugaagcgucaucacuugaauaggcaugucuuucccuagacucaggaacuuucugcuaugauuuucauuaaacuauuuuuuaugccucuagcaugaaucauuuuuucugcucaugauuuguagauuuggucuuuuauaguguaccacagaucuucagugcucuguggauaccauccaguugauuuauucuguuguuucugagugccccauuuccuauacuuugucucaagcccagacauugcauuuuuccuugagccauucuguuaacgcguuuuuuauagauuuuuuauuugacguccugcguuuacuauuucaaguggcuuuuuuuaacauaguauuucugucuuacagaauuucaauuucuagccauacuuaacuuccuuucuucauuaggcaaauuuucuuggaauuuguccaggauuuaguuggugucuuuggcuguacuuacaauucuaauacaccccuaaaaaaacagugucugcagaaacagucacuaugaaagggcaggcccacucugaacauagaaccacagucaaauacacaguuccccuuaaaugccagucguaaagaagcgcaggaacacuggagguauuguguauuaagauacuagucaagugugugugugcaugaaaaggaaaccaguagaagaaguuaaugauuagcguugaauugguuggaagagugaagagggaaaguaggugugagugaggcaguuuagcuaagguagacagacagacuauagguaaggaaauggagagauggcuggcuucaccuggcucugugguuaggagcacuugcugcuccuucugaggacuggaguuuaguucccagcauccaugugugcagcucucaguugucuguaccagcagcucugagagagcugaugccucuggcauccuugggcaccugcacucaacacgugugcccauaugcaggagcauguguauauacauaauuaaaaaucauaaugauaaaucuuaaaaauagacacagacucugacaacuuaaaagcugggaagugucccagcugucaggaggcugagacacagacccugcacacuggucugcuagcccaucugcuuuggacaagccuaucaacguacagaugaaaagaagaggggcgagcaagacagacggacaacauugcucugcuaaguuaauguuugguaugaaacagauggaaucagcgugaaggggaaagagcaggaugggauguagagacuggggggugccuucucaccugacuguuggucacagccuugcauugcaugucuaucacucuccaggguguccuucccaugugaggucacagaugcucauucuguccguggccauccuucacaggucugcucguacagucuucacaccuggguguuauucuaaaugcuggguugauacaucagccagguauccaucucacugaauauugcaucagucugauuccaguuucuucuuugcagucuagaggaauucuggccuggugugagcauuuaguuccaugacauuuuccaugaggggaaugaggggccagaguuaaguugcuuacucagcagaaagaguguuuguuuguuuaauauucuuauauguaaguauguacauguacauaugggugacaucagaucuccuggagcuggaguuacaggucacugugagccacucaaggucggugcugggaaccaaguuugaguccucuggaaaagcaccaagugcgcuuaagugcugagccaucucucuagccccaagaaucuuuuuuaaguaguguuuuguggcuacucccaugagugccaagagaaaaggguuuuucucuaauaucuccuccuuuugucauuguuguaggcaacugucuuaguuccuucagagcaguaccucagcauucaucuugcacgacacguagaguaauaagacccugaaucuuggugcucugcuccugggcuucuuaccgucuuuguuuaagggcuuucugaccacauguugguggacaucaccuuuagagagauuuaaaagcucuuggauucugcuagcuuuuuuaugucccaaccaacgaggcacuguccaggaauagccuucucuccuuuuaaaacaauaaccaaguugagaacacuuagauuggcauccacgaacagacuugggcgcccuuacucaacagcaggcacacuuugccaugggucaaaacuccuuacuucuugggaaaaucuuguuugucauuccuguaaauaauccagaccacucaacccuuccacucuucacccagagcagcagcuacuucuguggccgugcgugcccuggucauagaaaguaugaacuuguguucaucggccacaucaaugaguuuguggcagccgguggcuggggacgagaaagucagcuucaucuugacacagaugaccaccuaggaagccucacaaaaaagaggccccaguacaaaaacuuuuauguucuuucuuuuuuuccucuuuaugcacauguacauauucuuguaugugcacguacguguacaugugugugcauguggaggcagaguuugguguugagugcccuccucggucaccccgugccugucacugaaccuggaaccugucuagguagacugaagagcuacccuggguauccuguacagugcugggcucucugcguaggccucccugaaagcagguccuccucacacgugcacaguuagcccucuccccagcucccugcucugcucuuuccagucucucauuuuuggguguucccacaccucuucuagugcuguuucccagcucuccucggucauuucccuggugauucuagcauacuauaccacaccugcaugucaucuaccaucuuggaucuuuaauuaaaauacaauuacuauuguuaacuuacuuuacaucagcaaaaugugaucauaagagaaaguuuuaaggaccucaugaaaauuuguguuuguauuccuaacagguguuccuauaaaaguauuuggaauccuaccauauaaacaugaaagacgaauacuuuggaaaauucuguucgaucuguacuccugcgaaucuauauacagauauggacgaguagaacugaauauguuuguuagugaaaaagaauuccgggugcguuguuaaaagauaauugguaucacugcuuuaaaagagugcuguauauucugaggcgcuucggcugcauuuuaauuuggggccccugacauuugagagcucuaagauuaugaaguucuguagcauggucuuagaaacaugugagacagacuguuuuaauuauuuggcaguuuaccuucaguggcauuaaauuauauuauacacccaguacuugcuguuuagcuccaaaacuuuuagacaucccacugaaugcuugacuccccgcccucccauuuccucaggcucuagugacuguuguccuggaccagcugugauuggagucaucuguccuuuuguggcugacugacuucacugagcuugguauccucaaggcucaucuggguugcaguggguucaaauuucauuuucuuuuuacugaauaguauucugcuauauguauuccccaaaaugugucuauucauccaugaugaaagaacacuuagcugcuuccaccucucaaauaaaugaauaaagcaggcacagauguacaugaguuccuaaggguuuuuacaacuuccuguugucacauugugguggguagugugcaggcgggugggcagagggugaggucagccucugaugcgauugcucaggagcugucuaccuucuuuuugauucuuuucuuguuuaccucuguuuuguuuauucauugauuugccuguuugagacagggcucucacuaggacuuguaguuugccaguuuggcuagacugguugacuagcaagccccaggaauccugucuccacuuccccaucgaugaguuaugggcauguguuuuugugccuggcuuuccaaugggaucaucaugcucaggccucaugcuugcaugguaagcacugugccaccugagccaucucuccagcccugcuuucaguguuuuggggcucauauauaaagagcuaggauggcuagaucauaugguaauuuucuguuuaauuuuuaagaaauaaggaagugccauacaauuguucuugcuagaugcacuauuuuacuucccaccagcagugcgcaagaaugaaagauuucccuccaucauacuuguguuuuuuuuuuuaauuuaauuuuguguuucuuauuaguguaugaguguugguacacacaugccacagacuaugugugggucaaagauggguuccagggaucaaacucagguuggcaagcuuggccagcugcaccuucucacaggcccuuuugugucuuugauaccaucucauaguggcauagugggacgaagcauugugucauugaguuaguaguuucuaauuuguauuugccuaccauuggcauaucuucccugaagcaauuucuauuaauugugugugaguguguguguguuuagguuuugguuuuccgaaagggcguuucucaguguacccuuggcuguccuggaacucacucuguagacuagacuggccuuuauucaaagaucugccugccuuugccuccgaguguugagaauaagcggugcaucaccacugccuggcuucuguuaaaauaauuucuucuuuuugauuuuucauugacccccuacaucaacacuucuuucuauaaaaauaggauacaggucccaaugaaaaccacauaggugguuaauuuuauauacagugaaggacugaagaaggcaaaacucaaauagcugcuuggucauuucauaguuacauuccuaaagcagaaacagggauauugaacaauaggagaauaacaaacugguuaccagcagggccuuugcuguguaaggauuaauguagauggacuuucauuuucuuggcaaguuguacuuucuugugugggaacuuuagcucuuccugauuucugggaaaagcagauaaacaacauggcuucaccuuggugccauggaauguggaucugaguggcucggguuugauauuuagucugcuguguuaggagccuggugcaggaacagcaagcagccucuuuacuucucuccugguuagugaaaaggccuccuaaaucccugugccuugcuguuagaaucgaucacagugcuucauaugagugagccguggcuucaguguaauugacagcauucauugugcauggaagaagugcagauaggagcaauggagcaaggagggaauguguccucacccagagaguaaauauuggcuagccacguagauugagaggccauucuugauccuugagaccauucauacauacaauauauaagcaaaaaaaaugacggcaagguaguuaagaaugcucaucagguuguagcuuggccacaguggccaaaccugugugugguucgacuauuuggacacuuggggguaggggagagaaagaacucaaacgaggaaggaucagaaaucaaacuucucuccaauacacaguugcagagcagccugggcuaccugagauccaacauuuugucuugcuuauagccucuuuuugugcuuuuuuuuuuuaaccauggacuuuguuauuggauucuuucccacugaccccuuucauucacugaugguaucauccucagugucuagcaagagucagccuugcugggcagucguggugcacaccuuuguccuaucgcuagagaggcagagacgggcagauccccaaaagagccuuaacaauuauuuguauuuaaaaacaaaccauuguguuuguguguguguucaugcacauggguguuagcaugugggacaugggcuuagcauauggagucagaagagaaaaaacccaaaccuugcaggugucauuuucuccuuccaccaaguggaucccacguugucagguuuuauccagugaacccuccugucaucccagccucggcaauucuugaugcaccauuuaauagcucaccgaauacauaauucugacauaccuaucuuucucuguaguacauauuguuguguuggguuguguuguuggauccauaaugcaggaauuguuucugucuuaauugugucuguagcucaaugaucaguuuuucugguuuguguuuguuuguuuuuuuucaaacagggucuugcucuguaaccuggggugcugucagauucacuauguagcccaguccagccuggaauucaauggaauccuucugcuuuagucucccuagugcugagguuauaguugcuugcuaccauucuuggucuuuauacauuuuuuauuuuagcuuuucuuauuuauuucauguguaggauuguuugccugaauguauguuuguguccauacauucaugcagugcuugaugaggccagauaggagcaucagauccucugagucuggaaugauaagacaguuguggccugucguguggguccucuugagucuggguccucuggaagagcauccauugcuuuuagcuacagaaccaucuuucuggccugugggggguugguuuguuuguuuugcuuuuuuguuuucuuuucauugcuguuuacuuagauguauguguuuaugccaugcgugugugaguuacuuggcagagcuagaaggcauuggauucccuggagcuagaguuacaggcuuaacaauucuagaugcacgauuuaauugcuuacucuuacaaggugugaauggcccuuugcuguguugggaaaugaauuccaguccucuggaagagcagcaagugcucuaaaccacuccagcacguauacaguaagcuguauauguugccauuuguuuucagaaaggaaaacucuacuugaaaguucucgugguuaauauuuuguacuuaguucucuuuuauguuuguuaagacagagacucuuuauauaguccugucuauccuggaacucacagagauccuccugccucugccuccugagaacuagguuuaaaggccaugccuggccaauucucaucuuuuaauuuaaaauuuuagaugcuauuaagauguuucaauuaaauccaacauuugauauuuauuaagauucuaugugacauaauuuuguuuguuuuuacuagaaacugauagcgacuccuaaaagaccggauuuauaucaaguaauggcuguucuuuggcaaguggccugugacguuaaguuccugcacauggugagugacauuuuaaugccagaagaaccggguuacucagauugguaagugcagacccugcacuaaagguuuaaaauaugaauuucauuauuuuuuaaccuguuuaauuuuguuuuacuuugaaguagagugugacuauguagcucuaccuggccuggaacucuuuauuccuuauggagaucagaauggccuugaauuccuccugucucugccuccugagugcuaggauuaaaggcaugugcuauuaccagcucuugagaggagauuaacacugacacuuguuuaccaacuucucuuauaaaaguaauaugacuggcucauugauaaaacuaaggaaacuaaauucacaguuccaccuuccucuaccucccgugugcugggaucaaaggugagcaccaccaccacccagcaaugcuuuguuuuuugagagggguuuuguuguguaaccucagacuuuucauucucuccucucagcuuccuugagugcuaugauuauaaauguguaucaccgggcuagagagauggcucagugguuaagagcaccgacuacucuuccagagguccugaguucaaaucccaggaaccacaugguggcucacaaccaucuguaaugagaucugaugcccucuucuggugugucuggagacagcuacaguguacucauauacauaaaauaaauuaauaaacauuaaaaaaaaggaaaguguuuuuaaaaaacuguguaugacaguauuuagcuugauacauucccuuuaccuuuuauacaaaauguuuccaaauucaauagucagccauuguuaacacuuacugagcuacaaaauguuuccaaauucaauagucagccauaguuaacacuuacugagcauugccagaugugauugaagugaucuauccuuucaucugugcaggguuuuggauuugaggcaagugcuuaaauacaaagcuacaaaccuuagcaccuagguaugggacuucuuuguuuuugguuuguaggguggguagacugggucucuguagccucuaccucccaagaguagagauuguuuaccaccacauccagguuuacauagguagauuauuuuaaggcaauaauaauuugagacauuuugacaaaagagaauuaacugaaaggacugaggagccuuggucuucaguugugagauauaaacuaaacaacgucuuaggguugaggagauggcucaaugggaaaagcacuugcagagcaaaacaggaggaccugaguucaauucccagcaccaauguaaaaaguccagugcagugggccuugccucuaaucccaggucuggggaggcagagacaggaggauccuuaguucuacagaacccacaagccccagguucaugagagacacugacgugaaaaauaguguggagagaaugaugaggaaaaccgccuccaaccuccacacacauccauauguacacauuugucacacacagaccuaugggaagaaagaaauagcgugucuguuuuucuuccucuaggaaccuuggucgucauuuagugugcauacggaaaaugggcacuuagaaaagucaaagcacgggguaagaacaaaugaugccguucuuuuucaucauguaaucaaguguuuauuuucucuuaagauugucuuuagaggcuggagugauuaucuuaucuuuauuuuuaauuaacaaauuuucaguaauaagaauguacauacauaugugugugcauacacaguauauaaauguaugguuaggcaaagaaggaauaagaaaaagcuagucggaaauacuucuguauccuugggacuggugguggagucccuuacccagcaggagcuccauucaggauauggaugagcuauggggcuauguuugagcucugauuuucacucgagucaagucaguaaacguuagcuguccagguugaacuuccaggccaggaaguggugaguggcucacuaggcacgcauuggguuugcccugcagcugaggaauggaacuggacccugcuaucaccucuucuaucaccugacaaacagguuacaaaguguuaaccugucaacaagaagacccagagacgugugggacaugcagugacuauugugaagacauaagcaaucagcauucuacucugguaauaguuuaugacugacaaaaauuauuuuucuuucugucuaggaaucaguaaauuuacugaaacaaaaccuauaucuuguucgaaugacuccucguaggacuuuauuuacagaaaaccuaaguccuuugaacuaugauauauuuuuccacuugguaaagcauugcuuugggaaacgcaaugccccaauaauacgccauuuacgguaaguagaaauugaauaaagaugaguagaaaaguagaauuuacugagauugucuccugcuuuagaagguggcuuuucacaucuugauuuggaguaaggugugcccauguuucauuuaccuguuaaaaauacuucuucugggccagagagaagguugaaaaccaguucacaacuguaauuccaguuccaggggcucuagcacgccuugcuggccuuuguggguaccacacacauggcauacacacaacuacccauaaaauaaaagucaagaaaaacaguaaauaaaaaugccuuuucucccuguugcauauuauguuuuccacacacuccaaguuucguuuauuuucauuuuuaaguagcaaaaucaaggauacucgaagguuguuuuagccucaguuuauauuuucuuauguguguguacaugugugugcugugcccauugaggccagaacagcauguuguauccccuggagcucgaguuauagaugauuaagagcugcuugacauaggcgcugagaacugagcucagguccccaagaagagcagcaaggacucuuaacugcagagccaucucuccauccuauguaauguagucucuauuuaccuuguaacuagcaguaccuaaaguaucgucaaaagauggaaaaguguuaguuauuuuaaugaaucaucauauaccauagaaccuuaguaugccuauugacuggagacauuuauuuugagauuggguuucauguagcccaagcuagccuuaacuuucuguacagccagagaugacuuugaacuuguuuuguuguuguuguuguuucucgagacaggguuucucuguguaucccuggcuguccuggaacucacuuuguagaccaggcuggccucgaacucagaaauccgccugccucugccucccgagugccaccacgcccggcugacuuugaacuugugaaccuccugccuuuacuucccaaguacugggguuauggaugugcagaugugugccagcucaguguauuuacacagaagggucagccugcaaucccaguacccaggauccuggucacaugagucccaggccagcggggacagagagugaaacuaucuuaaaaaaaagaaaccucacccauguugguggggcacgccuuuaaucccagcacuugggaggcagaggcagguagaugucugaguuugaggccagccuggucuauagaggggguucugggcuuacauagaaacccuuucucaaaacaaacaaacaaccacccccacccccaaaagccucaaaacccagaagcuucauauacacacaaaaguuuuaaaaugucaauaaaccacaauuagaaaccuaauuuucaucucaaggucuugggguaguggccauuuaaaugcaaauaucaaaaagaaagaaaaagaaaaccauuagauguaugugguggcacacaccuuuaaucacuguacucaggaugcagaggcaaggggaucucuaaauuugaggcuagcccagucuacauaguaaguuccaggccagcgaaggcuauguggugagacccuaucucaaaauaaaaaugauaauauguaaacuagaauuuuugugagaauuaauuauaccuuguuagaauuucaauuggugauuuucauugcaggcuagcugugaauuuuuaagaguaccugucccggucuccugggugcugagguuauagccauaacacacuuauguacacauuuccuauccagacugagugaggcauucaucccuguaucccaguacugggagauuaagguaggagggucgguucagagucgucucuguacagaguggagaauacacaugucauauauaaacugucaacugaauucaguuauauguguuagccauuuuacuuggacauaggaggcagcuuucucagcuguagcugacaguuguaaaagugugucucuuugguuuuccucugcaguucacugaguacgguugauccuauuaauauccugaggcagauaagaaaaaacccuggagacacagcugcuagaauguauccucacgacuucaaaaaacuuuuugaaaccauagagcaaucggaagacuccgucuuuaaguggaucuaugacuacugcccggaggacauggaguucuaggaagagucugcaagccgagagugagcuggagcuguuuguccauuauuuugaaaucaugugacaaaugaacacugaauuucaagaaguucauauccuuuuaacagaagagaaacuacccuuguuuggcacaaaugaagcaaauaauuucuucucaaguugauaccuuugauacacagaaaacacaguggcugcaguauuauucaaaguuaaauaaaacgaaaaccugucaguuugaucagaucaaaucuacuuuguuuuaaaguacucucugccguagaucaaugguagaacacauaccuaguauguccaagguuuugguuuugcucccuuguagacgcccgacucgccagcaagaaugacgccacaacaggauucuuuugcacacguuuauugggagagcuugauagcgaaagcgaaagaccccgagcccaaaaaaccagugcugcuuauauaggccuaggauaggugugucuacaccugauugguuaugcuuucaguaccucauuuacaugccuugggccaggcagugacucugcaaaaaaaaaaaaaacucuacugcacaugcgcacauugguuguuuacccauauucaugggcgucagcuuauugaaaccaguaccaucuuguaauggcguuuauuggcuucccauacucccuagcacaggaaauuuuuaaaaaauuucuauuuacuguaaaggcccauagguauggaguauuuucaauuguaauuuaauuuacuuuaaaaaaacaaaaaaccuuugggccaaaccucuuuaaauaugcacuuuucaccauugccaauugcuugcaucucccucaguuucuauacuguuacgcuuagaaaauaaauugauuugggcagacaugguggcauaagucccaggccuugugagguggagggcccaucaguuuaaugccacuuucaacuguagaauugaguuugagaccaguuuaggcuaagaaaagacccugucaagcaaaacaacgguauaaacuuagaaagugaucaguuuaucuuuuauuauguugaaguggauuaucaggcacuaugcaauccaguuguuuaaauuuuaaauuguaguauguuuuaaaacuuuuugagaaauaaaagaauuuguauauaguuugugugu

SEQ ID NO: 549 - RNA, 1693 nt, Mus musculus
agcaguuaaaaaggcguuuauugcaggcaguaaacacacagagaaaaagaccuucuacaaaacagagaggggauuugagaagcugaaaaauccagucucuucuugaggccuggggguuguaaaaccucuaaaaccucccugaccuacuuuaguguuggucaguuugaaggcagaaaggauggaugguugaucgguccacuacaguuguguaacguguucuaaucaggcuuugaacuuauugaaccaguccaucagcaggugaccugcagguagaugauaaaagcuugccagguuuuugucucaaaucaggagguuaaaaaaagcuggccaucuuggaaauucgccauggcucaugucccuguuugucuacuaagggucugcccaacuccucgucucucaauacuaacaaaucgaaaagaaaacauagguuuggcauaauggaaccuacagcuucgugcaugccaagcacgaagcucugccagcagaauuacccagcgucagauauaugacaaaagauuaggcuaggcgaccugaacucucugcuuuuugagaaaaaaaaaaaaaugagaguaagaguuucucaguaagucuggguuuugugugugugugugcguuuccuugaagaguuggagcacagaacggaaaaaacggaggcaagagcagcagucauagacggaaagauuaucgcuuggcugccagcaggaaccgccacuagauuaggccggcccuugcuccgcaaagccggacacgcccuacacuacgcccagcgcacaaagcccuaugggacuuguagucuuucgccuaucugcuccuaggaggcggagagacccugcuguacguaaaugaaucuuucuucccggcgucgucucgguuuucucccuuugcgaaaggccuaguagggaaaguuugaaaauucccgcggagucggcgccagaggccggaacccucgcgagaaguccgagccccgcagcgcgaucugcgaucggauccccgcccuggccacgauccuucccugggcggagaggcugugugugugggguucgggcagugcgcccgggguaaugcgcagagcgcggcccgagcggugccagcccaguaagucgagucgccagcggggaggacgcggcgcgggcggugggacgaguucgaagccgggauugggcgaaggagcacccggggccugaggggaccggcgagagacugagcgagaagcggcuuccgcgggcccggggcgcgcgccgggccgugucucccgggagaugcugugacggaccgcacggaagcagcgacgccggggcccuuggcggccuggcccgcgggcucagguaggguggggaaccgcaggcccgcgcgccgagggcggggcggccggggcggcgaggcccggggccuaggccgggcgcaccgccucgcggggaagcggcguccgcgagccgcgaccggugcggcucguuccagcgcucgggcguuaguuacauaacccuggcggcgggugccggcacauggccgcagagucgagccuccgggcucgucucccgcgcccgcgggcgggaucuccgccccccgggacgagucugacucgagaccccgggccgucaggguguagcggagcgauggagaccuuuguggggcguuccccgcggacagccgcgggcgcuccgagucucuccggcguuggcgugagcuccacaug

SEQ ID NO: 550 - RNA, 205011 nt, Mus musculus
guuuuuuuuuuuuuuuuuaaggaguguugacucuuuaguucguuguacuuuuaauuauuauuuuauuuaaauguacaauuuaauuguauuauucucuuaaaauauuaaaucuauauuuuauggaaacucacccucaagauauauauguuuaugggugaaauuggagacgcuuccguuaagugaggugacugguguauuggauguuuaauucagcaccggcauugcaugacaguuguugaaauaacaagugguuuauuuuuaaaaaccacaucuuuaaacuuuuagguucagauaguaacaguagacaucguaagggcauuuaaaagaaaaccagcagaaaucgaagcaaacauguccggagaagugcguuugaggcaguuggagcaguuuauuuuagaugggccagcucagaccaaugggcagugcuucaguguggagacgcuacuggacauccucaucugucuuuacgaugaaugcaauaauucuccauugagaagagagaagaacauucuugaauaucuagaaugggguaaguuuucuucuaaugcguugcugggcgugagcauuauuaacuauagugaaaaugauguguauagccuuaacaacagaacaaacgccuauuagucaagacuucucucuccuaguuuuucuuaacuguuugccagggcaaagcggugccacuuaguuguugccugguuguuuggccuugcuguuugugaacucacugcgucugggggggggggggggcgggcagcagcaggagcuucagaaggaaggcugggauuggcagaauuggauuauugagcacaguugucacaaccguucagugggaggguauuuguugguuggaacauuccuucccagucuuugaaaaucacaggagauuugaggagaugcugaagucccuguguuaauuuuaggacaacaggaauguggagguggugaucaggggguuuagucucaucucuggauagcacuggcaaaggaaaguacuaaacauggacuuuccaaaaaucacuagguuccugagaaauaauagaaauuauguguauguguguguguaaaaagauguaguuggaggauguuuggaggcagcuccaccugccuuagauuuuauucuaaauugaauuugugucuauacuggcuagaugugacccaggugaccuauaguaguggacuagaucagugaugcgggcaaacucugcaugugaccuucaaggcuugucugaacuccaggagccucugaugucacucacucgugugagggaagucugacauccagcaguggccaucacugcccaggcugguagagagugguaccauagcucuggaaggauuuaggccauuuagaauuuugagcuguugaaauacuuuuagcuagcuaaaugauuuuuauaucgacgaucuuuauucccaaguaaaccuuaauuuuucugaaguaaaaaauuuaaguggccguuguuguuucuguuuucaaauucauucaaaauuuguuucucaagucaacucccacuuuaagaaugcuaacaugaagcaauuugaauucuccaguuuuccaguauuagaugagugauugcuaguagcacgauguuucaggguuuaaaagaaaauguacaaaugugcaugggaugauuucacaaagcaguuugccaucagcgugcugggaauguaaggaaucuuaaaucaguugucaggcaacuucucgcuugagaguagguaauuuuuauguuggcacugacuuugcauuuaccugccuuuuuaugugcaggauacaauauuuuaugaagcauauggaaucuuacacccuguguuucauaaacuuaggaauucugugguguuucuuuuuuugaagacuuaaaagguuucaguacuuuuagaguuggaauuugaguccuucaguuacagcuucauagugauacuguagucugugauuaugauugucauuuaauauccuuuucauuugcaaaacgguaggagaacucuuuguacauagcaguggcaaauauaauuuaaaauaguguauuauauaagugaaaaugcauuuucauggcuuccugaugugugguaguuuuaugcuaugggguauuuugccaucuuauuaaaauaaucucuguaucuuccauuuagcauccuuucuuggauuuuuuuucucuguuuaugaagacacuuugcaaacacauacauacauauuuacuuauacuaaaaaguaaaacaaagaucaaguguuuggcuacauucacuauguuuuuuuauuuuuucagagagaggguuuuaugucacucuugaaguuucuguguaacugagacuggccuugaaccuuggcccaucccccucuaucuuuacagugcuggcaguauugugcauuaccaugugcagauuauauagugcugggaauucaguucaauccccaguccaaaaucaucuuuauucuuauuaauaauuucaugucuuaccuuuuuaguugucugauauaugguaugaugagacucuacagucucauaaaccauuacuggugcuuuuaaaaggcuuauuuuuauuauuuuaaauuaucuaugugugaaggucugguauguguuguaagugcaaacuccugaggaggccccagacaucugauccccuuggagcuggaugcuggcggcuguaaggugccugacaugggggcugggaaucaaacucagguccucuggaagaaccauuugcccucuaagcuaccaaaccaucucuucaacuccaagagagaaguuuaaaaguuaaaaaacucccccuccucuuccuucucuuucccuucuccuucuucuccuucuccuucuucuucuucuuuagauuauaauaguuauaucauuuccccuuccuuuucuuccauccaaacucuucuauagcucucuuucaaauucauggcuucuguuuucuuuguuuuucacacacacacacacacacacacacacacacacacacacacagacacacacagacacggagagacacagacacauacauagacacacacacauacauauauacuccuaaaaucauaaauacaugcuuagucugcaugauguuacuuguauuuauguuuucagggcugaacauuuggguuuggauaaccagucggugugcucuuccuggggaagagagacuagaacuuuuaaggaauuauuuuguguacuuuaggcucuuaagccucuggcaugcucuucccuucauaagaauucggaguggaaguguugcagagaugcauccuaagugguuucguuuacugucuuucuuuguggaucuuagauuaagaaugauggugucuuuucauuuaaguauugcagugagucauuccuccuucauuuauuagucuaucacuacauuuugggaaauguucuauaauguucccauugcaaaaaauguauaagacuaucuagauuagguuuucagauuaugaauugacugcaccuuaaauuuucaaugaauuagcuuuuugggauggaaauuuauaagaauauuacuaagguuaaauuugacauuuuagauuugcuucaagaugucaucuuugguuugauuuucgucauucaaaaaguauugucuuuaagucuuuuaaaagacccaguaguugaaauagaacaguguaauuaaacauuccauauuacauguuaaauauuuguguucggcauuugcauuauuggaaguaccaccuagaggcuccauaguuuugcaagagaugucugguuacuuuuaaacacguagucaaacuuuuguguguaucgcuccauuaauuucauuugacuccaaguuaugguccauuucauuucuguagugguacagguaauguuuuguucuuaacaguaccacaggaagaaaacuugacuaugccaagucaaacaugcugcuuuucuuuuauagccuuucuugguuuuggugcugaggaagaaaaguagaguaguugagaggaaaaagggauuaagucagugagugcuugcccgaggggauacaaacacuauaagaccagaggucacuucugaacuuaauaauguauauuuauuuucuaguuacagcaagcaagacuugaaaagcuuucuuuccuuugauuguuaaauuguugaaaagauuucuacuuauagucaguaaaauuugaaagacugucuuugauuuuucaaguguuggaaagguuaugguuucuguuuuuguuuauauaaaaauaauuuuguugucgguagugguuauagucaaguuauaguggagcuauagaaguaaaguaguugugauguuggaaacuaacuuguuagugaugacugauacauucacuaucauuacauuguuuuucuucuacuuugaaaugagaaauaugaauguuaaggaauuacuaauuuauuuaaaaaguggauauaggauaauacuacucagaacaagaggaacugccaggauucccuggauguagauuacuuuucuagacuuucugaccuugaucuuauaagauuucauguaaguuaucauuaacugauuuuauagcuuacucagauuguaugcuacaccacaggauagucugauuauuaaacuuacugcuagguauaucaacagguauuguaagauaaacauuagaaguuaguuagcauguguauguauguauguacguacaugcguauguauguauuuauuauugagacaggguuucucuguguagcccuggcuguccaggaacuugcucuguaaagaccagggugguguugaaccuggagauuggccagcuucugccuccugagugcugggaucaaaggagugagccaccaaugccuggcauagaguagcuuugaaguuuauucuuaguuuuuucuugugugaguuggggugaugauggcuugauuggaaggaaggaccugaaucauuucuagaauacuuuacuuguucuguaugucugcuguuccucacuguuaacuuuuccugaguagaaauauuuaucauacagaauugcuaagauauucauugaauaaagauuaaauuaauuuuuaaauaaacucauuugugaucauuguaaauguguuuaaaguauagguaggucacuuguuuucuuuacacuagucaugaaauauucuguuuuaagaauggaugugguuuaucugagccaguguugacaugugccggaaauauucuaaaugauaguuuacuguuucucucccuuuuuccuuucucuuccuucuuccugcucacuucuuccugagggaguugacaaauaauauugguuacuguaacaacuugcaguauugauuacuugguuaguaaacuguuuaaaauaacaaugcucuguggaugaaaaugaugucaagguucucauuuuaagaauuuuagaaguauuucauauggaaacaaggcauacuuuacucuagcagugugaauaaauacuauaauauguuggaaacuuuaugaacugucccauaaaccuuaggacuugauuacuacuacauaguaaguccaaucugcuuuagggcaaaagaaccaaacuuggcaugaguuuccuugugcuacucaaaucuuacuaccaggaaacuguguaaagcucauucuuuuucauucaguuggguguaauaguuaaaaaaaaacaauauaugaagucuaaccaacauuuaaaaguuaggcuaggaaaucagguucaucauucuuagagagaggaaauagagagcauuugugcuuugucacauuucucacucuugugccuuacagacugagaguagaggaguuuggaauguuguguagaugcagauauauauguuagcuaauaaugagaauauuagaagcauggcuccuguuuucggaaagaacaugucaaagauccaggacaacaaauagauaauuuauuuuuauaaauaaauaaaaaggggauguacauagggaugagauugggagggagaggggcagaggagagccuggacuagggagaggaugagaauggagagagagagagagagagggagagagagagagagagagagagagagagagagagagagagagagagagagaaagaaagaaaagggagggagagaggcagaggagagccuggacuagggagaggaugagaaugaagagagagagagagagagagagagagagagagagagagagagagagagagaaagagggagggagagagagagagagagagagaaagaaagaaagaaaagggagggagagaggcagaggagagccuggacuagggagaggaugagaaugaagagagagagagagagagagagagagagagagagagagagagagagagagagagaggaagaagaagaaggaggaggaagaagaaggaggaagaggaggaggaggaggaggagggagggaggugaauucaggugaguauacaaacccuuuaggaguaguuugucuuugaauucuuuuuugaacucuauuuuugagucagggcuucuucaucuaguuuacuucucugguuugaaagcguguuccuugaauccaugcccuauuacugagggguguguguauguguguguguguguaaaugugcagagaaucuuguaaguuuggaaaauuaacacagauauaauucaaguaaaauauuucagguuauccuggaauuuacaaaauguauuggauuacagaaucaccauuuugaauaacgucuguagggucgauggcaagucuucuaaugcauagucuuagagaaaugguguuccuuugcaacuuuuuauugagguuagagagaaacuuugagaaacuugaaucuagcuuugaguaaguuauauuuuacuuagugccuguagacuuauaccucugugugugaaagucccaugaucugagagauaaauuuaaucacgguagaguaguaauggugcuguugauagaaugacaucuaagagacaggcugcucacagugggcuuggaaugguccacugaaggccugugcugccagcuccuggaugacugugauguccuaugacauucuucuuguucuaaucgaacuaacuccccauggaaagacauuuacaugauuuuagaugcagaaauucucacuuuguuuuuauagcgccaguuacuauaauuuuaacauuuauaaaacuauuuugcaucuaaaaauuuauucauuaugauguuuagaaagaaaaagccuugacucuugcaauuucauaauccacuguguuuuguuuucccccaggguaacaguguuuuagcuaagcaauugguuucuguccucucaauuugugggaacuuuuauuacuauguauaauggugugugcauuucaugugucagcaucuguuuguuuauauguauuauaaagaaaccagaugaucacuccuguuuauuaaggagaaacccaugcacaaccgguguuauuuuggcaguguguggacagcuaaaaauuugugauuacuguaaaguuuuguucuaaguuuuagcaugguagauaauaauacuggagaacaaucaaccugauuguucaaaaacaagugaagagcuuuggauuuagacuggguccuuuaauuauuggcuaggugaucuaggcaaguuauuuaaccucuugaaucuguguuauaucagcugaaaaggaguggacauuacuacaauauuuuaccagaagaugaaagcaaguuuagaaguuuucagucccauucugauuuuuucauuuuugauacagggucucauguagucugugaacuuaaucugaccuuaaauuucugauucuuuugccccuacuuccuaagugcuaggacuagaggugugcacuguuauaucugguuucuauggugauaggaauuaaacugaggaccuuguguagaugcuagaaaaguaauuuaccuacucaguuauaucccaguuuccauucugauuuuuaaauuucuauguuauuuagucugaaaauaaaggaagaacuaaaauaccaaauuggggauuaaguuuaaguuaaguauauacuaauacuaauuaaaggauaaaguaaauucacuaucaacaagcauuuauaucuucuugauaauaucuaaaacuuuuaaauuuuauguaauuguugguguaugaauguuaugcaugucuguguaccacgaacaugucuggugcccguggaggccagaggagggcaucaggucuuucgaaauuauauuuuuugaaagugucuuucucagcuaugcaaacagucuuagguauucuuuuacgauguuuugcauuaaauguuuuguucuuucuagcuaagcuauuggggaggggaguaaauauuaaacugauacugucuuuuccaccaccaguaacagauacuaugcagugacuaguuacaguuuauuuuuguauauguggcuucaaucugaaaauuagugguagaguucuaaagcucaauucagaagguuacauuuuuuauugaugugguguucauguaguaccuuuuauggacuaaaauuaggcagcauccacacauccaugugauauuucaguaaguaugaagaaaaugaacacuuuccacaaguauuuccuaaacugcauuucaagaggcacacugaauauuccacaaauuauggguuaauuggauauguagggcuggaaacuaguauuuugaauacauucuuuuuuccuuaucauagaaaaaguuucacaagcucugaacagaaaccuugugcaagguuggcccaggucacuuuaacuguggacccuugagaggaacacuggauugaacuuggggcacuguggccacaugaggaaaccguaggcaguggccagagucuuuaagcagguuauguaaaaagcauauuuaaaaaaaauauugucacagugugcucagagcacaaacauagguaaggguuuggcacauuugcauaaucuagaaaccagcguagcugaguuuaaguugggguagaguucagcauuggacaggaagaucucaccuguguuggagaguucauacaugcagcaucugguuugcagaggugcuucuccuagccuagugguuguuuuuuuguuuuuuguuuguuuuuuguuuuguuuuccuuuuuucaguaaagcauggucauuuuccguucacugguacagagaaacuguaaaguagaacaaagcuaauuggauuuuaugagcacuuuauacaaaugguagaauuguccaguucuagcaagaaucuuguccuuaagugucagugcucacuagggguggcuaauacccacguaauccauauauggugaaaagcagugagcacuacuuagaaguaaguguucugugcugagauuuaaaaaauucuugcuugacaugacuaaagccucauuuugaauugcaucacugacucccugugguuuuuuugucuugaccaaaaaaauuaccauaaagaaacauuuagaaguauacuaaaaucucagguguuugugaaccugacauaguaauauggugccucucauaaagcuuuuccauacugugugcccauacuuucuuagcauuugugguuagagccacacuauucgcaagauuagcguaauuucuauuucugacuuuuuaaacugcaugccuuuguaaugugucauccuuagugacgaugcaugcuacacuaacaguucccuccaggaagcccauugcugugguagcugcuugagaugugacugauguuaccaucguguuccucuugcuuucauaacugugagguaguaucaguuaaguaccuccugaguuauccugcuuuuccucuguuuuuguguaucuggcuaaauuuauuuguauuaaacugguaaauaugguuuuaaacauuccugaguauuacuguuuuacuguguuuuccuuucaaauggcaggaagccuuuaacauauuacaugucucuaacuugaaaauaugaugucuuuauacauccuggaauuuaauaaaacacauuucugucugucugucaugucugucugucugugucucuuugucucugucucucuagccuuggcugcccuagaacucacucuguagaccugucuagccuugaauucagagauccaccuuugaaaggcgugcgccaacagcgcauggcuuauacaugauuuuguuauaucaugaucauguuaguaucaugcuuaauaucuuucauugacucuggacagcuuuucaugauaguuuuauuuaacuucugagcaugauacauacuuuuucuuuucuuccuuauuuuaaagacaaggugugccuguauagcucagauuggccuugguuugugcuuccucuuccuacugaguccuagaauuacagguauguauaacucccuggucacaacuuuuauacagugcucaucuacuaccuuauauauuuaacuuuaaaaauguuuuaauugaaauaaccauaauuguacaaaacugcaaguauuguacacuuuuucuuacugaaguacaagaauaauuuguuuacugauguccauuccuuuacaauauguuuguauguauaucuacauacuuuuauaugaccauaugcaacuguucaaauccagaaauuaacauugaugagauacugucauuuuauuuucagaaacuuuugaguuuaucaguugauguaguggucuuguuagagcaacaggauuccgucuggaacccuggguuaugugggagugguguaucuugcaguguugguuaagccagguaaccuggguuaugugggagugguguaucuugcaguguugguuaagccaggucuuuagguuuuccuugacuuucacaacuuggucucuuuugaggauugcaggccuuuugcaguaaccuccccauuuggauuuuccucacaguucaauuuagacaaaaucuuguuaguaucucagaagcagugcagucaguguugugcuugcauccugucaggugaggcacaggucucacacuguuuauuacaugcugugcugacacucaccaggcuucuccacuguaguuccuguuuggguggggugcgcuggaacaugccgguccuccuaacaccaaagaggccgaggcaggaucaugaauggaagcucugcugggcuguauaagagaauuugagccuggccagagcaacacaucgaggcacagcagcagcagcagcagcagcagcaacagcaacagcagcaacaacaacaacaucagacaaacgaacugaaaucaugacagaacaauuauuucuuucccuuuauaauuauuggagagguauuuuauauuaugugucuauccuugcauuauuaaauuguauuuauaucuagaauaacuuaugugguuuuguguguguguguguguguguguguguguagcuuaguagguuagaacccucacuacagauuaguagaauuacccaagugcuucaggaaggaacaaauuguccccuaucuucaguuuuucucuuugaaaauguuucaaauuaaaaaaagugaaaacaugaugagagaaguaggcaagggccuacaauauaugaauuguauaugccaccuucagugguuggaauguugucaugggaucuucaauagcuuagccugacccagauuuagucauuaggagcuccuuuaaauugucccuuugacauuuucuugcuuuuucauauaacaagguggcugaggcuuguccuguuccuuccuugucccugccuuggaaccagcaagcuucuaaggacugcuggcaccuuuuaggagaaggagucacucuguaagacagggugaggucucgcuccgugggagcucacugcuucucuuuuaguggacagugcuccccuccauuaguccauccguacuuugcccuguccagccaucuccccauuucauguauguauugacaccuguauuucaaaucugcauguauuuugguagauacuuguuucugucuuuauuuuauaggaaagaucaugaguuugcaccaauaucccuaauuuuagucuaaugcuacagggcuuauuuuauguuucuuuuuuuuuuuuuuuuucuuguuuuuccauauuguaaaucuccuucccaguagucagugagaagaauggauccuuuuaucuuucacauacuugagagaggcggggugguagguaggugaacucaggugaguguacggacuguuuaggaggcagaagcuuugggucccccaggagcuggagucaaaggcaguuuugagagcuugaugugggugcuggaaacugaucucaggcccucugcuugagcaguaggugcuucucagugcugagccaucucuucagccccauuuauuuacuuaggagaucucucaucaguccuccacucccucccucauccagauaaucuguugaggaugcuggcuugcugcucuucucaucccuagagccaugcucuucaccuuguucugucugaacaccacaccaggcuucucuucaucccaggcuuucuucucacccaaggaugcucuuuguguuccccaggcucugacacucccagugccagaagcccuuugguggcuguccugugcuugagcuaagcugucagccuccacgugacuucuuuugcuuuucuuuguucugccaugccuacuggccuucgugugaauuguucaggaagaggggauggcuauuuaccuaguacaugccucucuuuagaauaggaguauggcuugagaaagguuuuauugagugauuuugugguaugaacaucauagaguguauuuauacaaacguaagaugccuaagaugucacuagaggauaaagucgaauggcaccacuauuguagaugucagccauuaagcaggcuuaacuauauacgcauucauacacuuuuuuuuuugagguagagcuuuauuaaaaacacuaaucagguuuugagcucaaguccuuuucuuucucucccagcuuuuggaaucacaggccugggcuaccacgccaagcuccccuagucacccccuggucuaaaagaaauccucucaaaaauuuauagaguguaacagucuuuuugauaucuauccugugaccuuuaaccaugccgucaugggacaguugauauggcuaaaguauagcgcagugugugucggccccacagaccuuuuguaccacacucagcuguuauuuagcuaaaaagaaaaugguugcuaaucaaggggugucugguuagucugaguuguuacauucuggccaguguuuuuuaacuuccccacuccugugccaucaugcuuguuauacucaaggccagcagcugucugucugucugucugucuaaucugcuucagacuuauagcagggacuuguuucuucuuuuauuuacucugcuuuuuucaaaaguguuuuuuucuuuaaaaaaaaagcagacaaacuuuuuaaugggcaaguaaggacgguuucuuaauugaugguuuaugauuuccuuuaauagcaguagacagucuauaaauagguacuuaguagaaugagguaaagaaaaaguaaggaacaggguaaaaugcaaauagucuaauuugucaauuagugcuuucuuucauuaaguccauauuuaaccuuauauugacuauagacagaacaaacuuuagagguuaguauugaugaauuaaacauauaaauagaguuuuguuuucacugcaguccuacuaaaacuacaauaaagauuuuuuagcagucauaaauguccugaaaugagaagagcaggaaaggagaguuuaagcaguuuccuuugugaagugaauacgugagugacaccaaccucagagccugcggacacuggggucuaaguuagcagagggucuaagaaagccgaggaccugcccagguuaauuggcagaaguuaauacacuuugaguaguuguagaaguuggugucuucagaaugcucugcaaguuaacaugugggcccagcugagacaagaggccagcuaaggcuguucucagaugggaaggcuagagcucucucuuaagacaggcugcucauccucagucaaucaggcuuugguggcugagugacaccaagcauagaguagugcaggccucaaacgugggacaucugggagagaguuuaaaguggguuagaaaaugaagcagcucgaaaaagggcucuuaagagaaaauuguguaggaaaggaaaguaacuaauuuacaugguuauaauaaugguggcauugaguaaugaccugacuaaaauuaugcuauaauuacauuggcaggguacuauagggaggggaguguguuagggccugauacuugccuuaaaucuuauagauggcaacguagguaucuuuuaucuaauuuaggagaguaguuuauuuugggaaaagcuauguagguuaaauccuuuauauauguuuuuaaacauuuacauagcuacuucuaaguuacacaaggcacauaugcaauguucauuuuauggaauugaacaucagcaacugaacucgaacagaacaguacagacaaaggaaucacacgagugauguaaaugguguuuuggguuuuaaguaauggaaaauccaaugcaaauugguuaaaaguaagaaaaguuuuacuuuuuacugacuuaucaagaaccucgauguuugagccuuuugguugagugacucagcaaauauccaggcucugugaaucuagggcagugugaacuucuugaucacaucccaaaggcuguggauggcacuggagcagaaugcucccgaguuaguggggaaggagagagaauuccuuugcagagagaaaaaggcuucugcaguggucucagaagccagaguuaagucuguauccgugagggaggcagucaugaugcugguggggaugcgauuguucaggugucugagcugugugaaggaagaguaagauguuuuaacaaauuuagaauauggugagauggugagacgguuuauucauuaaaaugcuugcuaugcaaauaagaggacuugagucuggauacccagcagccauuuaagagccaggcauguguguauuugcacacucuagaacucaggaauaaaagaauggggugggguggggucaggccgugcugguuaggguuuuuuguuuguuuguuuguuuguuguuuuguuuuguuuuuguuuuuuugucagccugccacaguuggguucauuugggaagagggaaccucaauugaaaacagugccucuaccagacugugcugcaggcaagucuguggggcguuuucuugauuaaugauugauauggggaggccuagcccaccuagccuagcagugcugccucccaggugguccugggagauauaagaacacuaaccauuuugagucuggaaagccagccaguaaggcaucccucuguggccucugcuucaguuccuguuucaccuuccugcaguaauggacugugagcaggacugucagcuguaagguaaaaugaaucccuucgcccuuacaucgguuuugucauuguuuuaucuaucagagcagcagaagguaagagcacaggagggccucuagcguuugcuggcuaguuaugcuggccuaacugaugagucccagugucagugagaagcacuguaucagaaaacugugggaggguuuggaggaaggaaagggaagggagaaaugacguaauuauaauauaaucucagaaauaaaagaaaaaugaaaaaaaaaaaacccuuaaaaccaaaucccuaaagguggagaguggcuuaggaaaacaucuaauguagaucucugaccuuuccaugccugcacacagacuuguauaggcacauaugugucacauaggcacaugcaugugcaacacauacacaaauuagaaucuuaauuagaaagagaaucuggguucugugagaucacaggcaguuuucacugcacugggcuuugugguuuacuacuuagugagacauuuucauuagaaauuauuagugcuccaggaaaguuuggaauuacuuuuugucuuuuccugaucacuugucagagaugcuugcuaugauaauauacuuuuaauuuagagauucagggcuaguguuacuauguagaagagagaguggaauguauuaaaaauaucuaugauuaaauuugaauuugaaaauugcauauagucauugaaauguugccuuucacagccuuaccaauuuuuuguuguuguugacuuauccuuccucugauugcuuauaacacuauaauaauugcuauagugcuucguuggcagcagugugacccuuggguuaugacauaccuauuuuaaugugagucacacuaggaucaugucauaucugcagcacaaauuccagcauaucaguuguuagugauaacuagaugguguguuuaggaggucuguuuaaaguaaauuuaauaaagguuguauaugugugugugugugugugagagagagagagagagauggggggggauuggauacaguuagagucaucuaggaggaggggaaauacuuccaucagauuugccuguaggcaggucuguggaguuauuucuugauuaaugauggcugugggaaggcccugcugcacugugaguggcuccaccccuaggcaggugguccuggguuguauagaaaagcaaguggauccugccuugaguuccugccgugaguuccuccccuuacucagaagucauuuuccugaguauucuaguugccagguacucucucccaucuuucccccuauuuaauuuuacacauaugguuguucugccugcauuuaugugcgccaugugaauuuucuguggaggcuagaagaggguguuggauccucuggaacuagaguuacagaggugggugcuguaauggaacugcuccagcccccucauagccccuuuaaaaagaagcgugcacugcccaggguuuuguucucgagaguucuuagggcuagcagguaaguuagggaguggagucugggcauggcucacacugguccuccuccucugcuuugcuucgggcuuugucuucauucaguugucucugcagagguacuugcaaacauuuuagccugaauggcguguguguauucacucagacacauggaaucuuaaucauugccaggugcucagacccuccaggacucaccuacuuuugcucuggucuuuauugcaggccagaaacaugccauaggucucaggagagaggcaggcgagccuggaggcuuugggcugccuucaggagccccccagacgacuucugagggucguguuucuucuggauugucaggaccaagagaagggccuuuucuuggggucauagagguugggucaagguuaggguucuuugccuggcugauagcuuugggaauucagccugauaauguacuugagcugugaucugagggacuuugguguuucuugggcuuccaaaaggaaggcugaagguuagggcauggaauguacgcaucuccaucugauucugggugaaacagauaaaccggugggaaagaauucgauugauuaaaauuacuuagaaaaauuguagcauuuaaaagguuugagagaacaugaggccgacuuuccuuccauaguucgguauggucuccauuuucaucuacacucaguguucuccagccucauccaggccaugguauuggcagagauggaggucuggaaguggagagaagcaguaagugugacugagcaucuaggcuguguuuuuaacaggccuggacugcuaacaagucacaggcacaacuuagauagguggcaccugagugugcuugguccccuuuuccuuagagugagaaaaggaggguuaggccaagaaaacuguucucuucccugcaaaauaaugucuuauauacuacagauguucuuacugggaaacaaaacccuugaauggaguccguuucuaagauacugccauucauuuguaucugagucaguuuaaaaauucaguuaggaugagaacuggcaaucucaucuuagaaagucuacacaggucagggaauaaucuaguguaguaucuucacagugagguauuuuuacccgugauggugaaggcuucuaagggucuguguggguacacagaguuuuauaaucuucuacuuccuuaagugcuuguuuaagaaaccccucugcuugagaaugcucugaagucaguugacuucucuuuuucuacuuccauuugacaauuacccaucucccacuuuguaaaauaaagcauacuuuucacucaucuugaaucugguuuauaagugguaucuugccuuggaggaaaacuucuagcucagugcaggucaggaaccugccacaggucucagcagcaagguggacaagucuggaugcucugggcugcucuaggagcucucagcagcuaguucugaaaaccacaccucucuucacucuucuucugaagagaugugguugugaaacugaagggagugcuuggaaauguuaacucccuaggcaagguaaaacaaaggaggugcugucacguguugaagcucuauuuuauuuuccuacuuuauaaguggcugucuagcaucugucucccuggaaacuguuaccacuugagaccuuggcuauauaugguaauaacauauuuauuugaauaaagaauuaaauacauguuucaacagaauugucucacuuuugccauugguuuuggaaaaccacagaaauaaaauaggacacauuuaucuaaguuauguugcuaucguuucucaaaaguacugcgaagccaggcuuagugguacagaauuuagucccagaacuuggaaggcaguggcaaacugaucucugugaguucgaggccagccuaguccacauagugaguuccaggacagccagggcuacauagugagacccugucugaaaaaaaaaaacaaaaaacaaaaaacaaaaccaaauacugggaaguuugaaagaauacagugcuaaaccggucucauccuuaaauuuuuuggggggggaauacuguaaauuagauucaguaucuuuauuugauauaagguuauucuaguuuucuauuacuucuugguuauuugacaaguugggggaaauucucaauauuuuauuugagaauuucacaucauguacccugaugacacucacuucucaauccuuccauguuuguuccccucugacuuccuccagcaaaagcaaaaaccaagacuauuuugugcugucuauauacucacuggaguauggucaaacucccaguggccaacgcccuaaggaaaacugaguccuucuccaccugcaccccaacuagaagucgucaguuguggagagcuacaccccaacauccccaucuuaguuuuuauacuucucuuugaugucuuccuuuuaaggcuggcacuuuuuggggguggguggguugggugacauaggcguuuccacagaagcuuucuguguaccucuuucuuagcuguaugucagcagcaacccacuacaagaguagcuuccuugcuuuucaagucagugggagcauggauugagcuuguacgugguuucuaguaacacugagcuauccaucucuccagcccugacuuuggcuuucuaaauaccaucucaguuaccucucacauguuggcuuuuuguuuuuuguuaacuuuuguuccacuuuuaaguauuuucuauuucuauuuucucuuuuggcuuaugaguguuuuuauuuauauuguuuaaaagucauuaauuuaaaauuuucuaccuuguaccacacuaccauuuauguaauauuugcacauuccuuaugguuuucaaaauaucauaucuucuagauccagcuuguugcucagauuucucaaguuuuugauuacuuuaccucucaauuacugaauaauuuauauuaaaauuacaccuuuauagaauauuugccaguuuucuguguaaugcuuguaaauuuuuguucauuauacauuuugaggcaagauuaauuagauucaugaagaguagaauuauuauuuuucuggugcauugaacuuuuuauuuaguaauuauacuggcuaguuuugugucaaauugauacaggcugcaguuaucacagagaaaggagcuucaguuggggaaaugccuccaugaaauccagcuguaaggcauuuucucaauuagugaucaaggggggaaaaggcccuuugugaguggugccaucccugggcugauagucuugguucuagaagagagcaggcugagcaagccagaggaggcaagccaguaaagaacaucccuccauggccucugaaucagcuucugcucccugaccugcuugaguuccaguccugacuuccuuuggugaugaacagcagcauggaaguguaagccgaauaaauucuuuccuccccaacuugcuucuuggucaugauguuugugcaggaauagaaacucugacuaagacaguaaucauguacaguagggcuuuuugccuuaaacuuacucuuuuaucuuuauuuaaauguaaauaauauaucuuuauuugguuauuauucauuaaaaaaaacccuuucauaucuauaucuaucuaucuaucuaucuauaucuaucuauauauagugcuuuagagaauauaaauggcuuuuagaaacaacauauaacuagauuuuuguuccugaguaugaaauauuuauauuuuuguagaggaaucuuaaucuagcaauauggcugcccuggcugaaauacagacaugccccuuaguacauaccuuuauaaucccuaacacugaagguaaggcuaguuuguagaaagaagcagccaugucugaaaaggacauuuaauugaggggcagacaaaaugaugagucagagaaagauuugcuagaaugggucagagauaggauaugcccaacucucaccagaacagcacuggaaagaaaagcuaguuaagagcagugcagggaguuaagaggcagugccgugaagcuguucuguuaguugggagguuauaaguuuagugcagugcaguggaguugacuuuguucaugaguucagugcaggccagcagaggccuuugaagcuagagaauaagaaggagccagaagauuagaacagauuaccagaguuaguuugaggccaagccgagcaauucagugagaagccuagagaagccagauugaaucagucagcuuggagaggaaauugagccagaacagcggaguucaaccagccaacuagaguucagaaagaacuggaaagggugaggguauucaacaguuaaguuucagguugaaaucauucuaggccuagguuggcagguggaggcuggaagcugaagccuucaaggucugggcuuggagaagauuaguuuguacagaggcuagaagauuccaggccuaggccuagggauaguuagaaagaagugcccugggcucagcccacacagcuugaguauagcucuuaucucaaaaguuaguuuuacuuaucuuaacuggugcaugcaagcucuuuacauuuauuggaaguacaaauuuauguggauauacauuuuaucauuuaaauauauuuucuguguuuauuuuuguauauauugucacuaucuuuugaauuaauucaacauauuuuccagaugcuguuuuccuuccccuuuguuuggcauuuucucuuucuaggugucagucaguugaaacuugcacauggauguuguacauguaaggucaauugcaauuuccugugcaucucccgagacuccugcuuguaacuccuacuguuucuuacaauugggagaaacagaaacugauugggauaacauuggcagggugucuacuccuggaucccagcucuuguaaagaauagaaugaaagaauaacauugcaauguggccacuggagucuuugccccugcuccuuaccccacuuggcaucuaucuaccucccuaccucaugguguuaacucuggucagcuguuuuaggagguacagacaacaggcuugcuguaaagccaagcucuaagguuuuuauaaaguggauuccacccaucuucuccuauuucccugucucccucuguccccuguuugcucuccuuccucuauuuccugucacacagcagcauuccuaccccuuaaacugugucuuaguggcuaagcucuuccaaaaacuugggauuuauguguuuucaguaagagaaguagaauucucuucucacggagucucuaugaacuuuuucccuugcagaaugaccucugacuuucuguucagugggcauccucuuagguccugaucacuguuacuaccauuguuacguugucuuguuuaagaauuacuuguguugaguuauaguccuuuagaaggagaguuggaguugggguuuugcuuaugcuuuugaacuuuaacaaacuuuguaagagaaaugaauauaaaauacugaauuuguuaaguaaggacugaauuugaaaauuaugaguccuaagugagaagaaauuagaaaaauguccaaacauguguaguuuguuuagaaauauggacacaaaguuuugacuaauaauaaaguucccagagcuuccauaccuuaucugucacaggugagacacauuuugaguuuguuuuuaguauuuguaguuggauguguuuguuuguaaguccaaagaguccaauugacaguggcuucaaacacuggacauuccuuacuaaccacgaaguccuuagggcaaucccaugucaguuucuggcucagcaaugccagugguggauuuagaaggucucugaaaucucuugauuguccugcuauuuggcacaagacagcuagcuauuuggcauaaaacagugcaucauuauagcagcaucuuaaguagaaagagagggacuuugggaaagggaaagggauuaguccuuguuuuuuuucucuucagguaagacacccccuucccaggcacucucaagcacuuuuaugucauuguuucaaaugauagaaaaugaguuuuauacuuacuccggacugaguguuagacaagaggaaagugacugccauggauggcauaugacuugcagagaaucaggccuuaaaguagcaagcaaacuagugguaaacaagauccccugaauuuauaagaauuaguuuuuuguaacuucaauuuuucaaaguauguauguauguguguguguauauauauauauauauacauauauauauauauauauauacacacacacacauauauaauaauaauaauuauuauuauuauuauuaauuuuuugguuuuuugagacaggguuucucuguauagcccuggcuguccuggaacccacucuguagaccaggcuggccucgaacucagaaauccaccugccucugccucccaagugcugggauuaaagguguucaccaccacugcucugcuucaaaguuuauuuuuaaugacaguuuuuaaaugcuuugaccucccuucuaacccaccaccuaccagaggcagugggaaagaaaggacaggggaaguggacuuguuuaggcuugguucuuuggagcaaauccugaguugucaggacaucagcgguucaguucacaggucagcagugacagcucaaaccacuuguaaacauuucauggauauaccagcaguccaguuugguagaguugaugcugccugugcuuuggacuacuuguagcccgacccuaccugcccuuggcgguuggaggugguggcgcagagucgaggacacagacuccaggagcaggugagaaaagccacagcaagcucaucugagcauuacugcaagcucccuuaauacccuccaccugagccccauuggucccaagaaagcaucucuucuaaagagcaguucuucgguuggcugguauugucugcaccaguaauccuuggucucucaggcaguccucaauuagguccucagcaggagaugcuuuuguggcugugugcacuccucccucuuuagguguuuauauagagguggcccugcccuuccuguuacaagugggauagcaaacaugaaucagcaggagagaccaggcccaacaggaaugccaggagaaguucuuggcugugucucagugaaaagaucauggaagaugggggaccaacaaucauuacacagcuagccaagcccagcccagccaaucaagcucccaucacuguucuuugaguuguuuuuaaauuucccucaaacauaauguauccuucacgggucuugccucacuaugugcgucuaucucagcugacaucacuuugccaaucagcccgaguccauggaagugguaagaaaccacaacacaccacaaguuuuuugguguguuucucuuuauggagucccaacaaauagagcucaacuaagcaauguaaggugugucgcuagugaagauuacuucaucacguguccuuucacguguuugcuuuagcagaacacccuuucuccugugucugcuucagcgaaauguuccuucaggagugugccuuagccuuucacaccugugucuacuuuaacuaaacuucccuucacauguuugccccagcaaaacaccguucaaccgacuuuccaaagaaccuguaaguuuccacuucaauuuuucuuccuuuccacuacuuauuuuuggugguacugagaguggaauccagggccuacacauccuaagugggcacuugucauugaguucuagucuuugcuuaggcauuuccuuagccauagggugcuuauaagucuuagaacucuaaggaucuuuuauuggauuaucagauuugcuuuauuuuugauauaggguguuguuauagauacugggcuggccuugaacuccugauuucccuaucucagucuucugaaggacagaauuaugaagguguaucaccaugccugcaaaaccagauuuguucaucuuuuauggcacugcuggcccuguucuagguguugaggaucagaauuuacguuauuccauuaaaugaagaaagugucuuaggccugucuuucugggggacacugauuccaucucucuccuuagcccaccagcauuaacucauuucuuugauuuuaaggguugugccaggaccaauaugcuuuaaauuaaaaaacaaauuuuaaaaguuuaucguaauguuuugcuugcauguauaucugugucccacaugugugccuggugucuucagaggccagaagguguggaauccccuggagcuggaacuacagacaguuaugagccaucauguaggugaugagaucgcaccuuggucccaugggggaacaaucagcacucuuaaccacugagccaccucuccagcuccuuuaauuuuuuuaaaaaauuauauuuuuauuauuuuaaguguaugcauguuuuccuugaauauuugucuguauuccacaugccuggugcaguggaggccagaagagggcauuauccuggaacuccaguuccagaugguugugagcugccauauuggugcuaggaaucaaaccugggucuucuggaaaagcagccaguguucuugacuucugagccaucugucuuuucuuuaugcuucuggagcaucuacugauauuuggggucuauuucauauuuuaaacuuuugauuagacauuuauuucugcuucuugguuguauuggucagaguugcuagagaaacagaaauggcguguacuauuagauuguuucacaagguagagaugugugugugugguguggguauguggggugugugucugucugucuaucuuugucuuuucugugucagugucuggauuucugucugucucauugccuuaucugugucagugucuggauuuguucaguuggcucaaguaaucauauaguguagaggcugaagaauucugugauggcugccugcaggcuugaugguuuaggcaacagucaugcuacugucucugagcuucaaagcuucagaauaaaggaugcugaugagacaguccugagucaaggcuaaaggcccaagagucauaugggucagagugggaggugagguuugucuaaauuacagauucaagaucaagggaucugaaauaugauguccuagaaugauggugguggcagcaacagaaaaaaaaaguuuauucugaaaguuagagugauagacugagacagcacgagagaaugcacgagauuacaaggcagcuauugccccuuucccacauuuuguuuuuaucugagugccgagccaacugcaugguuccuucccacauucagggcuugucauccccacucagugugcugacccccacccuagucuuccaggaaacucucagagacaugcauuacuaauucugcaucucccagucaacuugacaccuuaaauuagccuccauaucgggauuccucccucuggucuuuuaggaguuucguuguguauuuaauuuucaugguuguccacuuuauuuagcauaucuuguggguaugauguauuugugauguacagugcacauguggaggucagggggcagccucaagggcuggucuuugcccaccaucuuguuugagacagggucucuuucuguuaguugcugugcaauccaggcuagcuugcuggugauuccccugucucuguuccucaucuugcuguaggaacacugaggugacaguguugcuaccacgcacagcgcuguguggauguuggggauuggagcuuccguucuuacgcuugcgcagcuugugcuuuaugcacucagcguccccugcugcauuguuguacgugugcuggucuuuguuaucugcuucuucuagugacaaaacuagacacgcauaaggacuguuuggaggcuuuuucaguaacucaguuauuuaucacacacauuuaaaagugucuacucugaaagaugaacaaaauaaugguuuuaaguaccaucguugccaaauaucucagaaacuuguaacuuuauucuuuaaacaaaugauugugaaccacuauuuggaugccgggaaucaaacccagguccucuggaaaaggcagccaguuguaauaagguugugauacguuucagaaucauuuauuucccuuagcauggauuauucucuuucuggguuuuguuuuuuuuuguuuuuuguuuuuuguauuaucuuuaauuucuagcacuccacugacaacaucagcagcuauaagauaaaacguauacuagaaaggaucagagagaaaaaaaugagacgcuggagacauggcuuagugguuaagagcacuggcuacuuuuccugaggacccacguucaauucucagcaccuacaugguggcucacaauugccuacaacucugguccugcauguacacagcacacugacuccagccagagcagggacugucagaauuccucucaagacuuccuuuuucugcauuugcuuugcuuuacacaacugcuuuagcauauagaaaacuuguuccaaugcccaguaaacuguguguuaauuccuggaggcaucugaauuaagguuuaaauuauuuguucccuagccuaaggcaguuuuuucacacugguucacauaagucuggcaaguaaaguaggccucaccauaucugccugaugcauccuugagaauuagaggggagggagcaaugaaaagccuucagaaagcauuugccauagugaagguauuuacuugacagcaccaaagaagucaagguauugccaucauuagcugacauguuaucaaauacaguauugagucaggaaaacauuaacuuaucuaacaguaaaaaaacucagugaaucccuuugaugguguagugauuaguaauuccuuuucaguuuuuuuuaaaugaucauuaaggguauuuuuauaaguugucacuaauauccagucauccuaaucacauagaguucccgaagugagauuuuuaguaaauauucucauagucuuaaaaauaaacuuuaaaaaaauaguauaauauuuuuugaauaaaaacuuaaaaaauuuguauaaaacauuuuuguuaaauauugcugacaaacuuuuagggaaacaguucccuucacaauagccacaaauaauauaaaauaucuugggguaacgcuaaccaaacaugugaaagaccuguaugacaauaacuucaagucucucaagaaagaaacugaagaagaucucagaaaauggagagaucucccaugcucauggauugggagaauuaacauaguaaaaauggccauccuaccaaagacagucuacagauucaaugcaaucuccaucaaaagcccaacacaauuccucaaagacauggaaauuuacaaauccaucugaaaaccuagaauagugaaaacaauucuuaacaauaaaagaacagcugggggaaaucaccaucccugaccucaagcuuuaacuacagaacaauagugauaaaaacugcuugguauugguacagagauggauauguugaucaaugaaauagaguugaagacccagaaaugaaaccacacauuuaccgucacuugaucuuugacaaagacgccaaaaauauacaauggaaaaaagaaagcaucuucaauaaauggugcuggucuaacugacuguaugcagaagaaugaaaauagacccauauuugucaccuuguacgaaguucaaguccaaguggaucaaggaccucaacauaaaaccagauacacagaaucuuauagaagagaaagagcacaggaggaaauuuccuaaacagaacccaaauggcucaugcuuuaagaucaagaaaugacaaaugggaccucauaaaacuggaaagcuucuguaaggcaaagaauauaguugauaagacaaaucggcaaccuacugauucccaauuuuaacuagccccacauuugauagagggcuaauauccaaaauauauaaaaacucaagaaguuaaucaccacaaaaccgaacaacccaauccaaaaaaaaaaaaaaaaaaaaaaagggauauagaacuaaacugagaauucacaacugaggaaucugaaaugucugagaaacaccuaaagaaauguucaaaguccuuagugaucagagaaaugcaaaucaaaacaacccugagauuccacauuauaccaaucagaauggcuaagaucaaaacuucaggugacaacacauguuggagaggauguggagagagaggaacacuccuccauugcuggugggauugcagacugguacaaccacucuggaaaucaaucuggagguucuuuagaaaauuggaaauagaucuaccugaauacccagguauaccauucuugggaauauacccaaaagaugccccacccauccacaggagcacguguuccacgaaguucauagcagccuuauuugugauagccagaagcuggaaacgaccuagaugucccaugacagaagaauggauacagaaaaugugguucauuuacacaauggaauacuacucagcuauuaagaacgaggacauccugacuuuugcaggcaaauggauggaacuagaaaauaucauucugagugagguaacucagacccaauagaacaugcaugguauguagucacuaauaaguggauauuagccccccccccaaaaaaaaaagaaagaaagaaaagaaaagaaaagaaaaagcccauacagaaaacauaagauauacacuccacagaauuaaaaaagcucaacaaauugaagugcccaagugaggacgccucaaucacacuugggagagaaaagaaagcaaucacaaguggggagagagggagggaccugggagggaaaguggacaugggguggggaggggguccaggguggggguaggagagggggaagaggggaaccugacuugcuauuggaugagggaaaaggauugaagcccugagggccagcagaaagaauauaaacaggcaaccucaggaaauaggaguuuucagggacccccagaaugcaccagagaccugggaggugagagacuccaggacucauagggagaaggaauuuauagagcccaccuccagcaggaagacaguaucaagugagagaugggguugccaucccacagucacaccucugauccauaauuguuucugucugaaagaauuacugggauagaaauggagaggagccugaggaaaagaagguccagcgacaggcccaaagugggauccagcucaaggggaggucccagggccugacacuacuacugagccuauggaacgcucacaaaaagggaucuaccaugacugcccuccaaaggacccaacaagcagcuggaagugucggauguaguuauuuacacucuaccaauggacagaagcagcugaccccuguuguggaauuaggaaaggcuguaagaagcugaggagaagggcgauucuguaggaggaucagcagucucaauuaaucuggauucccgagaucuuucaacacuggaccaccaaacagacaucauacaccagcugauaugaggcccccaacacacauacaguagaggacuuccaggucuguguucauucagagaugaugcaccuaacccucuaaagacuggaggccucagggaguuuagagcuuagguggggcuggguggggguggggaggugugggauguggagcagugggaggguggauggggagggguggggaauggaauauggaguguaaaaaaugaauaacaaauaaaauaaaauuaaaaaaacuuaaaaauuuuguauaauacauuuuuguuaaauauugcugacaagcuuuuagaagugaauugaaucuagucaguuuuuucaaauguaguggcgagauaggaaacauucagguaauagacaugucugccuuacagcucuacuacugagucucaaaacucucaccuguacaggggaacaccagggccaaaaaaaugggaauggguggguagggaagugggggguaugggggacuuuggggauagcauuggaaauguaauugaggaaaauacguaauaauaauaauaauaauaauaauaauaauaacucucaccuguaacaucacagugagucucuguaauuccucuacacaucgugauuggauugcccagugguuuuauaacucucagcugcguucuuguugguuuucuuccuauugucaagagucguuuauuauggcaagguaacuauauaaccaucuauagacacaucuuagucuuuguuccuuauuaccagaaauuccaagaagucuguguaggccaguuugccuuaacagacuuguuuauaguuuuauuuuaaacauuuaacccauuuuuguuuuuuuuuuguuuuuguuuuuuuugaaaaguuuuauugauguuugguuuauagaugacaaguuagucuauuugaaauuuauaauucaauggcuuugauaucuuaagaaucuaaaaguuauaaaauguauauacaccccuuuuaaaugguuggugguauguauggagacagaggcucaggcagcacaagcagaccucaggcuugcugugcagcugaggaugguguugaguuccuggugcuccugcuucuacuucguaaacacugggauuacaagugccugggcucugcucuaacuauuuuuaaauguacauuucagaagcauuauauuuaugacaguguaaaaccauuauugcgaucuuaucucgaaaacugcgucauuauccaaacagaaauccaguggucacuccguggcugugcuucuccugcucuucgcuccuggugguggacucuguucucagucucuaugcagcuuccuguucugaguaguucauaaaaauuaaaccacacaguauagcauaucuggcuuauuuuacuuaaaauguuuucaagauucagcuauauuguaguauguaucagauuuuucuuucauuuuaagguuggaugauaauuuuacuguguguauuauucuacauuucuuacugcauuaauuuguugauagacauuuggauuguuuccaccuuuuggcuguugaauaauaauguagugagcacugaugagcagguaguuugaauucuucuuugaguuguuuggguaucuagaaguagaauuguuggguccuacaguaaaccuauuuuuagcuuucuuugaugaaccaucuguguuuucaaggcagcagaacccuagguagcccuacaagcaaugugcaaacauucugauuuucccacauccuugccaacauuuguuguuuugauuuagcuuuauuuaauuauuuaaaaaauagagugugcagugauaacucguugugcuuagguuugcauuucucuaaugauuagugguggugaucuuuacauugguuuguuggcuauuuauauaucuuguuggugaaguguuauucaaacuuugccagguuuuggauuggauguuuuuuguuguguuuucauaucuucuaguauuaauccuuuauuugauguauaucuugcgaauguuuuuguuauucuuugggccuuuucuccucuauccugacagugucuuaauagugucuuaaauaaaaguuuacauuuugacgagaugcaguuuaucuauuauuuuugcuggcauauuuuguuucauauaucagaaaucauugccauaucugaugccauacagauuuucucauguguuuucuucuaagacuguuauaacuucaccuucuuaaaauuuuucuuuauuuaauuaaaacauugauuucauucaguauauucugaucacacgccucccauuccccaucuccucuuagauccucuucaccucuccaccuaccuugcuccgugccuuuuacuuuuagguguuugacuaauuucaaguuaguuuugugugugauacaaaguaaggaccaagaucauuaugugugugucuaugugcaugugcacacaugugcgagcaugugcacaggcacacauggagaucagagguugauggcaagcaucaucuucaaucauucuccacguuauuuaaacaucuuuauuacuauugucacgaguguacacauaugcccaguugucuugauuuuuguuuucuuguuggauuguccugacacccauucuaaaaccaauugaacacauagguguguuucugaauauuuugauuuauucuguugauccauaagucauuauaccagaacuguacuguuuugauuauuguaguuagucuuacaauuaggaugugaggcacguuucucucacuuacagauuguuguggcuauucagucuguacugagauuucauaugaguuuuaggauauguuuucuauuuuuacuaaaagcucuacuacaguuugugaggauuuuccugacucagacgguugcuuggauauaauugucaucuuagcaguauuaaaucuucacaguuuagaacauggaauaucuuucuguucauuuaagcugcaucuaaauuuuuuuaaagcaccauuuuauacuuucaguauauaaagguuucgccuccuuuguuaaauuuguucccuaacugcuuuauaauuuuuauuuguuuuaagacugggucuuacuauguaaaccugguuuaacugaaacucucuucuuauauagucaaaggcuagcuuauauagucaaggcuagccucaaauucagagugauacaccuacuccugccuaccaaaugcugaaguuaaaggcauacacugccccaccuagcugcuuuuuuuauuuucuuguaaauguaauuaaacuauuuuauaauuauucacugaaaauauagaggaaauuuuuauuucuuucuauuuucugagucaagauuucauuaaguaggccugacuagcuugaacuccgucuccagcccaagcaggccuuggacuuguaagccucauccuccguggagcugguauuguagguaggccugucccacuagccugccuuuauuaacuuuuuuuuuuuaaacauuuuuaaugagcuuuauuuacaucugauagaaauacacugacuuaaaguagacaauuuacuguguuuaguuuauuugugguugugucaucaccacagcuuaauuuuaggccauuuuuuaccacaccccagcaaaaauccuccaucuauuagcuggcauauaaauaacaucaacaacuaaccuaggguuuuuuguuuauaggcuugcuuauuuuguuaaaauggaaucauguaaaguaugagacacagcuggcucuguauugauuuuauguccuguggcuuuguggauuccuuuacauauauaaaguguauuucuauucucccaauguucuauagugauuucuaugcauaauaucaugcuaccugcaaacgucuucccucuuccauauagauagcuuucauuauuuaguuuuuucugaucuacuugcucaggcuuuaacuucuagucuuaugcugaggagaaguggccagagccaggcauccauaccacguuccugauccuggggaaacuuuucuccauugauuguaaugucuguaaguggaugagcaaugagucugaauuuuguuaucauuugauauuucagguuuuuauuucucauguaauuuugacuuauuaauacuuuccuuacuuuuuauaagugcuuaaucuuguuuuaacacuauauuugacgaucaccaugguauguacuguuuccgacugaagaagcuuugcgagcugaauauuuuguugcaguugaggucuuagaaagguugcuuucacuccacuaggauuucaggguccucaugucuuucugaggcuugauucuucauuucuuuuguaugugugaacagucucccugugaaugaaugucccacacaaugacuacuuacacaccacugcaguaugaugugucugauaggcacaaguaaaacaauuagagacucuuuaacaaggaaaaccaagggguuagaacuugcaaaaacagcuuccugaaguuccauagcuguuccauagcuagacucauauguuuugcuuuguguuuggauauuuuguuguuuuugugcuguucuuucuguacacaaacaugaauacauuauuuuggcugaaucuuucaaggauaauuauugauaucaagauauuucuucagauacagauacugucuuguguugcuuuguaguacaacugucaacaaauaauuaaaaaaauuaaaauuaccuuuaguguguguguuugugugugugugugugagagagagagagagagagagggagagagugagugaguguauguguguagaggacaacuuguuagcgucuguucucuccuuaucauaugguuucuggggauugaacucccagguugucaggguuggugaagaggguccuuguucacugagccauuuuaucagcucugguauaauaauuguauuuacuguaaaauccaauauugaaauuaacggucccaauaauauccuuacagcaacuuccauuuuuaauuuuuaaauugaaaaucuagucccuagucauuccuugcaaguaguugcuuaucucuuuagugucuugaugggcuucaucuuucacaucagugcucuuguuugaaacacgucauugccacaagucacaaguuuugugguccuguccccauguaaauguguccaguuguucacugguggcgaaucagaugacuuuucuugggcaggggcagguuccaugugauagugcauggcuuccuacugcuccaugcucggagucaccacuuguuacuguguuguuguagugacagcuauuucuccaagcccgugggucuucuggaagaaccauaaguugaaagcuucauuuggaugcuguaguuucucuuggcuuugggagguacuuuugugccagugauuucagugccuucacagugugucauagcgugugcauuuuuuuuuuaaaaacuagaacuuguaaagcuauugacuacuaguguuuuuuuuuuuuuuguguggaagacuaacauacugauucaauuuauuuauugaaaaguuuagacuuuuaguuuugaaaaacaauuagcuacucuguaagcauaauuuaucacaguaaauuuagcaacauagguuacuuaugguacuuauugcuaaauuuaaucucaguggcauuguaauuuuguccaguuucuuacuguaguauuuuguaaaauucauuuuuuaaaauaaauagucuuuuuaagcccuuuaaauuuuaaaaauuauuuugugaaugccugugugcaugucuguuguaugguaugugcaugagagugcaggugcccucagaggccagagagacguuagauaacccuggagcuggaguuacauagccaugagcuugguacugggaaccaaaguggaguccuauggaagagcaauauugguucuuaaccacagagcaaccucuccagugccaagucuuucuauuaugagcuuauuuucaaguuaaggaauuucauucauuuugcuuucucuuuguuaugacuucuauugcuaugggauggggcacagacaggcucuuacuguguuguauaggcuggacuucuguacuucugaacucaguucuagcuccuuuuaaaacagaagauuugagacuugguggucguuuguuuauuuacuuagcacuagcuuaguccauagucccagaauuuuaacauaguuuuuuuuuuuuuuccccguagauucuaguuacuuauuucuucccuuuaauuucaaagcuuacuggcauuuuugcuuauccuuuacugauuugcaguuaauugcaugauauaaauacaauuugguuuuuauguuuuugauauuuugaauuuuauuugcagugguuuuaugacuugauauuacuaaaaucuguagaauuaaauguguuucaagguaauucuguccagcugcuacaguacuaucucuguauuuuacucaauuauauuguuuuggcaaucuguuugaaguauguuugaaguaucaguggauuuuaaguaaaaugacuuuucaggaaggugugacuauucuaacuuuacacauuuugagguuauguuaucugguacauauguguuuagaaucuuagaguaauuugcacuuuuguuuuugcucuaaugucuacaucuaaauaggaaaaugauuuaauuuuuuuucagagguagggagguuaaugccaacuagccucuuucuuuacugacauuuuguguaaaaucaauuuagaauccacagaauagauuggcugaaguuuagaaaggaucaaguacacauucuauaauuggaagaguguuagugaguaugcaggcuuuaucagugauaaggaacaauagugaaaacaggccuuuagaaaccaguauuagccguucaguaaggauuagccauccugcucacaugguaaguuuggaaaacaaugccauuaguaaccugagucugaaaauacugaauuuugauagaaugcauaauucaaagaaauuacauacuaguuacaauaguugucauuuguagaauuagaaaauaugagacaguaauauagcaacaugaaaugaaucaauuaucuaagucuccugaaaagacacaugugcugcauguuuuacuaaagcccgaagucauggccagccauguuguguguugaagguuucauuggcacauccuuuacacuuagaucuuuaaacaagcugaaugcugcugcugcaguggacacgagaggaugaaaacucacaggccuggugagcuggcuucccauuagugcugagcuccguguagacagcacagagggaagauaauuagaugagacuuguuuaugaacacgaggaagacuugaaugaaaucaaaucagagaaauuucagcuguguauugaaggaaccauuagagcuaaguauaggauuaucuaaaaaacaaaaacaaaaacaaaaaaaauguuucaaguucugaaggcuaccuaaauaguaguauguccuguuaagaccaugacaaagaaaacaagaacuucagugucaucgaacaguucucuuguuacacauuacugugccugauagucauauucuugccaacacuuagcaguuucuaacuuuuaaacaagaauuuggcacauuuaguuaguaaauuuuagacuccuguuaauuuuccauuuuguccauccuuucugugugaacuggcaguauugaaauaaacuauuuuuuaaaccagaauaacuaaaauuugauucuggugagcacaugguuguuacgaugauguuuuaggaaaggcuaaaaggauggcaaucucagggggaggugagagaguaucuuuucacacagaagcuuagucccuaaaaguguaaggcaagcgaaugccaucgaauuauauauaagaaauaggaaucugacaaguauacagauuuugugcaagcauauacuauuaauauaaauagacuauguacaucaccauuuucucaggacguucaauuuauuacuuauuuauucaguucauucaugauacccaaaguccuuucaccuacacacaugcacacacacacacacacacacacacacagggagggagggagggagggagggagggagggagggagagagagagagagagaaugaaugaaugaaugaaugaauauauuauugaaugguggugcgugucuauaaucccagcacucuuaaaacucuuaaagguagaggcaggacgauaacagauuugucuugguuacacaguugcaggucaguaugggguacaugcccuaagacucuaucucaaacaaacaaaaagucaaaaaauguaauuuaugcaaauaaaggaaacauugccuuuuuauagguauuaauucauacuuugauaguuugauuagauuuugaaggugcuuugauuuaguucuuacuuauacuuugaguuuuuuauuguuuaagaaacacucaucugcugggugaugauggugcacgcuuuaauccuagcacuaggaaggcaaaggcagcugaauuugaagccagcagcagccuaaucuguaaagcgaguuccaggacagccagggcugugacagagaaacccugucuugaaaaaucaaaccaaccaaccaaaccaagaaacaagcaaacaaacaaaacaaaacccaaagaccaaaaagaaagaugcaucuguugcacaucuaauuuguauuacauuucauuaagaaaguaacugauauugcucuuuuguuucagcuaaaccauuuacuucuaaagugaagcaaaugcgauuacauagagaagacuuugaaauauuaaaggugauuggucgaggagcuuuuggggagguaagagauauuuucuguguuuguuaauuguuuucgaaggcguuuuauauaauggugagagauaauuugcuugcuguuacaauugauaugccugaccagaaaauagauuaaaguugugaaugaagcauuuuacauggaauuuucuaugaugauucacuuuuuaauauguacuaaauuuuguuucugucuguuuuccuucuuuugccaaauucauacugucucaugcuacuucaucgccuaagaaccugggugugccugguagugggucuucuccuuuaucugcgcuugccucucccuguguuuucauaccacuucagaaucucauuuacacauaugcacgugcgugcgugcgcacgcgcgcgcgcgcgcacauacacacacacacacacacacacacacacacacacacacagaaaaugcuagagagaaagagagaaaaagaaaucagaaauuugggcuaggauuccauugagcuggagauaagauuauaacuacuugaaauucuaagacaggagucagcuaauccauggacaugauauaguucuccuuuuauuuaacuuucauauguuuguagcuuuuuuucuuaguuauagaggauuuuacaucuuucagcagguuuacuacaugcaugguguuccugagguuauuuuaaugaaaauggcuuacauuucacuuucaauuguugaaaguacaaaucagcaauaguguccugccuuggagccucccuccccuugagcuggauuccaauuuaggccuccuuucucuuggucucuucuaaauuguugucccuacaguucuuuuagacaggaacaauucugggucagaguuuuugacugugggauggcaaccccaucucuccacuugaugcccugucuuucuacugcagauggacgcuacaguucccucuccccacuguugggcauuucaucuaaggucccuccuuuugaguccuaagcuucuuucaccucccaggucucugguacauucuagaggguccucccaccuccugagguugccuguuuacauucauucugcuggcccucagggcaccuacauucccugcccucaccccccuugugauugcuuucuucucccucucaagugggauugaggcauccucacuugggcccuuccacuuguuaaccuugaguucuguggauuuaaaaaggauuccaucuugguuguguguuauucuuuuuaugcaucaguggauuugguaugcuuuaaagaauauuugaguguuuaauuuuuuuuuuccacuuuuuuauuuugggauuuuuggagacaggguuucucuguguagcccuggcuguccuggaacucucuguagagaaggcuggcuucagacucagagaucugucugucucgggcucccaagcacugggauuaaaggugugagccaucacugcccagcugguuuuuaaaccuauuuuugauacagaacuuggcauguaauuuucuuccaauaccuucaucagauuuuuggggggcuugucugugcuggucccaugagaagaguguucccuaaauguuuuacuguauucuacaagcuucuaaaauaguuaccaucuuuccuuauaugauucuggagucuguuacuaagauaauacauuuuuacaauggauuuuuuuuaaauuauguguuaguuuuauuguguuuacacaccucacauaacuuuuagaacuuaauauuguauugaucacuuacugauucauacgaccauugguucaucuuauuuuuaaauucaucuuacuagggaacugucaguuuucuuugcuuuuuaguaguuaacuucuagucucuucaguuuugcuguuguggauuaauucuuguuguuuaauauuuuguuuucugugguauuaacuugcuauuuauucuucuaauuuacugaaguagauuauuuaacuuuuuuauuuuuagcucuucuuuuaaaaugugcauuugggcugcuuuccugcaagccgugccgucuggagcagugaauucugagaugccaugccuccauuguuguuugcuccaaguucagugugauuuuacauuucaguuuguuuguuuuguaucugugaguucaucacaguuucuaagugucucaaagauuuccugguuguauucugccauugaauuguaaugugaucagagcuuagauagcauauuuguaugauuggaauuuauuagcucaaauucauuaauuuagcuacuuaaaauuuccauuuuaauuuuuuguuuucuauugaguugccauuucuugagaaagggguuguuuuauuuguuuauuucuuucaguauuuucuuggcauuuucuuuuuuuucuugaucuauuacuuccuagaaauuuuaauuauuucaguuuuugcugauaacauaugcagagucauuuugucuuccuaacgaagaacucuuguaucacuaaagaaugcuuuuuuuuuuuuaucucugugacauccuuuaacaaagauuaaucugaguuaguggaauuauuuuaacuguuagcacuuuaauuaaauaccuagcugaauucuuuuuaguuuguuuuuuuuuuuguaaccuuauagaauauuugcugcuaaguagaaucccaguuccuucuuagcccucugcuauccuagauuuaugugaccugauuuuuaguucuguauuaauagaauuauuuacucuaacugcaggcuuuuucacccgcacccaaguuccuaaaauaacaacucugagacugaaucauuucaugaauaaugccuaggccauaagcuagguuuuguuccccaacuagccauuuauucuagucugugagcgccacauggcugguuaccuccucucaguuucacaugugugucuccaucagucagucucuucccaagcccaacucucucccuucuggaacucccaccaccuaggccacggcuuuucuagugacaggugaugcuuccauauagcacaagcauucucuauaauuuacuauauacuauuguuucuagcuucuguucucuacauuauacuuauaugacacacccuuguuuuucuuuucuuuuguuaaguuuuauuaucuauuuauuuguaugugucucugcccucucucugcuugugcauacaugugugugcauggcaugcaugggaggccaggaggcaacuaaugggugccaucucucucuauuaccaugggccuucuggaaauugaacuuggcagcaagugcuuuuaccuacugagcugucacccugguuccauguccuaguuuuccacuagcucauugaauuuauuucuuuauaugaguauaccauaugcuuuuuacuuauaauaucauuguugaacgcuaaguugcuuaucuuuuuucuggcuguucaguauauugcccucagaaacauucuuauuuacauccuuggugagguauaagcaucuauuuauguuuaauauaaacuuaggagcagauccuguuuucugagguaggcauaguuagcuuuaguagacagugucaaauaauuuaagugcagagucauacucauacucccuguaacaauagucugaguuuccuaaccgaagccacuuuugguugguguuuaguggucaucgugacuccauuuuacauugccuguuaagucuuaaaggucaguaacuuuucaucuugcuucauaucauguggcuauucugugaacaaguaaacauuuugggguuacggagguaggaguugaauguuauugcuaucuucuggauguaaaugacuuguuggcccuacaguauaugugcauaagaagugcuuuggcuuuuccugucccgguagaucuuguauugaaauaaaguucaauaauuaaauuaugauuagccgggcgugugugugcggucucauguugaaccuuaccuuccuccguuucuuuguucaccucuguguacucaggccggcuggccuguaaguuucuggggacucuguugucaccucccaucuggcuguaggagaacugggacuacagauggcuaccuagcucagcuuuaccuggguccuagggauuugaacucugguccucguaugugcaugguuaguuagaacuucacccauuuagcccuguucucagcccucucuucauuuuuuuaagaucugauuuuuuuuuuuaauuuuagguuauagguauuauucguaguuuguuaaauuuauucccaaguauugaugcuuuuugauuuaauggcaaaugacuauaaaaauuuauauuaaguauuauguuucugauauguagguacaguugauuuuuuauaacugacuucuauaucuugaugucauauuuuggucguuugagaaggacaguuucuucuuucaccuuacagacuguacauucaauuucuuuuaugucgccugcuuagguggcuaaugcagaguugaacauguaagguggacaugcuuacccuccauugaaauuuagggaaaaggcuuuuuucccccuuggauuuaggauuaaggaauuuuaaggauuuaaggguuuaguaugcacuguuaaauaagauguuagcuauaggugcuuugguagacguugccuguuugguuaaggaauguguucuaauacuacuuuuugagguuuuaaaaauuuaaucaaugagaguugaaucuauuuuuuuuuuuuaauuugugaauauccaaaauucccagcaccaucuguugaagagacuguuuugcucucucugcagagcaugagaugccuauagcugcaagggcuuguugcuagcuccuuuauuuuaaucuauuaggcacuuguccuggcuaguuuuaugucagcuugaaacaaacuagagccaucugaaaggaggaagccuugauugagaaaauggccuugcuaggauauuuucuuaauuagagauugauugggggagggcccagaguucugugaaugaugcuauuccugggcuguugauccuggguucuguaagaaagcaggcuguguaaguuuuacagcucugaagggaaugguauccuggcagucaggagccaagguacaacaaaacccauguaagagauucauugggaaauguaacuauguaggcugugccccucucaaggaagcaaagaucagcaagacucgagacccacagccauugcacagcuagcuguaccagcaagccaagcucucucucuguuacuccguggaauccuauuuauacccuccaaacaucacguguccuccaugugccuugccucagcauaggucuugccucagcauaggucuuaccucagcgugugcauccaaucaguccuuggaagcggcaagaaacugcagcacaucaccagaauuuuuuugauguguuucucucuauguaguccugacaaaugcagcucaacuacagauguaaggcaaaccaauacauauguguuguuggcaaagaauccuucaucacguguccuuucacgugcuugcuuuagaacauauuugaccugugucugcuucagugaaauguucuuucacgagucugccuuagccuuucacaccugcgucuacuuuaacgcaauguuccuucaaguguuucccuagcaaaacacuaucccgccuacuuuccaaagaacccguaaguuuccacuucagugaaaggcacaggagaguggcugccuuugcuuaggugagaagcccagggaacugagcuggaggcaggcuuuacauaggguuucuuuauuucuaggauggggauugguggguuugguagguuuucaaacccauaauggguucaaacuuuuuccaguacaggcugagcagccauuaagcaguacugacuccuccauggccccugcaucugcuccuaccucccagguuucugccccaggaguuucugccuugguuucuuucagugauauuacuacagaguggaaguguaagccagaaaaacucuuuucuccucaacuuacuuuuuggucaugguguuuuuucacaacaacagaaauccuaaguagaacagcacuguagcauaauuuaaaguagggcacugugaugcuugcagcguugauuuuuguugaagagugucugacaugugaauguuaacauuauucuuuguauuaaaaaacagaaguuuucaauuuuaaugaaguucuaauacuuguuuacuuucauggauuaugcuuuugguguuggugcauaauugauuuuucaacuauuaaagcaauuccugggauagagucuuauuagaguuggaaucaucuuucaagauguuuuucucuucaguuaaucaauauuuuguuagcuaguuuuacaucuguauuuauggugaguguugacccauacauuuuuguuuuuaucauuuccaggcguuguuaauaggguuguggugaaucuaaguaaggagcugaggaaauguuuuugcuucccacuguuuggaaacugccuuccccuuaaauguuugauggaguuuaauaauguaacugucugaacuuggguuuuuaaugcucauacuugauuaacacuaaugguuuuagaguuagcuugucagcuuuuucuguaucaguuuucagcuucaguaugguuuauuuuucauggauuaugucugcuaacauuuaaguuaccagguuuauugucaugaggcuguuuauaauauuuaguaauuuugcaucuuacagagucuaaggugagguucuuucucucauguucauagugcaugcuuaauuuuucuugaguauuagaaauuuucuaaugcaauuaaauaucaaagcuacuuuuuaucuucaugaguugucucucuuguacucaggugcauguugugugugcauugcaugugagugugcacauaugcagaggccagagcgggaacuggguuccuucuaguggucuuuucauuauugccuugagauggucuauuaugcucucucacagaacuggaagcucgccuuggugccaaauuugcuggcuagcuagcacauggauggaucaaccuguguuugcccuguaauguugagguuucaugcaggugaagcugugccuugcuuuuuuuuuuuaaccugagugcuggggacucaaacucaacuucucaugccugcagagccaguuugcuuacccauggggccaucucaucagcuccuaucuaaaguuugcuccuuuuucucuuuaaacacugaacauguguuuuuaccucugugaaucuuuucuuuaaauuuaguguacucauuuguuuucuaccuuuucgagaugaaaccuauauauguauauguauccuugcuucuuugucauuccaauguaaacacagaagcauagauuuagcuuuuaauggugauuagguucauuccagagauuauuuuuuauuaucauugauuuaaagauguuacuuaaugucuguuucagaaguugauauuauucuuuguuuuaaaaguuugucuguuugaauuguuuugauacaaugaguuaauauacuuuugauuuuucucuacuuugaaaauuugcuaaggucagaaugugaacuguucuauugaacacuucaaaugcccuuaaaauuaaugcagaauaacauuuauuucuugcuguguuuuacuaaugucagugaacuugagauggucaguacuauuauuaagaucuuccauaauuugaugguuguccuuuagcucugucagugaccacggggguguuuauuucucccccagagcuguauauauuuacugauuuugaaaucuguaacaguaggaacauacacauucaguauucaguagcuauauuacucugaugcucaccauuauggccuacucuuuuguauaaggugacguuuccuaucuuugauuccuccuguuagucagcuuuccuaugguuugaaccccuuucuccuacaguuguauuuaaugugaaucuuuuguggguguauguaguuauguuuugaauuuuuaguacauccuaauaauaucuguaccuuuauuggacuguuuagauuaugaguaugaaaguuagaaaggcagaguuuacagaagugguauuuaauacauuucccccacuaugcugagcauugaaaucaggucuuguacauguuaggcaccuccaacugagcaacaauaucaucccaaguguuauuuuuauauaaaccuaagguaguaaugaaacuuacuacuaauacagagauaauucaccuuuaaguauauaugugaacagaauuaauauauaggcaauuacagaagauaguggaagagaaaaacacuuauaauaaaagaguuaagacuauuauuagacagcucauacauauaugcuaauuauuugauaggguaguugcaaagguuguauaggaagacaagcauuucuagagcuggguaugguagcacagauuugcagucucaacuauucagaaggcugagucuggugaauugcuucugccuaggaauuuucccugagucuggacaauauagcugcagccuacuccccuucaaaaaugaacaaacacauaaccccacucuaagaagaaucauuagaaaacucauaguaagagcagugauaggccuaacuauaucugcagccucaagaauuagcccaugaagaagaaguucaggacagacuugcauacacauauuuuauucuuuacuaaagacaguagcuucagccaguguggguggaaaaaaaaucaguagaugauuuagaauacaggauagcuauuuggaaaaguccuuuuguggagcaaauuaaaauucauaccauaugcuaggaugggauacaaauagaugaaaaaauaguguaauaaauaggacaaauauaacccagauaucuaucaauaugaaacugucugaauacauugugguuaagcagaccacaauuugcugugagacccauagcugaacauuagguggagcucaaggaauucuguagaagaggaggaagaauuguaggagccagaggggucaaaggacaccacaagaaauuggcucacagaaucaacuaaccagggcucauaugggcucacagagacugaacugacacucagggagccugugugggucugagcuaggcauauauguuauaguguguagcuuggucuucuugugggacucagaacagugggagcagaggugggcucugacucuuuugcuugcuuuugggaccauuuuccuccuccuagguugcuucauccagcccuaauaugaagggauguaucuagacuuacaguaccaagauauccuguguuugauugauaucccugggaggccuacccuuucuugaagggaaauggaggaguggaucugggagagaagggugaugggggagggacugggaggagaggaaggaggggaaacugugguaggcauguaauauauaagagaacuuacguagagagaucucugggaugcauuaugaaguggauaauauaauagguaggaaauguuauuguuauuuguauuuccaucaaguagcauagggagggguuaggagagauggggcaguguaagcaggagugauagugacacacaugggauugguuuaauuuuugauuuuucuuuugcuuauuauuaaguuauuuauuuauguucaagucauugcuccccaucgguccccacuucccacaguuccucaucccauucccccucccccuugccuccaagagggugcuccuccccaucaggucucucccuucccuuggggccuuaagucuuuugagaauuaagcacaucuuuucccacuguggcuagaccaggcagaccucugcuauauaagugccaggggccuuggaugggccuguguaggcuccuggcugguggcucagucccugggagcacccuggggucuggguuaguugagacugcuggucuuaugggguuccucucccuuucagcuucuucaguccuuccccuaauucaaccuuagggguccccaacuucaguccaaugguuggguguaaguaucuaccucuguuuuagucagauguugauagggccucucagaggacagccaugccuggcuccugucuguaagcacaugauagcaucaguaauagugucagaccuugguguccuuccccacaaucccccaacuucagauggaccccaacuugggcuggucauuggauuaccuuaccuuuagucucuucuacauuuuugucccugcaguucuuuuagacaggaacaauucugggucagaaauuuugacuggauuaguagcccugucccuccacuugagacucugucuaucuacugcugguggacucuucaaguucccucuccuuaauguugggcauauuggcuaaggucacccccaaugaguccugagagucucucaccugucaggucucaguauguaauauuuuauucauuaaaaagucaugaaaaucucauuauagaugguugugagccaccacaugguugcugggauuugaacucaggaccuucagaagagcagucagugcucuuaaccgcugagccauuuuaugccccaguacaggggaaugccagggcuaaaaagugggaauggguggguaggggagugggggggaggguauggggggacuuuugggauaguauuggaaauguaauugaggaaaauacguaauaaaaaaauaugaaaaaaaaagaaagaaaaaaaaagucaugaaaagcugggcagugguggcacacgccuuuaaucccagcacucgggaggcagaggcaggcagauuucugaguucgaggccagccuggucuacagagugaguuccaggacagccagggcuacacagagaaacccugucucgaaaaaccaaaacaaacaaacaaacaaacaaaaaaccaaaaaggucaugaaaaagaaccuugcaguuggaagugaauucaucugcaaguucucugaauccuuuuaacuaugcugggcaauagagaaggagggacccaguggcucccucacuuuaugagaccagaguaaccaaccuuguccuaaaaccugacaauguggggugaaggaagcgacauaggaacgacuacauaucacuaaagucaaggauaauaacugucaguuuugggaagcuggaguuguagugcacauaggaggguuucugaguuguagugcacaagagaguguuucugggcuguacacuuaggaauguuucuggguuguacugcagccuaggaacaguucugguuugcugcaagcuuguacaucuugagcuggguuuuacucacuggguacuuuauaauuguguuuaauuuucucucucucucucucucucucucucucucucucucucuauauauauauauauauacacacacacacauauauauauauaauuuuauaucuaccuguuaaaauuauaaaaauucuaaauuuuuauugaaaauagauauauuagucaggguucucuagagucacagaacuuacagauagucucuagauaguaaaggaauuuauugaugacuuacagucggcagccaauucccaacaauuguucagucgcagcugugaauggaaguccaaggaucuagcaguuacucagucucacgcagcaagcaggcgaaggagcaagagcaagagcuagagcuagacucccuucuuccaauguccuuauauugucuccagcagaagguggagcccagauuaaagguguguuccaccacaccuuuaaucccagaugaaaggcauagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauacgccuaacaugauauaacuauuccucguacaaucgcaaacgcauuaguaaauuuacaaugggcauucauauuacuuuauaauccucguuucugcaacugguuacguggccuuaauugguauuuauaacuaccuuccucuacuacccauucuguauuuccuucaccuucagccagcaccucagcaggucuuggcucuuuuccuggaggauugacccauaccuucauuccugaugggucuguguccuuugucauccugcuuggauuaggcuguuguaguuucccauugacuuuaaucacaggacaugguaguacuaagagacgcccuaagggaucuccuacacuccagacauaaucuugcuuaccaccauugugaagagguaauccaauuuccccaugguaaucuggaucuaucaccccuccuaacacuguuauuccuuuuuuagccuguugguuuaagggcauuagaagcccaaaaugaccagggggaagucugagcuuccaguucaauggaauguuuguuguagcuccugguaggagcacuccccucucuggagccaaaacuucuaggccagcagaaccuagaguuauggggacaggaagcaaaaauuuuccuagagggucacuaggagugauaguaaguggaacuauuccguuuuccaccccuugauuccuggacccaugaauccuggcuaugggugaaacuguaccauauaucgagcgcugauucaaagcauauacugccuucugaagaacucuaccccagccuuccaagcuguuaccaccuaauuggcgcuguaacugcgucuucaaaaggccauuccaucuuucuaucagcccagcugcuucaggaugauggggaaugugguaagaccaguguauuccaugaucgugggcccacugucguacuucucuggcugugaaaugaguuccuuggucagaagcaauacuguguggaauaccaugacgauagaugaggcauucuguuugauuuucugcaacuugagcucuauugcuacaagagagaagauucuccucaaggacacacuuagcaacuuuuagaucguuuacuugugucuggagccuuucgauuuuaucacacaacuccuuccuuucauucaucauuuuuuccacagauacuaagagcagccagccaguaaaaucauuuuucgauuuuuuccccaucuuguagaaagcuuugugcacugaaucaccuaauucauuaagaaaaucaagggcauuagcuucuuuaaguucggaauauaguuucaaccaugggucuucaaaauucucugagcucccaggagggagagaaucuggagagguuucaauaguugaaagugcugguggaucaacaagccaauuccagaauuuuaaaagauucauccuuguacuucuguuacucuagaaccacuccugguaccaacuucuauauuagucaggguucucuagagucacagaacuuacagauagucucuagauaguaaaggaauuuauugaugacuuacagucggcagccaauucccaacaauuguucagucgcagcugugaauggaaguccaaggaucuagcaguuacucagucucacgcagcaagcaggcgaaggagcaagagcaagagcuagagcuagacucccuucuuccaauguccuuauauugucuccagcagaagguggagcccagauuaaagguguguuccaccacaccuuuaaucccagaugaaaggcauagcccagauuaaagguguguuccuuaaacucggagauucaaucuucuggaauccauagccacuauggcucaagaucuucaaaccaagauccagauaaggaucuccaagccuccagauaagggucacuggugagccuuccaauuccggauuguaguucauuccaaauauugucaaguugacaaccaggaauagccacuacaauagauuuuuuucauacaauauauucugauuauaauuaccuucccccaacucuccccaccaagauccuucucaucuccucuuccauccaaacucaccuuucugauucuaguuagaaaacaaaugggcaucuaaggaauaguaauaaaguaaaauaagauaaaacaaaaccuggacuagagcaaaccaaacaaaaagaagaaaaacagccagggaaaaagcaugacaaacagacacagagacacacagguucauacacacaggaaucccaaaaccuacaaaacuagaagccguaacauauauguaaaggaauugcccugacaaaacaucaugaguuaaagagccuccacagcugcuaguguuggccauuacugcugggcaugguggcuuacacguaaggucuguuuguaucuccagugagacugugguggaaagaacuaguuuuucagguugcuaguggcuaucuauuggugauaaccucuagguuagggauuggaggaaauguguccauuucuccccuuagcacuucuuagugguucccaucugugccgccuguguaggcccgguguguacugccacagccuuugugagugcaaggucucacucugcauauuguucaacuguggaucuuuauauuugugcccggcugcugccagaagcagcuucucuguugauagcugagcaaggcagugaucugugaggauagcacaaugccauuaggaaucauauuacugcuauuuuccuuuagcagaacaauaguauuugguuuuucccuagauuacuggccuaucuggccucagguucuuggccacccaagcaguauugggaugggcuccaucccauggagugggccuuaaauccaauuagauauugguugguaacucccacaagcuuugugccacuauuauacuagugccucuugcaggcaagauaaucauuguagauuaaaaaguuguagcugaguugguguuuaccuuucuccuuugguggcaugcagaauacgcuucaggggugaaggucuggguaagcagcagcccagccucucuguguucagugaguuguggagguguaggcccuucagcaguagggccuuccugucaguuugugaagagcaaccaguagccuuggcaauagccuguugcaagauauuugaucaaacugugaaccccaagauuguguuauuuacuagaaaaaccugcuuuuaguuguguaucacuuagcccacaccuuuaauccaagagcuuucugcuugaauauuguaaacaugauuuaaaaaagucaaccauagaucaagaggugaagcacgcaaccaguugacaggaagugaacauaggauuauuaagaaaaaaaaagagagagagagaaagagggagucaagagaauggaaagagacaaacaggacguagaagggaggaacacuuggcuugaguaggcuuuuuugagaugacaagggagauugcuucuggggcaucagcugaggaggaaggucagcuaugugccuucucugcuucuuugagcuagcaggcuuucaccccagcaucuggcucccaagucuucaaauugguaacauugaaugauugccauuuuguuaaaaaaacaauagcauggguuggggguucccaugugcccccuuuugccaccagcccaauuauguauaacccauuccugccacuggaagcuucauuugguggcuagggacguccacuuggggcuucccaguucuuuggcagauucauuuacagcaacuucauacauguauaguuaggaaguuucuacuguauuagguucccauauuacccucaaaugaccuuaguuuuagcuacccauuccugaauucccucccuuagcccuacccccccacauuugauccucuacuuccuguccuucucucauccaucuguaauagaacuauuuucccuuccuagagagauccccccacuccccuuacuguaucccuaaucucuguggcugugcggauuguagauaagaucccauauaagcaaauauauaccauguuuaucuuucuggguuuggguuaccucauucaagaugaauuuccccccuaguuccauucauuugccugcugauuucuugaauucauuuuuuaacagcugaguaauacuccguuguguaaauguaccacauuuucuauaucucuucauccgcugacagauaaucuauguaguuuccaguuucuggcuguuaugaauagauuagcagugaacaugguugaacaaguaugucucugugauggaaugaagcauacuuuggguauaugcacaagaaugauuugccugggucuugggguagauaauuuccaucuuucugaggaacugccguaacaauuuccacaguggcugaacagguuuguacucccugcagcaauggaggaguguuaucaccccacauccucaccagcaugagcugucuuuuguuucauuggucuuaacuauuaugacuggcauaagauaaaaucucaaaguaguuuugauuugcauuuccuugaugacuaaggguguugaacauuucuuuaagaauucucaggaauuugugauuccucuuuugagaauuccguuuauagauguaucucauuuuuaaaauuggguuguuugcuuucuagaugucuggauuuuaaaauacuuuauauauuuucaauacuagccucuaucagaugugugguugguaaaaaucuuuuccaguucuguaggcugccacuucaucugaaugauggggacuuaccaugcagaagcuuuucaguuuccugaggcuugauuuacucaugguuguucuuagugcccgugcuauugguauucuguucagaaagccuuuccugugccagugaggccaagauuauccccaucuuauugucugccagaugcagugaauguucuuagguugauggcuuugauccguuuggaggugauuccuuugcaggugauaguuguggaucuacuugcauucuuuuacaugcacccauccaguuuguuuagcacuauuuguuaagaugcugucuuuuucucuuucucuuucucuuucucuuucucuuucucuuucucuuucucuuucucuuucuuucucuuccucuuucuuucucuuccucugucucugucucugucucugucucucucucucucuucucuucuuucuuuuuucuuuccuuuccuuuuuuuuuuuaaaccauuguguguuucaggauucuuuaucaaaaauuagaugcccauagguguguggauuuauuucuaggucuucaaauuaguuccauugaucaaugugucuguguuugugcuaauauauuacuguagcucucuaguacaauuugagaucaaggaugguaauaacuccagcaguccuuuuauuauccaggauuauauaugcuuguuuccauaugaagcugaaaauuguccuuucaaauucuauaaagaaucauguuggaauuuugauggggaugguauugaaucuuuagauuacuuaugguaggaugaccauuuuuuacuucauuaauccuacugauuccuaaacaugacacucuuuccaucuucugauaucuuccuuaguuucuuucuucaauagcuuaaguuuuuuuucacuugcuuggcccuaauuaccucaagacuuuaauuuugagacuauuguaaaaaguauuguucuccugauuucuuucccagcccauuugcugauuguauauaugaaggcuaucaauuuuuguguauuaauuuuguaucuugagauuugcugaaaguguuuaugagcagguggaauuuuuagggcccuuauguauaaaaucauaucaccuacaaauaaagauacauucacuccuuccuucucuauuuguaucccaauguguaaaaacacaaucaauaacaggacaauuguuagccaaacaguccuacuacaguaggcccugagaaaugcaguacagcugaaguauaagacaaggacaucaaaauagcuauuuuugaauauguucaaggaccuuaaagaggguccuuucuacuaaugaaaucuaugaaaacaaauaguggaaugaaugaaacuguucaagacaugaaaguggaaauaaaaucaauaaacaaaucccaaacugagggaauucugggaaugaaaaauguaggcacuuagagguaagucucaccaacagaauucaagagauggaagagagaaucucaggcacugaagacaagauagaagaauggauaccuuggucaaaaaaaaaaaaaguuagauaugaaaaaguccaggcauaaagcauccaagaaaucuaggacauuaugaaaagacaaaauuuaugaauaauggaaauagaggaaggagaagaaacccaggucaaaggcacagaaaauacuuucagcaacaccauugcacacacuagcaagauuuugcugaaaggacccugauauagcugucucuugugagacuaugccggggccuagcaaacacagaaguggaugcucacagucagcuauuggauggaacacaggacccccaauggaggagcuagagaaaauacccaaggagauaaagggaucugcaacccuauagguagaacaacaacaugaacuaaccaguacccccccaagagcucguguuucuagcuguauauguaucagaagauggccuggucggccaucaguggaaagagaggcccauuggucgugcagaccuuauaugccucaguacaggggaacgccagggccaagaggugggagugggugugggagggugugggggacuuuugggauagcuuuggaaauguaaaugaaauaaauaccuaauaauaaaaaaauacuuucagcaaaaucauagaagaagaauuuccuaaccuaaauaaggugguauuugucaaaguacaagaagcaugcagaacaccagauagacuggaccagaaaaauuucccaugacacuuaauaaucaaagcauuaauuauacaaaacaaagaaugaauauuacaaaaauuuuuaggucacaguaaaucuuuaaaauuuauuaauuacuaucuguaaagacuuuuguggauaacuggaacacucuucccugcuugccccccccccccgcccccaguguguguguguguguguguguguguguguguguguguaugauguauguacacauucaaaugagugucuaggcauguggaagccaggcuuucuuccuugguuacuuuccaccuuaccacaugagcuaggucucucacugaacuuggagccuauugauuuaauuacucuugugcccaguuuucaccuuucaccuaugagauuacagauauuugugauguguuuggguuucccaacucagguucucaugcuugcauggcaagccguuuaccuaguagccacuagagauugaauccugggucuugcauaugcuaggcuauugcucugccauugaucuacaucaauggaccuguuuuuauuucuaauuuugucacaugguuuacuuaaguuccugggcuggcuuuuuaaaugcaguguauggguuaugcuagcuuugaacuuguacuacugaauagcugggacuguaggcugccuuuucauugcaucagucucagaaauuaguaaguaaggcagauaaacaaaccaagaauuagaaauguuucuuuuuugaaugggaaaccuuuuuaugaaauaauuauuuaguacuccauauuaaaaugauugguagaauaaagcaguguucuuuaaaaagaguaaaagcugguguuuaccagaagauuagaaauuagugcaaucagucagcuuuguuucugguaccauccaccguuauuuuaaguuacccuauuggaauauguagucuacaguuaacacauauccagcuaguguuagaguuacucuuuuacauggucaggccugguaaucaccaauaaaacuucuauuuuaaaaauuuguauuuaugcuacagaaaagaacacacacaaagaggguaugcccuuggaggcccuagagauuuaccucagaaagaacuucauuugauagggugccugcuaucucuuuuaacucauuccaaaucuagaaagcaacuacuuacuaagagggacuguggaccuaucuuccuuguugggaauuccauuucauacuuaggaaaugugaggucacaucauucucucucagucuugcucugcagcgagagcuagaaggggaguauuuggagcaacaggcacugcuuagaacacuaguauguaugaaaguccuuauuagggaauuuaaaaggcugcuuuauaaagucuggaucuguccuagcaggaggcugaaggauagccaggguuuaaaguuauuuucuguaaaaaaagaacucuguuccuuacaagaucaacuugugugucucagguuugguccagucgagagcucuacucuagaaacuccauuagucauuauguaaguucuugaauauuaucugaacugacagaaacugagcugagaacaaagccaugaguucugguauucaccucuaauuucagcccauaggaagcugaggcaagagaguuugaugacagcugacucuacauuccgagacugucuguugguggggaugguaagugggggucaggaauucccauuuccaucaccaugcuaaucuggcaugucauauuuaagcauauaaaaaugcuugggaaucugguuugggggcuaugguaggcccagacuuuucccaggacuggugcauucuaacuaggauguccaguuuuacuguagagugguugcuuccucagagacaccuuuauuacccagccuguuuccuaagagcaguuagccagccagucuccaggagguugccaacaguauguauggccucuugacaguuuguuaaugucagauacuucagauuugggcuacaagaagucaauauauacaaaagagacuuuaucugccaguccauucuuauagauaagaauuuugauuucugcguugaaguuguaaugaaauaucacuuuauuuagaaagggcuauuacccaaauggcaguuuucaaacacucaauggauauagggaaaggagcugucucucacacauuugguauaaauuuuacuaguguagccauuacugaaaacaauguggaguuuccucaaaaaaccaaacauaaaacuagaaauggaauugucauauuguccacuagucccaguagacauuuaucuaaaggaaauggcaucagcacacuacaguguuuauuaagguauguucacaguagucaagaucuggaaucagcugaugggugaaugguuaaagaaaaugugauacacacauauacaagugggagaucauucagacacaagaauagugaaaugcugucauuuguggcaacauggaugcaacuggaggacacugugcuuaguaaaauacuccagcacagacuaacuguuuucagucacuuguggaagcuaaaaugguuugcauucauagaaugggaaagaagaagggaaacgaggagagggaaagggaagauauagcagucauuaaaaugggaggaugacaggaggguagagaaagguuagcuuagauaaugagaaccaaauaugguuggguaggggcaagucuguacugcauuagggugacuguaguucaccccaauuuaccauguguuucaaaagcaccgacacagaaguguugagugucacaggucuuagaaacaccaguagcaucagugcuaucauuuacuggugcuuagguaugcuguuguuuguuuguuuguuguuguugcuuauggguucauaaucugugacuauuauaaaucugcuuaguagacuuuggggggggagagagagagagagagagagaggaggggaggggaggggcagggcggggcagggcggagaggaaaaugaaugaaugaauauuaacaucugaaguuaaagguguguguguguguguguguguguguguguguguguguguguacaugcaccagcuucuagaggaaggauaauuugugauggaaucuaugcaucuggaauuaggauauuugugauuuuuuugguagcuaucuggucaugccuuuguuggguggauguucacaucuaauccuguucuguucauucuggauuuguagaauuauuugaaauauuguuuuucaucagcugauauuagucuuuuuguuuuuuuuuuaugguuuaucccuucaaauauauauuugucauuucaugagauugaggaguucaacuuuaugaggaucuccuauuaaaagccauuaaacuuaaugugggaucaaacugaagagguugagcuacuuucucuaaaaggcuaaacuugguuuccagcuuuugaucucaaaaguauauguauccaguagugggauugacaguucagccaaccuuacacagccacuugccagugcaacauagugguguuuacauaggagccuucagaacaacugucagagggcacuugucagccuuaauccaugugaggcaauaauugacagaaaggaaagcgauuucucaucucuauuuucaacccuugccuuuugaguguaagagcuugggugcuuucuuuagaggcagagcuuucucacccacguguaacuugaguguuggguagaggaaggcugacgccuauuuuuaaacaagagagagaagaggaguagagugacuuugggucuuaccccuugaagauucuucugauugcuuggaaugaugagcauguuacauuuaaggugucuggagucagagguccagucgcauggccucugugugagucaucacuugcugguccuuugaaaucaucauguuuggaaaucagugagagaauugaugacaggaaggaaccagugggagaaccgaguacaggaacugaagcaggccaggaaugaguuuauaaaacagagcaaaagugcgcggccucuccacugggaugaagggaagacuggacagcuuuuugcuagcguuuaugcccagcacuguuguuuccuuuguaugugcugguuuuggccaggagcuguacgcagugugagggagggagagaacagaguacccucugucuguggugcucagcgugcugcuuuuucucccuggguuaugaucauacugucauuuggcuaaugaaagcaauacuuacugguuuuugauuugggucauagucuaauuaauuagcaagagaaaccggcacuuuauggcacuggucuccacuuuguaauuuggagcacuuucccaguuaacuuaaauuuaucuauuagaguuuuuuauuauuauuaaucauuucauucacuuacauuucaaauaauaauuccccuucuugguuacuccucaccaaccccugcaucccacucccucuccuccccuccccuuugccucuaugaggguucuccuccacccauucacccacuccugcaucaccucucuagcaucuccccacgcuggggcaucaaaccugccuucccucccauugauaucagauaaggccauccucugcuacauagguaucuggaguccuggcuccuccauguauacucuuuaguugguuuagucccugggagcucugggugguccagcuaauugaaauuguucuucuuaugggguuguaacccccuucagcuucuucaguccuuccucuaucucuuccauugggguucccaggcucaguccgaugguugccugugaguaucugcaucuguauugguucuugcugguagauccucucaaggaacagcuauaucaggcuccugucagcaaauguuucuuggcaucagcaauaguguggggguuuggugucugcagacaggauggaucccuaggugggguggucucuggauagccuagccuuccgucucuguuccuuuuuuuuugucccugucuuuccuuuggacaggaauauuucuggguuaaaauuuuugagaugcauggauggccccaucccucuacuggggguguaugugccuaucuucuggagguggucucuauggguuguaucuccccuuuguuggguauuugacgaaagucaccauuggcuccuggaaucucuugcuucccuggagucugaggcuuucuagaacuuucuuacaaaaaaaauuuuuuuuuucucuuuguaaaccugacuuuuugugucucuguguauaaaguccauuauauggaauuuuaaaauuuacuuucaaacaugagaagaaaauaaauaaugggcaguuagaagaagcagggaaaugcuaaaauaugcuuuguggagaaauggcauuugugagaagggugccaugucagguccuugggggaaguuggaauagcaguaacauuuuuuuguuuuguuuuguuuuuuuguuuuuggauuuggaaggagggucuuggaaaagguuuucaguagacacuuagaaccagaaaaaugggagacugaaagcuggaaaggaauuuuaaugggacaagaacaacaaaggagaagauggggaggggcugggaucaagauuucaaagguauugucauccuugaggagugauagggacacuuuucugggguucgaaaggagaaggagaaagguucuuggaaacauggggacauuuaaaugcaguguaaaggacucugaucuagauacuguguuugguaauugugggcaucagaauaaguagggcagugguagcacguggcaguucagaacauuggggacaaaggcuggcuggacugguacuuacagguucaucugaggcugagcuacugaaaagggaagcaauaauaagauauaguuauuucacagaaggggucgacaaagauugaaguacuguaagauuaugaucccucacuaggauacgugcgucagauagguagggacaaacagaugugcucauagcccuacugccuggaggauuuagacugcagugcagugcugggaguuuggagcagacagcccagugucaguugaguuagucacaggcacugacacagaguccucccuaggcaaaucagaguguuugauucaugacugacaguguuugagauuuaacaugagaagauauguuucuuuuuugauacacacuugcucuauaugugcauugauuaaacuguguacaauaaaaaucacacagcuuacugaugauuuucuauacuauuuuaagacaaagucacccuuauacuuagagauaguauuggcuggauuacuucucacuuauucccaaugcaagcucuccucuggacaugcauauucugucgcuuuuacaagcuaaguuuaagaaugcacagaccuugaacagguaauuauuucccuugaaguauuuuguguucuaccaggcucaguggacgggcuaaccucuggcauggauaucugauaggaacauuucugucaguuugauacuuuuuccuccuaucaauuaugcuuuuuguaauagauagacaaaccauggaaauaaguuaguuuugaaaacuauuauaagaaauauacaccauggggaacaauacagaguaagaugcaguuuaaauucggcagcucugugaguuaagaaucuucucucuacaacacauucaugucaguuacugcuuaacuuaacgcuggguuuuccuuuuugcuuucaggaaaaccuuuaacuuacgcccuggguguuaccuguccacagcuuccugguggcucaccgcuucugccugcuccagccuugcuccggcagcuuccaggcuucugggcuucagagcuuguugugaaagcuugcugcuuuggccugcuaccccugcuucaggugucaaaagcuuuuaauuagcuugcuuccuuucauuaccugguuccuuauauguccaaauagcuuaguacuaggcccugaaaggggagaauaccuguaggcguuuacuuuuuccuaaggucuuuggcucaggcucuccugagacuccugggagaggaaacucaauuuagugcaugcuuugccuuugauggugcuggucuguaguccaaaggacccgcagguguggccaugucauauuuuauaaucugugucuguuuaauuuguugaugcccaggauguacuaauuuuaaauauuuuggcuauugcugcucuguguauaaauuaugauguuuaucaagagcacauuucuggcuguuuaauaaauaguuuauagagauuuuagauuuuaguccuuuguuuguuucuuucuuucuuuagugcugggaauugaaccuagggucucauguaugcuaggcuaggccuuccguagagccacuccccugacccuaaaauuucuuuaguaauauugauugaucauucacagauuaguuuuucaguuuguuguuuauuugagacaaugcuuucucugaagugcaugcuggaaugcuguccgggaaugcguuauauagcccaggcuacucucuaacuuguuuauuuguguuugacacaugaucuugguauauagcucugguuguauuggaacucccuauauaaagaccaggcuagucuugaacuggaagcuggcugcuugccccugccuccuaagugcuggaguuacaggcauacuccaccacaacagccugacccacuguuuuguuuuguaaguggggugguagaacacccuucagacugguguagggauuaaaugaguagcagaugcagugcuuggcauauguaguguguaugcaauacaagcuuuuucagaaguaagugcuuuuaguauuauuaguaaaaauaaugguaggugcuacauaagagagacuaaaaaggaaagaaagaaauaaaacaauaacuggucaguagcuacacaguaaaauccuguuuucaaaggugaaacuuugaaagccugguagaggagcagugugaggcagacuacaggcucuagagaucauacaaaagaggacugucaccagccuuacuucuagguuucaacauccacgccauaguauauuugcagaugagaauauugaucgcuuauaaucuuccauguguauuuacccacauuaguuacaaagcauucaucuuuccaaaauguauuuacugaguacuuguugacgccuaagcacugaucauauauuaaugaacacaaagguagaaauuccuaacucucaaagagcuuguggggaaaacaguaagcauuguacaugguuauacuauguguuguguauauauauugugcuaaauaauuauaagaaauaaggggaaaaggaagcaaaggaauauaauggaaagucucacaggauguagugacauuccagugagggagugagacaacaguggcccuguggagaugaaguguucugggacugggggaaaauaccagcagagguccuaagauggaguugugcaaggugagcauaauggcucgaguugaagugagcuaaaggugaggagcaguggccaaggaggcuggcaggccauacugucguuuauaaggacuuugaccucuuucuaacuuuaggaaaucacagaaguuuggaucaaaagaaugaugucacuugaacuacaucuuaacauuguguuuguacuguugaggauagauugugugaaugagcacagguagaaaggucagguaaaacauggcaugaugccaaggcuuauugggacagaagaggugguuggugaauucugccuauaucagagguaggcuggauuucugaauuucauacagaaaugcagaacugcuuggauauugaaauccaugaaauaccguguggccauuuuuacucuagacgcucuagccacacacagcggugcacagccgauuaguacagacuugucacgugcugaccauuucuguacugugugcagguuuucuagcaccgaagacuguuuacuagaaagaguuaaaaucaucucugauguuuuagaaaugcaucuuuuuucuuuauaauuuuaagucuauauuaaauuuguuuugauuguauguguguagucuguguguguguguguguugggcauggaacccaaagcuuuguguuugcuaugcaaguguuucaguacugagcuacacacccuacucuaaggaaguacauuguaaaaugccaucaucuuaugugacaauugacuuuucuacuuugaaauacagggucuaaagugggaguucugagacaaguuuauuuuugcuguuuuucuacugccgugaacacagaaauaauuuguaguuuuaagauagaggaacagaucagugaucccuuuggaagcuucauaaucuuuuuuccucguggcaucaguuugauaauucugggauguuucuugagcuuuuauuucccuuaaccacaaaucaucccagaaaagcuuuuaggcagcucaugaaacuguuuuaagguauuguugaaguguuuuaaauucuuuguuuucuccuuugcaguagccuggucuuccuuacuaccaugcacauaugugaauugaguuucuuguccuuaccguauacugccacgcguauagcuaguguucauguugugaccaagaugagggguaugugguagaaaggcaaauaaaaaucuuaccucugaagaaaguuagaaguauuucaucuuguauuauuuucauguuuauccuuuuaauauauggcacgggcauuuacaauuuauguucauguauuuauaaauugugaucuaaaauguuuuauaaacuuacguuucacauauugugaguaugagcuuuucucuaucaaauaguauucucaauauuucuucacucacaugaauaauucuuuguugguuuauuguauuuuguccauuuccucuuuaagaauauuuaaguuaguucaguauuuuauuagugaaaaccauauuguguugaacuuuaugacuugacauuuaauucguauguugauauuuucaauugaaggaauuucuggcaauugaagagcugauucucuuaguacuaaaggauugugagauguacuggcugcugcauaagcauagucgaugaacaaguagcaguuaggagauggggagagugggugcuucauauagacucacggugacagcucacaccuacugaacacuuaacuggacagcagacccuguaguuagcauuuuauaugcauauuaauuauuuugaucuuugcuacaucuauauaagguuaguacauuuauuaaacucacuauugaugagaaaacuaauugaaagacaacugcuucaaagaaaaaacauagaaucauacaguuaaaugauaaaacuaagauuuaaaaccaguagccuggcuucagauucuccuuugccaccaucuuccggacacccccaauaaguguuggaguguucagugggcgcuggccacucucauugucaccucuucugugagcugucugaccacaccuaagcuuguucugagucuaguauucugggacucuuggaagguaauuuagugcagauacuuucaaaucacacuaucaaggcuugaagcagcacuccauagcaagucuguucaugauucugaaguaaagcaugguuuguuguuguuguuguuuuuacaguaagagagauuaagaaaaaauaugaauaauauccuggcuuuaucacauacugcuaaaugaguuaugaaguuuuuuggcuuuugagauugcaguggauggauuauagaccugggucaaagucauagcauacugcuugacauuugaacacucccgguguuguugggcauguugagguuagaagacaacuugguucuccauugggggcccuguguuccaucuuauagaugacugugagcauccacuucuguauuugccaggcacuggcauagccucauacgagacagcuaagaagcuagagaaagcacccaaggugcugaaggggucuguaacccuauagguggaacaacaauaugaacuaaccaguacccccagagcuugugucucuagcugcauauguagcagaagauggccuagucggccaucacugggaagagaggccccuugguauugcaaacuuuauaugccccaguacaggggaacgccagggccaagaagcaggagugggugaguaggggagcaaggcggggggaggguauaggggacuuucaggauagcauuugaaauauaaagaaaauaucuaaaaaacaaaacaaaacuauacgcacaguauaauuauaaaauaaacaagauugaccuguuuuaaaaaaaaaaaaagaagaagacaacuugggagagagucaguucuuaccccugacacaggcucucugaucuuugcugcuguacuguguacuuaagacuacccggccuggaauuuucugaaugauucuccugucccugccucccauauugcuauagaaauguugagaugacugcuguguuaccaccacaucaggcuuuuuacagggguucaaagacugaauucaauucguuaggcuugcuugugcagcuagauauuuuacugagccuucugccugccauaucuucuaccauguuaauugacuaugugacuguuuaugacagcuacugagagauguuaugcacugauuuuaauuaugucaucauauugcuuuaauaacaauaugaucuagauacaaaugaagugcucuuaauaagcacauuugcuauuaaaacauauuaagaaguuagaucuuggauuuaaaucuaauuuucuagccuuagaaauacuccuuugaacuguucaaaagaucuguacauuguuuuucuugccugcacaguaggauguugugauguuagcuuuccauuacuauaacaaaauaucucaaauaauugacuuauaaaaauuuuauuuugacuuauguguagagaaauuuuaauccagcaacaugaaugcucuaauaaggcaucacauccaaugauaggauccaguuuucugggaugcagacacacccuggaucaccaugcgaucuggcugggaugcagacacacccuggaucaccaugcgaucuggcugggaugcagacacacccuggaucaccaugugaucuggcugggaugcagacacacccuggaucaccaugugaucuggcugggaugcagacacacccuggaucaccaugcgaucugucugggauucagacacacccuggaucaccaugcgaucuggcugggaugcagacacacccuggaucaccaugcgaucuggcugggauucagacacaccuuuuaaucucaaaguuaguuugcuuccuucuaagcagccauaguugaaagugaagccuaacugaagggcagaaaaagugacgaaccagagaaagaguugguucaugcagccagaggcaaagcauuuagugagaagccagauugaaucagucauuuuggagaggaguuugagccugaacaacugagcucaaacagccagccagaguucagaaagaacuagaaagagugagcuuguucagcaguaagccuuggagacaacaauugauucuugguggauaaaagauauauuuauacuuaugguuuuggagaguucaguguguaaucaauuagcugucugcuuuugggccuauggugaggcagcauauuguucugggagaguauggcaaaauaaaacuguccaucucuugaguggagccugauaggaagaaagagagggaggaaauaauuaagucaguuucuaguccauaacccuaacaacuuaaagguaccuaacuauuauuaagcuauauauaauaaagcgcuauauuggguucuaaaccuuuaccacuguauggacauuuaaggggcacccaguaucuaaacuauggcagauaguauuugcuuucuccaguggugccucucaguuacuggaaaugcuguccaugaauauuugcuuuccuuucuguaguuuaguuucagcccuauaacaaaccugacaagcuggaagggccuuaggagauuaucuaguuaaacggaaacaguguuggaaacagacguguaaucaguuuguuaacagugaaaauggucuuauuuuuacuuggcaguuucuuugucuguaaccggauaaaacuaggcugugcuaccuuuuuauuguuggaaaggacacguucaguccgcaguuuauagaacuguuggucuuaguugcucuuugggaauuggaggagggaguuaugaacgaacuggaauauauguguagucggcaagagcuggacuaaagagcuuucucguuuucaguucauuuuguauugcuugaucccccagaaccucugguagcugcauucucugugaccccuguggaucuggcaucacuaucucauaagaccagcugcuugcauauuguguaucuugguuaguuucucaguaauagaugcugaguuuaaauuccuguguagaaaacuugggaaggaagauauaauguauaauaaacaguagacacuguugacaaauaaaaucauuugcuuggcauaauucacuaauguaacuuuuaaauuugacauuauuuaauuuaggaucuuagaauugagcagcauuaaaauaauugauaauugguauuuauuuuuuucuuacagagaggaaaauggaaaauggaaaacguaagcuuuuugccauauuuuaaaaguuguauuuccauuaucuuuucuagguugcuguaguuaaacuaaaaaaugcagauaaaguauucgccaugaaaauucugaacaagugggaaaugcugaaaagagcugagguaagucuuuucuguuuugcaacaauugauggcacuuagguuguuuuucauauagauaaguuaauauguugguaguaaaaaucuuuguacaugaauuuuugaguacuuuugugagcuuauguauagucugaauauguagcaagguggacucaaauuauuagugcauuuaagauuuuuaucaaaauuaacuuuguguguuugugaaaaagaaauuucaaaaugaaagaagaaagaguaucagcccaacccaugucaccagaaugcagucaguguaaggaggcugugagauaaguuugaucugaagaaccuacaguggaaagagagcagacaacagaaaguuguccucuguccuccacaggugugcacuguggcaucuuagcauacaugugcaugcacacaugugugcacacuuccucacacaggcaaucaacauguaaaaagauauaaagguagaggaaguaugaagcgcucuuaaucacagaucuugcgguggcugcccugagaucuccagucuguagagggagguugaaaugaucuuagugguuguuuaugggauggaucccaggguggggcagucucuggaugguccuuccuucugucucagcccggaacuuugucucuguaacugccuccauggguauuuguuucccauucuaaggaggaaggaagucuccacacuuugcacuuccaucuugaguuccauguguucugcaaacuguaucuuagguagucuaaguuucugugcuuaucagugagugcauaacauguguguucuuuugugauuggguuaccuuacucaauaugauauccuccagauccauuccuuacaaagccagacacuauuauugcauaugccaacaagauuuuacugagaggacccugauacagcugucucguacgaggcuaugccagugccuggcaaauacagaaguggaugcucacagucaucuauuggaaggaacacagggcccccaauggaggagcuagagaaagcacccaaggagcugaaggggucugcaacccuauaggugcaacaacauuaugaacuaaccaguacccccagagcuugugucccuagcugcauauguagcagagcauggccuaauuggccaucaaugggaggagaggcccuuggucuugugaagaucauaugccccaguggaggggaaugucagggccaggaagcagaaguagguggguuggggaacaggguggggggcggggagguacaggggacugucggagaggaaacugggaaagggauagcauuugaaauguaaaugaagaaaguauauaauaauaauaauaauaauaauaauaauaauaauaaagaaaugaucuuaagauaauuuuuccaggaaaggauuuuguagguuguuugcaugguacaacuuuaacaccuuccaaguuaaaguuacuuuaguggaaacccuguucuuaggguggggaauauauuuaaauguuagaagguauugcuuaaauaaauguuuuaauuauuuagaguauguagcuauguguuuuucagcacacuugccaauuaccaggcauuaucauaugauauuuuuguuauauuaaagcuuuguuacugacuucuuaaaaauuaauguaucucauguuuuuggguucuuuguuugauguauguggcuaucaaauauauguuaaacuauacacuugaaaguuaauucaaaaguuacuggguccaucuaggacccauuuaggagguagaggaagaaagauuaagaauuucaguuuguccuaaguuuuauagcaaauucaagguuugccugggccacaaggagaauuugucacaaacaaacaaaaaaacaaugaugaugcugugcuauaaaaaauggaaauuuuaagauuuuuuuaaaauuugaaauuccauuuaguuuucacagugaaaaaguuagauguuaaauauucucuuauuauaugaaaagauuucucuguaacaguauuuugugaaugagaaaagccuuuauuuucaagaaaugagaagcuagacuagguguaaucauuaguauacuuuauauuuuugaguaaugauuuugucucuuauuaucauuauuauaauuuaugaugaugaugaugaugaugugagugugcaugcgcauaauauguuuguaucaggauagccauguaccugccaugguucuguguaugaaagucagaggauaacuuucaggagguuauuuuaucuuuccuucaugaaaucuagggacuagacucaggucaucagacuugaauggcaaguacuuuuuacuggcugagcuaucuugagggcacuaugcaugcaguuuugauaggcuguauaugauuggaaauuugaugaauguauuuuauggaaguucuugagaguccuaugacaacuuugcagaauuaucauuuaugaauggaccucauuuaacuucuguuucaacguaggauuucuuuuuguuuuaaguuuuuucaaaaaaauuuauuuauuauauguaaguauacuguagcugucuucagucacaccagaagagggcauccaaucuccuuacagaugguugugagccaccaugugguugcugggauuugaaucaggaccuuuggaagagcagucagugcucuuaaccgcugagccaucucuccagcccuuguuuuaacuuuuaauucuucuuucauauauuaacauccugaucacaguuuccauuucuuucucuccucccagccccuccucaccccccaaaauccacuccugguuuuucuucagaaaagagcauggauagcaaccaaacaugccauaucaaauuauaguuagauuagacaccuccccuccuauuaaggcuggacaaggguccaaaaggcaggcaaaagagucagagacagccccugcugccacuguuuggagucccacaagaagaccaggcuacacaacuguaacaugugugcagagggccuaggucaggcccaugcagacucccaugugguucucugagaaucuaugaggccagguuaguugggaaagugagaaacuaaguuuaagcuagcuuugcagagcuaguaauccuuuuguuauauugcugagacguaccaugcuuucuggcuagccaaggauggccuuaagcucuucaucuugcuuucacuuuuuaagcacugugauuguaggucaccaccuuuuuuguucauuguguuuuuagagacccaaaucauggagauaauguaaagauaacaauaacaacaaacagcaacccccacugccucccaaacccagaaaaucaaaaaacccauuuucuuuagauacaaauuuuuucauucagaaaauaugauugaauuucuuuuuuuuuaaauuagguauuuuccucguuuacauuuucaaugcuaucccaaagguuccccauacccacccccccaauccccuacccacccacucccccuuuuugacccuggcguuccccuguacuggggcauauaaaguuugcaaguccaaugggccucucuuuccagugauggccgacuaggccaucuuuugauacauaugcagcuaaagacaagagcucccggguacugguuaguucauaauguuguuccaccuauaggguugcaguucccuauagcuccuuggguaauuucucuagcuccuccauuaggggccgugugacccaucuaauagcugacugugaucauccacuucuguguuugcuaggccccggcauagucucacaagagagagcuguaucuggguccuuucagcgaaaucuugcuaguguaugcaauggugucagcauuuggaagcugauuaugggauggaucccugcauauggcaaucacuagaugguccauccuuucguagcaccuucacaccaccagaguguccauuuaucaugguuuaauacugaucaagaacagauuuucuuagcagggccacuguugauacuugguuauuucuuguggaagcuguucuauguauuguauggggggauuauccugccuucuucuacuagauaccaguaguaucuuucccagcugacauaaacagcugaggacaauuuacauguacaucaaauaaauaucuggaacgugccuuauagcuaccuaauacccauguuucaaaaagaacagcuuaauaguuuaaaauuuacauaaugccugagacuaucucuauagaguauguguguauauguuugugcaucagugaaacugaggauggcggggagugugugaagcauaaccaagaagauuagauaauaaaauaguuguugaaauugagugacaggauguugggagaaggaauuaugucacucucucuacuucuguauguuugaaaucuuaugucauaauuuauuauaaauuaucuuuuaaaacuuucuuuuuuacugaguaauuuaggauaaauuagaauuuacaguuuacuuuguuguuuuggcuaaugucuucagaguuuuguuuaguuuggaauugucaaucaagugaagcgugauugcuuacuagauuccagcuggauuguuguuaaaaucucaggucacugucaucuaagauaaagccaggagagggguuucuuggguuuugucagcuuucuaaaauauuaagaaccauacacugauuucagcugagcuuuauagcaggacuuaguagaaaguagguaacaugauucuauuuucuucuaaagugaacuaagaauaaugucauagacuuaguaacuugauugacaguuuaacucaccacgucagaugguuuagauuuacuuuuuuagugcuuucucugauguugccacuuaauuccuggcuuugacaauucugcuuacccaaauuagucuuguguguguacaugagcaugcuagggauaacuguguguuauuugguuucuugugucaugggaacuuaacuuuccuaaugggcaaccauuaccaacugugagagcugagaacggcuccuggguacgaggauuguacccaugaacagcucugaguugaguccugaguacuggagcgcacaauucaaagcucagacgcacuuacuguggccauccuuuuuaugucuuuaacaauggcgaaguagauauggcaaaauuggacauuuauaucaucugacuaacagguuggucugugguuaaguuaaauaauuuugugaauuuuucuguuuuggacuauagcaauucuaaaaaauauuacacuuuuaaggcugugauacauauuuugagcaauuguuuacaauaguguuuagucuagguuuguguaaaguauucuuuacaauauugucuuucccuugcagacagcgugcuuucgugaagagagggauguguugguaaauggagacaguaaguggauaaccacucugcacuaugcuuuccaggaugacaauaacuuaguaaguagucguauguuuuuauauuuguagccucuuguuggccaacuuuagcauuauacuugaagguauuucuuaaauguagauguuauuuaaaauagaaaaaucacugcacuucacagagcaucaguaauacacuugguauugguacuuagcacacuugagcauguaaccccuugguaugagaauuuuuugucugagaaauuugaugcuguuuuauugaaucugcuuauaccuuuaaauaagaaaucccaaacgaaauccagucuguuuuaauuuucuuccauuaaauucuauaggaaugaguuugagaguuuuucucuuuaugacucucccaauguauuuuauuaguaguguucugauuuuuaaaaguuuacacacuuuucaaagugaccgugugcuguaugagcccauauauauugacaucguggaccacuucauaaaagcuuggggggaaaaaagcuuagagaaaauucagaauauuagaaucuguaccacuugaauagagacaccagaaaugaggaaguaaaagucaaaggagaaacaaguugaguuuguuccaguugagcauguaacuccuuugccugcuauucaaaguuuuucuguuuuugauccacuuuuaucucuagguuuauaucuuuuaggaguauauuaaugucuuagaugcugcuauguaccagacuugacaacuagauuagaacgcagagggggcgguucuggaguccugggagauguguguacgcuucugcucacuuuagauggggagcagauggcacacuacagcacuaauaccaucaaagcccaacuuggugagccagugaguuuuauuuggguuaauugcaggagcagaaauuacucaaaggcagcucuguuaccaucaugcaucauauguagugugugcuuuguagucagaauuguuuuauaaaugacaggguaaagcuuugcauguauuuauuguucagugucagagugaaugaaaugauguucuacguggaaaguaauaaaggcuaaaauucuguccguauauucuuuuggagauagauuuaucacugaauuuaugcauugcuuaaaaucuacauuuuguuuuaaauauauauguaaauuuuaaaaagugauuuuaaaucaugagucuccaaugagugcugguaauaaaacuugaguccucuguaagaacaucaacugcucuuauuguugggccaucucuccagccucccaaaugucaaauuucaaagaccgaaaauuugccaaaaaguauaaagaugaagaaagaagucugagcugcuauugugucuucugaguuacuuagucugauuugcguucuuugcauaagauuuuaggauuuacaauucuucuucaaugauuuuucucuaaaagcaguaaucuguauauuuucaguuauauuaauuauauuggaauagaaguaacagaauuucaaagaggaucaaaauaaaaauucuugucauuuacaaaaguuaguauuuagaagucuuaguuauuaucagaggcauucuuuuaagcauuuaaaauuuuagaaaguaaaugagugcuuguaucugaguuauaacuacugugccuaguauguacaaggcccuagauuacauccaccuguacgacccaaaacaaaccugaaaaccaccuauaagaccuauuuuggugcugaagcaauggcuuagcaguuaagagcacuugcuguucuugcaaaagaccugagugcaguucccagcaaccacaguggacagcuuacaguugccuagaacuccagcuccagaggaaaugcucucuuaccugacucugagggugccuggacaccuguggugcacaugcauacacucagggcacauguaaacucauucauagaaacaaacaaacaaauauuuaaaagguauuagaaaacaaaaacaguuuaagaauguagacaaaucuaguuuuagauacccaaaaagaaacaggacuuaaagauacuuauuuugcaaaguaauguuuuugauucaaauaauuuauuauuauuauuauuauuauuauuaaucauuacuauuauuauuuuacuuauucacuuuacaucccaaucacugcaccccuccaaaucacccccucccacaauucuucuccuaugccuggccucugcuccugugaguggguggggacuacccuggacaucccccuacccugguacaucaagucucugugaggguaggugcauccucucccacugaagacuuaaaauauaauuuuccuaauugucaaggcuguaaauaauacuaauaaaacuaauuucuuugacauuuucuaugcuuauaauuuucauguaucauaauuaaagaacuuuuaagccaaauuuaaauuauauuguuagcucagugguauccuagaaauaaaauuguuauugggcuggagagaugucuuagugguuaagaacacaugcugcccuugcagaggaccugauuuuuguuuccagcacccacaugguggcuuacaacugccuguaacuccaguuccaguggauaucacacccuuuucugaacuucauaggcaccaggcacacacauaugcaggcacucauuuguacugagaguacacuuuagaaaaaaaaaaucauuguagcaucaaggcaugcuaagugauccauaugccuaugggcauguauaaauaauauauauuuggaaaacaaucuaaaauguaacaaaaucgauaacaucaucugucaucuaacucaaccuggugaacacucugauauauauaccucuuccucuucuuuaguauaacauccacccauccauccauauacacacacacucauauaucuaaaauggguauacuucuacguauguauauuugagaaaagauuccauucuguaagugaaugauacugucaguuacuuggcaaaugacaaaagcagcaaaauuuguaauccucuuaugugccaaguuuuaaacuuuguuucacuguuugugaaacugagaggucuuacuaguauuacugauaauuaucuuacacacuuaaauguuaguuagccacacaaguuauuaaucuucauaaguauucagccuagucccguuugacccugggacacacuacguacauuaacuuuaucauaauuauuuacugaguacauucuguuuguguucacaguaccugguuauggauuauuauguugguggggauuuacuuacucugcucagcaaauuugaagauagauugccugaagagauggcucgguuuuacuuggcugagauggugauagccauugacucaguucaccagcuccacuauguucacaggugaguuagccagucugucagugauugucuuagaacacucaugaccgaaguuacguguaauauccuucccaggaguaugcagcauucaguuuccuuauggucguuuuuuauaugcugauguuacuuagaauucuagcccauaaauuauagacuuguuauauauuuuauuguucucaagagaagacuuuggcugggaagacagcaaagaugaauuugauuccuagcagcacguaaaagcuggacacagcagcaugugccugcugggggagaggagugcagagcccgagugauagauggcugaccauucagucuagccgagucaaugagcuccagguucaucaagagaacuugucuuagaaaauaaggcagucuugcuguuuacacugcucuuuccaguggcauugaucagagacacagucugaucaaaacaacacaggcaagcaagcuugaucccaucagaaugcuguauuuuguuauccucgucagcuuuagaugacaaggaaagaucaggaauuuugugaaucuucucacagcacguacacauaaucuauagagaagaccuuaauguugagucuaguaguagaauuuuaauagcugauacuguguuggggguaaguaaggucuuacccuggcuucuguucuucuuguguuuuuuccuagguucucagagacaguagugcuuaacacuggcccuucauaaggagacuuuguuagaaaauauugucagauuuagcuucuucucuucucuucucuucucuucucuucucuucucuucucuucucuucucuucucaauccuguuauuggggauagagcuaggcucugggcauguuggguaaacaaauguuccaccacugagguacagcaccaggcagcagauuucauacaaaaagauaauaguagaaaguagauaguauuuuaaaauugugaauuaguguaaaguugguaacaugagauuuucagagacaaccauuucuuuucuuuaaaucuuaaaaaaaaauuguuuucaugaaguuaggaugaggauggugaguaugaauauggaagaggcacaggguguaugaccgaaauauauuauauggaacucgcaaauaauuaauacauauauuuuaaaguuuuauuaaaaagguucuuagcugaaauauuugcccauauagaaaaauaauaauagaauacuaauuauuaaaaauaaggaguuacuucauuuuaaaucuucacagauaguuuuuaaaaaaucuaaaauuauacauuucucacuauuaacuuuauuugauacaucaguuauuauucuugguaauaaacacuuuauguuuuuaguucauaagacuuauauuuucagauuuuugccaccugaggaaagauguucaucuuuuuguauaaacugccauuacguauuccauuaauguuuauuuaaaauuaugagauuaaauuguaagcucuucugaaauggauuuauugagauaugauucauauaccacauacuucauuuaaagcauauaaugguguuaguauauucacaaauacauguaacccuugucaugggccauuuuagaauauuuucauuacuucagaaagaaacuucauaccauauccucucaccucaguuccaacacacucagcccuaagaaaacauuaauuacuuucugauccauaauuauacuaaauuugggccuccguauaacauguagucuuaugacaggucucuuuuccuuaacaugguguuuacuagguugauugauauuguaggauguauuuacuuaacaugggguuuacuagguugauugauugauauuguaggauguauuuacuuaacaugguguuuacuagguugacugauauuguaggauguguuuacuuaacaugguguuuacuagguugauugauauuguaggauguauuuacuuaacacaguguuuacuagguugacugauauuguaggauguauuuacuuaacacgguguuuacuagguugacugauauuguaggauguauuuacuuaacaugguguuuacuagguugacugauauuguaggauauauuuacuuaacaugggguuuacuagguugacugauauuauaggauguauuuacuuaacaugggguuuacuagguugauugauauuguaggauguauuuacuuaacaggguguuuacuagguugacugauauuguaggauguguuuacuagguugacugauauuguaggauguauuuacuuaacaggguguuuacuagguugacugauguaggauguauuuacuuaacaggguguuuacuagguugacugauauuguaggauguauuuacuuaacacgguguuuacuagguugacugauauuguaggauguauuuacuuaacacgguguuuacuagguugacugauauuguaggauguauuuacuuaacaugguguuuacuagguugauugauauuguaggauguauuuacuuaacaugguguuuacuagguugauugauauuguaggauguauuuacuuaacaugguguuuacuagguugauugauauuauaggauguauuugaagaugcuuuccuaguaagguugauuguuugguaagcuuuagauuuuccagaaguuuuucagaacccagaguauacauuauacaacauucacaauguaugcaucuuggccucaaauuaauccaucaagaaauuauaacucaguuucaggagaaaaacaauaacaaaaacaacaacaacaaaauacaacugacagaaauccuaagaugacaagauauaagaacuaucagaaaaagacuuaacaaagcacuuauuuugaugcaauucaaaguaaagaaaauacauuugaaaugaaugaaaugauaaauaucuccucagugaaagggaaguugugcaaaaacaaacaaaccuaaaccuuacacaaguaggauuaauuuuuaaaaagauuuauguguaugagauuuugccugcauauauguaugugcaccacggucaugccugguacccucugagaccagaagagggcauuagaaucccuggaaguggaguuaaggaugguugugagucaccaugugggugcagcuagcagaacucaggcccacugcaagagcagcaaugcucuuaaccucugagucaucuuuucaccuugccucuauccaccauggcaucaguaagagaggaaaauauagcauuuugaagaaaaauauacuaaagaccuucaggagcaggaauuugaauauaaguuaaggaaauuaaccucaugcaggagagagaggggcagggugggcaaaaguuuucauguugggaaaaauaaggcaaauuuauaaaauuaaaauuggugcaaacaguuucagucccagaaaccaaagcuaacacaucauaaucaaaauguggagugcaaaagauaaagaaguucucaaagcuggcuucauguuuggagaaacagaugaaugguuuccggcacuuucaaaccacagaggcuagaaacaaugcacuagucuuagaugacugacaacaagaaaagucuguacagauuucauauucaauagccauuucuuucuauaacuuuagauauuuuacaauguacaaaacuccaaagaauucauuacccugaucuuuucuuacaagaaauugucaacaacauacuucagaauuugagaaaaugguaacagaaagaaauuugggauuucaggaaggaaaaagugaacaguaaauaguaaaauugucagucuguaaacacuauuuccacaauuacauuccuaaacacuuguguucauuuaaagcaaaaguuagcugagguacucaaggaugauuuuauaccccauagagcaacuguagcauaauggaugguguggaccauuaauuccaauauaauuacugacuuucaaauaaaguaaaacugaggagugggagaacaaguggcuuagaugggaaagcaaaauaaaaaauaaaguuauuauuaaacuuugcauacaaaacuuugugcccaaaaaugcauuaaauauuuaugguauccacagauauaaugugagcaagacagacuugcagguauaaauagggcacguagaaaugcuaaagagauuuagagcauguuauuacagugaauucuuuugaaguggaaacuuaaggguucuuugggaagucagguguauuggaugguguuuugcuggggcaaacacucaaaggagugcucuucuaaaguggacacagguuaaaggauguuugcuaaagcagacaugugcaggaacauuucacugaagcagacacaggugaaaggauguucugcuaaagcaagcaugugaaaggacaagugaugaagaauuccucgcuaacaacacacauguauugguucaccuuaccuugcauagcugagcucuauuuguugugacuccagagaaggaaacccaccaaaaaaaacuucuugugagguuccuuaggcuucuugccacuucugaggacuugggcugauuggcagagugaugucagcugauacagacucauguggaguuucgcuaaaagacaugugaugaagccaagaccaguggaggacacaugauguuuggagggaguuauaaauaugacccaaaggacagugacaggggcuugcuugcauagcuagcucacuaugaaauguaaggcgaaccucaugucgcauacaaucucaggagaggguacaggugaauggggcaagcuaguguaaacaauguacuguugaaucaggguaguuaguaaaggcauagauuaguaugcaucucugaggguuucuucuguuagacugacuuuucaagggacuuuuuacuggguauggaccaggagguuacugcaaaaugacagcuccuuuuucaguuauuacuuacaaacacuuaaugugacauuuaucacuuagaucugaaauguguauaaacaucacaaaggaugucagucauuauugcuuugcauauucaucagguuauauuuacugaugauuaaauucaauccccuuauccuuucuucuguucauucugucuccuuauuucccauaccuggucuucuccaguuuccuuuccuguaguggauuuagcuaacuuaagguaagagugcauaagauaaauugaugccaagauaugaaaaggaacaaauacucauaauuaagacauuauguuugagaggcuggucaaguguguguguacccucuugcagaggaccuuaguucacuucccaggacccacuuuaggugacuguuacccaccuguaaguucagcugcaggggaaccccauguccucuucuagccuccauauuaccuacccacacaagacacaugugcauaccuguaacuaaaauaaagacuucuagagaacuuuuguuuagaagucaagaaggacuauuuggauggcucuggguaaaagugcuugucucugcccugaacuggaucccuggaaacaaugguuggaggaaagaacugacugaagaaagcugcccucucgcuuccacacagacucuaauaaacuuaaccaggggaaaaacuucccauuucaacuuacauguuuccauguuuuuuuaugcuaacccuucuuuuuuuccuugugaaaaaaaaaaaaaaaaccuggaguuuaagagcagguuuauaucuuuagggcuacaacacuaucuuuuugucaacaaaaucuuuuucugaaggcgaauugaggagauuuggggguaauauacugaucucauguuccugucuuucauccucauaaauauuacuacaguuuuuagauacuagcuuguauaaaucuuuaauacaauguauuuuuuaaaaugcacuacuaauccccaaaccaaaaaccaguuaacuuacuuguugauuucuucauauucucauuuuuccuuuauauaauuuguuccacauuaaagacucacaaauugcaauuuuuauuaacuuuucuuugauuuuaauaauauuaauaauuuaauaauguguuagagaaaagcauaucuauaaaucacaagaaguagaacaauccugguuuaauaugauuuguugggagaaauacccuauaauaaauuacagagugguuuucauccacuuucucuuagaaauacaugaagaguguguuacaguuguuuuccagguuuuggacugauauuguuucccuuagcauggauuuuuggagauaauuggccaguuauuuacuugauauaugaaaaaucuuuaccauuauguauucuugaaaugcuuuguagccugaagcucaaaguagacuuaauuuuaccacuauagauuuuaaccccuuuucuauggguacaguaguuuuggcaaaguuacaagguaauuuuaacauucaguccaguuguauuuuaaugcaguaugauucuuaaaauacauaguauguaaaggagagguauaguguaaucaaaaaguaaaaauaaauauauuucuuuagaagaguguucuuccaaacuauaugaacaauacagaugucagagaccagccauggugcuuauggggaagggaaauauagguaaaaauuaauauaaucaugcuucuggccuccugucuauauaucauugcauuugaauguuuuaaaaauauuucccuguuauaaaaaugugagacuuugcgguuucugucuguaccuggaguugauccuuugccacagggcucuguacccaaaaucgugccaagagagagcuagccccccaggagugccagcacaccugugaguacagguaagaccaccacuucuuaucaaauuccuggcccaagagggaccuucccagagccaucaggacacaggaaccaaggaacaggauccuucugguuucugucugaaccccagagcugacccuguaccacagcucuccauaccuaaauuccuccuggagagaacuggucucugaggaguacugacacagaggcuugcaggacagacaagccacagccagagacagcaagaccagcuaacaccagagauagccagauggugaaagggaagcacaagaacauaagcaacagaaaccaaggcuacuuggcaucaucagaacccaguucucccaccacagccagcccugguuaccccagcacaccagaaaagcaagacucugauuuaaaaauuacaucucaugaugauaguggacuuuaagaaggacauaaguaacucccuuaaagaauuacaggaaaacacaauaaagcaggugaaguaacugaaaaagccauccaggaucuaaaaauggaaauagaaacaauaaaaaaauuacaaagagagacaacccuggagauagaaaaccuaggaaagagaucaggagccaucuaugcaagcaucaccaauagaauacaagagauagaaaagagaaucucaggagcagaagauaccauagaaaacauugacacaacagucaaagaaaaugcaaaaugcaaaaagcuccuaacccaaaacaucccggaaauccagaacacaaugagaagaccaaaccuaacgauaauagguacagaagagugaagaucccaacuuaaagggccaguaaauaucuucaacagaauuauagaagaaaacuucccuaaccuaaagaaagagaugcacaugaaaauacaagaagccuacagaacuccaaauagacuggaccagaaaaaaaauaccuccuaucacauaauagucaaaacaccaaauguacaaaacaaagaaagaauauuaaaagcaguaagggauaaggucaaguaacauauaaaggcagaccuaucagaaauacaccagacuucucaccagagacuaugaaagccagaagauccuggguagaucucauacagaccuuaagagaacacaaaugccaacucaguuuugcuacuacaccuagcaaaacucucaauuaccguagauggagaaauuuaagauauuccaugacaaaaaccaaauuuacacaauaucuuuccccaaauccagcccuagagaggauaauagauggaaaaugccaacacaaggagggaaaccacacccuagaaaaagcaagaaaguaaucuuccuucaacaaacccaaaagaagauagccacacaaacauaaaaauaacauaaaaaauaacaggaagcaaaaaucacuauucauuaauaucucuuaacaucaguggacucaauuccccaauaaaaagauauagacuaacagacuggauacauaaacaggacccaguguuuugcugcauacaggaaacacaccucagugucaaagacaaacacuuuguuuuugucagaguaaagggcuggaacacaguuuuccaagcaaaucgucccaagaaacaagcuugaguaaccauucuacuaucggauaaaaucgacuuucaaccaaaagucaucaaaaaagauaaggaaggauacuucauacucaucaaaggaaaaaucuaccaagaagaacucucaauucugaacaucuaugcuccaaaugcuagggcauccacauucauaaaagaaaguuuacuaaagcucaaagcacacauuguaucucacacaauaauaguggagacuucaacaccccacucucaucaguggaaacacaaacacauuaaaaaaaaaaaaaaccagaaguuauccaaauagauuuaacagauaauuuauagaacauuucacccugaaacaaaagaauauaccuucuucucagcccugcaugguaccuucuccaaaauugaccauacagucuuucacauaacagaccucaacagauauaagaagauugaaauaaucccaugccuccuaucagaucacuacagauuaagguuggucuucaauagcaauaaaaacaacagaaagauuguaucuugaaacucaagaagaaugaagaccaaaauguggacacuuugccccuucuuagaauugggaacaaaacacccagggaaggaguuacagagacaacguuuggagcugagacgaaaggauggaccaucuagagacugccauaccuagggauccauuccauaaucagccuccaaaugcugacaccauugcauacacuagaaagauuuugcuuaaaggauccagauauagcugucucuugugaggcuaugccagugccuagcaaacacagaagugaaugcucacaguuagcuauuggauggaucacagggcccccaauggaggagcuagagaaaguacccaaggagcuaaaggggucugcagcccuauagguggaacaacaauaugaacuaaccaguaccccacccccacccccagagcucguguuucuagcugcauauguaucagaugauggccuaaucggccaucauuggaaagagaggcccuucgguccugcaaacuugccucaguacaggggaacgccagggccaagaagugggaguggguggguaggggagugggggggaggguaugggggacuuuugggauagcauuggaauuuaaaugaagaaaauaccuaauaaaaacaaauuacaaaaaaaaagaacaacagaaagcccacauacacauggaagcuggacaaugcucuacuuaaugauaacuugaucaagaaagaaagaaaugauagacuuuuuagaauuuaaugaaaaugaagguacaacauacccaaacuuaugggacauaauggaagcagugcuaagaggaaaacucauagcucugugugccuccaaaaugaaaauggagagagcauacacuagcagcuuaacaacacaccuaaaagcucuagaacaaaaagaagcaaaugcaccuaagaggaguagaaggcaggaaauaaucaaauucagggcugaaaucaaccaaauagaaacaaaaagaacuauacaaagagucaacaaaaucaggagcugguucuuugagaaaaaaaaucaacauauagauaaacccuuagccagacuaaccagagggcacagagacaguauccaaauuaacaaaaucagaaaugaaaagggagauauaacaacagaaacugaggaaauaaaaaaaaaaaucaucagacccuacuacaaaguccuauacucaacacaacuggaaaaucugaaugaaaugaaaaaaauuucuagacauauaccaaauaccaaaguuaaaucaggaucagauaaaccaucuaaacagucccauaaccccuaaaaaaauagaagcagucacugaaagucucccaaccaaaaaaagcccaggaccagauggauugaguacagaauucuaucagaccuucaaaaaagaccuaauaccaacauucuucaaacuauuccacaaaauagaaauauaaggaacacuaccuaguucauucuaugaagccacuaaaacuucacaaagacccaaccaagaaagagaaguucagaccaaccuugaugcagaaauauucaauaaaauucucgcaaaccgaauccaagaacacaucaaaaugauuauucaccaugaucaaguaggcuucaucucagggaugcagggaugauucaauauauggaaaugcaucaauguaaucaacuauauaaacuucaaacacaugaucauuccauuagaugcugaaaaagcauuugacaaaauucaacaucccuuuauguuaaaagucuuggaaagaucaggaauuuaacacccauauguaaacauaguaaaagcaauauacauaguaaaagcaauauacagcaaaccaguagccaacaucaaacuaaauggagagaaacuuaaacuaagagaaacuuagucccacuaaaaucagggacuagacaaggcugcccucucucucccuaucuguucaauauaguacuugaaguucuagcuagagcaauuagacaacaaaaguaggucaaagcaauuagacaacaaaaggaggucaaagggauacaaauuggaaaggaagaagucaaaauaucacuauuuguagaugauaugauagcauacuuaagugaccccaaacacuccacuggagaacuccuacagcugacaacuucagcaaaguggcuggauauaaaauuaacucaaucaaauuaguagcccuccucuacacaaagaaacaggccgagaaagaaauuagggaaacaacacccuucccaauagucacaaaugauauaaaauaccuuggugugacucuaacuaagcaagugaaagaucuguaugauaagaacuucaagucugugaagaaagaaauuaaauaagaccucagaagauggaaagaucuccaaugcucauggauuggcaggcuuaauauagagaaauggcuaucuugccgaaagcaaucuacagauucaaugcaauccccaucaaaaugccaacucaguucuucauaguguuagaaagagcaauucucaaauuuauuuguaauaacaaaaagccuaggauagugaaacuauucucaacaaauaaaauaacuggagaaucaccaucccugaccucaagcuauacuacaaagcauuagugauaaaaacugcaugguauugguacagugacagguagaugaauggaauagaauugaagacccagaaaugaacccauacaccuguggucacuuaaucuuugacaaagaagcuaaaaagacagcauuuucaacaaauggugcugguucaacuggcagucagcauguagaagaaugcaaauuuauccauucuuuucucccuguacaaagcucaaguccagggggaucaaauaccuccacauaaaaccagacacacagaaucuaauagaagagaaaguggggaaaagucucgaacacauggcacaggggaaaaauucugaagagaauaccuauggcuuaugcucuaagaucaagaauugacaaaugggaccucauaaaauuacaaagcuucuguaaggcaaaggacacugucaguacgacaaaaaggcaaccaacagauuaggaaaagaucuuuaccaauccuacauccaauugagagcuaauauuccguauauacaaagaacucaagaaguuagacuccagagaaccaaauaacccuauuaaaaaaugggguauagagcucaacaaagaauuuucaacugaggaaacuugaaugacugagaaacaccuaaagaaauguucaacauccuuagucaucagggaaaugcaaaucaaaauaacccugagauuccaccccacaccagucagaauggcuaagaucaaaaacuuaagugacagcagaugcuggagaggauguggagaaagaggaacacuccuccacugcuggugggauuuuaagcugguacaaccacucuggaaauaugucuggugguugcucagaaaauuggacauaguacuaccugaggacccagcuauaucacuccugggcauauacccagaagauccuccaacauguaguaaguacucaugcuccaguauguucauagcagccauauuuauaauagcccgaagcuguaaagaacccagauguuccucaacagaggguacagaaaaugugguacauuuacagaauggaauacuacucagcuguuuaaaaaaaaaugacuucaugaaauuuggagguaaauggauggaacuugagaauaucaucuuaagugaggugacucagucacaaaggaacacucacaguauguacucacugauaaguggauauuagcccaaauguuuagaauacccaagauugaauucacagaccauaugaagccuaagaagaaggaagaccaaaauguggaugcuuaagugcuuuuuagaagggugaacaaauaugaggaaauauuuggaggaaauaugaggacaaaguguggagcagagucugaaggaaaagccauccagagacugccccacuagggauccaucccauauacauuauuguggaugccaugaagugcuugcugauggaagccugauauggcugucuccugaguggcucugccagagccugacaaguacagagguggaugcuugcagccaaccauuggacagagcucugggguucccuauggaggagguggagaagggacugaaggagcugaggguguuugcagccccauggaggcagcaacagugucaacaggccaccccucacccccuaagagcuccuggagacugguccaccaaccaaagaauacacauggggaaacccauggcacuggucacauauguggcagaggauggccuuguuggacuucagugggaggagaggcccuugggccugagguguuugaugccccaguguaggggaauaccagggccugaggacaggaguuuguguauucgggaguacccucauugaggcaggaguaggagggaugagauagggguuuuccaaauuggaaaaggaaaaacauuugaaauguauauaaagaaaauauccaauaaaaaauguccugaaaagaaaaaaaaagaaacauuuuuuaaaauaaagagcugagguacaaaaucacuuuagugugaaaguccuagauggcuugagaugaaguugagauagauguuauauacaugauugauagacaaaugauaugaugaucauagagagauagauaggcgaacagauaaacagacaaagagacauagagacugaugauagagauauauaaaauaguaauuuuauccuaaaaugaguuuucaauaaaggaacaggcaaaagaaugaaaugggaaaggaggaggguaaaaaguccacuggauauagcaaaugauuaagccagaaggacaaggcucuagcacuaguaugauguaaaguacaagaagaaagccugaggcuugaaagauaaugaugaaauccaggcagacucaaaacacaaaaggcauaaaaaaaaguguaccuuuauaaauacuaacuuugcucuguuuuaaguaaugcuguucugggagagucaagucuagccuauuggucuggaguagccuuaacauaaugcucuacuucuccaccccccacccccacccccaccccaccccagacaggguuucucuguguagcccuggcuguccucgaacucacuuuguagaccaggcuggccucgaacucagaaauccuccugccucugccucccaagugcugggauuaaaggcgugcgccaccacacccggcccagugcucuacuuuuuaaacccaaugguuuuuuuuuuuuuuugcuuaauaggaguuacugauuuuaaaaaaacuuuguaaauaauuggccuaauacucugagguuagagaucacacuaaguaggaaaaacuggaauuuguagcucuuuuugaaagaaaaauuaacucucaaaauuaaugaaguagaccugaugucccagacuacagagcugcaucagugauaucacuuccuuuucuccuggaggaaaccaggguuuuauguaaagcugcuuaguucaaagauuuauagcaaaauggucagccucaucugcccuuuacucuagacauuguuucugggguuaaaaaaauaaacuaacaaagaauagaggaaaauagagaugauuuauuuacugagaaacagauggcagaagccauaaaggcuauggcaagcaagugaauuuccuggagauggcccacuguuuuacaugacugugaugggugcacucuggagaggcacauccccagagauuuugucccaggauugcuucucacuauugaugugccuucccugccacuauuacauagcuaaugauaccugggcuuuaguccacccuauugggcaaauuuccuacagauuaauaugaagaugagcuuuuaugaauuaaugcuauuuagaugaauuaaugacuuuauagaauucaaauaauuuuaggaagaaaguuuaaggagaugguuuugguuguuuugccagaaagauauaaugaaguuagaaucaagaacaggaugugccccuccucauagaacaguaagugaagcuugcauaaucaggaauacaacgagcuuucacaauuacacuaagaagagacauaggcuugggacagauuugugaucaaggaaaaacauucauucuaggucagguccaaggaugaagucacaggugugcacuaugauaaaggcuaugugaaacuguugcuuugaacuuaauaaugagcuuauagaaugaaacauaguuuugaacuaauugagcauccuucuguaacucccuuuuuauguaacauuuuaucugugagauaauuuuaaaaagaacuuuucucuaagaagguauaaauugccagggagaagaaauaguguggguucuggaucucccacuccauuuaccaaauguacauacacacacauacaugcauacauacauauacauauucugucuauauguauaugcauacauaugaauguagauauauguguaugaauauaacuaugcauguguacuuaugaaauugaugugacagguggcugggcagagagagagagagugcgugcgcaugcaagugagcuagccuggccauccaaagggcccuugagccagagagaaaagagcccagauaacuaugccuuuuuucuuuuuucuuuuuuuuuuuaagcuuguuucuaaaauguuuauuuuuucauuuggacagaaaauuaugaaagguagaaucaagugugugacuucuacugaaggacaccuaaugcaagcuuaacuaaauuaaccugaucagaaauugagggguuuuuuuugaugauuuuuuuucuucuuuuuuuuaaaaauuagguauuuauuucauuuacauuuccaaugcuaucccaaaaguccuccccacccucccccacccacccacucccacuucuuggcccugguguuccccuauacugaggcauauaaaguuugcacgaccaaugggccucucuguccacugauggccgacuaggcuaucuucugauacauuuucagcuagagacacaagcucugggggggggggggauguuacugguuaguucauauuguuguucuaccuauaggguugcagauccccucaucuccuuggguacuuucucuagcuccuccauugggggcccuguguuccauccaauagcugacugugagcauccacuucuguauuugcuaggcccuggcauagucucacaagagacagcuauaucaggguccuuucagcaaaaucuugcuaguguaugcaauggugucagcguuuggaggcugauuaugggauggauccccggguauggcaguaaagaucuaauuccaguucuucacaaacuauuccacaaaauagaagcagaagguacucuacccaacucauucuaugaagccacaauuauucugauaccuaaaucacagaaagacccaacaaagauagagaacuucagaccaauuucccuuaugaauaucgaugcaaaaauacucaauaaaauucucgcuaaccgaauccaagaacacaucaaaacaaucauccauccugaccaaguagguuucauuccagggauacagggaugguuuaauauauggaaauccaucaacguaaucgauuauauaaacaaacucaaagacaaaaaucacaugaucauuuuguuagaugcugagaaagcauuugacaaaauccaacacacauucaugauaaaagucuuggaaagaucaggaauucaaggcccauaccucaacaugauaaaagcaaucuacagcaaaccaguagccaacaucagaguaaauggugagaagcuggaagcaaucccacuaaaaucagggacuagacaaggcuguccacucucucccuaccuuuucaacauuguacuugaaguccuagccuuuuuucuuaaucccuugcuauuguuagcaggaguuaaauugccugaagccagucgguccuggccacagaauagcaaagaguuaaacagaaaguuaaauugccagaaguaagcagcuuuuggccgagcagcugcugacucuguaccccuucucugcugcugucccugggacgcuggaugcuccgcuagccacuggcaaauagggaaauaauuuauuaugaaguugcaaucaaaaggaauguaucuguguuuucaaaccauaggacaguuaaaaacuuuaaucuagaagugauagguuaauugauagauauaaauaaauuaauaaaagaugcgacaucaguaauguacaaguaugaauaaaauauuuaauggcacaaguaaaucaaaggaauaaguacuuuguuuuacuuaugagauugacaaagguuaaagugauugauacucccuguaauuguuaaagaaugagaaacuaugcacuuuuccacuguugacuaaguugagauuuuguaacuauauuuuuuccuagcaaugauauguucauuuguuuauuuuccucaaaagcuugauguacgccuauacaucuauuauuuauuuauuuauuuuggguuuuucgagacagaguuucucuguguagcccugacuguccuggaacucacucuguagaccaggcuggccucgaacucacaucuauuuuuauccaaaucacuuaugaauuaaucagaaggaaauaaucuggaaugugacucauuuacauuaugaaaacauugauuacaaucuuuucuuuaugaagguuguuguauaggagugucuuuuccaguguugucauuaguaggaaaaguggaaguaacauacuuucccagcauagggauauaaaaagauucuggcagauagaaugauacaguuauauaaagucacuaagucuuauuaaaauuguuucauucauaagaagugauucugucccauacaguuccaggcuuugauuuuagcuacuggaaggaaagugcuacuuauuaucauuguaagaaucaucucaaaugcugagauguccagauggugacauuguugauuuuaugaauuuaugaaauuauuagcguagcaacuguugugcauagcacacuguacugggugcuacagacccaaugggaaggaaaguagauucgcuaagggccuccauuuccaugcuuucuggguaggagagagauacguguuauccaacuaaccaguagcacuugguuuaaaaugacaauuuugauggagacccuaaagguggauagugauuuaugaauugagacaauuuccuuuaugagacaccaggggaagccuuguuuagugauuauucuuuuucuccuguagcccagaucaaccuuaaacuucugauucuccauagugcugagaaaacaggcacuuagcuugaaacucuauuuguaagcugugccucacagagaucacaauggaaauuaaauauuuauagugaagagaaaauaaaaguguuuuauaucagaaaaucuccaaucuuaaaugaaaauaauugaagaggaaugaggugaaaaaugaauuaagucucuagcucaggaagcugggaaagaaagcaaaauuagcuuuaauuauagagaagaaaaagguaagaugaaguuacgugaaugaaagauuaauaggcaaauauuaguauauuaaaaaugaauaaaaaccaaaauacuuuauuaaaaaccacuaguuuaaucacugguacauuaucauuaaagacagaucccuaguuugaauguuaauaaauaguuuagaauauggaaucuggagguagacugccuggcuguaaauccugacaguggccuuuaguauaaacucagugugguuuagcuuccuucucuguauacaggguaaugauugcacccaccuggguaguagguugaauaucaagcacuuagauauuauaugguaaucuuauaaaacacggaguagcuggauaugguaguucacaccuauaauuucagcacacucgaguuugcagcaagagaauugccaggaguuccaaccagucuauguuacacagucugagguuaucauaggcuucagagugaaggucugccucagaguguaaaccaaccaaacaacaauagcaaaaauaauaaugaugcaagggaacaguauuagaaauggaacuacaaacacaccauagagauuucugauuuuaucagcuacauuguaauuugagaaguggauaaaauauacauuuuauuagaaaagaucaaaacgacuguaauacauucuaguagaaacagaaguuauguggguaagcuaagaauguuuaaagaaaugaaauuuauaaugcaguccucuccacaggcuccauugucgugucuguaggggcucuuacuuuccucugcauuuuuaaauugaggcccaugugauaaaagugcaggacauuacaguauacagugacagugugcagugacaugccugugugaccauccucucaauagagagugcuuucauucccaaaaguauuucuagaaugaaaauuaucagaguacuuuuuuuuuuuaucauggaauuacugaaacaauaaaugcuuuagaaagcuuuaauaugaaucacagcuaggauggaacccuuaaaacauauuuuucuuagaguauuuuuaaaagauuuauuuauuuacuauacacacauauauguacaucuauguguguguauguauacacacauauaugugcauauauguacaucuauguguguuucuugugugauuggguuaccucacuaaggaugauguccuccagaaccauccauuugccuaagaauuucaugaauucauuguuuuuaauagcaguacuccauuuguugcguaaaucuccucccaaauaugccccagcaaugaaaacaccacucaguuauuaugauuauaugcugugcgccuagauugggcaguucuaccacuacacuaccaucucccacaucuaugagaccccuuagaacuugcgguuucuccaggccaugugcuucugcuccgcuuuucuucgucuuccuccucugcauccucucccucuuucauuuucuccuccuucucucuccuugcccuccucuucaccuucccuuuuaacugcccaaucaucagcucuccuuuauuuuacaaauuaaggugggaagcagguuuacaggaaaucaccugagugcucacccauuccuuguucucagccacucacaggagaauggaauuaacaucaacuauaauuagcccuaggguuauccacaacauccccccccuucugucuaauuaaaagacuauuuuaucucagauauaacugaacauaacuauuauuauuuuguaauuuauaagguacaugagaccuaacacccauuccaucaucuuuguuaauuaaacagaacuccugucaucuauccuuacuuaaaagauuauaguucuguaccuggccgugucuuggcuuuagauugaaugccaucugaacaccauccucucaaaucuguuccucucacaguaaaaagccuggguuggcuaggagacuaugcaguuauucaaccccaucagaaauccaagaaugacugauauuaacugaaaauauauagagagguuaacacagcuuccaaaacguagccaauacauagagaucgcugaucaccuggacagucccuuacuucagcaguuggagcauccgucuucagccuacuggccagggucaucugacagacuuagagaaacaggaauauuaaggacuagccuacugucucggcagaaucaagauguccuaaccuguaauuguacuuucuugggacaguauuaugucuguagaugaaaugaggcaauucuugccuaguggcuguuuugccacaacuggaguaacucaaagaugcucacuuucuucuuugaauccaagacagggaaaguugucaggagcagacuggucucaacaacaagugacuaaauaaucacuaaacaucacauucuguagacuucugacauuuuuaaaaccaacuaucuaugugaaguaaucuauacuguucucuguuaacuacucucaagccauuucuaauuaaaauaacugaaaacaccguaacaauaaacucagagccaugaauuuccuauuuggcccuuaacucacaggcuuaaacaucucagaccugcuuauaaaaacagcaacaggaggacuggcuccaaacccuguacuucaaaauuuuuaguaucaaagacaaccuauaauaaccacucucagccccaaagcuuggggaacugggacaaugacucuucauaacuucuucaagcugaguauggguguugagauauuuuugaagggcgggggaaagguggggaaaugggggaguugguuggccuuaagaaggccacaccaaugauuguauuagucucugaugucuguguccugacuggauccagaugaaaaaccaagacaucaggaguucaggcaggucaguucagcaugucugaugaugaaauucaaauucaccaaggcuguauacgcuguaauauagaaaucucaaaacaaaauuuuagucucaucaagauaaccuuuuuguuugguucucuggaaucuaguucucagggcgucucccucuaucaaaucugauccauagaacucuggaagguguaaauaccuuaaucuccuuuuccaaaaacacaaaacaaaacuuuuccccaaaucagcaucuccuucagccaguaaccaggaaaaccuguagcuugcccucugucacaguggaacaauaaaacaaccacaacacucaaaaucacacacaucuuagccuauuuaggcuugggaucucugaaagaacagccacugacugagccaugucuccagccucuuaaagucuuuuuuuuuuuuuuuuuuuuuuuuuuuuuuuuuuuugcaggaggcgagggguuugaaacagguuucucuguguagaaccuagcuauccuggaacucacucuguagaccaggcuggccuugaagucaaauauucaauugucucccuuagaauauuuuuuaaaagguaguucaaguuuuucauguaaaauuaucuaauuauuuuccaacuaaaacuuaaauguauuuauuuuuuucagagacaucaaaccugacaauauauugauggauaugaauggacauauucguuuagcagauuuugguucuugucugaagcugauggaagauggaacgguaaauaaacauaaauuaugaauuauucuacucagauauuuccuuuuccaugucuucuauguucuagagagcccugcuugcacugacugucugcccagccaugcaccuguauguguuccaccuccuucuacaaagcuuuggcuauuccugcacgugauaaggcuuguucaucgaguuauuuuaucugcuugcaauaaguacuuagcuugagaauggcacuuuuaagagucuuguaucuucuuuuuuggcugaugccuacuauuuuacuugaaauguuccuaaguuuuuagaaugauaaauaagguaaguuucauauagaaaaagaaaacauaacuccaccuucauuuguacuguuuuucuaauuauauacuuguucugagggacaauuuucagcuuuguuuugguuuuuuuuuuuuugagacaggguuuuucuguauagcccugacaguccuggaacucacucuguagagaccaggauggccuugcacucagaaaucugccugccucugucucccaagugcugggauuaaaggcgugugccaccaugccuggcuuacuuuauaauuuuauaacagacaacuuuuuauguauuccauauuuguuuaaagagaugacauuuucucuuaauuuuuaauaccaggguucuauacaaauccauaauauaaaacugaguuugcauuuguauuuuauauuauuaaggguuuuccuuguuaucaauuauuuaaaaauccuuaauaugguagauuuguuaauucuuccuuuauauggucaguacuuuacacaucuccuuugugccuuacuaucuggugaaauacuacuuuucccaguaugguuucuuuucaauuaaacugacgaauuaaaauaauuuuaauaguuaggcuaauauuucuauuacuguuuaacuuucuuuugcuuaauuuaugugcaauucaucuuuuuaucccaucacuuucaaaugugugcuuccacuaugucuuaucuuguuuaaguaaauuauuuaacugauuuuucucucauuuauucauuuuguuuuauuucuuucccaguguuaaaucuuuguccuuuaacaggugauuuaauccacucuugggucuugugacucaggccagcgcugugugcuguucauauagguuuugcuuguugucugcccuuuuucucuccugccuccuacugugcaguucagguuuagcuuucucacucucuuuauucuuggaagguaacauauuucauuuaaaauauuuuaaugccucucuuuuguuauuuuaaaaaauauuuauaguuuacuuaacuguaaguuaauaauuuuucucacuucauucccauucaauauaaucaacuuauuuuacuuuaugccacauauagaaauuaauuuaaauugccaaagaacuaugucaaaaccaaaaaaaaaaguaugggacaguauuuaugauuagauuuggcaaaugucuugaggauaacauagaaucacaacccuucuacccuguaaugguaaauuauauuguccucaaaaacguguguguauauaugagaugacacagcgggcagaaugagaagauagcguauagaaaacugcaacagugucugcccaucacuucucugauuacaugcuaagaauaugugacgaauaguuacagaguguagaugcauccugaccuguaacacuaaccugcccacgguuaccuugggaggcacagggugagauauuggucuuuccugaagcuuucuuccaagcucagcaacagaaaaacagucccagugaagaauaagaggaguuucccacaggcuuacaaaugggaaugagaacaugaaagacacucagcaaaaccucucuuuagagagaugcaaguccagaacccgugaccccacugugagugcauccucugccacccagaaacagcaaguguuguccacagaugauuuagagccucuggacacuguuaggaggaguauaagacaggguagugacuguggaaaauaguguagcuaguucuuccagaugcuaaaaaucaguugauaauuuauucauuuucauuuuuaucuguuaacuuguuuaauuauauuuucaacauuuuaaaauuaagaauuuuguuuuaaagucuauuuuuucuguuugguuucauuuguuuguuuguuuucugagaaaaggucuuucuuguauaauauccuuggcuggccuggaauuugccuuguagaccaugcuggccacaaaagcauagaaauccaucucagugcuaguauuuaaggugugcaccaccaugccuggugcaacuuagaacuuaauaguauuuaaggugugcaccaccaugccuggugcaacuuagaacuuaauaguauuuaaggugugcaccaccaugccuggugcaacuuagaacuuaauaguauuuaaggugugcaccaccaugccuggugcaacuuagcacuuaauaguauuuaaggugugcaccaccaugccuggugcaacuuagcacuuaauguacaauaacuaaucaaucuucaguuuucuuagacucauacuuagagaugucaaauuauuaccaguguucaucugaaugaguuguucauaucuaacuaaguuuuuaguucuacuauaauacauacauacauacauacauacacacacacguacauacauguuuugauugauuaguuauauaguuaauaauuuuaaaaaacaguaagaaagcugauauaguagugcuguaaucccagcacuugggaagcaaagugaggaggauugugagucugaggcuggccucagcuauaagcaagaacuugacucugauuaccaaaccaaaccaaaauuaaauaauaauaauguuguaagugaaacauucguuuuauuguuaaugacucagauaauauuguuucccuauaugcauucaacuauaguaaagguucuauaacauugugaguaaugaagacuauuaauauaaaggccauauaaaauuacucuguaaaaucaggagacuaaauacagaugauaaaaaugucuuauuauacgccuacauacauacuguauaucucaaguaccucuuucuaauuaaaauuuauuuuuuaauaauaaaaauuugaacuuuauuagguccaguccucgguggcaguuggaacuccagauuauauuucuccggaaauccuucaggcuauggaagacggaaaaggcagauauggaccagagugugacuggugguccuugggggucuguauguaugagaugcuuuacggagaaacaccauucuaugcagagucucugguggagacauauggaaaaauuaugaaucacaaaguuaguauauuuauuuuuuuauaauuuuaauaguaaauacauauaguaaauuaaaggaauaugauaguaaagacacaauacuucuuucaaaacaaugaauacucauauuuuuugauuaguaggggauaaucauucuuaaucauaaucuaugaaauaauuaguuuuaacuuuuuacuauauuuuguugagaagugcuccugaauagaaacuuggucuaugucuauauaguugaguaauagaguucaaaagugguuaguuuuuuagucaguuuuaacuauauaguauguacagucaugacaagcaugcauacacagauucucaguaucacuaauaaugaguggagugugugaagagagauaaaagugagauuuguuggcaucagaagacgacuuuguagcuacaguccuuugcuguacaccacuucugaccucagcucaaucccugaacggcacagaaagauggaaggagggaacugacuccacagaguuguccucugaccuucacaugggcaguauggcacuugugugcaugcacacaccuccacacagcuguagucauacaccacaaucauuguuuuguuuuguuuuguugugauucuucugucaaucuagcaaguacaaaaugaaccaucaguacucuaauaaaugcagcuucaugggcccuccucagauuguauugacagaacuacaaguuguaacuuccuguuuuaacagcuguacaucuugaguguuaaaauuaugguuagaacuuuuaauggagcaaggucaggcuuagaagucagccugguugggauaucuagaacaacuguauauauaggauaucuguuccaguguuaaugaucacaaaacacuggcugcaauccauauacacagcuggaacaagaucauaaaacucaaguaauguggaacuaggugaaacaaaauaaacaguacaaaagaagaauaacuguccaguuucagaaauugugaacaguuacaaaaguucucauuaggaaucugaaugccaccagaagaauaggauaaccuguaauuuuuaauuuggucuggugaugcaaacaugauuaguuuuuuucuacauauuaaucaauuuuagagacuuugugucuucuucugagcuguaacuguagugcaguaaguaguuaugaagaacuggaagcuagggagaaguuugcaguguguaaauggcauguguaucauucagaaggaaguuacuugaguguacacugcugaacagcacaggucugaagaaagaguucaaguuccuuuccugucauuaguuguauggcaguuuccucuucuacaagacugucauacuagcaguucccacccagugugauuauuaagagaaucaaaugggucagauaaguaaaucacuuugaauagugccagguacauguuaauuuuucaauuguuuaaugauuauuuguuauuuuauauuguaucugaacauuaucaguaaucuacuucuuaggaaauacugaguuaaauucugcuauuuguaaucagauccaccugauuuaacagcagcuuaacgccuagagcagugguucucaaccuuucuaacgcugcaacccuuuaauucaguuccucauguuguggugacucucagccauaaaguuauuuuguugguacuucauaacuaauuuugcuacuguuaugaauuguaauguaaauaucugauaugcaggguaucugauaugugaccccucaagggguugcaacucacagauugugaaccgcugcuauauagcaucugaccuucucucuuuguaguuccucugucaugaaguaacuuagagaauuaaaaguucccuuaggaaaaggauuuacguccaucaucccugugucucccuacagugucacugcuaagucaucaaacacuuaguagacacuuuucuaagggaaaugcauuuaaguaaaucuaccgcauucuguaagauaacugcuaauuuguauuugcacacuguauaucuuugucuguguaggagcgguuucaguuuccagcccaagugacagacguguccgaaaaugcuaaagaucuuauucgaagacucauuuguaguagagaacaucgacuuggccaaaauggaauagaagacuuuaagaagcauccauucuucaguggaauugauugggauaacauucggaauugugaagcaccuuacaucccagaaguuaguagcccgacagauacgucaaauuuugauguggaugacgacuguuuaaaaaauucugugaguaugacauuaugaagauguccuguccugcugguucuuuuaaguauuguuauaaaguaacguuuuuauucauuagucuaaugccaggacuauuuucuuuuaucggucacauuguauuuaugacuuccagugcucauuuugucauguaucagaaaaugaagagacgaguaaauucaauauggucacccaugaacaacagcaacauugagaucuguuccuuaaauaauugugccaguggguuuucuaagaagacaagauuggaugcuuuaaaacauacauuuugggucuggagagauggcucagugcuuaagagcacuggcugcucuuccagagguccugaguucaguucccagcaaccacaugguggcucacaaccagcuguaaugaauucugauacucucuucuggugugucugaaaacagcuacaguguacucacauacauaaaauaaacaauucuuuaaguuaaaaaaaaaguauauuucaugauuucaaaguggagaugacaaaucuuucccuuaaaaccagccauaaaacuggaaacaagcaaaaacacuuagagcuugauacaaccaaaggaaauaaagaagcauuuauucaugaaaaacugcugagcuguuuugaccauaccucacccuccaccuuccaccccaucgcgugcuuguugguacucacuacauggagcaaaaaccugacaccuugcugcuagguggggcaaaguugauugggaaagcucuaacccaacacaccguugccacuaaaaaacaacuugguaggaaugaauguggaaauacaguggauauacaguuguuuuuaauuauuuuauaauaauuuuauaaacguauguagcuguauuuuauaguuauggugaacaccagguuagcugucauugaccauugcuguguggaaauaaagguuaaugaauuugaagggaguguggagggguacaggggagggguugcagggagcaaaggaaagaagagggagggauguaauuauaaucucagaaauuaaaggaacagaaaguuaucuucugguuacauucucagcaacugaauauaaaacucuuucauauguacuucuauucacagauacuuuauauaauaauauauaccuuugauuccuuaacacuaaacucaugacuaacagugucauaacuuaacuccuaacuccuaaacagaguuuacuuugacuuuaugacacuggguggcagccagugguuucacacaccgauacuccuaucccuuggaaguguaaugggacaggauuaugaauucauggcaagcuugagcuacauacagcaagauccugcuugaaauuuaaaaaaacuaugcaguuaucagacagcacuucugggagcuauuuuauacagagauacuaucguaaagcacaaaagugcuuauagagugugcaagggcguuugcugucagugugagaugagaggagccccccccccccccccaugcucaguggcacccucugcucugcacacaccaucagggaacacggaaguucuacaaugccgauuuuccaaauaaauuuagcuucuagacugugugugaugaaacauggguacaauuucagcacugaagaggcagacacaggaagaucugggcuacaugguaaggucuugucucucaaaaaaaaaaaaaaaaagcuagacacauuuucagauacaaaauacacaaauaauguccauaauuucauucuuaacuuuuauauuguuuguuagaguuuugcaguggcagugcuuagagucuguauuuuguaucauuguacauauuuaccaaacuuaucacugugucuaaauugaauaguuguuuauccccauugacaguuaaaauuaauaguucauagauuucuuacuagauugguauucuuuuaauuuuuuucuaggaaacaaugcccccaccaacacauacugcauuuucuggccaucaucuaccauuuguugguuuuacauauacuaguagcugguaaguuucaaaagucaguauaauuuggguauuuuauuuuuuuuauuagauauuuucuuuauuuacauuucaaauguuauccccuuucccuaguuuccccuccgaaaauccccuauccccucgcuucucucccuguuccccaacccacccauuggcauuccccuauacuuggggcguagagccuucacaggaccaugggccuauccucccauugaugaccgacuaggccaucggguaauuuauuuaaaaguaaauugagcuugaaaaugguauaugugguuguaguucuggcauagugcugaauuuaaaugcggaaaauaaaugauaagccuauuucgauauuaucaauagaacaaacuacuugagaacccacuguuuggaggaaaagacaaggacaugugguucaagaguugacucuguugagaauagaugagccaggucagggcacaucaugaaucuucuguucugucgcgugccauuguucaccucacuuucuacucuucacucguuucuguccucuggucccucccuuccuagucacgugagaaucacuauaaucacuucgugugugccaugucggucucucuggcuguccuccagcugcugggcuuuccuugugaagugaagauucuuuuuaaaaaucuaagcaguuugaugugcuggggcacacagggucuuaacaaccacgcuaacuucaaauugagugagaucagagguuuaaguaccguauacuguugacauacauacugagucacccugcuuuguucugcccuguauguagcaagguaaccauuucacacuucauccugcccuguacccaguagucacccucguccucaguugauaguucugccucuccaucccugaagguugacccagcugugacacagccacccauuccugccacuguuuucugucuucccuuagacucacacaagcucucuucaaggauggaccauggugaugccuggcuagguugguuccuuccacccccuccugcguggcuaaaucuauuguuuccuuuuaugucauuagcuuucuccuuuauccacauccuuacguccugccaacccucuuaccagacacacaguuacuucuuccaucuuaaaauagagaacccuucuggaccucauaccugguaccagugcuuuccuugccauaagccagaguccccucucuucccugucuguucuuaaaauguuauucuuccuugaauccacucaguucagguugugcccccagcaccucaugcaaacugauucaucagcaucaccaugggcuccuggguugcugagugcagcuauuccuucuuaguccugguccugggcugccugucuucgccuuugccacuccuguugauggccagaucuguccgcaguucuggcuucuuuguaucuuaacuacaaaccaagguucuuauaaggcccugaacaacugacuuggucgucucucuaugcccugcggcuuucccagcuguucccguguggcgcuuacacaggccuccguugaagggugucuugggaugcucagacuucuguuccgcaguggucuucauccugacacugccuugacuuaccucaguuacuugugcaagcaccacuguuuugauuacuccaucuacauuucuaucuucuccuucuuaggacuucuuucucucucuccuguuucauaguuucucuuuuagaagccaaugcuuucuaaugugcagaauauguuauguacuuuuauuccugucauuauugauaaaauuuaaacuauuggcaagaauucuauuuauaauuuuuaauuuaaauacaauuauauuauuaugcccuuugcuuuucuucgcuuugcuucgcuuugcuuugcuuaccucccuuuguugugguaaaucuccaacccagauaagccccagcaaugaaaacaacucaguuaauaugaauacaugcugugcgccuagauugggcaguucuaccacuacacuaccaucuuccaccucuaugagaccccuuagaacuugcgguuucuccaggccacucgcuucugcucugcuuuccuuccaccaccuccuccucuguccuccaucauccucucuccccuucucucccaaagccuucaacucuauguucuccucuaucuccgcccaauuaccgccucuagccuuuauuuuauacauuaagguaggaagcagguuuacagaaaaucaccugagugcugacucauuccuuguuugcagccccucacaggagaacggaauuaacaucaaauauaauuagccccagggcuauccgcaacauccccuucccuucccuuucuuuuccuuuccuuuucccaaucccuuccaugaacacuuccuccaacucugaucauuuccaacuccccacucccucacaaaucaauggccucuuuuuccuugauuauuauuguuuuacacagaaaccuuuugaaucuauucaauguugcuugugugcaugugauucaggcugacuaccugguaguagaucaacaauuagguagcccaucucucagaaagacuaauucucuugcucucagcuauuauugguugccuauacuucuuugucuaggagugacucccugaugaauguccaucaucugaacucuacuaugcagucagaaaagcaccucaucuuaaaguuuugaauuucaaauucuauuauugaacaugugcuaaugguuuugacuacuguuucaggaaacuugucagauuguuuuaaacuaauaacccuuuaguuuaaaauccucauuuuauaauuuauggaauuuuaaacuuaaagauaauuuggugauauaaguuuuauuuaaaaauauuucuacacauuaugguaaucucacagaaaacuuuuuuagucauucugugggauucuagauguuuuacuguagauauucaaaucuaugucuuguaugaagaaguuuaaaauucuucaaacuuuauuguaauaugaaccuccuuuuuuuuuuuuucguucaguguucuuucugaucggagcuguuuaagagucacagcaggccccaccucauuggaccuugaugucaguguccagaggacucuagacaauaacuuagcaacugaggcuuaugaaaggagaauuaagcggcuugagcaggaaaagcuugaacugacuagaaaacuucaagguaaauauuuuaauguuuucuuuguuuaaauugaacuuacagaguucugagaugcauuacaaaggauuguuuuauuuucagaauggaucuucuuguaaaugguaaaaaguaaaguuguagaaauauaugcagaacagaguaugauggcauuuauguaaaaucacacagugaugugauuucuuuagguauggauguguucaucugaauguauggaguggaauacuucuggagacaggaggaugggccugucagggaaaaagggcccuucucauccucaccucacacuuaagugacuuuuaauaucguauaugaucagggcuugcaugcacgucguuuccuucaugcucugggaugauuuuaaaggacauuuuaggauucuuacuuuucacuuuuuuguuuacagugauuuugaucucucccuagucuacucaaugucacaggaccccucagucaacacuggacuguucuuaccaccuccuuucucacucugaccaguggcauuuuuauggcucccucuaucucugcuuuccuucuuaggcuuuagcugucuuuacguaaggaugucuuuguuuccuguguuucucucuuuuguguguauuguguuccucauuuagagugucuguugaucuuuguguuuguauaaacugugaggaguuugcuacugccucuguuguuuuguuuuuaaauuggacauguucuccugcuuuccaaaugccuuguaacuuguacuauaugaccaauaugagugacaauaagagaugguugaguuaauauuauuuuugucccagaaaauguuuuucuauuuuuaugcaauuagcaauugagccugaacaaggcuggauugcaauuuuuauuaaagucagucuaccucuaaugucagaagugaagggggacuagguagagcuugguagggucuauuucuccuuuacuuguaacuuaggggacuuguuccauucuucauccucuucuuacuauuuccaacuuucauaaguaucuuggugaggagaccauuccuaguuugaugcaguuacagcagauguaguaguaggauaggaguucuccucugaacaguguucuaaucccugccccacauuguccagaagggcuggauucuguuuuuguuuuuugucuuuuuccagcauaguaguccuuaauuuugggggcuacugagaugaccuaguaggaaagggcaccuguugcaaggccugacaacacaaguguaagccuuagaauucaugugauagaaggagaaaccugacuguuggagaccugucuucuguccucuacaugggugaauggccugugcgcccacauguauaacacccgcccaaagaaacaaauaaauguuaaaaauguuaguuuggacaaagcucuagguuagaccacugagauagccuuucaucucagaauaucuuacuccacucugguucauuuuacuuggucuuugcuuucacaguacaauaaugguugaacaaacaaguucuuuuaaguucuuaguuuuauauuucaaaaauauuuaguauauuuuuauuuuuacaaaaggaggcaauagccauuccuguuccauuucauuacaaaugaaaacuuuggggacacagugaaggcagugcuaagaggaaaguucauagcaaugagugccuccauaaagaaacuagaguucacauaccagcaauuuaaaaguauaucugaaagcucuagaaaaagaagaguagacagcagggaauaaucaaagucagggcugaaaucaaaugauuagaaacgaagaacaaaaccaagagcuaguucuuugagaaaaauccacaagauagacaaaccauuagacaaauuagcuuaaagacagagagauaguauccaaauaaacaaaaucagaaauaaaaagggaggcauaacaacaaacaaugaggaaauucaaagaaucauuaccucuuacuucaaaagucuguacuccacaaaauuggaaaaucuaaacaaaaauggauaaguuuuuagacagauaccacuuacuaaaguuaaaucaagucuccgauuuucauucuuuaauucuuguuuuauuuucagagucaacacagacuguucaagcucugcaauauucaacuguugaugguccacuaacggcaagcaaagauuuagaaauuaaaagucugaaagaagagauugaaaaacuaaggaaacaaguagcagguaacuuucugagggucaucauuaauuuaguauaauuucaaaugguuacugucuaugagucuuguugauguuauggguuaugaauuauaugacacugagaaauggcaaauaaaauuaguucugguuucauaauuugaucuggaaaguaaauauguaauugccuuacagaaggaggggcuauggggaaaguacaugaaggugauacauagagaauauauagaaggcacagccaccuagagagaacagagaugacuacacuagugguagaauuugucugggaaguuguguaugugaauggcagguaaacaggagguuuaacgaaaaggaaugcauauagacacagacaggcaacaagcaccacaucaugaguugagcgcuauaaauuucucuuccaguacugauuuuauugugccauguaaaacuuuguuguauuuucauuucugcucaaauuuuaagaauuuuuuacuuugacaugaauugagaagugcuuuuugaguguuugaagaauuaacuucuauauucucuaauccguuuuguaauaccuccuuaugguguuuguucuaugagaaaugaaguuuguuuucugccuaagauacaguugucuuaaccuguguucccugggcacuugggaugaauguguguucuugcuauucuagauuauuuguuuuauaaauauugauuagaugcuguugguagagaauguuuuugaguuuuuuuuccuauggucuugguuuucugucuauguauguuacuuacaguugagacaggcaugauuuaccuccuguugagcaggcuuuaagucuaaucagacagcuauuggcugcugccaagaucugagugacaccacugcacccuuaggcgugucuuguguacuggucauuguuguguucauaugcccaccaauacuucaaugcuucguccuugccagauggaacagaagucaauuucuaauuuguucuuuacugacauucugggaaucucuauuauuuccaguuucugguggguuguugucauuuuucuguuuuuaaaauaucauccuugucuuuaacgagaugcucagguuucuuauuauagccucagguugaaaauucagauuuggcuuccaugguugacaggggucagcauggaacuacagagguuucagagucugccugccgcugccucugccucuugagugcugggauuaaacaugugcaucaccaagucacaugggguuuuguuuuuguuuuuguuuuuguuuuuguuuuuguuuuuguuuuuguuuuuuugugaugcuuaagucaaauauaauaguagguuuuuuaaaagaguuuuuuguuuuauuuuucuguuguuagugauagaggauuuuggagaauggcccacuuaacaugaugcaaagaccuaggauaucagacacuuagggucaucaagaccaaccuugggcaguggcuccaaaguuuguuguuucacacuaauggagguuaaaaggcgauuaugcccuuccuggguauaggcaguguggagacagucuuuaguaagcauuauccagaaaagcaagaaagggaggggaagugagaucaauuuucaagaguugagaaaaguaucuaaggauagaaaaugugguugaauuuccuuuauccaggguuuuuuauagggcaauggcaagaaacuggacagagacugaugugauuucuuuugagauugguuaauugccugggaccaucaaagguuaaaccaauagaaggcccauauucucuguucacgucuuccccgaaccaaccagggagaugaccauguuguguugaugcuugcgcccacacaggaauagcugaagccugccucuauccaucucuuauucuggcuuaguuaucaaaauugacucauugcuagcuauuaaguuauuggcuaccauuacuaccuugcaggagucuugcuaacuguucauuuuaucaagcuuucuuuguucucagagccacuuaaaaaggagcuggaauguucuugguuagcuuuuuaucuaugggauggauagucuggggucuugucuugguuacaguuuuauugcugugaacagaaaccaugaccaaagcaacucuuauaaaagacaacauuuaacugggacuggcuuacagagguucagcccauuauuaucaaggcaggaacauagcagcaugcagacaggcaugguacaggaggagcugagaguucuacaucuuccucugaaggcuccuaguagaagacugauuuccaggcagcuagggugagggucuuaagcccaugcccacagugacauaccuacuccaacaaggccauaccuccuaauagggcuacucccugggccaagcauauacaaaccaucacaggucucuuuccugaaauagggcaaacacuuuagauaccauuguucucauuagucuauuauaaguuguguuagauacaauguuuuaaaagcaagaauauuuaauaccuaauggugucuuucauguuuuucccaaaggaaaaaagucuccuggagacuagguccugccaucacuggccuuguuucuccaagccuguauguugcuuaucagaucugguuggcuaucucauaccaggcuguacaccuucuaacuaauuuuccuuagugcuccagacucuugugguuuuaaauguuauucuuccuuuuaaauccagcuucuguucucacugaaauauuucaaaguagccuugccuuuuguccguaggcccauuuuucugaugcugccagagaaugcugucuucuucucccucacuaauagaguaucaaacaguccuauuuugguccuuugacuaggaaaagcaugauuuugggguggggggugcguuuccuuauacuuuuuggcuucucuggguugccaacaaucuucuuaaggccuggggugcacugccuucacugcucagaccgcagugcucugacuugucaccacaucccacugucucuggucacuggcuuucuuaaucaucagcuguauacuuguuuuuaaauagaaugucuuaggucuuuaaauaauuguucuuaguaggaaauauaucaauuaucuuucuuuaaaacuagaagucaccagagucagcuuuucuaagauagggugcuacucauggaauagcuuuaauaugcaugcugcacuauuuucaggggacucuuguuguuuugaggauaaaguaauaauuucucaguguguguuggaaacccucccuugccaugcaugugcuugucucuucagcuucauuucuaguuccugcucccuuuguuaugccaguccuacccacaucagaugguuucuagaucccaucagugcuuauccuucauccacguaauccugacuuccauuucauagcucugcuuucucuugucuaccugucagccaucuuuccaucuucugccugucugucugcguaugguuguucauuuguuugagacauauuuuguaacccccuacucauccauaacauguuucauuauuaacauaauuauggcuggcauugucuuuccucaccucaccaaaagagcacaagcucuuugaaaacaggagcuuuaaauucauuuauguuuuucauuuuauucacuaguauguuccaagucccuauaggguuguacuuggcucauuaaaaacccaaaucaguauuuguugaugaauuagugaaacaucauuucuucaaaacccauuuccuaagauuucugucuuuauuguguugguacaggcaagccaagcagaccuccauucucuauguagcgcagaaagggucauccuaucugggauauuuguuacugccagcucuuacuggguuccuucauguucuuuucucccacugccuucauaaauuuaacacuuaucaggcuacuuuugacauaaauuuuaaaaaccauuucccagugguggaaugaaaugaguaaaaucagugaaaaugcuguuaagaguaaagguugacccucuugcuuuggaaguucuuacccugcagagguuauuaugguggauauaugguacucacacccucacuucuguacucucucaguccauuucuccaauaccugucuaucuguucgucuauccgucccucccucccucccucccuccuuucuuccucuuuccuuucucccuuccucccuacauuuuccucuuuccuucccuccccuccucucccuuccuucuucccucccucccucuuuucuucccccuucucuccucccucccucccucccucccucccucucucccuuccuuauuucauuaucuuuuuuuuuaaaguaugguaaaaauacaucuauuaaaauguauuguuugagcauuguuuagugcuucacugaguagcauuaggcccagucccauccuguacagcugucauucccgucucuucagaacaaggaugaaauaguaacuccuuuucugcugcuucaagccucugccuucugcuuccauaaccugacauuuccagaaguguagaagugcacaggcuucguguucuguguuuggcuucuauaacuuggugcaguguucucaaggguuauucguguuguagggugugugagaaaucacucuuuucuaaaagccuaggcauguuccauuauauucauacgacagauuuugcuuuugccuucaucugucauugacacgugguuugcuguuacccuuuggcuauugguaauaaugcaguuaugaguacagacauacaguuucuggcuaguuucuuguuuuuauuuguucuuggauauauacccuguaaugaaauucuggaucauauauuguuuaauuuuuuucaaaagaaacccuguacuauuuauauagcagcuauaugguuguuuauuguuaaugugaacacauuuuaaaauuuuuuaaauaaauucauuuuauucuuauuaacucacaaauaaaacacaacacacuauuuuaaggaagucacuggaacaguccaaauuucuguccuucucagucacuuguuuucagguagcacagccauuucacuuagggauuuacuuuucucugucagcuacauuucuuccaccacacaaggaagguaaaagaugacgaaguagguauucuuuauucagagauauuuauuuauuuauucagacauacauaaauuauuugcuggguacuaggagcuauauuggucccuagaggcaugaugguagaauugaaaauaaagccauacccuauucacuguuagacucaggugcuuagcauccuucuuugccaucagagccagagcuaacaugcaagcccucacuuugcggcucuccagacacugcuagugcucuuuggugcuucuugaagaaggucugugcauacaagacaccuaccaacaacugaccuacuucauauuacuuccuuguaagagugucuucuaauuucuagaaaaauuaccauggauuuuguuaaugucugcucuuuuuuacaacauucuaaauucuuagacaacugagccaacacuuguuuuccuacuguauuucuagugucuauaucagauauacagauaguauauaucucuauauguacauaugugauuauacuguauaugucuauauauuucuuuauauagacuuauauaguaaauaugcacuuguugugugucuacagguuaaaaaaugaaaauuuaugcccccuuugauacuucuguaugaaauauaaaagguauuuuguuuucuaagugaaauuuuauuauguauaauguuaaacuccuaguauugggcauccaaacucuguauagucccuccaucuuuacuaaccuaggaccagcccugguggcugcucaguuaauguaccaacaaugaugaagaaacucaccuguugguaaaugcuauuguggaacccggaacgaggaaaaaaauuacuggauguggguugccauuuccaaaacaucuugauuaucauggugacccucuaauagaauuuauauguuccucucaaauacuguaucuuaauuaucuucuuccucauagaauuaaaaaguuuuauaucuauauuuugauaagacauugaaaauauuaaaagacuuggcccuuuacugauguagauguauaaauucuuuuaaaggauaauuaaauuacauauguggugaugggucaaauaaguagacaaaaacugcuuuuugcaauauuagauaaagagaaaaccaucccaauuacaucucuccagaaucagaaaaauuuuaucuuauaaauaaauguuaguauuuguggaguugguagauacacuuccagcaaagcacuagacucccuggaguguuuuauuucuuauaacuuuaaauauuuagcauguuagcauuucacaguagcauacuuaaagagaucuuuuucuaaaggaguaugaugacagcuauuuccuaugaaaacccaauagccugaauuacuggcaccuuagaguagacuagugguucuaaaccuguggguugugaccuuuuuagggagugucuuaguuaggguuucauuguuaggaagagacaccaugaccaugcagcuuuuauaaaggacaacauuuaaucggagcuugcuuacagguucagagauucaguccauuaucauuauggugggaagcauggcaauguguaggcaggcaugguacaggaggagcuaagaguucuaccucucauuccaacagcagcuaggagaagacuagcucucuugugguuaggaggagggucucauugcccaucccaacagugacacaccuacuccaacaaggccacagcuccuaauaguguuauucccugggucaaauguauucaaaccaccacauucuacucccuagcccacauaggcuuguucaaauacaugagucugugggggccagaccuagccauagcauaauaaaaaauacauuuaguccaacuuccaacauccucauaguuuauagcagucacaauaauauuaaaaguccaaaggucaaagucucugcuaagauucauccaaucauuuaacugcaacccccaaagcaaaacaggaaaccaacuggucagacuccuaacuccucaucuccaugucugauuuccaguuccuuucagcauugaugacugcaacaaacuuauuucucuugggcuguuucuauucuuagcagcuuugcucagcaaguaucccaugguucugcaucucuuaauauuuuggggucucuaagucaacuucaacuuuacagcuucuuguuucaaagucuggaaccacacaugaucuucugggcuccuccaacgggcuggcaucgcuucuccugcucuacccucuguagcacccucgacucugauugacuccacuccacugcugcucuguucuugguggucauccuaugguaauggcaucuccaguauuucagggucuucugcugcaacuaggcgucaccaauagccucucaucggcuaccuuuauggugccaaaccucaacuccuuuguaugaccccuucaguucugggcugacaacugcaucugaggcugcaccuucaccaauggccuucccugguuuuucacagugccaagccucagcugcucuccaugccccgucaucccuucaaaacuauuaucaccugagugauucuuauacauuaccaaguucagcugcagcucgagguacaaccuuggcuaucucuggcacacagccucuuugugcucucagaaaacacuucccagaagauuucaccucagugauauuggcuucuucuuaauugccacuaauuucuuagcucuagcuaaccagcaucaauugucccaguagucccuucucuucuugacuguaaagccagagccacaugacuaaagcugcaaagcucugcuccuugcuggggcuggaacaugaccccuguuauucuguuaccagcuuucuguuuuccaacuuucucacugccuaagauugacaguccuaaaacuugcucuguagauuaaccuugaauucagagauuugcauggcuccguagauugaccuugaacucaagagaucugcaugguuuugucuccugaauacuggaaugaaaagugucuacuuaaccuagaagcuuuaagcuuuaagcuuuucuucaccuagaauuugcucugucccaggcuggccuugaacucagagauuauuaaaauauuaaaaaaagaaccacuaagugcccucacuccauccaguuacucucugccagccaacucuccagcggggccagagcgccugaguuccccuugcugccacgccagccccguacaaugcuugucuauaccgcggucagcuccugcaacacuuagcaaccugguagcaacaaaacucuauaugcuuauaauuaacaagucggauuuauauaucaauaaauucucaauucacaagaugcucacacaauaauuuccaggccaauugauaacgguaaaagcugcccaccuagaauagacaaguuauucuaauuauucuauccuuuguuuuaucauaucuaccauuuuauucuuuaaaaaaacauuuaucaauacauguuuuuaacuccaaguacuuauagagaauuucauuucuuuaguuauauuacaucuuugccuuagguuggguuuuuggugugugucaggguggcgaguguauauguguguguguguguguguguguguguguguguauguauguauguauuuuaugcagaguaucaggcagggcugaaacuuaccauguagcccagacucaauucgaacuaaagcuccuccugccucagauucccaaguacagagauuaccacuaccugccauacccagccuuggccgguucuuuaucuauuuaaugucuuuccuuuaccucuaccccuaagccuauucauacaauuuccugcuuuuuaucuuugugagaguuacuaacucugcuuagaccauccauccuccagcuguacagaugccucgucacuccuuuuccucugcauuuggaacgcaguuuacccucacuuaguuguagcuuaaggaccgagacucuccguuuauaccugaaauugucuaucucaggaaagucuaaugcauuuuauguuuuaaauuacucucuuacuacaauuaaugauuaacguacuuucuuuccagugucucgccaacuuaaacuaauuuaauaauugggauuauuuauuugguuggcaguuagguaguugugugcaacaguuuggugaggugaagaagaucuuagugugguaauuuucaaccuauggauaaaguccuuuggcaagcccuuauuucuaaaaguauuuauuauaugauucauaacagaagcaaaauuacaaucaugaaguagcaacaaaaauaauuuuaugguuguggucaccacagcaugaggaacuguuuuaaagggucacagcauuauggagguagagaaccacuagaauagaccauuuuuaaaauauuguauauaauuuauccaaguugaauguaugucuugaauuuaauaaacuguggguucauuuuuauguuaauuugaaauaauuguuuaauaauaacuuugauuuuagaaaaauauuuuucuauuuggcaguaauuuuccaauugcuuagucuuuggcaacuuaacucagaguaugcugaaucugucuuauauaauuuucccaaaugaaguaaauuuccaauauuuuaauccaaaagauggggaaaauaaaaauuaacugcucuuucuggcuaaauacuacuauuacuuguuauacauaucaguauucugcugugcauucgcuuagacugucugucugaauuaaaguggggucuuguuuguuuuuguuuuuuaaagaagugaaucauuuggaacaacaacuugaagaagcuaauucugugagacgagaacuagaugaugcuuucaggcaaaucaaagcuucugaaaaacaaaucaaaacuuugcagcaggaaagagaagaacuaaauaagguaaacauuuaugaauggauccuuaaagcuguuuguacaugcuucaucuucuauaauuagaauauuggaaguaucccuaguaaaugacaauuuauauuuuucuauaaaaaucugaaaugaaaauuucaugcuaaccuaagauaauaauuuaaaguuuuuugaagauugauuuuauguuuaacuauguguauaugugugcuugcauagggguaugugcaccuaaauauaugugccuguugaggccacaggcauuggguacgugagcacuggaguuacaagcaguuauaaguugccuaacaugggugcugggaccugagcauggauccucugcaagaguaguaugugcucuuacccacugagccaucucucaaccccuacauuuuaaaauaaucaucuugguauaugacauucuucacuagcuagcaguaagagaacucaaauucuugggguuuagagugaaagucuuuuguucauuuggaaaguuagaagucuugacuuagaaaggaauauaacugaaaaagauuaaaaaaaauaguagggcuagaaagauggcucagugguuaaguacacugacugcucuucuagaaagguccugaguucaauucucagcaaccacaugguagcucacaaccaucuuuaaugggaucugaugcccucuucuggugugucugaggggagugacaguguacucacauaaaauaaauaaauaaaucuuuaaaaaaaaauaguagacucuaaugucuauaaaauuuuuaaguacagauuuuaggucuucaagugauauuuuauuguaguguuaauuuauguuuucuaauuucuaauguggucauguaucuuugacauauaucuauucguuauauauuuucauuauaacuuacugguauaaacacuaauagguuauaauguaaaaucacuuccaugguuuacuuauucuuuaaauaucauuuuuucaaaguaguaugggaaaaaagcuaaaguaauuuucauaagaucuuuauguaacauuuaaaugguaccaagcauagcaacaaaauuuauucauaacuaagauuauauaacaacacaauugagaagauacuauuuaagcaguggggaaaagacuugaaucacauauugggaaauacuauggguuucauuagcaacaacaaaaaauuaggacuaaugguagccuaugcaguugagagaugaguaguucagaucacaguauacauuguauuuaauggcuuuauauacaaauacugauuacuguagaaugaaguuuuucuggggguaugucuuauuacugguaaggaaauggaauuagaaauaagacaaccuuaugcugauuaaggagcuaucagagaguaaauugaauuagaugaguacauuuuuaucuuccacuuacuguagcuuugaguuuuggguuguaugacacaucugaacccaggcucacauaagagcauuuggcauuuauggcagcaguucucuuuccuuuaguaauaaguagcaauacuagugauuuaugaguuuuuauuuauuggcauuauuauauagucuaguuuuauuaacauaauaagcauaaguaucugguaucuugacuuauaggaacaugguuguuuuggcaauuuuuaguacauuuuaauccuaaaaaauucuguauguauauuuugaaaagacauuauugcugaaaaagaggagcuuguaauaauacauaaauaaugaugugauuuggauagugguuacagugaagagaaaaaaauucauuuucuuuguguccuaacgaaugcuuguuugcuuuugucuuuuauaacaaccauucugacagagguaaaauaauaccuaauucugguuugauuucucuuuucuguggugauugguuuaucuuggauagcuuuauguagcucuugaccauuuuuccugugucuuucuuggaauacuguccaucuggguccucugcuuuuuuguacuuauuuuggcaaauaucuuguuuuuaggauaauguuaaaauguuuuccaguauuguauuuuuauacucugucauguguuacagaauuuucugugcugagugauguuucauaugcugcgucuuuuucucuuaguccugucuguauugagacuuuggucuuacauaauguuuucuucuagucuguugcuuugucuaauuucuuaaguggucaaguaucucugccacauguccauucaucauuuuauguuauuucuuuuauaaaaugccuuauuuuuuuuuacauguuuuucuguuugacugucuugauauucauaagaauucuugaaaaauuucaaagucuuugauaagugcccagguuuaagaugccugccagugagcuucucuguuuacucucucugacuaaccagagcuugugaguauaauguacauuugucaauauaguuaaauuaguacauuugcuggcuuauacacuauuaggaaauccgagguuuaaaaaaaaaaacaaacuccuaacuuuuaaccuuuuuuuuuuuaagauuuauuuauuuuauguauaugaguacacuaucacugucuucagacacaccagaagagggcaucggauuccguuacagaugguugugagccaucauguaguugcugggaauugaacucaggaccucuggaagagcagucggugcucuuaaccacugaaccaucucucuaguccuuaucuuugcuuuuuaaugucugcucuuugauaauuauuucucuaaacauuagaaacucacuuuuauuuccauguugcuacugggaucuuagugcuccuuuuggucccugguccuugugaucacuauggaaagaauuccagugagacagagagacacagcacaggcuagaaguuagguagaauuuacucuagcgcaaaguacaauaccuucaaggggugaggcaggcaggagccagagacuuuauuuuuauuuauuuauuuauuuauuuaaauauaggauagaguuuauucagggcaugaggaggggaguuaagaagguaguagagguggggggaagagagagaggaaggagaggagaggaggggaggggagaaguagaggcuggccaugagcacauggagagagagaggagggaaggggauggggaggggggaggggggagagcaagggagcaagagcccaagagaacaagaaaaggauaaggccacagagaccuuuacagagcacugcaaauucucaagggaugagaguucacagugugucuuucuacacuuagguaggcuuuauaccauugcagagacuuuugaacaguuuuucugaaggguguuucauugucuaggugauugacaggccuuuuggaucagcuuuuaugggaaaggauggcaauauaucuuuguuauuuuuuuguuuuguuuugugguugugguuguuguuuuugaaggccuuuagccagacaauagucucauaaauucuaaauauguguccacccaaccagggcuagagauaugacgugaagcucauuuuuuugaccagugaucaaaaauccugcugcuaguuaugagggagggguuuguuccuuuuaaacuucaaagcugcuaauaccuaacuagcugccuaacagugugugauaagaauucaauuuuccuuuuuccaauauggcuaaccaguuauuguauacauaauaguuguucucuucucaguuaugcaauggcaccucugucauauagcaaauucuguuuacauuagcccauauucuuugauagaauuuugauugaaauuauauuucaucacugaucaguuacagaagaguuaauuguauuacacuacaacaaaguguauauauguuuauuauuuugaguauacacaugaacaagagcauggcagaugguuauuuuuauuuguauuuaguaaguaacaaccguauguuuuuugucauaguuaggguucccaaugcugugaagagauacaauaaccaaggcaauuuuauaaaggacaacauuuaauuggggcuggcugacagguucaaagguucagucuaucaucauaaugguaggaagcauggcagcauccaggcagacauguugcucgaggagcugagaguucuacaacuugacccaaaagcagccaggaggggauugucugccacacuggguggagcuugagcauaggaccucaaagcccacccccacaguggcacacuuccuccaucaaggcaacaccuauuccaacaaggacauuccuccuaauagugcuacucccuguaggcaaaacauucaaaagcaugagucuuuuggggccaaaccuauucaagccaccaaaguucuucuacaucaguuuuuaucuccuaugcaaugcucugagaaguaacuggauacugcccuuugacugaggagucuauauaaaagaagaguaaccuccaaaauauuuaucaauggguuaacauagaaggaaggggcacuacugcucuccuacuccuuuuugucugaguuuccuucggaaucugaagagaaaugucuuggaccucuucccugugccuuuggaauggaaauuaacucuucuaggucuuacuuaguccucaaaugaccagcuucacaaaagauguucccauacauaguccagggcaugugcaauguugaaaugccuucagaagguaaauggaauuuucucacuauugaaauuuguuaugaauuacauuguauggcucacauuuaggaaaggccccaguuuuagugacauuuguucuggugaucuaauuguguaaaacaugaaagcuguuuuuguccagugccauggucuuuuaaaacauaaauauuauaucuuuucauauauuuaaaaugauuuaaauuuuauaaagcacucaguuaguagcgugcuugccuggcauguguagaccauugugcucaguccccagcacugcauaagcaaguaugcugaugacuguacucccagcccaagcagugugugggcagaauauaagaaacucaagccuggcauccaggaauuggagggagggaagaagacaaaggaaaagaaugaaauguaaugaaaguacucuuuagugaaagguuuugccuuuccuaaauuuguuauucaauuauuucauauuuuaaauaucuuuaaauuuuagggcuuuuguuauuggcuuuuguuagcaguucugguucaacauugcugaauucuaauuaacaguauauauuuuuuaguucuuuucaaaaauuucuacaaauaauagcuuuguuucuaacuuagguuuuuugugguuucugucuucucuaagcuuacucuguuagcugggacgucaguauaaugcugaauagaaauaguaagaacaggcauuuuuguggaucaauuuuuuuuuaaaaggauuuauuuauuuuuuuuuauguauauagcauucugccuguguguaugccuacaggccacaagagagcaccaggucucuuuauagaugauuaugugccaccaugugggugccaggaauugaacucaagaccucuagaagagcagccagugcuguuaaccugugauccaucucuccagcccugugcugacgauuuuaaagaaaaugccucuaacauuuaccacuaaggcuuguuguauauguuuuagcaaaauauuuuccaguagauuaagggaauuaccuuuuauuuuauuuugccucucaauuuuuacuauuaagaaugaguuauugacuuuaugcaaugcuuauuccuauauaucauuuauaugauuguuucuacuuuuaaaauauaugccaaguugaauuaacaguuuuuuuaauauaugaaacacacuucugaguccaaauuacucauguaucauuugcuaaugauaauaugguagcauagaucacaauuauaucagauuguuuaauagcacuauuuaagcaccauucacgugucuauauauaacauauauuaguauguauauguauaauauguauaaauauauguauacauguguguauauauacaucuauauguaccuauacacauguggauggugcuuaaaacagucuucaauauaaugugaucuaugcuaucaauacuauguagcacauuuauauguauauuguuucaucuucacaacgacccaugaguuuuguauuguuuuauuuuucuuguuugacuaacagugagacugaacacugaacuguucgcuugccuagggucauuagugauagaaggaggcagagcuggccuuuuuauauugagucuaacucaaaagcucaugucuaggaauuuuaugcaucccuggaaaugauuugcucauaaaaaguuuuuuuuuuuaaaucucugaauuaaauuggcuuacacucuucucuuuuacuucuccuggcuuuuuuauucuguggucguccuggucucagaaugagugagguagugcuuccuucuuauuagaaaggcuuucuguuucuuaugggaacuuccuuucuguuucggacuauguauuucccauauagcuuuacuauagcaccagauuuuaguauauaugaaagggugguuuuuuaauuuuauaguuuucaguuuugaauauuucuguauuuaugauuuuucuccaugacaagugaucuuuuauaagugcaucuuaaaguuuuuacuguacauaauuaaaucguugauuuugauuucauagcuuugcauugaagcaugugaccuguauaucuguuuggaaucuacugagcuuggcuucauggcuuugguuuuaguguuauuuuaaaaguauuuaguguauauuacugaaaagaguauguauuuccaaaacagggugcaaauuucuauauauagaaagcuuauuagaauuucucaaacccuuuugcaggggagggauguaagacaaggucccacuguguagcccaggauggucuaaaccaggcugaccucacacugacuggagcccucccaggcacuggcuuuaucaguaugggcuguacuucagguugucgguauaggcauuguucugcuuucuugauaauuagugauuaggacauuggaauuccugugcugaucaauuuucuaauguuaucuaguuugggcaguuucuuuuuaauauacuuuaagacuucccuacccuaaauuuagaauguacuaaauguuagaauggucugacuuccuguugaguguugugauugcuugguaauauucuauauuccuaacaaugguuuuucugcuaaggucuagauuuuguuuaucugguauaacacaugaccuuuaccuggugaguuuggcccuuuauaucuauguucauuacuaauguugcuuuauuuuuuauuuauuuauuuauuuauuuauuugcuuuuuaguugucauacugugcuuuuuuuuguguucuuuuaaaaaaaacaaaauguaauuguaccaaaauacacauagcauaguauuuccuauuguagccauuuugaggcauuauucauuaggguuaaguauauguguauugcuauuugcuugguuauuuuuuguuuuaagcucuacuagcucugaucuuuaguauuugcauuuuaucuuuacuauccauauuaacaaaaucuaaaaauauuaacuaguuacugaaauuuuucagugccucuaguuguguuacuucuuucccauuuaugugugaucuacacagauauuuaguauguauauuuauuaguaacuauaagucagacauuuaauauaauguaugacauuucuuuacauccauguguacaagguucucaguccuugauuggcugaguguuccauugucagucuccaaccuucauccugggauaaagcuguagacucccuuuagugcagaucugauaguggcaaccucugucaguuuucacuauacuuuggaaguaauuuuucugaguauacaguauuaauuucuugucucuuagaaaguuuccccacucuuccugauaccacuugugacuucugaauuugauuaucuaauuuuuguuuuucugagagcagaauauaacggauuuuucccacccauuccaacuuuaaaaaaaaaaagauguauuauauuuguguguguaugcauguaugcacaugugaauauucacaugcacauaugugcauguguuguuguguggguguagaggucagauuaacaauuugcagaaguuaguuuucuccaccuucugagacccauugaucaaauucaguaccauuacccaccgagcuauccuacugccucuccccaauuucuuucuuuuauuuauuuuuuaauuuuacauggauggguguuuuguuggcauuauuuucgugcuuggugccuaaugaagcuagaagaggacauaauuucucuuggaacuggaguugcaggugguugugagcuaucuguccuacauggguacuggaaguagagcccagguccguggauaagcaugcaucuagaggcaacugcugagccaucucuccagccccaaauuuauuuggagauuuuaauuuuuauagugucaccuaguuucauucuuauacauuucugguuuuagguuugguuuuccuuuucuugacuuauaaagauucauauauguauauguauacguauuuuugcaugucuaaaugucuuucggauucuuuuauacacccgugugauaguuuuuccuagccuuuucucauuuucacacguuucugaugacuccuuuuauuuccccaucggucucauacauaccacucuguugguguuuguuuucguuuccuacuguugccauugguuccuuacagugguuuugaucuuugguucuuuguaaaucuguggaugucaacucauguuuguuugcuuuuaaugugugaauaagccaaauuuccuuccuccaaaggugaugcacguuuccuucuguugggaggcagggaguuacacugaccugagucugcaaagcaccucuaaaucaggaaucuaagaucagggaauugaucuccauguuauuugucuugggcuuauuuuucucaggaacaauagacauccacuuauuguuuguaauuauucauuuuaauuuaaaauaaccucccaaauauuuauuaaauuuuacaaaugauccugagcaucccaguuuauauuucuacauucuacucugucagcuaucucuuugcacuugccaggucaguguacaaauuugcgaguugggacuaguaauggcucacugauuaaaagcaccaacugcucuugcagaggauucagguucaguucccagcacccaugugccuauaaccuauaaccuguaaccuaguuccuggauucugaagcccucuucugcacuccacagguucugugugcacaugguguauauauauaaugcagacuaaacacaaauacacauaaauacaaauaaacuuuaaauaagaguuugagaagguaaauaagcuaucauugcauucccuuacugucuuuagaaguaguccauuuccuucaguauuguccugagguaaauaauuuuggcucuucaauaacuuaauaauagcuacuuugauggccaaauuuggucucuagguugcagacuugguaacauauuuuuuuuuauauaaaacuguaggaacuaguccaggcuagugagcgauuaaaaaaccaauccaaagagcugaaagaugcacacugucagaggaaacuggccaugcaggaauucauggagaucaaugagcgacuaacagaauugcacacccaaaagcagaaacuugcucgccauguccgagauaaggaagaagagguggaccuggugaugcaaaaagcugagagcuuaaggcaggagcugcgcagagcagaaagagccaagaaagaggucaguagccaggcaaauuccaaagugucuguggaguagugcuuuaaacuacacuuagacuaguuaaguaaugugcauuccagucuuuaaguuuugaaaaaguuauuuuguagcuugguacuauuaacuacugugaaucucgccauucaagcuauacuaaccaugaaaucuguauauuuccuuuuauguuaaagcuggaaguucacaccgaagcucuaauugcugaagcaucaaaggacaagaagcuccgagagcagagcgaacauuauucuaagcaacuggaaaacgaguuggagggccugaagguauuguugagguuuauggcuccuagugaauuuucuucugcauaagcuuaauaugaguguuggccuguuaacucuuugaugaagagugaaaacuaccuaagcuuccaagcgaguauucuuacuucucacuccuacuaguaggaagcugauacacauuugcuaaucacauucaguuguccagugaagagucagaauucacacaugacugccucccugaacauguuggccuggcagucugcauacauguggaauaagauuccaaagcuccccguaucuaucauguuuuucuuguuaugacaauaucuagcgaaggcaaauaaggaaagaaacaugcauuuuggcugacaguuuaaggguauuguuuaucauggcaaggaugguguaacugcaguaucuuaaagucauauugcaugugcagucaggaaguagaaagagaugaacacuggaacucaucuuauuaccaaacagagguaaacauccuguccuuuuauucagucuggaaccccauuuaggguaggucguuagguuuacccaaucuagaaacucgcucaugagcaugcaccaagggguucagacagaaugcuaacagguugagcuacaaaauaaucucagugaauauaaaaagauugaauucugcaaagaaucuucucuagccaugggggaauggagcuggaaaccaacaaaagaaaaacuuugguacucaaaaauauguggauguuacacagcacacccugaaacagccagugagccacggacaacacaccagggaauuaggaugagauuggaggcgcaucaccucagaacuguggacauuguaaggccaaguucccagggagacuugugccuguuuaaagaguuaaagccucaaaucaguaauauaaugaagcuuuacagaacagaggaggggcuggaagagcaagcuaaacucagagauaacagagggaaagaaaacccuaaguagagagcuggggguugugguguauauacuaaucagugcacuugggaggcagaagaagaaaaacaggagagccaggucauuuuggguacauaguugaaagccagccagggcuacaugaguuucugucaaagaaaacaaaacaaaacagaacaaaaaaaacauaaaaacauuagaucaagucaugagccucaaacuuuauuugagaagauuaauacaauugaaaacccuuuaacuagauggaacagaaaggggagagagaagagaaaagggaagaugcagauauuucacaugagaaacaaaagugggcauuuuacuauggccagcaaaaaguaagagaacuacaugccccuaggauaggugaccuaggugaagugagugaccgaaagugacucacagugacacagaacgucugcauggaacugcauagcuaauacaaagguugagugggcaauucaaagucuuguaacaaaaaguucauugccagacuucccacuggugaacugaaccaaacauuuaaaaaauaguuaaaauaagauuugcuguauuuacuacuuuaaaauuaguaagguauaacaauaauugacuuuuguagcuuaagugguugaauuaugugauaugcaaaaauaucaguacguuuuuaaguaucacuguuguaagccuaauaacugcuagcauucuguaccucuaauguguuagcuugcuagggcugcuacuaauaccuaaugaccucauuuaacucaauuccuucugaaagacacuuuuuaaaucaggucacauccucaauuacugggucuucaacauaugaauuuugggagaguggggauauauguuaucaucauguuuaugugugauauuuuuuacuacuaaaauauuuuuauuauguuuucuuaaugcuugcuuuaauaucuagacuuuuugcuuaucuuucacugucauuuuaaguacuagaauaucauuuggauucuuuuuuggaaaacaguugcauggauguaauauuuuuuaguuuuccuuacaauauucauuucugcuaaguuuaauaugcuaaucagaauaauuaaacuuucugugauacaagacugacauccauucuguugauaauauuucugaauuuaaugaaugaauuucugauauuucacuauuauuauuuugucugauggcuugaaauacuuaaaccugaaaaacuuaacugaguucucucauaguuuuauugugggacuugaaguaauacuuugaauuucuggauuuaauuaaguacuuacuaaaaucaaggguagcugcugagagggucauucggacuuucacccuguugaagcagugcauuuauuaauguguucaguuucuauuguuacuagcaagaaaacauuugcuuuguggcagguuggucguuuuugcuuauuauuuaauuucauuuucaguguuuuauuuggcuuuugaauucuuucauaauacaugauucaucuguaauuuaaauuagugaucucaucaaguuuuaauuucaggcgaaauuuucuuugaaacgucuuaggcguauuuguugccaucccaacaagcaacuagcagagcagcaaagauguucuuaaugugacuagaguugugaaaugugacugugugucuguggggcacagacaguggcucuucagaagugcugcuucacaugcgaaaaggcaugugaaggaaggagaugaauauguuaacuggggcuggagagguccugcuuaggagcgcucacugcucuuccagagcacccuuaguugguuaccaguauccagauugggcagcugguaaucgccuggaacuauagcuccaggagagugagcauccucuuccggccuccauagcacauacauaugugacauacagacacacaggcacacacauauacgcauaaauaaaaauuuugaaagagcaagaaucugacuuccucugacucuuccguucaagcaguuucacauccagaaacuuguggauagucuguauuuggcucauggcaaauauuccuuagugaguggucacacugcagugggcacccucuaccauugccucuggcccacacuaguuccuuuuuguacuauuuaaauuauguauuguacauguguaagagagaugguguuuaucucucuacaugaagucaaucaacagcuaccaucaguugacuuaguuaggguuacuguugcggugaugaaacacuaggaccaaaagcaauuugggaaggaaagaguuaauucggcucacacuuccacaucacuguucaucauccaagaagucaggaugagaauucaaacaggguaggaaccuugaggcaggagcugaugcagaagcuauggagggugcugcuugcugacuugcuacucauggccugcucagcuugcuuucuuauagaacccaaggccaccagcccagggauggcaccacccacaaugcacugguuucuccccccaaucaauucagaaaaugcccuuuaggcuugacggcauaaucuuucggagauauuuccucaauugagguccccuccucucagaugacucuaguugacauaaaacuaucccucacaccagcauuuuugcccuaaugucugguuucccccaaagaacaugguguccuucagcuccuguucucuugcuguaauauguaauaagccuauauaaguauguucuuuuaguuuuaaaaauucuauugcuguauacuuggacaacacuuuagagaauaagaaugccccuaagaaauuaaaaaaccugagaacucuuagaauuucuagccuguguguuucuacuuauguguagauaacuagcagagccuucagacugcauagcuucucuuucuuuuuaaaauauauuuuauuugagaauuugauauaugugcacaguauauuuuaaucauauccauucagacugucuccuucaaacuccucccagaaucucucaaggaaugcccaugccaacuucaugucuuuuuccucauuacccuacugaauccaguuagugcugccugcauaugcauauguaaggccacucaccagcaagggcaguuuaccagaagcaagacuccugagguaaacugacuauuucuucuccaauagcuucuuaaggugugaagccuugugaaccgcgccuugaucugcacuggaauuugaggugacuuggucuugggaaggucuuggacagacagccacagcugcugugaguucaugagcacaaugcccuguuguguccaggacacuggugaagggcucccccccaucugucuguuacagaccuccuccuucucuuccuuaacgcggucccuaagcccuguggagagcaguaugauauagagccgaggacuucacccucaauuguucucuguacauugaccagucaagagucucuguauuaaccacugcccacagaaacaaagacucuuaugcagugggggcugacagcugcauggguauaaaggcaaguauggagaagacagcuugauguccauuuacaagacuguagguuuucacuggggccauguuuugggccauguuuacaguacuaggcaagaguuccauuccaugaaucaggccuuaaauucagccaaaagaguaguuaguuacuccuguaauauucaugcauccuaaguucuaaaacaaggcauuuuaaccaaaguuuuccuccuuuggcugggcaugauggcugucuugguugguuuuugucaauuuaacacaaacuuagacauaucuggggagcagggauauuaaucgagaaaaugccuccauaacacuggccuguaggcaauucuguggggcauuuucucagucagugaucgaugucugagggccuagccuuaugggcagugacacccucagcaggugguccuugguucuuuaggaaggaagcaggccucuuccacggccucugcuucaauuccugcuuccagguucuugccucgacuucucagagaguucuaagcugaaauaaaccguuuucuccccaguugcucuugaucaugguguuuaucacagcaauagaaacccugacaaagacaguagcacacgccugucaccccaguacuuaggcuuugggagcauaaugaaugugaggcuagccuggacuacagagugaguuccaucauggucuaagugagauucucuauuuuaauguuuucccuaaaaguuaagagacuugcuuuuuccuaauguagauauaaagauguuugaccuuugagauuucuuucuguacaguuacaaacaccuaacaaccaugccuucccccacuuuaaucuuugaaagacaugaacauaaugcaaccuuuuugacuguuacuuauuacauauaagaugauagauuuuuuuucuuaaacauauaucaacaauaauccuagacagaaauuuaaauguugugcugcuuaguuuucaucaacuugauaugagcuagggucacccgagaagaaggaaccuugauugagagaaggccucaucagaucgccuguaggcaagucuauggggcauuuuccuaaugaaugauuuauaugagaggcuucagaucacuugagguggugccuagucaggugauucuggguagcauauguaaauguaaccauggggggagggguauuucuaugccccguuugcucccaagugauggcaagguguuucuauacccacucuagcccauuucagcucccaaauaaaugacacagagaccugguauuuuuguaaaaagacuucaagcauuaugcugggcacauucugagcuauucugagcuauucuaaccuagcuauguugugaacauuccagccaugugaucuuuaccugcgucggaaucuugccgugguucgcuuugguccacauuuauccucauaguuguucuuucaucacgaucuuauggcgaaucccccggucuauuucuguagucuuuccaccucccuucucucccuuucucuguggucucuuugggacccccugacugcgauuggaaguccugccaucuucucuucugcccaucugauuggcugaucagcucuucauuaaccaaucagagguaauggagaacaauuuuuacauagcacgaagacuggaguacaaccaaauguuugagcauagaaauuaauaucuggaaacacagcacacaaaaccaucucccaaaaggcauaagaaaucaggcugagaaagccaguaagaagcacuccucugugguucuauguuaguuucugucagcagguuccugccuugagcucugccaucacauccuuccauaauggaccuguaggauguaauaagcccuuucuucccuggguugcuuuucgucaaggcccuuaucaucgcaacauuuaaacuaggacaaauuuaaaucaagaaaucauauaaaugccaacaaaagguuuaaauuaauuucuaaccuuaauaugcaggcuuucuaaaauaucagugaugcagacuaaaaaagcauauaaacagaggaacauuauuuauaauauguggcagagaaauaaauaauugccauauacauuuuugagugagaauauauagauaaaugauguaccaauauagucccugauagaaaggacuuauuucuuauuuuauuucauuaaucuuuuguuauguauauagcaaaaacaaauuaguuacucaccaggaauaugcagcauagaacaucagcaagagauaacuaaacugaaaacugacuuggaaaagaaaaguaucuuuuaugaagaagaaauuucuaaaagagaaggaauucacgcaagugagauuaaaaaccugaagaaggagcugcaugacucagaaggccagcagcuugcucucaacaaagagauucugguuuuaaaagacaaauuggaaaaaaccaggagagaaagguaagaaucaaauuuuuucucaucuagcuuauaucuauuguguguaugcugugugccaagcccuaggaaacucaggcaguagucauagccaaguuucagcagggaaaagucaagacugcuaaacaggcaguucuagugcagcauggugggagagcaguggagggaaguguagaagcagccaagaggcgcaagaaggaccuuugugaacuguccagcaagaagugugcccuagcugcaccuaaagagcaaggaaggaguaagcagggaagggcccaggaagagguggcagaaugugcuaggacacaaaagaaagagaaugucacacagucagaaaacaaaugcuacuuacugugguagauacacauagaaaaacaggaguaauaagaaaugagacuaugaaagaaaaaaaccacacacccagguaaaguugugaauuaauguaaggccuuugcauuuugucccaauggaucaaagggaaauuacauaacagugcugcuauuuuggaauggucacuugcuacuuugugcagaaugauuuagaagcaucuaaaggaauccagcuagaaaacaagacaguaguccauagauaguguugaaguuggaagaaggggugguagauucagaaauucugcagagaagacugacugcaggacagaaggggguggcugugagaacaagagcagaggggucaucagcacugagguuccgggucucagacagcugaacagaugucagcaucuguccuuguuaauuauauugaaggccacauucuugcaguugggugcauucuuaacgaaugccaaguacugcugugguaguauaggagcaaacagacugcgcagagucucuguccucacugagccugcucucggugaaagacaauaaagagaagagggguagagcuacuacaacaugaucuaugccgaaaacaaaacaaaggagggaggaggagcucgcaugcugggggaaguuuuacagagagguggcuucccaguaaagaauaaauagaguuuaaguuucugcuacuguguaagagcacuguacaccgagaagagcccgcucaucuauucagaaguccugagcacacuguggaguacuaagcgcucaugugacugccccaccuggggauccaucccauaaacaaccaccaaaccccuucacuauugcauaugccagcagauuuugcugacaggacccugauauagcugucucuugugaggcugugccagugccuggcaaacacacaaguggaugcucacagucaucuauuggauggaacacagggcccgcaauggaggagcuagcgaaagcacccaagcagcugaaggggucugcaacucuauaggugaaacaacaauaugaacuaaccaguacccaccagagcucgugucucuagcugcauauguagcagaggauggccuagucggccaucacugggaagagaggcccuuggucuucugaagauucuaugccccgguguaggggaaugccagggccaggaagggggaguggauaaguuggggagcagggcaggcggggggugggggagcuggaggggagaguauaggagacuuuuggagagaaaacuaggaaaggggauagcauuugaaauguaaaugaagaaaauaucuaauaaaaaauuaacauuaaaaaaguaagagcucauguaaaugaguuucagaugcuuaguaaaugcggagcuuuguauguggacgaggcugguuucagggugaaauacaacucggggugucucucucucuggcguuaaugcugucaucugagugugaucauuuggagaauaaacauagauagaagguccuuguacugagcccuggggcaucccagucuauagaaacugggagaugaggaaggacuaucagugauucaggagaaugacaggaagaaaacaggcaagugugauuucuugggacccugaucaagacagcacauccagucugucaguguauaggcuaguaugaggucugaaccaagggaagaacuacacagugacaugugcacuuagcaucauacacuuugguaauaagugucaguggaaaagugaucacaggaaggcguccugagaggagccaguggaacagugugcaaguaacacuggugcuuaaaguugucccugcucaagcaagcaguuuaucucaagucacuuugcuugguggugauggugggguggggggugacguaguaaugauaacauuuguaaucugacagaaaguagcccaauagaugguucagcagauugggaggaagguccuagagugaugaaaagaccagccccacucagcaggcauaugcaguuuuaccuguagaaagagacuguagaguauaugggcucccgugaagucagcuaggaagguggcuuugguuuuaguguugaguugggaguguugaaugugaaaugcucaggagacauugaugugugggcuuggucaucaguuuaaagcuccagcaaguucccaauauagaucucacgauccacuggcguagucgauaguaauuggagccaggggcugaggggagaauguuuggagaggaauugagcacuugagguggcguucugaggagcacgagcauguacagggaggcaaaaggagggcguucccuaaggcagaugggaagaagccacaucacugcuaagguagauuggaugcuaagguagcacaggagaguucacagaaagguuugguuuauuuaggugguggaggcagaccucagauucuaacaugacaugcuuauugucauugugaauuuuaagacuaaguuuguuuaaugcuauuuuuaaaaaagaacgguuuuacuugagacuuugcacaguuuauuauuagugaacauguuuuucugaaaagcuucuaugcaauuucauuuucaaagggguuccugugucaggaaagauucuuuaauauaacuaaauauaacauuuugggcuuuaaauaacaccgugacacauuugcuugcgaacuggauuuuucuccuugaauuuauaauuuaaguuauaaucuaucuuuuguaaucagauuuuauugauguuggagucacccauuauuuacaucuuuuacucacuugaaaacaauuauauaaaauuacugaucugcucugaauuuuauuuuguuguugcuaacaucuucuaucaaguugucauggacauaaguauguuucucaacaugacaacacagucuucagaaauggguuccccuccucucuuaagaggcauuuagaaugguuuacuucuaaacaguuguaaaucagucuugccccauaaauaugcuuuauaauauuaucucugugcauguuuguaucuagauguaggcagagagaagggcuggaucauccauugacuaaaagcaugugagugugauuuccaggucaaaggaaaggggugggaugugggcggcccagcucuaaguaaagcagcaggcccagcagucagccagaaugcuggcguuuucagugaagucacuucuggugacucagaggacaccugccauggugccuguugagaauguuagccucccucucacuguggcaagacaaguguccucugaguguucucgggagacauuguagagaguggcuaagcaacuaggaaguagagccucucaagcauucuccuugucugagccagacagacacugcuaugucagguaauucucaugugaagcucacugauucaggcuagcagugaaaacacacaucuaauuauugaaucaauguauugaaccaccaaucccaaauuguacauugauuaaucuuggcucuauuugcucuguccauccuuggccucccacucuuggaauucaugugcauuugcuacucccugccuuucccuauauaaauggacagaaaugucugugcuucguuguauaagucuucucuuucacaucugcacuuggucuuggcugugguccuagcucuuaugcuggggccugaagaugacagacuugcagauaguuagcaccccucaucuggaagcagcugcucuuguggugaugcuaaugagaggcgcagaaugcucuuagcuuuagcuguggcugcacacaggcucuuaccugucagugccugugccuucuaaugggauaagcugagaagaaggcagugcugcacacucaugaccucagacaugacggccaggugagggccacccuacacaguuacgaggccugcacuccuuaaaacuguugugagaccuagaaaagacaaacuacguuggucagagggaaaaugagaaagaaacugccaggcacagcccauguuuuuuaacuggcuugggacuagauaagaagcagacagcaucaagcugaugggaaacuuaaauugggaaaaagauuugguaguagugcuaauugggacaggugcuuauagaaguuaagcauguacuugaccuugagaauacagucuggauuuuauaggucagaagaauaacaucugcaccugccucuuaguuggucaggagaauacuguacacacagauaaucuagcagcugauggacagagcuaaccauuaggacaucuaagaaaagagacgcagaaguucuuuguauuauguuuguaacuuuucucuuacauugaaauuauuucaagauuauuaaguaugaagauucagauaauuauuaauuucuaaguauuaaccauuuuuacugaaucuaauaagcuaguuuauucugauuucuauauauuugcuauuuaacuguuacacaaauauuuuuuucaguugacuuuugauccaauuccuuuuucugauuuuuuguuuugaauuguguuagucaaagugaaagggaagaauuugaaaaugaguucaaacaacaauaugaacgggaaaaaguauuauuaacugaagagaauaaaaaguuaacgagugaacucgauaaggugagugguuggaucuccuuuggucaagugugugcugggugugaagcacugugguuuauuccaugauugucacuuuauauugcugugauauuucaugguggcaguguuucaaugacaaauucuuacuauacccacuuguaucagucuuaguuuuacuccucccauaguuuuguccuccugaaucucaccccaucaccaccuuuuauuugagaaacugucauguagcucaggcuggccuugaauuuauuuuauagcugagauuauccuuaaauuacuaacucuucuaccucuacuggaauuauagucaugcaccaacaugccagcccauguguguguguguugcauauguaugugcauguaugauagauggcuguauauguauagagacuuauuacuaacaauaaauuaacuaaaguuauaaacugacaaguccuaguaacuguagcuggcaauguugaaaacagggagccuuccagugcauccgucagcgggcucaagaucgaagacuuccuguagucucuccuugaacacgguuugucagauuccuucuuccuggaguguuagggaggauaaucuacguuauucacuguacugaccuaaaugucaguuucacccaugaauauccacacagacuuauucauaauaagaauugaccaaauauuuggacuccucuauuccagucaagaugacauaaugaaauuuaaaacaaugugauuucucaucauguaaacaguucugugaaaagcuuuuucuuagaaaaguuaucagaaguuaucaacauuacauguuaaaaaggcuggccuagggugucugaaaauguacaaggaagaaagaaaugcagcaacuaaugggaccauuugucaggaaaugguuggauaguaguagcaugagauuuuuuuuuuaacuuaagaaaaaauuuuaacauaauauaucauauacaugaagaaaauugccaggcauaccaacaaacccacacaaaucacugaaaagccagcagaaacauaaaacagcacaaauaaaauuacaaaaugagagggaacacaaggcagucaguauaaacagagguaugagaguucuccacaugcauguuaaaauaacuauauuauauguccaagaaaggaaaugaaguaaagaauuugcacaaauaacuggauuuuauacagaauaaucaaacagauauuugaaaaauuaaauuaccaaaauacuuaaaagaaaguuuuaccaacauaauggaaacaguaaauacacaacuaaauaaacaaaaaagacuaggguuggacagggcuucaaaaaaugaaaaacaaaacaaaacaaaaagggggacauaaaagugugagagacaugaugagaagaacuaacaugcaaauauuuguuuucucaaaaggagaggugggugagacuguuguaggagcaauguuaaagaaugaaugaccuagauuguguguguguguguguguguguguguguguguguguguguguaaaugccagaaucuauaaagcuacugagucacaacacugcccaaagcaggaaccaauauauaggauccuaaaagcagccagagaaggcacauguuacucagagggugaaagacagaacugaaccucaguaggagagaaggaaagaagcaaaccaagagaaaagagaaggcacuuucuaaacacugaaacaaaguaacuacccuuguaaauuguuaaauguugaguuucauaaagaaaccugcaaauaaaauaaaucaggcaugucaaacaguugugucacauucucaguggaucaugauuuaacauaagaaaccuagguuaggguuuuuuucuaaauagaaguuucaacaaugggaaguugguuuucaaauguuucuaugguauuuguguguaugugcaugcacagguagauguagugaagacuagaaguugacaguggcuauguuccucaguagagauuucucccccaccccaccccuuuuuaaucuaaggucucuagcuaaaauuggauggagcucacugcuuaggugaacuggauggacagugagcaacuccuuacuccacccuaugcugggguugcagaugccaggugcauccugcuacauugucuuuuacaugugucugaggucagaacucagguguucauacuuggcacaacaaagauuuauugacugagccaucuucuaagccccaaguuuaaauuuagguacaaaauguuuauauuuaaagugaaagagccucauuuuaaaauaauacauguuacagcuaauuuuguauaauaaaaauacaguuuuuccuggaauaugagugagaagauuacuguuggggagcuggggugggguugaagcugugugcuggacucuugagaacacuugcaguauccauuucuuuuacuguugaguacauuauuuauuuuauuuccguuucuucauucuuuuaaacuaguauucauuuauacaguuuccuuuuauauuuuaaaucuuuauuuuuauuuuauguguauagauguuuuaccugccuauaugucuauacaucguguacacacagugucuauggaggccagaagaggcuguuguauccccuuggccagagugccaguuguucuuccagaggaucuggguuugaucgcuagcacacacgugguggcucacaaccaauuuuguaaugugcuuguaacucuuuauaagaaguuuauaaguuaacaggacauuagcaggaagggaggugggaggagggcagaaggaagaggguuuggcaugaggacuuggguaauuuuuuucaaguugaugaauauucauuauuaagaccaauuucauaaugggcuuggcaaaaggcaaagaaagcaggaaauuucaaaggauucauuguuuccaaauucuccagugcggccucagugugguauagaauaauaaaaagacaaacaauuugaguugaaaguuaugcauuauuagauggaauaacgggugucuaaguacuguaguaucuuguugagacacucacgccuucaaacugccuuccagcugacuucacuguaugagagcuuaaguuugcgcaaccagcacuuagaagaagaagucaaagaucuagcagauaagaaggaaucaguugcccacugggaagcccaaaucacagagauaauucaguggugagugcccuccagagugcuguugugggggugggguuguggccaggguugcugugacugaguuccugacaaccuuggugucuuccguugccauggagauaaaguuacuuuaagcuuguaaaaaugggaaaguaagccuuuaaagaacguccaucugcuuuugauauucccuaagaucaaaacuccauauuuaugguuauuuuaagaaacugauagccugagaaaaauguaaaagaugagcaauaccguguuuguaaguauaacacagcaguucacauauggcauuuuuaaagucuuaaaagauuggagcuuagauucacaaacuauuuccuauacucugaggacuaauuuugauuauuuggccuauaaauuuugucauuuuuauuuacuaaaugauuguuaccaugcuuauaaagguuugcaucuauuauacuacauggauaaagaggaacccagugaagacuuuauuucuuauuaacuuuuauauuuauuuaaaucuuuacccauuuuaaccuuuauauuaaaauagcuaguuccuuuauguauuaucuacaaaccaguuuauuacuuauugaggguuuuaauuuccugugauuauaucagcuuaaucaguuuucugcuuucccuuaucaaauuucuaauacacuucuuaaaccauaacccaaauaugucuaugcugaccuaacuguagaguucuuuugauaacuaaucuuugcugacauaugugcccagauuguggaaauuuacuuauguuccugaaaacagaacaguugguuuguuaguguuuaauuccuaucuacaccauuggauuuguauuucuaaagggaauuauuuuaacauuuggccaaguuuauaauggagcuaaacaguaauaaaggaagagcuggaaaauggcauuauaaggcgguguuuccaaagccuuugagucccaggccaccacucuauguuuaccagugacgaggacaguggggagugauccagaugaaggaaggauuuuuuuuauucacuuauucauucaguaacucaguuguucauuuuuaaagaccucuuuucaccaugugcucauggcugaccucaaauucuuggucuuccugaagaaaaacguagcagcaucugaacccugcagugaaguaacugccaucugaagaugccaaauacuaaggguucuggagaagcauaaaugaaaucaaccuagcuuugucgugaagcauuaugcuguauuuauuuauuggcccguaauucaguuugaaauaacuagaaauuucaacaguagaaaauuucuuguuuaaaaguguguaugugugugaguagagguaggcuggacaucaacuuuggauuggauugcuucuucggucacuguacccuuuuuuuuaaguauaauuuaacaaauuuuugucuaaaucauacugauucuuauuaacuucaugaccuuaagauaauaaauaggaacuggacuuggauuucuuuaagcuuuaacguuaauucuuucauuauuauuuaauuaauauuucuagaaaacagggaugcuucauuauaacccugauuucugcagaauaucauauuuaaaauuuucuaacuucagcuuuaaauaaaauauguauguuuugugagauaaaauauaagaaucuagauaaugagaaaucuuaguagucuucagaaagccuuaugcuuguccagugugagaucuaaagggccaucuuuugugguucauggauuauuuacugcuugucagauguaaguaaccugggcuucccuaaacacugccagcuuccauuuguacauaacugaguaguuaauaaaucugugccuacaucuugacagguagccgucauaguguggccagucuuuuaaaggaguucuuugaguauuuaaguuuuugucacuuguuucuuaaugaagcuuuaaauuacauaugucacugaaguuuuccuguguuuuacuuugcacuauguccaccuuuguguguguguguguguguccucuagggugagcgaugagaaggaugcacgaggcuaucuucaggccuuagcuucuaaaaugacugaagaguuggaagcauuaagaaauuccagcuuggggacacgagcaacaguaagcaagcucugccgucucacacagagacacaucucuugcuggcagaaagcacauauacaucugacuucuguaaaaguucuugugagaaauauuuuagaucuuuauaagaaaauauaacauauuacuguuagcucuuauguauagcuacuuauuauugaaggaacugaaaaggaaaaaacaauuauuuguucauuuaugcauauuuacugauauuucuggauuuaaugaaaauguauuuucacaaguugugcaucaguucuacucaguuaucagugauauugcuuauaaaauagcugcuugauucacuuguauuauaaaauuuaaucuuaagaauaaaauagggaacuaagacauagccauauuauucuauaggauaugcccuggaaaaugcgucguuuugcaaaacuggacaugucggcuagacuagaguugcagucugcucuggaugcagaaauaagagcuaagcaggccauccaggaagagcugaauaaagucaaagcaucuaacaucuuaacagaaugguaaggaccaaucaucuagucacuacaguaguuuauaaacuuguugauguuacguguuucguugccuguuaaggguuguucuuuguuuguuuuuuuaagcaaaaaaugaugaccagaagacuaggaauacaauucaguaguauaaugcuugccuggcaugcccaaggccaaacgucugccccaccucccugacaaaagugaggaacagguuuagggagauagcugucauaaaagugcuuaccuuauaagcauaaaagccuaaauuugagccccacauuuaaaaaaaaaaacaaugcugagagucauagcaucugucuacaauccuagggcugaaaagagagaggagaguuagagggagagggggagagauggagaauuccagcucacuggccaggcagcuagccagaucagugagcuccaaauucagugagagacuuugucucugaaccuaaggugaagagcuguugaggauggcacugauguuacccuuuguccugcacauuuguguacacacaccagacacacacgugaaacagugaccacaaaacguugucaagauuugaaaagcaaagaugugacucuggguagcaccucauacagccuuguuuuuucaggcuuuccauagaugagcuauuaguuuuaaauaauauucuauucuuuauuguucuccucauauguaaaguuuaguuaacucaauuuuuuucuauucaaucuaaaauucucucacauucuguauagaauaaaacuuguagccagaacgaaauacaaauaucuggagauugggaccucuaccauaggccuuuuacaaugguuauuuuagugauguuaaauuuuguggauaauuguuuguuugggggguugagauguuacauuuuguaaaggcaaaauaauuaggauuauuuucaagguuccuuuauuuauuuaaaaauaagcaaacuccuaguauccagggcauuuggcuacuaaacauauccccuugguucuugucauaacaguaacacaaauucuauuuuugauggauaaaugaugaaacaaaaguuuuuaauuggauuagauauuaaaaugguucaaaaauaaaucacaggacuggacagauggcccagcaauugagcauucucauaguuuugcagggguccaagguuugauuuucagcaguuauaucacaacugccugucagucuaguuccauagaauccaaaacauuguggccuccuuagggaauguguuuucaugugguacacauaaacucauauagacagacagacucacacacacacacacacaugaagagagauaaaucucuaaaucaguuagugaauaacauuugaacaauaguaaguucacaguaaaaacaaaacuauaaauuuaaaaauucuucuggcucaaaaaagcaaaacuuccaaaagcaugagaagagacacaagacugcaggcugaguucugagggcuugcugccuauacacacuccuguugaguucuauacacuguugauguaaaugacacaggcaugcauuauguuuuaauuaaauaugcuugugaagcacugaaagagaaguuguucuggagaauaugaaguagaccucacauaaagaaugaccgaacgccagagugaaugucagcuuccucuugcuuuacauugcaguuuacauguuugcucauaaagcagagcuaagucagaguggaagucauacacgcguguauaugcucuagcuccacggugauguaugaagaaagucuaacaggauucucaaacuaaccauguaaucauucagcucagggucgucagguguuucuacaacggcacgugcagccucugcucaguccuugcucacaguguggcagcagcaguccuguccugagucuugucaugcgagggacugagcuagggcuuccuucacacagccaggcaaguccucugcuacucagcuucaucccagaccuggaagccaccaucuuuaccuaaaugaaugagacuggcuugcuuuauuaauuuguauacuagcggguggcaggcugcauuugucuucaugcaauaguuagcagucuucuaauuuagccucacagacauuuaaaccaaauaagcccagcuacacaaaacuaaugacuguuuuccuuucccugcuuauuuaaguaaacugaaagauucagagaagaagaacuuggaacuguuguccgaaaucgagcagcugauaaaggacacugaagagcuuagaucugaaaaggguaugagauuguguguuugcaucagcgcuugcuguacugaguggccauuacugcagaggagccagcuuacugcacagauggagaagucuauacguuagcaaccacacaugugcacacccuugagaguucauacacacaugcacacacacucaaaugcguauauacacgugcauagacuggcugagauauuagguauuaguuaauauacauuauauuaagaauuuuaaauuacagaaaugacugcuuugccaugaauuugacuguuuuuucaguguuaaaauauacuucaugaguaacuuuugaguugggauaaaaguauuuugugauguauuuauaauguucucacauaucauaugagguagacacuucaacagugguaacauuagaacuuaguguagaaacuugaaaagggagaaguugauuugggggcagagucugguugaauagcccaugguguucuugauuuaagaauccucuugcccacuuccccagagugcuaggauugcauuuauuagcacugucuauggaccuacaguauacaaaaucuuauggguauaggaaaaacaaucagggaaacaauauaaaacucaagauuaauuauuuuacuaaugaagaauuuuuggguguuuguugucuuuuuccagguuggcugaugcuuacauuguuuguccuuuuugauuuaccagauuuacuaguauuuuuuuugagaacuuuuguucuucuuuuuacauguaccuagcucagcgcaugucauaacucuaugauauaaaccucuuauacaauuuuuccauaauguggacauuauaagggugaugauuuaguaaaaauaaacucagaaugugacuuauuuuaguaaaggcauuuuacauagaauuaccaaaaauccauuuuucugccaauggccaucaucaauuacuggauuaauauaugggcuuuguuuuuagcugagaguuuucuuauuauuuuccauacccacaacacagagaggguugggucugguugggucuuuaaugccagcuuauacuagggagaacaaacgagccacauaaaagcacuaaauuacuguauggcaccuuuuuucaaugauugaauuuuuuauuuuaagauuuauuuauuuuauguauucaccauugcugucuucagacacaccagaaaugggcaucagaccccauuguagauggucgugagccaccaugugguugcugcgaauugaacucaggaccucuggaagagcagucagugcucuuaaccacugagccaucucuccagcccauugauugaauuucuuaauggcaaaaguguauaagaacuaacaauuccaggauaagccauccugcuaaaugaucaugcuugauuuuaauucauacacagcagagaaguauauuaaggaagaaaaacaauauguaauauaggugccuguaguccuaaaagcaguuuaaccagaaugacaccugugccaaauaaaagcaacagaucaaauugacugcauuauuuuuauauuauauccaaacuuaaaagacuuugaaguuccuggcacaugaaagcacauuaaacaaagcauuucuuauuuagaauauugcaaaaugucauuauguuacagcaugauauauugugcuauauaacugaguuuacaaaaugagggcaaaauccuuuucuauauuuuauuuacuauuuuauucccaauaucuagaaaaguaucugcuacauuuguguguauguguggagagagagagugacagagagagagagacagagagacagagagagagacagagacagagagacagagaaagagagagaaacagagagagacagagaguggugggggagauggugcaugccuuggcauccauacagaggauagaaaacaaccuucagaauuuaguuuucucaccugugggucuuagagauugaacuuaggucuuuaggcuuggcgcaagagccuuuagcugcugagccaucucagcuguucauaauaggcucauaauaaauauuuguugauuaaauauuuucacugucuguuagaaaauuaugauagaauaauauuaauauugagaagcacauaaaucagugauugggagacaacuguguaaaaugcuuacuuugcaagcaugagugucugauuucagauucugaguaccuacauucccaucacccaggagugauacaccuaaaaucccagcacugagagagaaggaaaacaaaaaacaaaaacaaaacccuggaguucacugacaagucauuuuaaccaaaugugagcuuuaguuuuagugagagaccauguuucaaacacaaaacaaaaccaaaugaaggacaagggaagauacccagcaacugcccuuagaccucuaaauguaaugcaugaccguacacccaaauauaaauacagagagcaccuguccuguaacacaaaccaguuggcaagucuucaugauagaaaagucaaagcugcacaguaggggcuggagagaagucucagcaguucagagcagagggauggggugggggaugagggugggguggggcuucuagaagaccagguuuaaucuccagcacccagaguagcccacagcauucuguaacuccagucccaggguucugaugccuccuccuggccuccacaggcacugcaugcacaugguguacagacacacaugaaggaaaaacauucauagauacgaaaauuuuuuaaauuaauuaugauaggcuauuucugcuuuacuuccucuaauauuuacuaucauccuuguauuuagagaauuuuuaagauagaaauuuaaauuuaucauagucaaaaaguauauguacauuuaaaaaaaauaauuggagaaaaaaugaauuuuggauucuucauucuucaggaagcuaauaccugaaauaggaaaaaauguaauuaacuauauuugcuuuauuaaugaaauaaauauuacauuucauaaaugcugaaaagauuauuuuuaaaaaaguauuucaaaagauguaccuuguuuggcugguaaaugaauuuagaaaagucaaagauagacaagcuucuacuuuuauguuauuuuucaaacugcccaaaaaauauuuuauuuuauuaugacauauuagaucagugguucucaaccuuccuaaugcuguggucuuaaaacagcuccucauguugugaugaccucaaccauaaaauuauuucauugcuagcucauaauuguaauuugcuacuguuaugaaucuuaacgugaauaucugauacacaggguauggauaucugugaaaggguugcuugacccccaaaagggucaugagccacagguugagaacugguguaugagacagagaagguaacuagugacugagcacugucauguaagcuagucuaguuuaacuguuacagagucugggaaacacuuguguaguuugguuuuuuaacuauguagaguuaacaugaucaauuuugaaacauaguagcuuuauuuuuaaaaacuuuaauagauugagacaagagagguuauccaugaaaguuauuuuuaguuguucuacuuuaaaaaaaaaguugcugcuguuuucuagguauagagcaccaagacucacagcauucuuucuuggcauuuuugaauacgccuaccgaugcucuggaccaauuugaaguaaguaacuacacugaagacccuugggucuacauacagcuugcucugggaccuaaauuuaccugcaguaaaacuuuaauugcagcugcauaagagaaccuagcaucauaugaauaagugaauagaaacauguaagggaggaauaucugcauucuuauggaaguaugacaacauuuguauguaauaaaaacaccuaagagucugaaacuaaaagcuguuauuagacuuuaaaacaguuucagcuucaacccccugaagaaacggugaaagcaaggaaaaaaaucccaauuuuugaaauaauuuuccuuuucuccaaagauuggaggcacaguaaaaauaagugaaagcaagagcacgcucucuagcucacugccgcucguguuccaagucagcuccaggagugugcacuagagaaugcuguuugauaaaaguacuaaucuacacucuguuagcuguacucugaaguagugauuguguagcucuuugcucuuugucauucuuuccuucuuauuuaaauauuuugcugaaaaaaauguaauauaaugucaaaguauguuuuaugucagaaaauauaaguuauugguuauggccuugugcagccguuagaaauccuggaaucucugugcaaggcucggaccuaagaacuguaaugugcagugagcccagaucccucucgucgcuuccauucccucgggaacaguuaggagcagaugcccugguucaguuguuauuuucagaagugcaccauucacuuaguuagcggcuugccgugcacugccguuuuauuacauuggggacaguaacugaauuucauuucuuggggaagggaggaagaauuucuaagcucuugacaguggugacaguaacugcuuuuuucauuuacuuauugaacaaaugccauuugccuuucaguuguuuuggauuuauuauuugcuuguauuaaauugcuucauccauauuuucuauuuuuuauugcugaauucguuaaauaggauucccuuucuucuuccucauccucacugauugauuuuuuggaugacguaagucuuugauuuucaaccaaugcauccuucaauaaaaaagaucagugaauugauuugaagaaugugccuagaaaugcagucaguuuuagaaauauaacuuggaaauauaugugagccaaaugcuuccuucuuauaaauauaguggucuaucauuauuaaaugugauacaguuaaaaaaaaaacuuuuuaaaaaaaugcuuuggccuuuggcaaaucucuguguuuccauucuuuaccagaaagacuggaaugcuugcuuccgcucugucucuguccgugauaagcggcuccuuuugucuuuuauggcuucgcuuuuacucucuccuuuucucuucagcaccgugcuguuucuguguuguaacuuuacaagaagccucugauggaguaaugaaaaaaaguaaugacauuuuaagaguuaacuuuuuaguuaagaauauaaauuaaauuuuaaugcagucagauuucucuccuaauguucaaaguaauuuuaaguaaauugugcauuauaugccccauuuggcugcuuuaauauauccuaucugaguuaauuguguagauuuaacacucuauagguuucagucagugccugaugcaucgauccccaccugcacugacuguuacauucauuuucuguuccgcuguggaugacucagaauucuugauauccuguugaacuugcagacucaguagaaauuaaaagauaaaagaguuuaaauguaaacaauguacauuaaaguaucuuaaaugaggggaaauuuauuaaauauuuuauuccuaauauuuuguuaaaguacaauauucagaugauuucagcauaauuuuucgcuggaaaauuuuuuauauuauuuuucaaauuccuaaacaacaaagagacuuuuugguguguuugaaaauauacccaaaccuguuucccuccaaaauagaaauuuuuguuguucuuaaaacaauuaaugcuggaugguucuguaguauaauugaaagauaacuguccugaaaacaucacauuccaugucucagucuuguuuguuaugcuagaacaauauuguacuuucauuaucacauuagaaaguuugaguaaauuaccaaguucuauuuacuaauaaacuguuuucacuuuuccuaaacaaauucucgccuucauccuggcucucccauaagcacucagguuguagaaccugagcagcuccauagagaucugagugaaccucuguagacuccugcugcaggagagcucugagauugcuccucuagauggcauggaagugcgcccaagccagacccauucccagccacacuuucccucucggaccccuuugcaacuguuagacagcacaagcucaucccagcucagagcugagucuuagaaaaggggcagaggcggcaaacacagaaguggaugcucacagucauccauuggauggagcacaagauccccaaugaaggagccagagaaauacccagggagcugaagggguuugcagccccauaggaagaacaacaauaugaacuaaccaguacccccagagcuccuuggaacuaaaccaccaaucaaagaaaacacaugguagaacuuguggcucuagcuauguauguagcagaggauggccuagucggucaucaaugggaggagaggcccuugguccugugaagguucuaugccucaguauaggggaaugccaggaccaggaaugggagugggugggugggugagcaaggggagggggaggggauaggggauuuucagagggaaaacuaggaaaggggauaauauuugaaauguaaguaaagaaaauaucuaauaaaagagaaaagaaaaugggcagaagcacacaguaaguggaugcaagcugaugcacagaugcugcuggguuucugugcaguuguuuggagauguuuuguuuuguuuugucuuguuuuugcuucacacuuuuccaaggcacaaguugcuguuguuccauuguucugguaaaccucauaagcugccuauuccacuuucuaguauggaguucgaaggagauuaucuggccuuccaauaccuagguuugcucaucugacaauaguugaaguuguccuagucucauaaagugguuugaacauuuaaaggauuguauaauggcuuugagaguuucggucuauuuccuuacagguuggcuaucuucuccuccucaccuuuagccccgucucuugucugcccguguuauguuacugaggugccugugcuaugaugucacugaggugcucguguuaugaugucauugagguaccuguguuaugaugccacugaggugcccguguugugaugucacugaggugcccguguugaugccacugagguacccguguuaugaugccacugaggugcccguguugugaugucacugaggugcccguguugugaugucacugaggugcccguguugugaugucacugaggugcccguguugugaugccacugaggugcccguguugugaugucacugaggugcccguguuguaaugucacugaggugcccguguugaugccacugaggugcccguguugugaugccacugaggugcccguguugugaugucacugaggugcccauguugugaugucacugaggugcccauguugaugccacugaggugcccguguugugaugucacugaggugcccguguugugaugucacugaggugcccguguuguaaugucacugaggugcccguguugaugccacugaggugcccguguugugaugucacugaggugcccguguugugaugccacugaggugcccguguugugaugucacugaggugcugcugcccuugcuccuuccuucuugccuucugcucgcuagcagugugaaccacagcaccuccuuuggaauugucggaucccauuacuuuuggaaaaugauaguuauuuuuuuucuauuagagagagagcuaacagugagcuccuauuuaaaaacaguuuucuguucuucauuuauacauuauaacccucuuguuucuuuuguucauuguuuauaacuaugaccauguuuccugguguuaaccauucacucauuuuauuauuaaagucacagcaaaauuauguuuuaauaguagcauuaaaucuuugauauguucauguuucaaauucaugauauacuaugaaacagaaguucaguagcuccuauuguuggauauuuagauucuuaaggaguaauucauuauucuuuauccuaaaacugguuauauuaugcauuuucuuuauaaugugugacuuucccugcauuaaguagguucuggucccuaacuaaccucaaauaccgucccucuggucauccucuucuaccuucuauuauugcuauaaaaaagaauauugaaggacuaauguuuaauugaagccagacccuccacacuuaggacagagggaucguaaguuuaauuugguguugugucuacauagcaucugucuucucaguucuuccccacacacauguccaggguuacuuucagaguucucaauuuuauuacuaauaguccuugccuccaacuuuaccuucugcucuucuccuacuuuuauucuuugauuugagcuauuaaaauuaucauuucauguuuagaaccacauggaacuagucuucuauucacuauuuucccugcguuuguuuugucuguuuauucacaauucauaugaaugcuggaauuuuuaucaggauggggagaugguaagggcaggaugccuuaagucaagcuguguaguuaauccuguguagagauagcuuugacauagggcaggaguuuauguaauucccaccauuuuguuccccaggaaagagacggaugagacaguguagggguguauguucagcacugugcagcugugaugugagaggauggcugcuugggcugcuugcacacaguguggacuucaaaagaacccuagaaaauauccaggacaguggucuaagccucuguuuaucacaccuuccuguuuggaagaguggucuuagcaagggugacuuuuaggguuuucaucuuaggaaaaacacaaguguagacagaggauuuguauggcauuccuuaacgcacauaaagagacauauuuuuaaugaaauaaagggcaacaugacgaaaggauauuggaaggacauuuccauauuuaaauugcaguagaaaaaauuacaugaucucuucuguaaaaauccauaucucuucuaccuuuccuuuucacucagcuccauacaaaucccuaauccugaugaguucccaugaggcccagccucacauucuguguagccaaccagauaaggacaaauggaaauuaaaguucuagugucugaaauucagacauggaagaagauacuggguccauaauccagcuuucuauuuaccucauauugcuuuucuuccucguauucuguuaaacaagagaaaugaguuaucucagcagacagagucuacgcauaaaguuuagccucaguuaaaaucuuacuuaaaugcuccagaauauugaacucagucaugcuuccucccuucacuagggucuugauuucaccauggcucucacagugauccacagaucuuauucucacagagccaaucucaaggccugaggauauugucagggcggacaguauagaacugugcuuuuguuuucucuguugucagugcugaugaucccugauuuagcucucagcauuuuaaaagucaccuuugaaaagagcaagaguggguauguaaauggauaaaccaaagcuccuuaauuauauauuucaugaguggggugugugugugugugugugugugugugugugugugugugugguguuuuacuaugguucaaauaaguuuuauuaagugauugcaaauaggaacucaaaauuaaguagaccuauuguuguuguuacaauuguucccgacuugauggaaugcugccuuguggaucacuauguguaugcaaugcaaacuucagccugagaccacaucugagcaguuguuuccuuacuguucuuauccgacaguuuuucauggauauaaauguacuugacuguaacaaaacaaugguguuguacauaugucuguaugcuauauguugguacagagggccuggggccuguccuaugaguauguguaacgugguguucucucucuguugaagcgcucuccguccuguacuccagcuagcaaaggcagacguguaagagacucccgcacugugugcugucccaaugccuucugccugugucucgccccuggccuuuggcugcagagcccuugagcaugcuccaugugucauggccccucucaugcaugugcugcugcucgugcaccacuccucuccucuccucuccucccugucucucucucuagcccuccauuuaggcuuuggccgcagagcuuuaggaauguucuuuauguaaauuuauacaacuaagccacgaaaauaguaagauaccuuuuuaaagugugcuuucuaaguuauucaaauacaggguaaaugaguuucucauagaaaaucugauacauacaauuauguagaguguucaggccauuuauagaccucguugacuggauuuuauauaaaucaguucugaagaaguuguauuuaauggaugucaaagaaauuugccuaaauauuuuacacacuauagauuuagaaaaauaauuuuaauaauaauuuuuuguaaucuaauuucaagauuuaaacagauucuauauguuauuaauacuggaaacaucuuccauugccagugcuagcuccaggcuugugucuggccgcuucacaggcucuguguggcucugauaugcuccagguggggaaucaguguguggaaaggucccgggcuuuuauaagccagccugccccagcaccugccacacacaccacugagaccuuuaacugcauuugcauucaguguuaaauagcacuaaaggacagucauugggagauaaaaaauuguaacuuugagcugucagcuucaugacuggcaagcaccuuuauuccagaguuccuagagauggaaaguuggagaugaagcacuucuuggugaacacgagagguaguaggauggacguugauucuuguguucuuucugaacugauaaaggguguugucacacaaacaugaguaacacuagcauuacagauaauuugaacagcccccucagcugucaggguuggacucaguggaucugugcguucaucugcccucuguuagaagucuauuaaaagauuucugcucguacagaugucuugauuguuuugaaauuuauagaguuaagccaguagauacuuguaucuauaaaauuauuaguaacuauuuuguaaugggaaggcuggcauuugucugcccaucuguacuagauuuaucagccugugaauucagaaagguuuuguuuuauugauaauuuuauuaagaauuaguuauaucugauuaguaaucauguacacugagagauuuggccauguagaacauuucauugacucaagaaauaggaaaaaaauugagggaagugacugcucuuaggauuuuuacuccuaauccuguaucuuuuuuucuuucuuucuuuuuuuuuuuuuuuuuuuuuuuuuuuuuuuuuuuuuugagacaggguuucucuguguagcccuggcuguccuggaacucacuuuguagaccaggcuggccucgaacucagaaauccgccugccucugccucccaaaugcugggauuaacggcgugcgccaccaccuggcccuguaucuuucuaugacagcaucuaaagaagcugccauuaaccagaaccugucaguauggcagccuucauugucucuuuucccaucguccuucagcuccuccuuggcuuaguaacugacuuuuccccuuuaauuuguaaagaaauauguucauaaaaacauaugaaaaaguguaaauuacccaguaguuaagugagaacuuuguaguggcauuguaaaguagucucugggacaagguuguaacauuguuauuucauacaacacaaauacuuaccauuucuaauuguggcuuugagucuaacauugacauaggguuucauauauaccauguuuucagaugauuaaaugcuuuuguaaacuuaaaaaucuuucccuugaaauagcacagaaguaaggaaacauccuagaguuggccauuucuaugcuauuaagccucauuugcaggcugaagacguaaaguucuauuaaauaauaaauuaaguauacuauaagaaaaauguuauaaauaguauuguuaauguauggauacaaaugacuggggagaguuucaucugaaucuuuuaauacuaaaaggcacagacugucucauuucagauuguuccuuuagaauuuggaucagagaccacaaagagccaacguacagcuucauuuccuguuacuuuucauagaguauaaucucuagaguccauauucaagacaaaacacuguaaauaacuuuaggagaaauuuucauaaagaaauuuccaaaauaauguaacuaguaagacuauaucugaggcuauaagauuaaguaauuuuuacuuguuacaggauaauacaauauuuauauuuuccaaaugaaauaauacugcuaucauacuagagguugcucauaagcucaguuaacagaaauaacuauuucacuaaaaauuuuaugcucugaacacaaaacauuggcuucuuuauuucauuuuaauacaguacuuuaaauauauauugugaggauaauuugcuagaaaaaucuuaauuuauucaagaaccauuguggacuucuugcgugacccugucaugcauuaugaacaaaaaaaaaaucacaacauuugauuuuuuauuauauacacacauauuauauauuugaacuaggagaacauaaacaaaacugacaauauaguaaauaucuuuuaguuccuacucauuagaauaaguuauuaaaauagguuuccugccgggccgugguggcgcacgccuuuaaucccagcacuugggaggcagaggcaggcggauuucugaguucagggccaaccuggucuacagugugaguuccaggacagccagggcugcacagagaaacccugccuugaaaauuauauauauuuuuccuuagagaaaaugaauaagaauagaaaagguauuuuuauaaaaguaaucuuucucaguggauuauaauuuuaaaauauugaguaaauuuuuuacacuguuagauuaagauuugcuucuaagguuugucuucgaacaauaucaaaauauuccauccauuaauauuauguguuacuuuuuagcuauuuaccauuuuauuguuuuuuauaauuaucaagauaauauuaaauugauguagcucugcucuuauguauaucauauuuauuggcuuuuacuacauuacuaacucaauuaacuacuuagacuuaaugcuauaauaucuuuagucguguccaugaguuaaauacagaaaugaugauuccauuuuuaaaaguuuuuagagugcucuguguaaaaauguuauucguguuuguguauaugaguuauugucagcuaaucuuaaaaucagucuuaggcaucuuuaauucuaguguauuuaaugaauauccugaaauuuuaguuaauugcuuuuaaugguaagaagaaaccauuaauuacaaauacaugauaaggauuagcauguaauuauaguuaaaaugaacaccacagucauguuggugaugauuaaaggucuggugagaggguaagugacauguuuuccucaucugccuuguuaagcugcguuugagagagucuucauaauggcagcaauccccagaugaugugacagcguaguggcuuuauuuccuuagcuucugcuuuuaauagaaucuuauaaaagauuugaguuugauguucaaaaaauuuuuuugccaagaguguuuucauguuuaauuaugcuuuuuguuucuugcguuuauuggaauuacacauagaaaaguagaguuguaauuuucaaacuccauagugguuuuuuuuucaaaaaucagaauguuauuguaaaugauauaguuggauuuuuuuuaauauucccacucaauaccauuucaaaauacuacugcuguguaguuacuuaguuucuuuaaaaagaaaaauaauuagauuuuuuaaugaaauugaguuuuaguuuaagagcauauagcucuaaaugcacagauagugauuuuugcuguucuauuuuauuguagguaacacuaguuggucuuucuacaguauuacuguaguuuucaauauagccuggguuuacuuguugcagcuaagaaaauaauuuuuauuuccucauuuuuguucucuuucauugacacuaauuagugaaaacuaguuaagaagaaacaacaaauuaauacauggcagaaauucuucaaaagaaaaagauuucuauuaaaggguucaagaauucugaagucagcaaucacaaauuaaacugauagugagucuuuuucuuucucuaguggcuuacucacugccaugucauaucuuuaugggaccauaaaacaugcugauaaauguuuuaacaccugacucuggucaauaaacugcuaaauaaacugccaguuuugugauagaaacucuuguucacccacagccgagaagguggugcggcugcaugcuuuaacucuggugcuggacacuggacacugugcucaccucugcuagcucacggucccacuacucaaggaguaggcuugcucuaaaaugugggucaguauuagugaaaacacaagcuaucugcccuugacuguagacauauugaagccacaagacuuagaggucaaagucauuggaacuauuuauuccuauucacagaauuaccuuggauccaggguuuauugucuuacuguugaguauuagggcuucaggaucucaugauagcucaaaaaaaaaaaaaaaaaaaaagaacuuauucuuaaaauagcgcaguuuucgauguguaacaaaucuuccacuuggacacucuuaugacugagucauuuuagguucuuauuguaaaacauuucagagcugcuucauuaccuugcaauuuauauaauuaaauagacaaaagaauaaagagaauguaggaagugagaaacauuccuguuuuauauagcuaaauauaauuuuauuaccuucuucuuagcuguccccaaauaaaguugugaguggggcaaauuugucuugagaucauuugauucuuuuauuuuucucuuccuguucacaguuuacugucaaaaaacauaacuuggccuccaugauucuuauugcucugaauguuucugucauggcagcaccuugguagaccauagaggacuggccgugcagugaagaguuggauucaggccuaacucgaaacuucucaaagcauaccaguuuaugggaucaucugugccacacauacagagcugguagcugguaucccgcagcaguuccaguuuuuaaaccuaaacaugaaagacuuacauugauuaguaacuaacugugcugguuauuuucaccaagcccuucauucauggacuguuugaacgguggucugugcccaccacccucagaggccgugguggguauacccacagagggcagcuccuuguguuuaccauuccaucuuuaacuccugcagauuuaccagaugauaaugauucuccacauugaccaaaagguggcaguuuuauaugagcaacauaucacaacuccagaacaguuuuuauucuuguuucauuucuauuugugugauuucaaaaacaaaacaaaaaaaccaaaagcccaaaaccaacaccugaucaaaagcaauauaggaaaggauuuaguuagcucacaaaucucauccauucuuccagcgaagucacaaagcuggucacaccacauccauagucaauagcagagagauuaauacacucgugaucccugcuugcucucaucaggguuguccuugucuuacauaguucaagacacccugucuagggaauggcacugcccaaagucagcugggucuuccuauaucacaacaaucacaagaaucucucacugauaagcccuuaggccucagacucgauaagucuucauugagacucucauuaaguacuugccauucaagcuagaguuuuaagaggcuuuauucaccuaguuccauaugcuaggucuuuaugauuuuaguguauguucugaucuacuuuguuaauucauauucucauguccguucuuaaaucuuucaucagcuauaauuuagaaaggggaacauugucuaucaucauguccccuccccaggaguaagcauaguaauuauaagagaaaguaguuuacuccuuuuauuagaacauugcuguuuuucauacacuacaucaaaacaaguuaccugaucuuuccaaauuaucuucuuuaagcucaauccuaggaacuuugagaacugccuauauuucaugguaacuuuuaacccaaagcauuuucaguuucuaagaguacuuaacuuuaaagggugcgucugacuauaauauuucuucuguuguaaaauaagaagaauugaugugagugucaaacacaaagcucauacuaaauuccuuguccuuacaauuaauaccuugaaaagaacuaaaucacacugucuaugacaaaaucauguauaauuuauagcaugcaucuuuuaucucacauauaugauccuuguguguacagauauacguacaggguaagccagugcucaugguaagaggugaacagcaagcuuggggcuggagcuuugauuaacugcuuaggaauuguuugaaugccugccugugcccauugcccauagagggccacuccuaaaguuugucacuacucacucauaacucccauacagcugccagaguaugcaguucuccauauuuaacaaaacauaguaaaacuagugcuuuugcauaaugccaucccgaaugugaauauuuaaacugagcuuuuuuuuuuaaucuuccucacgaauuguugucaugaucaugucuuaagaguuccauguuguuaaaaagugauuucuugggguuuuuuuuuuuuuuccugauuuauuuuccuagacugaucccguugacaacacuuacauacggaacccgagcaucaaguuuuacauccagucaaggcccacaucuccuuccacagcuagugaggcugagccaguuaaggugccucccuggagcagccuggcugcacaacuuacacuuggguucaggaaaggguguugacauguuuaagugaaaucugucuaguuaaguacauuguauguuaaguuaugguucauuagcugucauuacauuuugaugauauauauguagagagagaaauuuaccacucacauaaaauaggcaaaaauauauagguagauagguaaagguaguuuuuaguuagagaaguguguagguauaugcuuaugugaagauuacauucaaaacuuaugggaacggcauuauuagauccaaacuguagccacaaagcauugaaagugccauucuugauuuguguucuuuaauucuucuaaucaguuuaguaagccgugauauaacuaaucauugcaucauaagcauagcuuagaaaugaaauuguugcuagaauaacaacugaacgacuguggcagcuggauaguguauaauaacugcucaauuagccguggguacucacucaacuaaaccuugccuuuuaagagucaaaaauacuauguuaauaauuuaugucagcccguugcuuugagcagcccauuggucaguuuucucccccugccauucuaaacuaauuccacauugaagaaugugcauuuaggucauuaauuauaucuuuuauauagcuuuaagccaaagguguugggugauggucucauuagucaccacuaggaggagugacaugguaacaucaucucuguggauugcacgggaucugggacacauuucuuuccauuguuuuguuuuguuuuuggaaaucagcugugauuuagaacuuuauaaaacgaugguaagaggaccugcuguaauggcaugcacagcucucacaguguacaaacauucuccuguugugggagacuuccacugcuuccagcccuguauugcuaaaauuagugcggaggggaugaccauccuaguauuucuacuuuugcacaugggcagugugagucgaaguagauguaguuuguauuugaaccuuaacuaauuagaucuucccagauuguuuucuccugugcuucaauccauuuccaccccgacccccagcagugugugagagcucccuguuuccccacaucccugccaacccuugcacagucagaugcugacuucuucccuguuggaugucugugaaggaucauuuuuauaauuuuguacuaacuuggguuucucccuuuucaaaagauauuuagcauuguuuuauguguucauuggcuauuaaugacuugccuguugguauccuuuguccauucauucuguuaauuuuacugguuuuuuuuuuuuaauguucuuuuaaagucugaauaugaguucuuugcugggcuguugguugcaagcauuuucuuccauucugaagauaauuuuuaaauuuuguguuaucuuuuuguuuuucaaaacuuuuagucagcuuuaccagucuuuuccuguauggcuucugcuuuuugugguuuuuaacguauuguuucuuuauggaaguauuauguuucguccguguuuucuucuaaagguuuaaauuauugcuucuaugcauauaagacuuuacaaacugaaauauguugcgacauggagugggaaugggauucuaauauuuuccccacauaaacaacugacucucucuguucaccccagccacacuguuucugcucugcaugucauggccucccuguccugcucuuacucaugcucugacucuccauugucuucaucacugcagcccugcacaguucugguacuugguuuaggguaccacucguagccgcuguguucuuuuccuucuugacccuuuaguuuugaauaccacuucuacugucagugugucaaauucuguguaacucuuuauuagaauugaauuaaauuuauauauuugcacguggaaaauugggcaugauauugggcauuuccacccgugaacaugauacacauagaaguuguuucuuuucauucuuuaauagaguuccaucggcuucgaugugcucuguguugcuuguugauuuguucuggugcccuaaauuuuguguugugugugagugagauccaguuuaaugaaguuuuuauaggcauuguugaucuuuuauccagcaccuuugcuugagucuuuaauuuuaauaacuucucaaggacuuucugcagaacucuaaugacaguuuuguuuacuauuguguuuuuauuaucuuuugcauacauuuuucauuguuccucuuuuuauauuuaucuuuucaaauguuaaauuauaguuugggcauaauauauuuuuaagcuguucaaaaguaaacaaaauuuaaauugaauauaaacucacaauuuacagaaaacugagacauucaguaaaauuccauacuaagauuauaauuuacauaugacaguuuuugagguuaugguuagaagcaaaguacuacccaacuuucucuucauauuugaguauucuguaacuuuauacaaggcguaaguuguuuuccuugugugcuuucuuagcauccuaaaaggaaguuacuguccuuuuuauuuuuuacuuugcuaauuaagccccuccccuacauuaacuuccaguaaaaccacugguucuuuuuauucaaagaaacaucuuauauaauacuucauaaaauagacuucauucuacuuacaguaaaaauaugguuuauaacuaaacaaauuaaauucauaauuucaauaauguuaaauaauuuaaccccuuuauuuaaaguuaauuuaugugcaagaaucccacuaaucuccauguauucaaauuuauguaauuacaguccauaugcauaacauauauucuaaacauggaaaucuuccaggacggugagauggcucagcagguccuuuacuugcugggcagugcugaccuuugucucugggugugcggaacguaugguuccaccaagcauagaaggagagaaguaacuccacagaguugcccucugaccucccacguguucuucuagcuaauacccacaucacgcgugcacacaccaacucacagucaaaaguuguugaagagauuaaucuucuaaguauucagguacuuuuaaaaaucaaugugacaaauaaggaugaaugugaaaauaccuccacuuuuguguaaguuauaugcugugauuauuguuuucuuauguggauuuuauuuucuaauuuguuuauuuuuaaauuuccaaauugaaaugauuguaauugagaaaauacuucauuuguaaauaucgugagcucagauuuaaacuacagcgcuguggaagcuugaccccagggagaucacacagugucuggauagcccucuugggguguugucugguuuuguuuagucucuuucuaguuauuuucuaagugaguguuucauggcauucauuuccucuuuugccugggauucagauugcagacugugcuccacuuccagcucacacaccaaccuuaaggaaaaagggaugcccggcuucaacuggcuuuccaccuaagguacuugguucuaaaacaugggagugaauuucuucuacuuuggauauucacuguguuuuguugcucgucuccucaaaguuauaaaaauaaaaauuugggaagaaaacaaauucuguaaugaauauaaaugacauucugaauguugagagguguagucaguacuuaaugcuuaaauuguguuucaaagucaauuagaggaacccuccaggauccccucgaguuguuaccugauaaaggcauuaaguugaggccccuuguuagagaagcugaauccagguuuaaucaagcacggagaaggaaaacugcucagaaggaaggauaagggggucguccuugacaaaggacuuguacacgacaagucgugaagaccggcuuucugucuaagccauggaagaaagucuagaaacugcauggccagugcuucuuccuagaacauaaacugugaguaaaucacaaugagagaggucacuggcucugaaaacuaauuuaaaaagcaugaaagaacaugugcuaagcaagagucacuaugugcuguuacaugaggccagacagaguaugaaguuaaaauaaacauaauaaauauccucaccaacacagguaaucucagacaggagaaggcagugauaagaaaaaguaaucuagaaguucuugauccaggcuguaacuacuggaguccauaaaaggcgugaguaauagagugagaagagauagaguagaacagugcaugcgucaguuagcagugagcugaagaaccugaaagagaagcuguacggcaggaacgcugucagcaucuucauaguacaguagggccuucgguaggaaagaggcggaauuaaagaaauagaaacggucugaaaccguagcucugaggauaaugauugcuguucucagcguccgugugaggcagcucacagccuccuguaacuccaucuccagagcucugaucccucuucugauuuccaggacacuugauguaugcagugacacacaaacucaauaaaaacaaauuuucuuuaaaaagaaauaauagccuaaaauuucuucaaguuagagauggaaagcuucaguaaaagaugcaagaaaacacugaaaacaugcucaaaauguuaaauguuuccaaaaaugugcuucuuuuuuuuuuuuuuaguguuuuuuuuuccauuuuuuauuagguauuuagcucauuuacauuuccaaugcuauaccaaaagucccccauaaccccccccacuccccuacccacccacucccccuuuuuggccauggcguuccccuguacuggggcauauaaaguuugcaaguccaaugggccucucuuugcagugauggccgacuaggccaucuuuugauaccuaugcagcuagagacaagagcuccgggguacugcuuaguucauauuguuguuccaccuauaguguugcaguucccuuuaguucuuugggugcuuucucuaguuccuccauugggggccuugugguccauucaauagcugacugugagcauccacuucuguguuugcuaggcccuggcauagucucuucuuuagcagguaggaacuagaguaacagcccuuaggagccgagaaagcucagcagugaaauguggcuagagcagaggcugcucccuggagcugugcgcugucugugugugcagccugacucucgggcagguggaggcagagaccagagacucuggaggcucaagggccaccuggccuggaguacacagugcagcaacagagacaccaaaacgcuaccuccgcaugaugccagaagagagcgucccugcuguccacaugaguccuauggcacccguacuguccuuuccccacaguaauaauaguauuuuuaaagaggugggagaaagggagauuugaaaugauaaagaauucaggagaaaacugaaacuaaaauauuucagaaacauaagcuaaauccuaaauucuaaaucagacaaggucuaagagacaaaagaugaguuucucauuucuaucaguaacugaggaagaaguagaaagcaucaaguggguggcuagcaaagaccggcagaaaagagccaacgugugugaugauaagggucccugacacaucacaugcaaucagaaacacacaaaguuauagucaagaaaaacucauaaaguaaccuugaggcugaaagcacacauccaugcagcacccgugaaguuugucucuggugcgugaggagccgcagcuccacaugggugcacagugggaggcggaaggacugacucuccugucauguauuuugcagcgcaagacucaucaauuuuucgugaagucuuucacugccccuaccaagugucaccagugcaccuccuugauggucgguuugauaagacagggcuguuccugugaagguaagaagcagccaggaaaagaaagcucuuguuuaugacaguacuguugcuaacagggcacaugggcucuaagcagaccaugcucaguggaguuaacucuuauccgacccauagugaaagcauguagaccacaacuccacaugcucccgcccuucuguauguaccuuuauagccacugaaacacaugguuucagacgauugguagaaugcugccauuuacagggcuggggggauggcgaagugaaugagugcuaaccacugaagcagaagggccagagucagggucuccagcacacauguaaaggacuguggcccggcugugaucccaggccucaggagguacagguaggagacccuuaaggguacuggcaugcuggaccaguugaacuguugagcuccagguuugaugagagacuggaccucaaaaucaaguggggaguggaagauggaagaagaugccugacaucaaccuuggauuccauaucaucacauacugugaacaugcaaacacauauacauacaugcaugcauaccacaugcugagagagcauugaguagcuaaaugucuguuauuaacuccuggaaggggauuucagggcugaugacaaguugccguaggauuaaagagcuagaaacccuccagagagcucuucuguagggcugugcauaagucagccgugguacucaccagguugggguuguuggguuuuuaucuauuugguucucacuuugaucacuaguauuaaagagaauaauaauauaaauaauaaaaauauuuacuaccucucaugaacuucugaacggcaagcaacuggauuuguuuccccuaguaaaaagugguuauuuaaaauaaaauagaaaaaaagccuuugucuaacauagcaccacgcgugcaauuagugccagugaauuuuuuuguuguuaaaaugaaauuuuaucuaaauugucuccuuuuuuuuuuuccuccaaaagucuguggguucucaugucauauaacuugugugaacaaagccccgacgguuugcccaguuccuccugagcaaacuaaagguccacugggcauagacccccagaagggaguugggacggcguaugagggucaugucaggguaaguaccuuguuugucacuuaauaaacauagugcuuaagagaaaaguuaauuacucgaacucauuuaaauaauauuuuaacuagagucaugauuacaugcaaaugaacucuagaauaucacaaacuguucugucuuucuguaucucgagauuugcaaauguugcagucaucauaaaggagucuuggggcucuggucuuaccuaagagggaggguuaaguuaggaacuaugacgauguugguuugcuagccagaguaacacgcacagugugaccugagugucagguucaucuuauaaccaugucugcuuguuacgcuuuucucuaaaagccaugagugaccugcauuuagugaguugucaguucagagcccucagaagcugcugggaacuacaguguucccacuuuccccucacuguuggccccuugucacucuugcagucuuagcagcgagagagcaggcccaggauaggcgggcgcgcacagacuucaggugccaccugcagcucaccauaauucucauuugaguuuugucuguuuguuugucugacugaaacugaaccaagaucccuaagccggcgggagugaagaaaggguggcagagagcacuggcuguggucugcgacuucaaacuguuucuuuaugauaucgcagagggaaaagcaucgcagcccaccuccgucauuagucaagugauugacaugagguaagggcgaggaauaaagacagaucugucacagcagcguagaucaagguuuauggucuuucuucuagguuacuauguuuugguaaaauaauuuugugucaguuuucagguuuagcccuacagcuacauacuagaaaguuaagggugguucuagggcaaguugguuugugucuugaguauguggagucaaaguugacaucuaaaagaccaguuauguaguaaaagaguccuaauuaugcgcuguucaagucaucgucugaaacugcaaagugacugaguguaagugaagggguaacucucccacggccccuggacaacgcacuaaagcagccaacaccugagagucugucucccuagcaccacuguccagacucuucgugugcccucaacaccucccuccuuuccuagaaccucgggcauuguccugggggugguuauuuucucccacagcuucaggcauugcuucugaauggugggucccacuugucuccuauucaggcacagccauugcuaaaaaugcacauucccccuaugccuaguaucugaagcacagugaaauacacagggaauaucagcaagggcgauguggcagaccugaaaagugaggagcuagcgcuagcaaagggccauuccucagcccacauggucacggauagccuggacaacagcaagacugucuguuacaaggaaugcaagacggagucaagacuuaaaggcagagggaguaggggacucaugacucaucgcaggagcaaggaguaagccacuccucacagucaggggagcagacacagcacacaugagacucauuauggcaggcaggagagucauuaggaauucuggaggcuaacaaaagcugcuucuggcugugugcuuccuggucuuguguaccuuugugggucacuguuaugucugguguaaugcaccacugccaggucacuccugaugaauuaccuugaguacuguuagucauuauguaggggagucuuguacuuuguuuuuuuguuguuguuguuuugcuuuaaauugagcuuggguguuuauacaguuaagcuuugaggauugcuuuguauauguuauuuggguauauaagcaaaaccauacacacacagcaacauguaacaaccuuaaauguuuaacuuuuauuucagagaugaagaauuuucugugaguucagucuuagcuucugauguuauucacgcaagucgaaaagauauccccuguauauucaggguaagucuaugagucgaaaagauauccccuguauauucaggguaagucuguggaugacugagcacauacaggcuuuggguuugugcacauuuguuugugugcacacauguuugugugcacaugcaugugaaggguagacggugacaucagcuaucuuccuugacugcucuccacauuguuuacugagauggagucucacugaaccugcugcuagcagcuguagcuaguuuagcucgccaguuugccccagccauuccuggcucuaccucuggagcucuggggcaacagacaaacccaccuagcucuuaccuggguucuggggauccaaacucugacccucagguuuguguagcaugugcuuuauccacugagccaacucuccagcaccuaauuacuuguuuuuaaugaauauauuuugcuacucuguauaaaucauaaaguuacuggaacaacaccuagaccuaguacucauuuauguauccguaccauccauggaugcaaaauugugcuaagacuuguagaauacaucaguguuucuaaaguauucuucauguucuauaauguuuuugagucccaguuaaccucuaaauaaauauuaucucaugcaguucuucaaauuaaaaaaaaaaaguugcucucuauaaaacucucauuguaaaaauugugauucaguugucuacuucuuuauaacaaauauuccaaaaugugaauagugcucgucugucucuguuguguaugaaucuuacauccaaggaaggucagagauuaaaccuagucucucacuuuccaggccagcagcuguuuauucuccccuagcuaucuagggagccuauaaagguucacuuaccuguaacuaauuugcaguagaauuguauugucacugauguuuaaagcauauguaaguauguaaagggugucuauacauuuauguagcguguauauuauauacauaauaaauaauagcuuaaaagugcucugauugauuuguaaacuuuauuugcauacuguuucuagugcucuugucuucuuuaaugagaauauaaaagguugucaggaagcacuaagacuuugggaacagucugaugcagugcuucagagcacugggacgcgcucugcuccacgcucgugagauugcucacuuucccuuuaccguggagucucacauagacgcuuagguuauaaucauacuuguugucuccugaagcuguuaaggggugaaaugaguuaauacuuguaaguuacuuuucuuccugguacuugauaauuuugugucaguuaugaaauuggugucuacauuauuuuauagcauuauguaacacagcaugaaaugaaagucacacuuggacuuguaucaccuccugcuguuugaauuguaguguuacagugagacacuuucacucagugcaacuaaagugugcuaaagugauaauuuaauaaaugcucauuuuacugaugagugcuaagcagaugagcguaauucugaagcuagcauuagagaugucuguuuucuaauauugugacuauuaaauuguuuuaggucacagcuucccagcucucagcaccuaguaacaaauguuccauccugaugcuagcagacagcgagaaugagaggaguaagugggugggagugcugagugaacuccacaagauucugaagaaaaacaaguucagagaccgcucaguguauguccccaaggaggcguacgacagcacgcuaccccucauuaagacaacgcaggccgcugcaaucauagguaggacucuauaccacucagugucgugacuguccacuggcuaccuuuugagcuggugcugcgucucacauaggaguccccaguguccgggguaauguuuagagguucgugggauggaggcgccuuggccaggcugguggguuagcgccuacacgagugcaaguguauuagcuuccuaaaaugcacuagugccgaagcccagcugcucguggccgucucugcuuuugugauugggacaagguaauuccuagagugcgggcuucuuuucuaaugugcaguggaggaaucugaaauccuagcgugcucagccugccaccagcaaacagcagcucccucucguguguggcuguuucccuuugcuccgcucugaagcacauggcccacuuccccugcuuucuaguaaacaauaggaaguuuagugagugggagucagauuccuuucacguguuuccagaguggguggugucugugacacuaacaaacuagguuguuaauuuuauuguuauugaauaagcaguuacuucuuuugauagguacuaaagcagguuuuuuuaauugauaguucuauuuuuauuugccacuguaaucugagaggaaacauuuugauauuguuauuuaucuuuacuauugcaccaaauauucucauuauuugcuuuauucugguaucuuuacauuaccuuuaucugaugaaaauguuuuauguuugugucuuacauagaucaugaacggauagcuuugggaaaugaagaaggauuauuuguugugcaugucaccaaagaugguaagagaaaccccaguuauuucagagaaaccuuaaauuauauauuagaaagcucuugaaccuggaguuuaagagcaggauucuguuaugaaaauuucuagauauaauuuaauauuuuuuaaaucaaaagauuucugguuuucucuuuuuuucucuuuugagacaggguuucacuuuguaacucugguuuuccuagaacucacccuguagaccaggcuggcuaaacuuacagaucugccuguuucuuccucccaagugguggcauuaaaggugugugccacuacgcccagcuuuaaaucaaaagauuuguucaauucuguugucccuuuuaaguuguaaagccucaguccuguguuaucccugccacaugaaagaaaacuacacgccgcuuuccauccuuggcggugcuguaagaagucgggucugaaaucgccgugcuccagugcagucgggguuuaacucccugggggaaauuaaguacugagugaaauaaaacaaaacgaaucgaguuugcuauucauaaacauaacacugaaguucuuaaguucugucuuucuaucagguuagauauugagaaagcaauucauuuaaacuugaugagcguguuauccauagcaagacccugagaaggguaggaagcuccgucagucagugaaguacuugcccugaaaucauuugauuuccagaaaccacauaaaaggcuggacaugugugugcuugugaucacaaccaacacugggauggccgaggcagauggauggacuccucuuagcacuggccagccacccuaaccuuccaaacccagaucccagagagagagccugacuuaguaacagaggggggugagcaggauaacucagcacaugaaggugccaagcaagcccggugaccugagcuugaucccuggaacccacauaaagguggacaaagaaaagugacuccacacggcuguccucugacuggcauaccuaugcuguaacauguacccacacacauacacaaguuaaaauuuuaacuuaaacaaacaaacaaaaccaaaacaaacaaacaaaaccucaaggcagauagcuccuaagaaccaacauccuaggcugauuucugguggcaacacacuugugcaugcauacacagccacacguacacacaaaaaagaaauaccugaagggguggugcuagaaagaugacucgacuguuaagagcuggcuacucuugggucacacggcccccaauggaggagcuagagaaagcauccaaggagcuaaagggaucugcaacccuauauguggaacaacaauaugaacuaaccaguaccccggagcuuuugucucuagcugcauauguaucaaaagauggccuagucagccaucacuggaaagagaggcccuuuggacuugcaaacuuuauaugccccaguacaggggaacgccagggccaaaaagggggaguggguggguaggggaugggggggggguggguaugggggacuuuugggauagcauuggaaauguaaacgaggaaaauaccuaauuuaaaaaaaaaaaaagagcuggcugcucuuacagaggaaccagggguucaguuccccauacccacaugauaacucacgccauccacaacuuauguuccaggagaucugaugccuucuucuggcuucuguggacacaggcaugcaaaugauucagagacacauguacacaaaacacccgcauacauaaaauaaaacuugaaaagaaauaccuaaagagaaacaugaguuucucuguuacuuagauuuuaaaaauaggaacuucagagugaaauuccuagauuuuaguaccaaaaagcaaacuuugugaagcauaaacaugcuuuuuuuuuuuugucuugacugacaaaaaucucaguguugaacuuaaugccaacuaucagugggcuaaaugaucugauaauggguuuaauuaucuuccuuucucucucugauuuuuggccuuuguuacuuuuguguauaugugucuuuaaugaguuggguuauauacuuugggguuuaauuuagauguguuuaauguuguugccucuuccuucauguagagauuguuagaguuggugauaauaagaaaauccaucagaucgaacucauuccaagugaccagcuugucgcugugaucucaggccgaaaucgccacguccgacuuuuuccuaugucagccuuggaugggcgagagacggauuuuuauaaacuggcagagacuaaagggugucagaccauagcugcugggaaagugcgccacggagcucuguccugccuguguguggccaugaagagacagguccucugcuaugaacuguuccaaagcaagaccaggcacaggaaguuuaaggagauucaagucccauguaauguccaguggauggccaucuucagugagcaucucugugugggauuccagucaggauuucucagauacccccugaauggagaaggagguccaugcaauaugcuccauucaaaugaccauacacugucauucauuucacaccaaccaauggacgcucucugugcaguugagaucuccaacaaagaguacuugcuguguuuuaacagcauugggauauacacagacugccagggccgaagauccagacagcaggaacugauguggccagcaaauccuuccuccuguuguaagauucuuucuuguugucugccuucuuccuuuuuugcuuuuccauuuauuuuaaauauaaucacuuuuacuaacagcuuauuuuuuuaaucauucuuaaggucuuccacaaauacuaauuauguugcuuauguaaaauaaccauauauuguaaaaaccuagacaaucagggucaguauuaaaugcuuuuaaguaaaacuaauccuucuguggaaaaccuacugggauacauuguuuuuuaaucuccauguuguuauguuuugaaauaaucccaaaucauuaucuucauugucaccccuaguacagugaguguucuuaaguagcaguaccacaugagacccauggggaaguuacuaagugaauuguuuaacuaguucucagcagguagaauguagccuuuauucagagugcugcucugcuuuauaguuuauaggguuuuagugcugucaauagaccccaugaccaaggcaacuauuauaauggacaguauuuaauuggggcuggcuuacagguucagagguucaguccauuaucaucaagacaggaacauggcagaguccaggcaaggauguuguaggaggagcugagaggucuaaggcugcuaggagaagacuggcuuccaggccggaagagggucuuaaagccacacccacagugacacacuuauuccaacagggccauaccuccaaguaguggcucucccuguuccaaauauucaaaccauagcaagguuuauacauagauuucaauguacuuauuucacuuuuucuguaaaaaaauaagauugcuaugucauuuaaugcuuuuaucacggaauaauaauaaucacuauugaauacauauuauuuuacuauaugagaugaagucuugagugaaauagaugcaacgcauucugccugcacagcauagggaagacucccggcagaacaguagagugccauguuaccguugcugucagcagagugucugauccgcagugcuuuguuugcaguggaaaucucuugagccuguuugaaugcugugaggaaagagccauuggaggaucaguaagaaagguggacuauuuuaaaacugcagaaaguagaauaaaacgcccccagaagggcccaaagaggguggaauucagaguucuaguaaaucacuacugggcaggagguggggacuucucccugcggcaggaacaguggagggaugagggauggggccauccagguaaagucaagugagaaaaugugcuccaggacaguaaggcuuauaacagaaaagcaaggaaaucuguaauaaaagacccuaccacccagauuuaacuauuuacaguguuuuauuucuucugaaaugaacauuuuuauccaugacauaacggguaaaugaauguuguuuuguagcugagucagauaagccgagcauucuaauguaaaguaaaaaugaaacuaucuaacucauuucugugaguagccauuucuguugguagccaucaugcgagugaaucacguacucguggcucgugucuccauuucuuccacaaguguguagugagcaucugcuccugccaugcagcugcaggugacacaucuguagcauacaugucucuagauacaugugucaugcaucucuugcucucccauucuggaauaggacacuuacauaaacauuucucacaucguauguuuguuucucugucaacaguuuaacugcuuuaaaagcccaacucuuuaaagugcaaugaaaguucuuguuugacaagaauacaguucuuucuuuaugauuucuugauguuuacuucaaaaauguuuuuaacauuauucuuauauaauaacugugagguuuugaaaaauuccauucuacaguugcuuaggguaggucuuucaaaguguuugggguuuacuaguucaccauaaucagcagucugugucuuccuucuguccuucuguccuucccccagguuacaaugcuccauaucucuccguguauagugaaaacgcaguugauaucuuugauguaaacuccauggaauggauacagacucuuccucucaaaaagguaauagagcacuaaacugugggccaaacgguuacuuuuuaaguuucccuugcaaaaauucauuguacguagcagugcggcauaaggccaugcucacgaguauauaucguacauuaggcguacuaccucugaaccccacaacuuuucucccugcuccuccccggugagggucucugggaucaccaaggccagcagggugucagucugcaugaggcaggagggaauucugcuucagugugacucugucaccacuuugguucaaacuucaagagucugacacuggacgguuuauuuuaggcauauucacgcgcagcacaauuugggaaaaacuuccucgugauaauuaacuuagucucaugugcacaaugagguuuuaaggcaugacuacuacuaaaaaaguaguauucaguuuuccuugguuucgcaauuuauuaaacuguugaaauuauuaccuuuuuccuugcuuucuuuacucauucauuacauuuuaaagaugcauacauguuguuauauuuacauccaguucauugauuuuuuuucacuacuauaaaaccaucuuuuagguaaauaguguuuauccauuauccucuugacagcauuacuucugauucauugcucugucggcauuucuguguaucuagguccugaugaaggugugggaauuucuuuacccgaucagccucacaguggcaugcugaggcaugggcugcagcuauggaaccuuaugcaauagugccauguucuuuucccaaccgugauagucacauccacauuauuuacagguccuuucugacccacuucuucccuagcauaucauuuuauaaauuguaguaaauugguuuaucacugagcuauguuugcaugucccaggcugucuuaguuaggguuuuauugcugugaagagacaccaaggcaacucuuauaaaggaaaacauuuaauuggagcuaccuuagaguuucagaggcuuguuaguccauuaucaucauagcaggaaguguggcggcgggcaggcagacauggugcuggagaauccaagaguucuacaucucuaccugaaggcagccaggaggagauugucuuccucaggcagcuguagguucucccacauuggguggaacuugagcacuaggagaucugaaagcugccuccaaagugacacacuuccuccaguaaggccacaccuccuccaacaaggcuauacuuagagccgcuuccuguggaccugugggaccaauuacauucaaacuaccaccaggcaaugccugaucauguuugcucauuuuguuguugaauuugccaguuuuuugccuuuuguuuucuuccuggcuaauugaacuuccuuuguggauccugaguuacugacacacagaaugacucuuccauucugugacgucuggucacguugguggaauaguuuccucagcaggguuauuaacuucacugaaauaccaugguaucccuguuguuucgguguuuccuuuuucuguucuuaagaaacuuuccuacuucaaggcauaaagcuaugaccuuuauuuucuuccaaguuuacuguuucugacgccuguacguagcugugugccauauuuugugcacaguagcguuuugcuugcucuccgucugccugugcugcacuuagacuuguacuguaggugugagguagggaucuggcugugcugguuucuaggaaugcuuccuccaucacuguuuuaucaaugaacccuuucugucagcacugucaucuccacaugugugggcauaugguguuuagugauaagaauuuauaaaccaguguguucuuuccugacuuaauuuuuuggucacauuuuuuggugccuuuuaaagggucaguuuuaagguuuauuuauuuauacuugauuuuauuuaugauagacuuccuuuaaaacacuguuguuauaagcuaguuuauuuaaauaaugugauaauauaugugcuaauaaaaauuauuaacuugagacuuuuaaaaagaacucuuuauuuugacauagguaggugaaaauucuuaauaguauauucuuaauagacuaaaaccuuuaugauuuaauuuuuaaaaguuuuauugaaacauuaauuuuacuuuuauuauuuuagguccgaccuuuaaacacugaaggaucauuaaaucucuuaggauuggagaccauuagauuaauauauuucaaaaauaagauggcagguaaggaaauauauuaauaggaucauuucaguggaaauauuacaacaguccaaggcauuuggauaugaagugccuuccacccacauuugaaucaggcaucucucacucuggaguaugugauaugcacugucaaccucuggcaagacaauaaagacaagcuguaagcaaacuaucuguuuaugcuaugugacuguauaggcagaaugucugacugacacacguuuuccugaggagcacccagguaggaagaaaagugagagcuggaucugucgucuaugccugugguacuguagacauagucauucggccuacauuaggaacacuuguccagagucgcaguguuccacagccauuccacagaaucucugaaguacugaagacaaucuaggaagaggcuaagaaggucacaggagugagcccccagagucagggcuuagaccaggaauccaggaaagugaggaugggggaaaauaaccugugggaaggaggacguuucucggggcugagaggcaguuccgcaguuuaaagagcacgcugcucuuugagaggacuggaaccaccagacgcacuuauuacaggacagagaagacaguguaaagaguagguagagugacugguuaaaggcaugacaccaagacagcuauaguuuccuccagcaaaaguguaguaucuuuuacuuauaaucaaaagugagacuguuuuguaagcuaugcuaauuucaguauguauuuuuuugcguauuccauggaaaauuauugcuugcuuucugauuuuuaguacauaauucuuuaacuaucacaguuguacacacgguauaauugauuacaacaucacagagaccaauggauaggaagaacuuuaacaaucuaaacaauauuauuauuuucuuucucacagaaggggaugaacuugugguuccugaaacaucagauaauagucggaaacaaaugguuagaaauaucaacaacaaacggcguuacuccuuccgagucccugaagaagagaggaugcaacagaggagguaugcagcuaacuugugcccagcauccguccaugcugccaucacccagagaacugucuagaaucagaagaaagagucucugaaaauuugucacucagcuauggucaaaauuuggaaggccgggguagcuuauuagcagaguauuugccaagcaugaguaaggcccagggaucuaucuccaacugcauggggaucccacaguaaugaguaguaccccucaaaguuaugagaauaaaauaccauauuuucacucauuucuggauguauauaggacaacuauaauuuaaugcauauauaacucuguaauauaaaucauuuguguagauagcaaauuuguauaugcuuacgaagaaguacagaagccagguaugguggcucaugccuauaaucuuaacacucaagaggcuaaggcaggaggauuaccuugaguuugaggccagcaugcccugagcuaaaggguaagauccuguccaaaaaaaaaaguaaaagagaaaaacaaaaagaaauucagauuaacuuuauucuccaugagcuauauuaaaaaccauuucuaaaauaguaucuauuauaaaagauaaacauauaauuuuuuaaguuaucugccaaguagaguagaagaucuuuaaucaagguguguagcugaguggugagcacuugcuguguguggccccuggcauugauuccagcacugaacagauuacacacacaaaucagcccuaaauuucaagaucuucuuacguaaaauuuacaaaacaaaguagucuaaggaauugaacuauuacuauuacuauauuguuauccuaauuauaucuuuauuuuuauaaacaaaguaugcuuaauuuuuuaaaguuauauugauuaaauguggaaauacugucuaaacagguauucuaccuuacagggagaugcuacgagauccagaaaugagaaauaaauuaauuucuaacccaacuaauuuuaaccacauagcacacauggguccuggagauggaauacagauccuaaaagaccugcccaugguaagaggcgugaagagcggugugaauaugaacggugugaggagucagggccagcugccggggaaggauguucacguaggcucacaugcaugcucugcuucacacacacgacacagugccaucugauggacgaaaccuaaagcucagaaagcugacaaaaguucuuaacccagaaaaguuuuccauuugcuaauacaaguuugcuaguguuggugaaagaaagcgcuguauuugaaagguucugugacaaauccuagaugcagcucccaaagcucuaaggucucagucagcugaaugcaggugcuuggguguugucuccucggaagcccacccaggcucaucacucauagucacaccucucggcuaaaugugaaauucagucugcuccuuugcgcaaauccaggcaugucuccugcucaauuauaugugaaaaguaccacaccggaacacuguuguacuuuaacaacaugaagauugcauccacagacccauuaugcugagguuaaaauuacuaguggaguuggcuaaguccccaggcgcucugcuccugacgugucagugucacacacuccuagcaggccacuaaaauccagagggacccuuugaucagcaggguagcugcucaacugggcaaaagaacuucagaauaauuacuaucuuaugacaguuuuggagacaacugugaauacugaccgucaucucuccuaaggacaucuaucuacauuucauuggcaacacggugguaggagaaaggagagagcagggauaaagugugcuguguaaucagaacuguauugucaagguuagccuauaaaggggucuuuauuuauuccuggagaaaaaauaagucuacauucauuucaaucaaaauauuugguuguaaacauuacaaucacauaacugugcuuucuugcuauuuucacaucuuuggggguggaguggugguggccacagaaauauuccuuuuuugaguucacauuauucacauucaaaguauuccuuuggggucuguuagccuugggauauaucagcugugcuggguaaauauaaagcauacacuaucacacuguauacgcuguaacuagaucacagugaagcccagcaagaagcucaaagucaagcauguuagacucagagcugcugugcgcguugcuggguuuguaagcuuuucugcuucccagcuucugccuggagcaagagcacgggugucuccauuucccagugguaacauugcuccagaguccucgacugccaugcugucaucugggcagugcacauagcaggguccugagggcagagcucugccauugcuguucuugcuauuucguuuuucugaagggaaguuacagcccaggcacacagugcuuuaguagaggggacuguaugaaguguaacaaacaguuaccucgucauaggagagaccgagaacagugcacuguuuuaacugaauuuuugaucauuuuuuccaaaguguguaguauugagggauggaaagacaaccagcuuuagaccuaaaaguauuuugucagauagcaugccagcuaaaucaaaccaagguucugauagguauuagccuucuaaauuaaaaucauauuuguaacuauguaaaaggaauuguagaaaauguuuuacuuauacgcagcguuucccuuaaggugguacaaucucaggauuuagucuugcucugcuugggucccaccaggugaaacccuguuucuguccugaaggucuucccaaccuucacgauggagugugacccucggagucuaaaucagcaguuuaauaguguaagagacuuuaaaguaccccucagcuuuacucuuucuguuugguuugguuugguuuuugguuuugguggggguuuuguuuuguuuuuguuccuguuuuuugagucagggucuuacuauguagccaugucugaccugaaacucuccaugaagacuaagcuggcuucagacucauagagauccaacuggcucugucuccagaaacagaggccugugucacugcacccagccuaacuaaacucucucccuccagucucuuaccacuugcaucuuuuguuuggagacagaggauuucguuagcuggcccuggcuagccucaaauucacuauguagccuaggcuagccucaaauuugagccugucuuccuccugccucagccuucuaggugccccaggugucugucaccauacccaccagaaauuuguggguuugcuaauauugcuaaaaagauuuuuguuauuaagcaaaacaauuucagaugauauuugucauucauccaccaacuggcuccauccauaugacccuccaugcuggcugcugauuucuaacuagacuguuaguuugggguauuugucaucaccugguuuuguuaacucgacaaccaccucuccacaaccccagauuaguccuuuuucauaccaauucaguugguuuuuaaugugccuuauucuuuuaauguuuaauuauuguguaagauaacauuguucuauuuccaggcugaaguguugugcguuuaugagacuguuccuccauccucacaugucauaggcagcagaguuuuccuguuauuuccuguuauuuccacaugacuuuucccaucucacauguggaggauguaguucucugaaggcauuacuuaacccucugacgcacgcuucuugagcaugugcccugugcccaggccugggcuucucuaggagcagacgcagggaaauagcgcagcacugugugugucuguagcagugcucacagguaacaagagcuuggguuuuaauguaaucucaacucuguguguccuuuucagucaaauggaauuaugaauuaucccucucccuccccccuccaaaaacagaugaauuacauugaucuggcaacguauauaagcgcuuucaagucccaaagcuguguugcugccugcaaagaacauggacccuggauguuuuuaugucucaucauaaauaagucaauaucauguuccugugaaauacuuaagagcuuagaaagacuuaaaaagcucuuuagacguuaacucugcuucacuuguaccagauauccagaaauaacagugcuucugucuuaaauauggaugggccaguaagcuuggaagagucuuuuucugaccucuuguaucagaugugaaccuuccgucuccauccucgugaguggagagaagauaagcaguuaauauaagauggcauucaagucuuaagagagagacugaguuaguuuucuugaaucuuuaucauuuauauaccugugguuuuuguuguuguuaagugauugcuagacauacaggaacauuuuucuccaacauaaugcaagaguaauuuaucacuguaagguucguuuaucaccauauuccuaacacaguacauuuuaccugucucuaaaguuguucaugaccacaauauacugaacccaauaaccucuuuaagaaguaaguuugcuuccugagcccagaaaugauacaguguuuccuuguuguauaugcauggagggccgccuggacucagcucaugacaccuucccuccaaaaagauaguuuucuuucuuaaagucaaagaugauagauagguagguagguagauagauagauagauagauagauagauagauagauagauagauagauagauagauagauagaugauaaccuuagaaaacagugauuuuauucacguuucuaaaauaaaucaacugucauauauagaagccuuucuuuuaggcuuagauaagucuugagggauggugugcucuggaaacacucuucuuccagaacugagcuagggagaaucuccguuauaggaaauggcuggccucucaguggcucugcccacguguucacccggaagcauuuaucaggugaugugaaaccuucucuguagacguuuuguaacuucauuauuauauauagccuuuuaaagaacauauuugaacauugaaagcaaaauuuucccuuguugaaaacaugcuuguucuuugagcugcuuagagauaaaccaggacuagcacagccuccaaaucucagcaucuuuguuauaaggaaaugagcucacuaaagaccaggacauagcauaaaucagaacugagaaacagccauaaagucgaagggugcagguuugcacuuugcauuggaagugcucugggguuccucccccuuucuguagcuuucuugcuacuucugugcuuggaguuuugguguuuuggagagauuuugcaaugcuuaagaaaguccugaagacccucaaagccucugggaccucuagaagccaugcugcuacucgcucaguuccgguaacauggggaugguguuaucacaaaaugaucuuuugaaaaucugcuguuuugaguaacugauuacagaauuuaauccucuaaggccugaaagaauuucacuggcacuaguucugagaucugccuuguucuccguguguguguugucuggugucacucacccugauccaucagugucaccuuacaccauuuuuuuucuuucuguuguuuugauagccagguuucccuuauucacccccucaucaccacuccggccugaucuccucuccgagcaacuuugagcacaucuaucacaugacugucacuucugcugaacaguuucucucuccugaguccauaagcccugggucccccccgucccugcgcucugccccuggcacaccacacucugugacucugaggguaugaacagcugagucgagcuaaccuugacuaacuaacggagugugcauuuucuaaccacugagguggcgccuagaagagugguuagccuuucuuccuccucagcugccagcuucaacuacuuucugacuucuguuuauccuccucucucuccucuucucagucugucuuguuggauagaguuuucccauuaugguauuuuccauucuggauaccauguuaaaacgaaaaccacccaaacaaaaacagcccaaacuggauuuuauuaaaacacacagaaaaagagcucccugaauuucugagguuuuucuuuuuuagcugcucuuuacccuauagccacuucaggucagagaaaugcuuuauaguugaugagauuauggucauuagaguucacccauaguccuaucaaaagucuccaaaguaaugcuguaaauaacaagcacguaacaggaaaaaucccaaguuaaagucggguuuuacaaaucuuuggguugcugauguggauuuaauugcagccuagacacaagaagaaaaguuaggaagaacggaaaagagguugcuccacugcugaacgggugcagugguccucuccuccagcccaugccguguuaccauggcucaugugccgaaguggccguuaaaaugucuagccuaucaaauaguuucuguguguaugaacauuaagggaagcuaauuuuaugaauaugaaauuauuuguauuauaccaugcaaacuuauuuuuuauaaugccccagguuaguaaauuaguaacaucgacuuuuaaauuuuguaacauaguaauuuuccaguaagaaaauucgagggauuaaaagauuauuuuuguucuuauuaucagauuucuuugauaaaguaaauaacaauaccaucugaaugccuugcuugauagaauuaccuuaguuugcuuggcaacuggagauggauuccaaggacuccacagucagcaggaccuugcugugagagacacugcuugcuguagcuugagcugaguggugccacacagugggaaacuaccuuacgcaucauuuuaacuaaaaaaguccaaaauccuggguuucuuguuauauucuaauggaguguauaucauuugacuaagugauaggcuuuuuauauaaacacuuuucuguuugucauuccuuuaguaguguaguuucaguuguaguuacuagcaugcuuuggaagcuuagccuccauuguuugcucuagcguaggcuuaucauauagaagagagagcagcccaucuucugagcugugaagugcagagugacuggcaguugcugucuccaaagacccucuuggccuucuuacacacacugcugugugucagaggcuugcuccugugugugcagaugcuaaaaugcugccuuugacugucuugacuuucuuuuuuuuuuuuaauuuucuuagauaaaauaaggcaaaaacacugcacagaauuacauggacuuugcagaucuggucuaggaaccaaaguaacaaugcagauuugcuucucuugggguugcagguguuugggaaagcccagugcgcagacacauccagagccaucucuccaucauggggucuaugaucacauagugacugaguguccaguucuagacuucuuagcaacccaaauaauugccgggugugguggcgcacgccuuuaaucccagcacuugggaggcagaggcaggcagauuucugaguucaaggccaaccugguuuauagaaugaguuccaggacagccaggacuacacagagaaacccugucucggaaaaaacaaaacaaaacaaaaaguuaacuacacuacuugauuuccuucuugccucuuuguuguuucugccucuuccuagauccuguuuaaaucauuugaucuuugccuuacuguagcagagaggcagcuguccuuugauaaguguuagcauauagguuagcuuaguaagaacuuuaggaacugggggcuaugucauggcucaguugcuaaaaaugcuugccaucaaaccugacaacauggguuggaaccccaaaaccuacagugagggagaggaccauugaccaccuguauggcacacauuugcucacauucacacacacacaaacucgcacaucccacacaaauaaauaaacauuuaaaagaaaaugcagguaggaaacagcaaguuauuaguaguaucugaugaguuaacaggagaauuggccucuuuaugaucauuaucacccaaauaccccacaguccagguguagucucuugacaaugaggaaaaagcauguuuaaugaacuaauuaaugcugaggaaacuacuggcugguuaauguauuucccagucauuuugauuaaucuugaccaucaugggauaugcugaguguagaaauaaaguggaagugagauggcaugguggguaaggggcaugcugccgagccuguccucugaccuccacauauguaauggcaugaugugugcacacacacacacacacaaacaaaacaaacaaagauccccaggucagcuccucucagaaaagcagcgcaugcuagcuccaucagacuugcuuuucuuaacuaaugcauucucauucuucaggaaagucauaggguuggaguuuggacuacuuuuuaauaaaacuauuuguauuuucucaacaucuguguaaugcaugcucauuccuccuagaagaauucugauguaaucuaaagggagguuauugauacugaugcucacagauaagccaugugagucguuagaucagggcaggagagccacauagugggacagggcaagugcuuugcuccugcagauguggccucugugauucucagaaacccaggaggcacaugcuagccugagugcugaacaagcuagggccugcugcccauagauuccauagugcagacacugagugcucuguuucacuuccugccccaccuccagcccccaccccaccuuugccucagaaaauauuugcaagaaggugggaccauaucuacacaagaauaaaguguuguaaaagauaaauagaaguuaguaacguggccuguguggucugcccacucuaauauuuaagaaauugauucaaaugucugcauucucuggguuuugcucugcccugcaccccuuuucuaguugaaagcacugaguagggcaggucccagacucaugcucccugguacaacugugacugagcuaugaagugcagcaggaggaagcuucauguuccagagcuaguaagauucaugaacaugacacauggcgcaggaagaaagguuugucaagaaaauaauuuuaauugacucuccuucagauaggcuaacucaggucucuuaaguaaauaauuucaacuguagacaacgcaguuucguuaucugcaaauguccauguaauucugcagcccacuuacagcuaaccauguaacguugcaaaccaaaagcugccuauugguaaguacuccuuggcagggaugacauucauuuccucucagggcuucagagcccugcuggugagaaagacugggacucgauugcucccugcccucuaucauucuguucaagaugccuagagaaccagaguaaaaggcaaauguccacacaaaacuggcugaagaguauuccucuccuuuguguuuuagaacccacggccucaggaaagccggacaguauucaguggcuccgucaguauucccuccaucaccaagucccgcccugagccaggccgcuccaugagugccagcagcggccugucugcacguaaguggccgggcggggaggggagaggagcugaggaggugagaccacaaagaaaagguaucccuugcccaggagcaacuuccugguagagaugauggggaccugugucuaccagaagggacuguacagugaugcccgcagcagcaugcccgagugugugggaacaugugcacagaguuaguucaucguggcugggauaguuccugcauguaagaugguaguuacagauugccaucaacuuugaguguccagcagacacuguacacuugacaccagagaccucagcaaagccuucuuuauucccaaaccacugauggccgagcagcuaaauacacuacauccauuuuccuauuucaaaguccuucagucagaagacauacucguuauccucauucuuggacuucccugguacuuuuguuuauucaguaaauacugguuucuauacgugccuuguuuccauauauugugagguucaguuaugcuauauucaucacuacugacaacauaacaacuuaccccacaacuuagaaccauaaaauagcaagcaaacaagcugggcaugccagcacagggcugacgcaagagaagagcaaguguccaggcugagccaugucacagaacucugacaagaaagguuggaggaggcagggaagagacgagggggcgagaaggagccacacaccacagcauguguuuauuuaccucaugagcuuucugagagucagaaugguuugggcuuuuucauaacacuguugacaucuuuauuugccaaucagaaauaacuugggggcagggucacuuagcaucuaagugcagacucucucaucucuggggcaaccagucuugggaacccaauuuuaguuuuagaauacaaacagcaucaggcuaaccuacuacaaccauuuggcaaggaccuagguacuauauuucuagaacaccaguuuacaagcaguagugguagugucuggaaggagucagggauggugaggcugugagggcuuagggagggaagggccucgggggcauugagaacagucugccgggugugcuucugcagugccuucugagcacugacacaguugguggucaguagcuggacauacaauuguauggugacaguuuuguuggauucuuaauguaaaaggcaguuaacaaaaucaguaauacauugaaacagucuauaacucaguguccuucaccagucaugaaacuuaauaaaauuaaaacuuuucuuaagcaaagacuaaagcauaaugagaaacguggaacacuuuuaaaugggcacuaacaguacuugucauguuuccaaggguucuucucuuguugucagugccacugguccccuugcuauaugucccagcucuuaggucagcauuugagggugcccucaaaguaacccccaaaguguuccucucaagcuaugaaauaagagugcuuucuuguguucuguuuucuaugagaguuucugaaaggcagcauuugccuggggauggcugugugcuucugagagugcagcccaugucuuaggagccucugugaggucuggguaggcagaugccccaucuguuagaagaaagcccaacaugucugugguaugacgaugcugagggcacccuggcaauggcagauggcacuggaaggauuccaugggcaccacagggccuggggacugcugucuaaacaccaguagucccauagccagaggacaacagaaacaaccuuccgcaugggacuucugucuucuuggaagccuguacacuuuauagagguguggccucuucugaauacauaguucuucccaaccauuguccuguagggucgucagcccagaauggcagugcacuaaagagggaauucucuggaggaagcuauaacacaaagcgacagcccaugcccucucccucggagggcucuuugucaucaggaggcauggaccaaggaagugacgccccugcgagggacuaugauggagaggugaaugggccauggaugguggcugcaccugccaugcaugcuuaaggccaauguuucguccaggcugaucuacucccugccccuuugcaugugccucugaagggagggcaaggccugucacggguguguaaacuguggcuuuccagaagcuucaggcuucuaaucaccuuucaaugaaggguucagcaguuuucaugugugugcauccuccagucaucucauggaggagcugucugcugacacgcaugggugguuggguuguggguacuggagaggccuggggcagugauuguucucuguuccuuugcuucucaccaacgcuuuguuuguuuugcaggacucugauucuccaaggcauuccacagcuuccaacagcucuaaccugagcagccccccaagucccauuucaccccaaaagaccaagagccucucccuggagagcacagaccgcgggagcugggauccaugagcccaggaccggugacugcaggcagggacucugcacucccacuccgacaacgugccuggcagcagccuugccuuccgcacugcugcaauggggauuccuccgcagccaggcccgcuucacccuccccucaacccccagguagcuucuguagacagacugcgcagacgcagcgcuaagaguagaccgguuguguucucaccguagcccucacguagcgcccagcagccuccaugagcgucagccaacuguugccaggaaguaaacccucacgaauuaaaacaaugcauauuuuacuacaauacagaguuuaaauaaauacauagauguagaaguuaaauacugaauguaaauagucaaagaagcaucuuguguuugaugaaagauggaugcguauauaagaaagaucauuuaauuuaaagaaauguguuguuucuugucuguuucccagcuaugucauauacaggguagaaaggccucaagugacacuguaaagagaucagaagucagguccccauggugucucuucucaagccuaggcaggcugaggucacagggaaaucuaaggaauguuuggagauuagugccauuggugggaugugaccugaacaccaccggggguggugaagccacuccagaggcucacuugcucugaggcaucuugccucugguucucagaccaugucccccacuuacaauauuuugguaucucgcacagaugaaugugaaacaauucugccaccuuccagcccuucccauccuaacggggaauucguggcuucugaagauuaugggauggucacgcagcuacuuuucugucccugccaaaccuugcccccucuagguugcaaugaggagucucuggauuaagcacaacuucccuguugguuaaggguaguuuuaaacacacugcuggggacaggucuccuuacuaaaucacagaaaaccucagaagcauaggcuugaauggccuugaccaaauaugccuucccacgugaggggacgguggggcuuguggugugcuggccaccguggacugugagccagcuuccccucuggauaucuacugcugcacuugucccaggaagcaugaggagaccacagaguccucuacucagacguccuccagcuacgcacacaggaggggacagguggaaacuagugcucaugacguaaagaggcccugccucucuuaauccucuccucuuccgggauggaaaagccaccauuucuccccacuuuaagccacaucugaaauagaucuccaagcugaccuuuacacagcugccaggcccugcaggucagacuccccaggcaugcagcuuuauggggguguuaagagaguugagggugggcuggggucuuuguaagcagcagcuuugacagacacucuggagucuggagugagcaaggguuuuuuggggugggcacugugucacucuauauuuauccuuuuggaaacagaucauauaaaaauaacuuguguacacccaaaaacaagggucagaucuuuaguuuggccagaucccuauacaucugcuucaacuugacacuuugcuugaaagagcugccuccccuucccuccguccuuucccucuucuuucuccuucccccagcagaaaccugaccaggcugagacacgcugaacucuacccugagccuuugguuuguagcuuugacaaccaauugugaaguugccuacaggugcuuguuuuuaaaagaacccuuuuagaaucagucuaaaccucuacauccccuaaaguccggcuccacacagugacuuccaccccagcucugccccaaggagcccuguggauuugguggauuucccacugcugucaaagaacuagccaucccaacagcagcccugcuggcccagaguagagggugggguuccaaaaaugacucucuuaccagauucauccagccuucugugaagaguauuccugucagaaacugggaaaggauggagaaagaugacuagucgguuuccaggagacagaaacaaagauuccucagagcagucaauaacaaagauuagagacaaggccuuagguuuaagccuuucuugagaucgcucccccuaccccauggaagguauuugaaaguguguggcaccgggaauuuauccagaaauggaaaaaaaaauacauuaagagacauuucugauauagugucuauggguuaguacuuggugcuauguccagccuguaugcuauuuacccuuugaauucuggcuaaucuguuaugugaguuuuggguggguauacaaaauauauuacaggguuucguuuugguuuugccaaaaacaaacgccuuccuaucagagauuguuaagcagaucauauauauauauauauaugauuuuuuaaauuuguguacauacucccugugcuuagccauuuguguucuuucccagugagcagcuuuaagacaggggaauaacugcaaauggccuguuaggcuuuccacugaauuccuauagcuaggcuuagagaaagcaucuggaauucccgucauucccaccagcccuucuucagcuacuccucuuucauguuaaaauccugucauuuuguuaauuuaguggccgcguuuauuuccaggcaaguucagcugccuuguguggguccuugggugucauuaaagagaagccagagcagaggggcagccuccguucccagggcagccaccacaaauuuaauucucccagcucagcacaucuagcugccgcccacccagcccacccccaauacaggugcacuuaaaauggcugacacccugcuguagguccuacucugccauagcccaaggccacuguccccuuccaguuccaccuggccccacugcacagcauuucccuguacccuuggaguggcuccuaccuuguuggaaccuucagucuucacaaacccaguuccuugcagagcccugcuacagugagugugucuccugcuagcgccagcaccacacucuccugucccagggacagcaucacacagagcccuacuucaguuuuaggagacugacugucaucagucagccuugaugccauugaaaacaaaaugaccuuauuugauagaauaacagcauuuauuuuauaaauuuuuaggauuuuuuucucauuguaauauuauuguacaguuuugcauggccucaguguaaucauuuuuguucagaaaauuaugaccuguguguguguguguggaagggaagauacugcuuuggccucuuagcacucauuugguuugguuuugucccuagauguccuagggaauuuccugacaguaucugcuaccaaacuauaacauggauucuuuugcacagaacuauuuaaggugggguggucaaaaauguaacaaaggauuucucaccaauauuuuauguugguaucaccuaauuaaccagacuuugauguucugcaauaaaauaaggaacugucagcauugaguauucuauuucuucccguguggagagugugaggcauucuuggcucgcugaucucccucuggaccucuucucuaucccagaggacacaggucgguuugaucggguccuggagcucagguaagaauaacauucaaauccauggaagugcucaacucccuu

SEQ ID NO: 551 - RNA, 2673 nt, Mus musculus
uaauggacaguauuuaauuggggcuggcuuacagguucagagguucaguccauuaucaucaagacaggaacauggcagaguccaggcaaggauguuguaggaggagcugagaggucuaaggcugcuaggagaagacuggcuuccaggccggaagagggucuuaaagccacacccacagugacacacuuauuccaacagggccauaccuccaaguaguggcucucccuguuccaaauauucaaaccauagcaagguuuauacauagauuucaauguacuuauuucacuuuuucuguaaaaaaauaagauugcuaugucauuuaaugcuuuuaucacggaauaauaauaaucacuauugaauacauauuauuuuacuauaugagaugaagucuugagugaaauagaugcaacgcauucugccugcacagcauagggaagacucccggcagaacaguagagugccauguuaccguugcugucagcagagugucugauccgcagugcuuuguuugcaguggaaaucucuugagccuguuugaaugcugugaggaaagagccauuggaggaucaguaagaaagguggacuauuuuaaaacugcagaaaguagaauaaaacgcccccagaagggcccaaagaggguggaauucagaguucuaguaaaucacuacugggcaggagguggggacuucucccugcggcaggaacaguggagggaugagggauggggccauccagguaaagucaagugagaaaaugugcuccaggacaguaaggcuuauaacagaaaagcaaggaaaucuguaauaaaagacccuaccacccagauuuaacuauuuacaguguuuuauuucuucugaaaugaacauuuuuauccaugacauaacggguaaaugaauguuguuuuguagcugagucagauaagccgagcauucuaauguaaaguaaaaaugaaacuaucuaacucauuucugugaguagccauuucuguugguagccaucaugcgagugaaucacguacucguggcucgugucuccauuucuuccacaaguguguagugagcaucugcuccugccaugcagcugcaggugacacaucuguagcauacaugucucuagauacaugugucaugcaucucuugcucucccauucuggaauaggacacuuacauaaacauuucucacaucguauguuuguuucucugucaacaguuuaacugcuuuaaaagcccaacucuuuaaagugcaaugaaaguucuuguuugacaagaauacaguucuuucuuuaugauuucuugauguuuacuucaaaaauguuuuuaacauuauucuuauauaauaacugugagguuuugaaaaauuccauucuacaguugcuuaggguaggucuuucaaaguguuugggguuuacuaguucaccauaaucagcagucugugucuuccuucuguccuucuguccuucccccagguuacaaugcuccauaucucuccguguauagugaaaacgcaguugauaucuuugauguaaacuccauggaauggauacagacucuuccucucaaaaagguaauagagcacuaaacugugggccaaacgguuacuuuuuaaguuucccuugcaaaaauucauuguacguagcagugcggcauaaggccaugcucacgaguauauaucguacauuaggcguacuaccucugaaccccacaacuuuucucccugcuccuccccggugagggucucugggaucaccaaggccagcagggugucagucugcaugaggcaggagggaauucugcuucagugugacucugucaccacuuugguucaaacuucaagagucugacacuggacgguuuauuuuaggcauauucacgcgcagcacaauuugggaaaaacuuccucgugauaauuaacuuagucucaugugcacaaugagguuuuaaggcaugacuacuacuaaaaaaguaguauucaguuuuccuugguuucgcaauuuauuaaacuguugaaauuauuaccuuuuuccuugcuuucuuuacucauucauuacauuuuaaagaugcauacauguuguuauauuuacauccaguucauugauuuuuuuucacuacuauaaaaccaucuuuuagguaaauaguguuuauccauuauccucuugacagcauuacuucugauucauugcucugucggcauuucuguguaucuagguccugaugaaggugugggaauuucuuuacccgaucagccucacaguggcaugcugaggcaugggcugcagcuauggaaccuuaugcaauagugccauguucuuuucccaaccgugauagucacauccacauuauuuacagguccuuucugacccacuucuucccuagcauaucauuuuauaaauuguaguaaauugguuuaucacugagcuauguuugcaugucccaggcugucuuaguuaggguuuuauugcugugaagagacaccaaggcaacucuuauaaaggaaaacauuuaauuggagcuaccuuagaguuucagaggcuuguuaguccauuaucaucauagcaggaaguguggcggcgggcaggcagacauggugcuggagaauccaagaguucuacaucucuaccugaaggcagccaggaggagauugucuuccucaggcagcuguagguucucccacauu

SEQ ID NO: 552 - RNA, 17025 nt, Mus musculus
aggccuuccgucaucgagaugcgaccggauggcugugucgccuagugccugucgcaguccagagguuccgucaccagacgaaauggcggaggcugcggugguggcguggguucgcggccccgguaccguguggaaggcgcugccgugugccucgguugggugcuccgugcgcgaugugaucuaccgacacugccaggaacaggugaggauggcgguucccgggaaaugggggaaagagaucaccaagccaggcuggguucgucguuggguguuucugacuaauauggggacauuccucugcuagucuauggcagucguuguuuuguccccacgucguaagagaaucuccguccauuuacugcgcuuuguccaaccucgacuacaaacucucguucuguuucuuuuauccccccaaaugauaccuuuaagguucucuucuuacauucacauuauagauaggaauaugcuuucuuaccgacccucaggacacccauccaggccaaagaacgguuagagaaggauauggagucauccugacagagccaaucacucacagauauucuugggccucuuuagacucugccauguggauauaaaacccugguuaagugcuucuaaaguuuuaagcuuuaauucccaaagaagcaggcuuauacugacuaggaaaucucaaaccucuucaaucaucuaaagaguuuacuggguucccugagucuaauuuuaaucugggcguuugguauagaacaguuuuucuguaugacugcgccuucguuguagucuguuuucucugcuuguuauguagaaacauaacaaauguuaaaauaccaaaucuguuccuaaagagacuuggaugaguuccaagaagaauaugugauuuucuaauuucuuuguccuuuaaaaaacaaggacaagaaagucuuuccuuguagcccaggauguucugaacauacuggagggcugggauuauuggugugucccaccacaucuagccuuuguuuucuucucuauucugcggucuaguaagaaaaacagaaccuuuuuuuagccauucgaauucagauacuuuccaaaacaggugacuuuucaauguauuugaagaauaauuuucaaguuuuauuuuuaaacuuaaaauugauccauaaacaauagaaucuuaacaaugaggaguguuggaaauacacuuuuuugaaaggacacagaaauaaggcugggccuggugguguaugccucuaaucucagcacuugagagguuuggggguucuuagccacgucucuauagugguuuuggggcagccuggacuaugugaaacccugcuugaaagcaaaacagccuccuaucaccucguccuuagauuuaacagaggcacuguacauggacuaugggaguccagacauccagaaaaaacccccaauagaauugaguuuggagaacagguaagcagaagcaguuaucagagagcauuugagucugucuguuacuuaacaacaguaaaugugagugcaagcagcuuacuaaggacaguuugaugaaauaggaaaaaucaagauaguucaaguucaagcuauacuuuuuaaagcaaaacgguucugauccaugaagaaguuuuaucucucgcugagagaggaagaccucugcccuguugaucauuagccuuaacagacaucaguaaaggugacuacaaguuaauaggagacucccaaggacauacugcaguaguaaaaugcuguaaggaccuugacaaucuacuccuuucuuauuugcugggggaaaaguugguuuuaaaaacuggagaugagaagaauucggcugcugaaggugucaguaagacagcaacuuucugcugcccuuugucaugaaggcccagguguguguacaacuuccaauuagggguuccugaguagaauauucugcauccaaaauguguauuuccaagggaagaggagccugguguguucaacgguucaagccugacguuggucauuuaaguuucucuuaaccucuuuucuuguagcgaugcuugguuuucuuguuaggaacuggagacauuugccaugguuucucuguuugcagcuccucacggcagagggucaguacauuugaccuuaguggacugcacguugucucuggugcuuaggcugguaggcugauccugcaaaggugugggugaauacaguguauuggaacauuuauaaucuacacauuugggaaauguauaaucuacacauuugauaaaauaggaaauucuuccaaauucuuuuuucuacuagaaacuuaauagacaggauuuuuuuuuaaagauuuauuuauucuaugugaguacacuguugcucucuucagacacagcagagagggcaucagaucucauuacaagugguuguaagccaccaugugguugcugggaauugaacucaggaccucuggaagagcagucagugcucuuaaccauggagccaucucuccagcccaauagacaggaaucuuaacuagaaaagcaagggguugggugauggccuaaugguugcucuuccagaggucucagauuuggcuuuuagcaccagugucaggcagaucacaaaccacuguaaccccagcuguccccagggauguggacgacucugaccucugaaggcaccugcaccaacaugcccauacuuauauacagacaugucauacacuuacacacaaugaaaagggauuuaaaaaauuuuuuuaauuaauuaauuaauuuauuauauguguguauacuguagcugucuucagacacuccagaaaaggacaucagauuuuuuguuacggacgguugugagccaccaugugguugcugggauuugaacucaggaccuuuggaagagcagucggugcucuuaaccacugagccaucucuccagccagaaaagggauuuuaaaaggaaaucuuuuuguaaaaaggaaauaaaguacagcuuuuuuuuuuuuugggggggggauacuuuuaaucuucacugugugaggaauuacaaaaacaauaaauuaagccauauauuaaaccaaaauuuccuuuauacaaaguauuaaaauacaauuguauuucuaaaugaaaucauaggcauacaguuguugucauuaaguaaacuaagccaaaugcuauacauuaaagagaaacaucaauaaggcaaauguaugaaugaagacacuucugaacucccccauuucaucgagcaucaaaaaccaccaaucuuuuaguccuuuucuuguacauuauucuguauccacauucucugcaucugaugggaucccuggacuuuaucucauuuucggugugacacucuccacaaauaucuaucauuggcugcugcuuuggugguugaacaucuuucugagcguccauugguagugccuccucagcuggaagaagcgccccuucucugacuaaaguacagcuuugaugcagucuuugccccucucugaacaauuuuguuuggaaauaaaguuucugcuuucacauugucuuucaaaauuauuuaaaaauuuggagugagucgcuuuaauaccagcgucagggaggcagaggcaugugaguuugaagauagccuggucuauagugagaacuccaggacagccagggcuaugaagagaaacccugucucaaaacaaaacaaaaaauucauauacaauauguauuacauauaaagauguuaaagugguuuuuaguuuaaaaacaauaugaggugaaucuuuacaacuuaagguagacaguuacauggacuaaacaacccuuuauccuaauuuuguguagaugcccccaguccccagcuggggaagcccuaucucuuguuugcaguggugucuccuguaccuuuccaucacugagaaggaaagagauugcuucucuucacauuagcacuucugucuuucagcccugugugcagccugcccuucucuugcugugggugaacugucauuauucuacaauuaauuuguaauuaccuucuuuguauaguuaggcucucuugaugacauagccaagagagucucuguuggaggauugucucuaccaaauugaccugugggauuaucugggaaucguuuucuuaauugcuaauugauauaggaaggccaaggcuacuguggcuguauauugaccuggcuauccuggaacucacagagaucugucugccucugccauccauguucugggauuaaaggcauggucaccuuuccaggccaguaguuuuauuuagagugaaaccugaaauucucacugaguguggcagugcacauccuggugucuugcaaguuugaguagacaaucuaggcaacauacugagauaagcacucuacuaaaaacaaaacaaaaccaccuaaaauguacuccugacucuuccuucuccucucuccccacuuacacacgucagggugauaugcauuuuaagcuuuggaucaguuuugauauuaaauugacccccaguguauagaggucaggagaaaugagugagacuucugccuugcuagaucugagcccugugcaugcacuacagugagucacgugaccugcaagagaggagggugcaucggccauugcaggaaacugcacccaacacagguuuggucauguuuguuuucagcucaacaaauagucuucuaaccuauuagcugcuuaaggugauuacuaagaguaagcuaggccucgucuacugucauaagggcauuaaaaccuugaucuugucuccaggaaguucccguggaaugcuucuuugugacgugcaauggaguccucguuaaugccggugauaaggugcagcauggagccguguacaguuuggagcccaggcuucguggggggaaaggagguagguagugcugauggccuugaguagcagccugugaaauggagacuugcuggucucuggcauaccagccuuggguugccuugugaaaucauuuauacuaaguuuuggguaauuugggguggggggguauauucucuuucagcaaaaaaauaacucuuaaaaaucccagcuucuccagcuaggcugcacuuuaaggaaguuagaugauaaaaguaaccauuauuccuuccaguuuguugaaggacaagcuuucaaacaaucuuugccugcuuuuuuucaagauuugucucuuguuguacucuucuaagggugacccaaagucaucuuaggaaacagguuuucccaggucagguagauuaagguccuggcuguacugauuaguuaagaagaaagcaaagagggcuggagagaugauggcucagugguuaggaacacuggcuguuagagacugagcagagucucuagagaaccaggguucaauucccagcacccacauggcagcuuacaacugucuguaaaucuaguuccuggggaaccauggcaccaggcauauaugugguacacauaucugggcauacaggcaaaauaccuauacauauaaaauaaauuaaaccuuuuuguuugguugguuuuuuaguuuguuuguuuguuuuuuuuuuuucagacaagguuucuuuguguaauagaacccuggcuguccuagaacuagcuuuguagauuggcuggccucaaacucagagaucagccugcuucugccuccuaagugcugggauccaaggugugagccaccacacccagcaaauaaauuaagaagaagaggaggaggaggaggaagaagccaagaaggcagaagcaugcagacugcacuaagagcuggggguuucuuuggaugcacaaguguauucuuuauuuuuauuuuugguuuuucgagacaggguuucucugaguagcccuggcuguccuggaacucacucuguagaccaggcuggccucgaacucagaaauccaccugccuuugccucccgagugcugggauuaaaggcaagcgccaccacugcccggcacacagcauauucuuaaguuuucucagagucucaguguagucguccugccuguugaaauguguuccuaagaaagcaacauguccacagauaccagcagcuuaagguugcccucaccguaaacaucauuugucuuuaagacaaggucuugagaagcaguucaaacuggccucgaacuuguggcaagucugcugccucaguuucccaaaugcugggauuauaggugggugcccucaugccaggcucacuucauaacuuugaaguuuuugguuuguuucuuuguuaauuuauugugacauugcuacagggugacuguaacuagucugaucuugaacucaguaugacccaggcuggucucaguuuuccuccuccaaccuucacauaguguaugaaccaccauaccugcauagaccaggcuggccucagacccacagacccucuugccucuguuccucucuaguugguuguaaacacaguugauauagaugcuacugguggcuaauauggugcgcuucuuacagcaaguuugugcugaggggaaggcacaggcuuuccugucaugagccacugucugcaccaucacaugagucuuguagcucuguacauguggcguguauuccugugcauguguguggguuaugcgugugcauauguguguguuaugcagaggccguggguugaguggauugucuuuugaggucacucuucacuuuaucuguggagacagauuucucacugacccuggagcucaucaguuugcucagugaacucuggggauccucuaguccuguggcugggguuguaagcguguguccuguccagcuuguacguggagcugagaccccagacgcagcucaugugugguucuacagcagguaauuuacugacugagcugcugcugaagucccuucgcuuaguucucggaaccuuggucuggcuuuggcuaaagcuuuucauggauccuacuguacaauacagcauucaaauggauggcuaccuuaguguccuggguaaaaucuuagguguccauuuucuuuucaaaaagaacaagagagaaaggagugcauuuuuagucuuaaaggcuguuuucauuaaccugccuuguaucccuaacccucuuaucuguguauuuugguuucagguuuugggucuaugcuucgagcacuuggugcacagauagagaagacaaccaauagagaagccugccgggaucucagugggaggagauuacgagaugucaaucaugagaaagcguaagcuaucuccuuuuaguuaaaucuuugucuugguugggguuuuauuacugugaagagaagccaugaccacagcaacucuuauaguggcaaacauuuaauuggggcugacuuaguuucagagguacaguucauuauuaucauggcaggaagcauggcagugugcagguagacauggcacuggagaaggcaccaagaauucaacaucuugaucugaaggcggccagaaagaacugucuucugcaagaagccuggaggagacucuugauuucacacugguggagccugaacauaggagaucgcaaagcccacugucuuagucaggguuucuauuccugcacaaacaucaugaccaagaagcaaguuggggaggaaaggguugauucagcuuacacuuccacacugcuguucaucaccaaaggaaguuagcaggucaggaagcaggagcugaugcagaggccauggagggauguuaccuacuggcuugcuuccccuggcuugcucagcuugcuuucuuauagaacccaggacuaccagcccaggggauggcaccacccacaggaggcccucccacccuagaucacuaauugagaaagugccuuacagcuggaucucauggaggccuuuccucaacugaagcuccuuucucugugguaacuccagccugagucauguugacacacacaaccagccaguacacccacuuacacaaugauguauuuccuccaacaaggccacaccuccuaauagugucauucccuauggccaagcauuuaagcacaugacucuauggggccaaaacuauucaaaccaccagucuuuuauaguauugugacauucaacaugacauaccuuucuggagaaguaucauaauaugauuaggaguccauuaauugucuagggaacauuuuuuuauauagucaaaaugcuugggggugaguucugggaaauaccuuguuaacagaauuccugaucaagccacagagggagcauuagagagugcagaugaggagauugguggacugaugcaugaguguggcuugugagacauggcauacaguuuccugguaaacuugauaggauuguuugucucuuguguuucugguuuuuugagacaggguuucucucuguagcucuggcuauccuuuagcucacaggguggccuugaacgcacagagaucugcuugccucugccucccagugcuggguuuaaaguuguucgacaccaugccuagcauaaguaaacuugccucaaggcagagguguacgugaagcagcacuagagcagcagugugguuuggugguagcacacuugccuaagguccuggcuuucaucccugugaucacccuccccucaauaacuagcuaggugggucacggggaguuauuauuagcaaacaguaugucccgggcuugacuggucuguacuuuaacacuacuuguagcuggagguguuggguuuuuguuuuuuguuuuuaauaacauaaacaggugaauaaauauuacuaugaauacaauguuauuaaguaauaagaguuuuucaaguccuucgcagugugggacuaccuucauacgcauggucugccauugaucuaagugcugugugacaugugcuguguaagccugugcacgguacaccauccaguuacgucccucccuuccccaggauggcugaguggguaaaacagcaagcugagcgagaggcugaaaaggagcaaaggcgccuggagaggcugcagcgaaagcuugccgagccugcacacugcuucaccagucccgacuaccagaggcagugccaugagauggcugagcgucuggaggacucaguccucaaagguaagagcaaggaauccuccacaugcucugcggccccuggagccaggauccguugcucauaauggaccugagcauguuggaggagggugaggaacagaacaccuuggagccucugcucaaaacucagcacagccuguuaucacgugcugacccuccaccacacccagcacagcacugauacaacguuagugugccucucuggaaaucccuuaggcuccuuagccuagccucuaauggcugagccgucucuccaguucaucuuuuuuuuuuucucccugugcagugcaggacuaggggaagucuucaggaguuguguacauaugucagcauauuuaaagcauccaagguaguguccugggccugucucgaguccaguuaauuuaaagggacuuuucaucagaaagacuaggacaagaaagacauauauguaaauaacuguuagcuaugaaccuucagcuucaaguuacaaauugcauguuguguuguaaaaauacaauucuaaacuggguguggugguacacuuuuaaucccagcacuugugaggcagaggcagguggauuucucugaguucaagcuucacccccccccccuucacccccccccccccccccccccgucuauagagagaguuccaggacagccagggcuauacauaaacacccugucuugaaaaaaugaaacaaaaagccaaaaauccagacaguguccuagcuaggagugauggugacacaugugacccucccacuagagcagugcacacaggaucagggaucagggucaucuccagcuacacaguguguugaggcuagcuuggucugaaugaggccuggccacaaacaagugugguuccauaaugguuuuuuugcauuugagauuaaucucauauccauuuaaaaaucugguaugacaauuuacauucaucaggugaggaacaaccauaacuaagucugugugaaaacuuguuacuaaauacagagcuucagauuauagauuguauccugauagcaauggcuaaauuuucauuuagguaugcaggcugcauccagcaagaugguaucagcagaaaucacugagacucggaaacggccuaacaagucaaaaacggaccaggaaacuagugcaaaaaaaaggaaaaggaaaugcuuuugguaaguccuuccuguuuccuccacauugaucuuggaggaccugugugccguuuccaccuuaucuguuggcacaagugccaguccuccccuccccccuucuccugauuuucuucuuuuuuuaauuuuuaagauguauguauucuauguauaugaguacacuguagcugucuucagacacaccagaagaaggcaucagaucccaucacagaugguugugagcuaccaugugguugcugggaauugaacucaggaccuuuggaagagcaguuggugcucuuaaccacugagccaucucuccagcccccgauuuucuuuuguuuguuucuuuguuucuaauauuuaugugaaauaggguacugcucugccugccaggcugcccuucagccuuggggcucuccugugucagccuucucugcuuggauugcagaucaccaacgugggcuccacacucagggcucaaacaagcacguuuuuaaguagcauugcugggagcacucagagcuucagauuguguugauugugcccuguacacacugaagccauuuggcagaaucugaacaauacauuuggguguguauguggucuguguguguguguguguaugggugggugcgcgcacacgcuauucuccuaaaauuacccuuggaacuuucccuuucuguaucaauuccaacuguugauaguuagacacaguaauugauaguuagacacaguaaaaagccauaugaaagugcuuagggacugauugcccuuccaaaggucaugaguucaaaucccagcaaccacaugauggcucacaaccaucuguaaugagaucugaugcucuucucuggugugucugaagacagcuacaguguacuuauauaaaauaaauaaauaagucuuuaaaaaaaaaaaaaacaaagugcuuaggucugaggguacuggcgagaacauggcgcucgcgucuggcuuuacagugguugaaugcagcccucuugaguuguuuccccuucuguuuaugcuucagaacauacuuuucugaaacuugccuacuugccauuuuaagcuagccuguguuccuuagacagagaauccuccaugcagggagaaagggauaggcugggaauggagucacgcccuucugcuucuccccacagguugggcauggaugggcuggaggcugccgagggguccaguacuggaagcucagaggacagcucagaggaugacagugaggaugcuccugggacuucggagcagagcugcugugcucgggaagacggcauugaugcuguagagguggcagccgaccgaccuggcaguccucggagcucggccucugguacacacucugagucaccugaaaagcuucagugccccgugaccgagccugggcagggcauuuuggagaacacaggaacugagccaggagagaccucugacaaggagugcaacgagaggaagacagucacagacccagaggagacgccagcaaggaaggaaacagagagucaugaggccacagaaaaggaccaaaagacaggaaugucugguggggacagagcugccaugguuuugucuggagaagacaggaaaagugucccugcugcuaaucuggagggaaacaacucaggagacacaguauguuggggucuuguuuucacucuuaacagggacuggggguggggguguagugcacacuuuuagucccagcacuaggccagccuggucugcagagcgaguuuucagggcagccagggcuacacaaagaaaccauaucucagacagacagacagacaaacaaaaccaagcaaacagacuggagagauggcucagugguaaagagcacagauugcucuucaagaguucaauucccagcaacuacaugguggcucacaaccaucuguaaugggaucugaugccgaguuuugugugucugaagacagcuacaguguacacauauacaugaaaauaaauaaaucuuaacaaacaaacaacagcaacaacagaaauagcgagugagagcacuggggugcaugcucuggaacuugcuauguagaccaggcuggccccaaagugaaggucuuccugccucuaccucuccagcacugggaugacagacaugagccaccaacccagcccuugccauuucucuucuaauguuuuucuuacguguaugacugaucugcuugcauguguguuugugugggaagcgcauguauggcacccacagagacugaaggagggcauugguccacugggguuccaggccauguccucugggagagcagguggugcgcuuagccuccgagcucucuccauccauuuagucugguugguuuuguuguuuuguuuaagauagggucucacuucugugucuggcuugggacucucuaguccaggcugccuugaacucaguguaauucuucucagccuucaaaaucuaugacuacaaaguaaucuacugcagggguuuggguuguuuguuaguuuguuuuuggugggggguugcaguagugucugaucugcacaguaaaggguuaagaugcagaugugccucuuccccaacagcugcuuagugaaaaccauuuaaucccacagaugagagaagcuuguccucuaagcucugaaauuucacuguucugccacuagguggaguccuuggugccauguuuuucaguucuaagauagagcuucacauuuggccucguuuggaauuuuucuuuuucuuuucuucuuuuuuuuuaaguguuuuuuuuuuguuuguuuguuuguuuuaugguugaggagaagguuuuuaauguagauaggagagagaguacagccaguggcaucugaaaaggguucagauggaauugggccgugggggauuggagaugaggagggaaggagggagagagggaaggagggagggagggagggcaggauguggggcaagugcacccauagcugaggacccagaggaccaagagagcaaguggcagugauggcagguuucauagagaagagaagcccuguuuaagacagagucucacuguguggcccuggcuguguuggaacucacuauguagaccaggcuggccucaaacucauagauaucuucccaggugcugagaugaaacucacacuaccaugccugacuuguauuuauuugugugugugugucuguuugucugucugucugucuuuguguguauauucaugaguguguaugguugcccagauaguccagaagagggugucugaucccuugguguuacagguauuugugaaccaccugcggcuaauauccaaacuccaggccgcaugauagggcaguggauguucuugaacauugagccuucuuucuagcccacuguuuauuucuuuauacaugcaauaacaagucuauauugguacuuucaaguugaucaagugcgcuauguuuccuacuacuaaauugaggcuugugguuuucuuuuccuuuccuuuucuuuuucuuuuuuugagacagggucuuucuguguagccucugcuguccuggaacucacuauguagaccagacugacccucugcaucccgauugcugcgaucaaagauauguauacacacacacacaccgcccccuagaguuuucuuucuuaugugagacaaaauaauugucaccuggauauaaaggucuuuccuauagaagagaaaaacccauuucuuuuaucauuaaaucuaagucucacauucuguccuuuuuguccuuuuauuugggaccuuuagcuuaagagcugaaccaucucuccagccccuacauggcaaggacuaucccuagcgcucuugugaaggugaaaggagagggcagagccagaguuguccucacacacaugcccacacaugucacacacaggaaggacauuacguuucagggagcgggggagauggcucaguuaagagagcacuggccucucugccagaggaccuggguuugauucucagcacgcacaugcacacacagcugucuuuaacucugguuccaaaggaucugaucucccccccuccccccccccucgccucccuggcuaugagggcaccaagcacacacacaguucucaagacauaccugcaggcaaaauacccauacacauaaaauuaaauaaaacuuuaagaaggaagaaaaauccuugcagggccuuagaaguguugaguuucgucugaaagucuguaaagguguuuuagguagaacagcugcgagcccaucacacacaucuucuuuaaucaccauguaaguggaagcacguuggucuccuuacguagcuaguacugaacgcucgaagcucguggagcacagaguaagaguggcuacccaccaguauuagccuuugggugccugcucuuaugauaaaauuaugagaguaggcuugcucuguauuauaacuggugaaaucugaaaagaaagaguaacguuaacaacauguucugagcugggagugcugggccucaccucuaacaccccagcacaugggagggaggcagaggcaggagugcugcuaaauguuuuaggccagggauacauacauagcaagacccagucuuaaaaagccaaaaacagaugccagguaugguggugugugccuguauccuagcccuugagaggcagagacaggaggaugaggaggaugaggaguucaaggccagcuucagcuacauaagcaaauucaaauuuagcuuugaguauaugagacccuguugugggacuggggaggaacuguaugcuugucgcugucgugagugugucuagucaguagcagggagaaaauacagcgaauggcacugccuuaaaauagaauguggugggucuucagucuucacaggcuggcuuuaaugcuucuuuuucccaucaggcucuuggucuggaagcgguggaucugucagcauucagcucugcagccgaguuggagucgcuggguuuggagaggcucaagugugaacugaugguccuuggacugaaguguggggggacccugcaggagcgcgcagccaggcucuucucugucagaggccucacaaaggaacucauugacccagcuuuauuugccaagccuuccaaggggaagaagaagugaauuuccuuggcacacuuccuccgcugugacagacuuguggccuguguuccuuuugauacuaaaagccaauuuuuuaauaauucgguucuaacuagucucuuuucaaacuagucucuuuucagugguaccugaacuugagguuuucguuggaggagaaaacuuuuguauguuauuuuucuuuguuuuugauguuuuuguaagagauacucuguagcccagacugaccaagaacugugugguucacuuuggucucaaacuugcagugauccuccugucucgcaugagcugcugugccugcuuugucagagguuuauacauuucuuuggcuuuauauacugugucacuugaguaagauauuuucaagaaauuuauuuguauaacccaaagcagucagguuuguagacacagauauucauaacauucauuuuaaaaacuuguuucucuuucuaggagagagaaagagagagaaugagaauaugaaugugugugugugugugugugugugagaccagggauggagccuagcugcuuccaggccucucacuggggauuuuuauucuagcuagggaccuauuuuguuugguuuucaaagaaucaguuuuuugucuuuguggauuuuucucaguuguugaucucauuggcauuugaauuguauuuccucuccuacaugccuuguguuuaucauuuuucuuuagcuccuuaagucuuugaucacugauuauagauuuuauuuuuauuauuauuaguguauugcccaauuagcaaauguuuguguuuucuguaaauguuuuauugauagugacucucugacuauucaggacagaaaguaccuggcauccuuguugugacugacccaggauagggucugacaugaucugugcuguguguguuggaaagaacguaccaucagccggcagcaggguggguucuggacaccuaucaugugagugguuggucggaucggucagaugaccgccuucgcugguucauuuucauaaggaacuaagagcaaaaucaaaucucaauuaggauuguggcaauugccuuuuuugagauuaaaaauaacuucaucagcguuugcuaaguugucaguuguauauuaauucagugacuuuauaugucuggcucugggcuggagagaccgcacugacugcucuuccaaagguccugaguucaguucccagcaaccacauaauggcucacaaccaucaguacagcuacaguguacucauauacuauacauaaaauaaauaaguaaauaaaucuuuuaaaaaauauauggcucugauggguuuuggauuuuuuuccccaucugacaguucacgcauggacacugcguccugauuagguccacaguuucuacuucucuaacucuucugguuuacuuuauauguuaaagcuacuguucaguucuuacacuuauugaacauuacaucaugaaauucccuucaucucuggugaguuucuugcucaccuguauuaucuaaagcacagcuuuguccuuguuuccacagugcguuuucuguuccucucuccuugcuccuccugucuaacacacagcaggugugucucgcaucugugucugacuucuugucaucaucaucacugucauagccaugauugucauugucaucaucuucaucuggucccugucucugaugacaggucagcagugagucacaugguuguuucggucauaacauuuucuuugggguguuuucaggugugccuaaaugucuacucuucugcucuggaguuuggugaacuucaugguuuuguauauuuauuccauuaauaaauuuggaaaaaauuuuaagcaauu

SEQ ID NO: 553 - RNA, 7007 nt, Mus musculus
guggacugggauaggaacaacaggcccucuuacccacccugguuuuggucauucuaaggaaggugacccaguugggguuccgggcuggauuucuuccuuccuagaaaagccucuccucaaaggcagcuuugcacugucccagguuccaaccucagagaggcaagaaggaagcugucgacaaacaucuggagggcugccuggggggucucguguugggcugaggcuggccucccggaugguucuucucccaauuccaccaucuugagcaaaugaggagggaaggcauagcaaggucacuuagggucccugcccuuaccacuuucauccaguccucagccaccacagagcagggagcaagugagcauuccaguggcaucuccauccagcuggccucccuucugaagcacuguccuuucucccccuggucugacuuuccugguauucuugcaguuggagcuucaggugcuggggacagcauagcaugacagggggugcccacagcaggcugggauggagaaaucucagaaguccgcgcagcuccuugugaaaaaaagauggugucugggacccugacaaggaggacacacaucccucuaggggacccaccaucugaaauaagggacugccugcaguaggcugggauggagacaucucaguagccuuuggugcucccauuucucuuaaacuuagcccuugacaaugacuguauagauuucaugugcuuuucagauggccuugauguucauaauuauucuguuauaccugacuuuccuacucccuucuccuucugcucuggugaauucugugaaacuagauguuccuugauguaaugauucuuaaacaacucaaaauugagacacagggacacagcacagcacaguccugauggcccaggugcacgguuguacauucucaucuuggaaacaauggcaguuuuggauuaauguuugacuugcaaagaaaguuugaggaaauuauuaaaaaugaaacagagccacuuacugcuagagucauacaggauccauuaccagaaagugaaggaauuuauuggaauuaugaaaaagcauggccgggcaguggugguacacaccuuuaaucccagaacuugggaggcagaggcaggcagaucucugaguuugaggccagccugaucuacaaagugaguuccaggacagccagggcuacacagagaaacccugucucaaugcccuccccccccaaaagcauuaguacaagagacauaauccugggauaaagaagaaauggaauaagggaacauaaacaugggguacuuuuaauuuagagaggaaaaagcuauugaauuuaugaaaugagguuugcacaacacuuaagaguaguuccuggucucuuuuggauauauauggauaagaaaguacagaaugcauaaaaucuuauacuaguaaaacuaagccaaaacaccgggacucuuaggagggucacugugugcaaugugcagaagcagaaagcuagcagaacugccaaguuaagggugaaccugagucuuucuggccacugccuggcagcuuugcccaugucauuuauuaucagagcuucacgggaaaaugcaaguagccgacuucggagcucugagcucuggaguauaauaagucaaaagguaaaguuuaaauaaugauaaguuugcaauaaauauuauuuuggccagaggccugggaauaggggaagcuugaaacuuuggaagaacaauuguaauucuugauucuuugugugauguggguauuguuuugauuuggcaacuauuauacaaugucuuuuuuuccuaucugcauuuggaguaucaauaaaagacuagggcaagaaaaaggugagagagugggucaucgaguggagagagagagagagugagaugcagaugguguggagagugugugugagugaaagaugagagaaggugaguuauguguaugugagagagagagugugaggagagagaguguguggagugugugaguggaaaaagaagaacacacagagugagugcaugagagagagagagagagagagagagagagagagagagagagaaaacacaacuuuaaggcuuuaaaacugccugucaguuuguaccugaaaaguugucuaugucuguuuauuaugggccuuucauauauccccgcuuccaguugauaacuaugauccuguguugaggcuggacccugaaacucagguaggaggucuuaaggugauuuuucauuuuuuguuuuuguuuuuaucugggaccaggucgaggauagcugaguguugacacaguuucacacugccccggcugaccucacauuuacuaagugaggauggcccugaaccccugauuugccuguuccugccugggcuggguuuuuaggaaugcaguaccauaccuggcuuggaucucaagacugagcccagucagggcuaucuaaugaguuuuaaggcagcauuagccacauagacagucucaaaagaccaaccaaccaaucaaccaagaaacaaaaaacaaaucuggaauuucagauauggagguuuguagguauuggcauaaagaagacauuugggggugcuaacucagcaguuagucaucuauaauuccaguuccaggggaucuggcaccugcaccagucacauacacgguacuuauaaaacauacauacacaucuaauacagacauauuugcacauaaaacauaaauaauucaaacaucacguuguuuugguuuuuuuaaaagaaagcguuuuaggcaggguaguaguggcauacaacuuuaaccccagcacuccagaggcagaggcaggcggaucucugucaguuugaggucaccccguucuacacagcaaguuccagggcuacacagagaaaccuugaagacaaaccaaaacaaaauuaaaaaagaaagaaaagaaaauguccuuauuguuuguggcauuugucuuguuuugagauagagugucaccaugcaacccaggcuggccuacaaaccuucuuauccaaaaugcuuaguccucucucagccuuccugagagcugagacauagauauauaccaccagauuggauuaagaaagcauucuucaauaauuugcaaaaaguagaggguuaaugaauucaccuuugacgaaguacaaagguaccauaaaccagaaaagaaauaauuauuaaaagaaaagaugugggguggguggcucagugguuaagagcacugacugcucuuccagagguccugaguucaauucccaggaaccacaugguagcucacaaccaucuguaaugggauccgauguccucuucaagugugucugaagauagcuacaguguacucauauacauaaaauaaauaaauaaaucuaaaaaaaagaaaagauguggagaaucuagucgacacauuuguaauaaggaagugcucuguguccagaagccacaaggcaacaggaagagauaagcuugagggcuagagggacagcucagcagcuaggaguacaugugcacuccuccagaggcccuggguucgggucccaguacccauagcugcaggggaucugaugaccucugaagguaccuucacuuauguggauacaccuucccuagcccccacaaacauauacauaauuaagaaaauaaaucuuuuuaaauguuuuuuaaaaacauacuuggaauagacagagcuggguguguggcgcaugucuguccacacugagacagaaggacagcagguugcuuuauuuauucuuuaccaucagagucugauccaaaaacucacucuguagcccaggcugucuagccuuaaacucaugggaccaccgggcagugguggcacacaccuuuaaaucccagcacuugggaggcagaggcaggcggauuucugaguucgaggcaguuuggucuacaaauugaauuccaggacagccagggcuacacagagaaacccugucucgaaaaacaaaaaacaaaaaacaaaacaaaacucaugggauccucuuaccucagccuucugaauucugggauuauaggcuugagacaugcugggcagggcugcagguuuaaggacagccugagccacauagugagacccugucaagauggagagaaaaaggguguguguugggggagucugagugccugccaauaaacauuggaaaguccagucgcacugauagcagaggagugcaagacaagggcaagcuaucugguuccucuccguuccaccuacacacuagauggaccuagguguaggugcucaauuaagagacuuuugggaaacucuuuuucucaacuggcauuuaagugggucuuuaaugaggguaaucuacaagaaucuggcaaagccauaaaaucugaacauccuaucaguuucagggccgauucuccagaaaugccucugcacaggcacagggcuuucuccucucucucucucucucucucucucucucucucucucucucucucucucucucucucucucucuccucucucucucucucauaugcacacacucacacacguuuaugccuguaauuaauuaccagcauuccaaaaggcuaugguaagacgauuacugggaguuuguggccaacuugggcuacauaaugacuucuacccuguucccuguuuaaaaaggaaaaaaaaaaaggugggcaugguggcgcacaccuuuaaucccagcacucgggaggcagaggcuggcggauuucugaguucgaggccagccuggucuacaaagugaguuccaggacagccagggcuauacagagagacccugucucgaaaaaccuaaauaaauaaauacauaaauaggaaaaaacccuaaaaugauaauauuauaauuaauuuauggcaaaauaucugaaagaauaauauaaaaaugauagcagugguuaguuaccuugggggaguuuucagggaggcaucgaggaugaaggaauguacuagaauaaggaagguugggguugucuuuaaauaguacuauuuaaucaguagcucggugauagauuccuugccuagcauguguaaaggccuggcuggguucaagcccuggaaucagucaucaaucaaucaaccgucaaucagcaaguaaauaaaccagaggaaagacgggugcagacugagggaagguaguuaauguuguuuuuuucacagcagagaaccguuaggaaaucauuguuuuaaaaaaaaucuaauuaugguuuugaagcaaaccaucagaaguuaucuuugaugaguggagaaggugaagugggagguaauugcuuuucuaugcuguuugauuuuaugucacacguccccaaaaggcucccaccagggccucccugugcuccaggaggagaccaaaugcuggcaggguggcucagaggaagccgaagcccuugaugccugggaugucaccuucccuaacgagcgagcgcaggaaguggguaagacuuccagccagccuucuccccagagugaugugaaggcuuguaucccuucccaugcuagcggcagcugagcuaccaguaaugaacuggcauugcuggagagagacucuguccaggacggcuuauccuagugauuucccucagacccuguguucaucacuaugucucuguuuguccagcaaaccucugguugucaggaauguaaauuucccagccccgaguuaucaccagcuggggcaauuagaauagagggcaaugggccuuaucacuaauccuguagcuuggauagccucccccaggccuuccuccuguacacacauaguccagauccacagcuaauaaauaagccugugcuguucuccucugcuaggcaggcuggaguggcaccuggaaguauaagacuggaggccaggguccuggggacagcccucucuguuaaaaauggaagggaggggaagagaagagugaggaacgaaaacaauuucuacuucccgaugcucugugacucauauauggaaauuaaaaagguuaucugugugcaggggcagcagaggcuccagagccaggcgagguagaggaacggauccugggaccagguuagcuaaggggugugagggcgcagcucugugggaggacuaaguucugguguguuauugcaucaugagugguuauagaugccaugcugaguugcuggggccggaggcagggcucagugguagagugcacacucggugaccuggaggccccgaauccaacgaguucuauuuguguguuacaaaacagcuugaggagaggauucuauuuuucguaagacaaggucuuccuguguagcccacacuaaccacaaacucaugucaguucuccaaccuuagguucccaggugcugaggguacaagcgugagccccuacaugccuauuuuuagaaaaggggcuuugaauauucuucccacgaagcaguagccaucacaacgauguauauauuauauacaucaaaacuuugcacucuaccccauagauagagacaguuacuuaaacauuuagaaucagguugugcaguagugaugccugccuuuaaucccagcacuugggagacagcggcaggcagaucucugugaauuggaggucagccugaucuacagagggaguuucaggucaacuagagcuauaaaguaagaccccccccacaccucaauagauagacaggcaaagagacaaaaaauuuagaaucaaaugugcuuaaagaaagaacaagacuguugggcagugguggugcaugccuuuagucccaacacuugagaggcagagacagggagauuuuugaggccagcauggucuacagagccuguuccaggauaaccaugacuacucagagaaagccuguuuaaaacaaacaaacaaacaaacaaacauccaaagaaacaaacagagugugucaaaaugagacauagacuuaaaaacagcugggcauggugguacucaccuuugaucucagcacucaggagguagaagcaggaagaucuaugaguuuaaguccagccuggcuacacagagaagaggagaggagaggaggagaggagaggagagag

SEQ ID NO: 554 - RNA, 7007 nt, Mus musculus
cucucuccucuccucuccuccucuccucuccucuucucuguguagccaggcuggacuuaaacucauagaucuuccugcuucuaccuccugagugcugagaucaaaggugaguaccaccaugcccagcuguuuuuaagucuaugucucauuuugacacacucuguuuguuucuuuggauguuuguuuguuuguuuguuuguuuuaaacaggcuuucucugaguagucaugguuauccuggaacaggcucuguagaccaugcuggccucaaaaaucucccugucucugccucucaaguguugggacuaaaggcaugcaccaccacugcccaacagucuuguucuuucuuuaagcacauuugauucuaaauuuuuugucucuuugccugucuaucuauugagguguggggggggucuuacuuuauagcucuaguugaccugaaacucccucuguagaucaggcugaccuccaauucacagagaucugccugccgcugucucccaagugcugggauuaaaggcaggcaucacuacugcacaaccugauucuaaauguuuaaguaacugucucuaucuaugggguagagugcaaaguuuugauguauauaauauauacaucguugugauggcuacugcuucgugggaagaauauucaaagccccuuuucuaaaaauaggcauguaggggcucacgcuuguacccucagcaccugggaaccuaagguuggagaacugacaugaguuugugguuagugugggcuacacaggaagaccuugucuuacgaaaaauagaauccucuccucaagcuguuuuguaacacacaaauagaacucguuggauucggggccuccaggucaccgagugugcacucuaccacugagcccugccuccggccccagcaacucagcauggcaucuauaaccacucaugaugcaauaacacaccagaacuuaguccucccacagagcugcgcccucacaccccuuagcuaaccuggucccaggauccguuccucuaccucgccuggcucuggagccucugcugccccugcacacagauaaccuuuuuaauuuccauauaugagucacagagcaucgggaaguagaaauuguuuucguuccucacucuucucuuccccucccuuccauuuuuaacagagagggcuguccccaggacccuggccuccagucuuauacuuccaggugccacuccagccugccuagcagaggagaacagcacaggcuuauuuauuagcuguggaucuggacuauguguguacaggaggaaggccugggggaggcuauccaagcuacaggauuagugauaaggcccauugcccucuauucuaauugccccagcuggugauaacucggggcugggaaauuuacauuccugacaaccagagguuugcuggacaaacagagacauagugaugaacacagggucugagggaaaucacuaggauaagccguccuggacagagucucucuccagcaaugccaguucauuacugguagcucagcugccgcuagcaugggaagggauacaagccuucacaucacucuggggagaaggcuggcuggaagucuuacccacuuccugcgcucgcucguuagggaaggugacaucccaggcaucaagggcuucggcuuccucugagccacccugccagcauuuggucuccuccuggagcacagggaggcccuggugggagccuuuuggggacgugugacauaaaaucaaacagcauagaaaagcaauuaccucccacuucaccuucuccacucaucaaagauaacuucugaugguuugcuucaaaaccauaauuagauuuuuuuuaaaacaaugauuuccuaacgguucucugcugugaaaaaaacaacauuaacuaccuucccucagucugcacccgucuuuccucugguuuauuuacuugcugauugacgguugauugauugaugacugauuccagggcuugaacccagccaggccuuuacacaugcuaggcaaggaaucuaucaccgagcuacugauuaaauaguacuauuuaaagacaaccccaaccuuccuuauucuaguacauuccuucauccucgaugccucccugaaaacucccccaagguaacuaaccacugcuaucauuuuuauauuauucuuucagauauuuugccauaaauuaauuauaauauuaucauuuuaggguuuuuuccuauuuauguauuuauuuauuuagguuuuucgagacagggucucucuguauagcccuggcuguccuggaacucacuuuguagaccaggcuggccucgaacucagaaauccgccagccucugccucccgagugcugggauuaaaggugugcgccaccaugcccaccuuuuuuuuuuuccuuuuuaaacagggaacaggguagaagucauuauguagcccaaguuggccacaaacucccaguaaucgucuuaccauagccuuuuggaaugcugguaauuaauuacaggcauaaacgugugugagugugugcauaugagagagagagagaggagagagagagagagagagagagagagagagagagagagagagagagagagagagagagagagaggagaaagcccugugccugugcagaggcauuucuggagaaucggcccugaaacugauaggauguucagauuuuauggcuuugccagauucuuguagauuacccucauuaaagacccacuuaaaugccaguugagaaaaagaguuucccaaaagucucuuaauugagcaccuacaccuagguccaucuaguguguagguggaacggagaggaaccagauagcuugcccuugucuugcacuccucugcuaucagugcgacuggacuuuccaauguuuauuggcaggcacucagacucccccaacacacacccuuuuucucuccaucuugacagggucucacuauguggcucaggcuguccuuaaaccugcagcccugcccagcaugucucaagccuauaaucccagaauucagaaggcugagguaagaggaucccaugaguuuuguuuuguuuuuuguuuuuuguuuuucgagacaggguuucucuguguagcccuggcuguccuggaauucaauuuguagaccaaacugccucgaacucagaaauccgccugccucugccucccaagugcugggauuuaaaggugugugccaccacugcccgguggucccaugaguuuaaggcuagacagccugggcuacagagugaguuuuuggaucagacucugaugguaaagaauaaauaaagcaaccugcuguccuucugucucaguguggacagacaugcgccacacacccagcucugucuauuccaaguauguuuuuaaaaaacauuuaaaaagauuuauuuucuuaauuauguauauguuugugggggcuagggaagguguauccacauaagugaagguaccuucagaggucaucagauccccugcagcuauggguacugggacccgaacccagggccucuggaggagugcacauguacuccuagcugcugagcugucccucuagcccucaagcuuaucucuuccuguugccuuguggcuucuggacacagagcacuuccuuauuacaaaugugucgacuagauucuccacaucuuuucuuuuuuuuagauuuauuuauuuauuuuauguauaugaguacacuguagcuaucuucagacacacuugaagaggacaucggaucccauuacagaugguugugagcuaccaugugguuccugggaauugaacucaggaccucuggaagagcagucagugcucuuaaccacugagccacccaccccacaucuuuucuuuuaauaauuauuucuuuucugguuuaugguaccuuuguacuucgucaaaggugaauucauuaacccucuacuuuuugcaaauuauugaagaaugcuuucuuaauccaaucuggugguauauaucuaugucucagcucucaggaaggcugagagaggacuaagcauuuuggauaagaagguuuguaggccagccuggguugcauggugacacucuaucucaaaacaagacaaaugccacaaacaauaaggacauuuucuuuucuuucuuuuuuaauuuuguuuugguuugucuucaagguuucucuguguagcccuggaacuugcuguguagaacggggugaccucaaacugacagagauccgccugccucugccucuggagugcugggguuaaaguuguaugccacuacuacccugccuaaaacgcuuucuuuuaaaaaaaccaaaacaacgugauguuugaauuauuuauguuuuaugugcaaauaugucuguauuagauguguauguauguuuuauaaguaccguguaugugacuggugcaggugccagauccccuggaacuggaauuauagaugacuaacugcugaguuagcacccccaaaugucuucuuuaugccaauaccuacaaaccuccauaucugaaauuccagauuuguuuuuuguuucuugguugauugguugguuggucuuuugagacugucuauguggcuaaugcugccuuaaaacucauuagauagcccugacugggcucagucuugagauccaagccagguaugguacugcauuccuaaaaacccagcccaggcaggaacaggcaaaucagggguucagggccauccucacuuaguaaaugugaggucagccggggcagugugaaacugugucaacacucagcuauccucgaccuggucccagauaaaaacaaaaacaaaaaaugaaaaaucaccuuaagaccuccuaccugaguuucaggguccagccucaacacaggaucauaguuaucaacuggaagcggggauauaugaaaggcccauaauaaacagacauagacaacuuuucagguacaaacugacaggcaguuuuaaagccuuaaaguuguguuuucucucucucucucucucucucucucucucucucucucucucaugcacucacucuguguguucuucuuuuuccacucacacacuccacacacucucucuccucacacucucucucucacauacacauaacucaccuucucucaucuuucacucacacacacucuccacaccaucugcaucucacucucucucucucuccacucgaugacccacucucucaccuuuuucuugcccuagucuuuuauugauacuccaaaugcagauaggaaaaaaagacauuguauaauaguugccaaaucaaaacaauacccacaucacacaaagaaucaagaauuacaauuguucuuccaaaguuucaagcuuccccuauucccaggccucuggccaaaauaauauuuauugcaaacuuaucauuauuuaaacuuuaccuuuugacuuauuauacuccagagcucagagcuccgaagucggcuacuugcauuuucccgugaagcucugauaauaaaugacaugggcaaagcugccaggcaguggccagaaagacucagguucacccuuaacuuggcaguucugcuagcuuucugcuucugcacauugcacacagugacccuccuaagagucccgguguuuuggcuuaguuuuacuaguauaagauuuuaugcauucuguacuuucuuauccauauauauccaaaagagaccaggaacuacucuuaaguguugugcaaaccucauuucauaaauucaauagcuuuuuccucucuaaauuaaaaguaccccauguuuauguucccuuauuccauuucuucuuuaucccaggauuaugucucuuguacuaaugcuuuuggggggggagggcauugagacaggguuucucuguguagcccuggcuguccuggaacucacuuuguagaucaggcuggccucaaacucagagaucugccugccucugccucccaaguucugggauuaaagguguguaccaccacugcccggccaugcuuuuucauaauuccaauaaauuccuucacuuucugguaauggauccuguaugacucuagcaguaaguggcucuguuucauuuuuaauaauuuccucaaacuuucuuugcaagucaaacauuaauccaaaacugccauuguuuccaagaugagaauguacaaccgugcaccugggccaucaggacugugcugugcugugucccugugucucaauuuugaguuguuuaagaaucauuacaucaaggaacaucuaguuucacagaauucaccagagcagaaggagaagggaguaggaaagucagguauaacagaauaauuaugaacaucaaggccaucugaaaagcacaugaaaucuauacagucauugucaagggcuaaguuuaagagaaaugggagcaccaaaggcuacugagaugucuccaucccagccuacugcaggcagucccuuauuucagaugguggguccccuagagggauguguguccuccuugucagggucccagacaccaucuuuuuuucacaaggagcugcgcggacuucugagauuucuccaucccagccugcugugggcacccccugucaugcuaugcuguccccagcaccugaagcuccaacugcaagaauaccaggaaagucagaccagggggagaaaggacagugcuucagaagggaggccagcuggauggagaugccacuggaaugcucacuugcucccugcucugugguggcugaggacuggaugaaagugguaagggcagggacccuaagugaccuugcuaugccuucccuccucauuugcucaagaugguggaauugggagaagaaccauccgggaggccagccucagcccaacacgagaccccccaggcagcccuccagauguuugucgacagcuuccuucuugccucucugagguuggaaccugggacagugcaaagcugccuuugaggagaggcuuuucuaggaaggaagaaauccagcccggaaccccaacugggucaccuuccuuagaaugaccaaaaccaggguggguaagagggccuguuguuccuaucccaguccac

SEQ ID NO: 555 - RNA, 1938 nt, Mus musculus
uuacaguucugugccuuuuuaaaaucuccagcaagagcuuguucacuaaaccuccccaagcaagcacaaagagcuuugggauccagaaguaaugaagcugaagagaguaggguccuuauagaagccgggucauggaucuggcuuucuuucugaucccagcccuaacggggagaggcuccauuuaggcuccugcaucucacuagcgggcuauacuguucucagaauacuggacguuuuguuugcuuuuaacccaaaguagcuucaaccaguaauuuacuucaguguucauagcacaagacacaguuggccacugucccagaugguccuagauagucaccccagaagucacacuacugucuccagaagaacuggguccuugcuacaccuacccauacccuaugauccuguuuugcccugcucuauucuucucugagucugggucuugucagucacuccagccugauguauaucuccuccuggccuugagaguccugaggacuuggucacaccucucaacacacacacaaagaaagggucuacaucaccagagugggcauggucagucugcccugucuagagaccagggacagcaggaagagcucaccucgaaaauucuggcugaaccucuugccucgggagcggucagcgugacuucccugcagcagggccacauacugggaccucacguggguagggauggccaucuccuccacauccgcgcuguccagggugggggccuggcugagcugcagcugcugcaguagacugcucaggaccuguuccucggucaucgcugccccagggccagccaggggcaguacccagagugcccagcaaagccacagggacuucauggcgcugcccaggaggaaucguggauauaugcgucccuaaaagugcccugaaaaguucuugggaccuagacggucugcugagggcuggcacuggccuucuuuauaguuggcccugggguggggggcagggaggaaggacaagaaaggucacaccccugggaccuccugggaacucagcaugagacaagccccugcgcccugaggaggggcugucuaagaaaggacacagagagcugucuggaagacacacggacugagauuucugucuguggggucacugccucucaacgauacuguucgcucuuguuggaauuaucugauaauaucaccgucuguuuugugggauagagaauuccucggggcaaaaaacagagagacucuuucaccaguuguugaaguacuauauuaccugcauagccauggcugggcugaauucuucagaaacgacucuaggucaggcggaccccaaacuugugauaauccuccucccaucauccucugcaugcuagaacuacagcuguguaucacuaugccagaccuguuuaagacucuggaagauucuccaugggccaguggaggucuagauuuguccguggaggaacaaagaggggcagaguccuguauuccagcugucucuggucaauuccacagauaccccggagucaaaggaaccguauacauccuucaguacccccacgggucuguccagguucgucacgguccucaucacaccccaccccucccaugccagaggaagacagaugccgcuaacuagagauuuugcuagcauagucucaggaaacaugaagacugcgcaugucucucugcucucagagugccacagaaugugccucuucagacagcaacuccuucugggagggcucgcccacuaggcucauaccacaagcgcucaggcuugugucuugcucauaccacagacuuagagacagaaaccauccagaggccaaaucugccuggaaacauguccaguccacagcugcaggcaccugacuggcccuacuucuucuagcucccaguuuacaacagcugggucuugauacuugguaaauuuuauaaauucuca

SEQ ID NO: 556 - RNA, 6002 nt, Mus musculus
cagaccgucuaggucccaagaacuuuucagggcacuuuuagggacgcauauauccacgauuccuccugggcagcgccaugaagucccuguggcuuugcugggcacucuggguacugccccuggcuggcccuggggcagcgaugaccgaggaacagguccugagcagucuacugcagcagcugcagcucagccaggcccccacccuggacagcgcggauguggaggagauggccaucccuacccacgugaggucccaguauguggcccugcugcagggaagucacgcugaccgcucccgaggcaagagguucagccagaauuuucgaggugagcucuuccugcugucccuggucucuagacagggcagacugaccaugcccacucuggugauguagacccuuucuuuguguguguguugagaggugugaccaaguccucaggacucucaaggccaggaggagauauacaucaggcuggagugacugacaagacccagacucagagaagaauagagcagggcaaaacaggaucauaggguauggguagguguagcaaggacccaguucuucuggagacaguagugugacuucuggggugacuaucuaggaccaucugggacaguggccaacugugucuugugcuaugaacacugaaguaaauuacugguugaagcuacuuuggguuaaaagcaaacaaaacguccaguauucugagaacaguauagcccgcuagugagaugcaggagccuaaauggagccucuccccguuagggcugggaucagaaagaaagccagauccaugacccggcuucuauaaggacccuacucucuucagcuucauuacuucuggaucccaaagcucuuugugcuugcuuggggagguuuagugaacaagcucuugcuggagauuuuaaaaaggcacagaacuguaacggcucuguccuggccuccuucaaguacaguggcucugccauccuagaggucuugugauaccuggagaggcccggcugacucuguccuuguccacagagguggcaggcagguuccugaugucagagaccuccacucaccugcuaguguucggaauggagcagcggcugccgccuaacagcgagcuggugcaggcugugcugcggcuguuccaggagccugugcccagaacagcucuccggagguuugagaggcuguccccacacagugcccgggcucgggucaccauugaauggcugagaguccgugaggauggcuccaaucgcacugcccucaucgacucuagguaggggaugcugcuggaugcuguuguugcugaugugugugugcgcgcacgugcgcgcguguguugggggaguugggaagugagggacucgcccaugcagggggaggggagcagcagaugauagggauggguaccggacgggacagacuccuccuucagggccucccuaacagccugccaguccccuugccugacgcgcacugcugugucucaggcucguguccauccacgagagcggcuggaaggccuucgacgugaccgaggccgugaacuucuggcagcagcugagccggccgaggcagccgcugcugcuccaggugucggugcagagggagcaucuggggccggggaccuggagcgcacacaaguugguccguuucgcggcgcaggggacgccggacggcaaggggcagggcgagccacagcuggagcugcacacgcuggaccucaaggacuacggguaggcuggagguuggguggcuagggaugcaauagacccgguccuccucccucucugcccccagccgcgccgagauuuuguaccagcuuaggugugaacuguguaggcugccccgggagaugagccauuccuaccuauaauacuuucuagcggugcguuuagaaaugguauuauaauauugaauuauaacauucuauuuccacuguccccuucaagaguaagucuuugaagauuuuuagcuucaagccaggcauugguggcacaugcuuuuaaucccacacuuggaagggagaggcaggcagauccccgaguucgaggccagucuggucuauaaaggauagcuaaagcuacacacagagacauccuauuucaaaaaacccaaaccaaaccaaaccaaacaaccaaccacuaaaaacagaacaaacaacaacaaaacccaucuuauuaggcauauacuuuaaacauuuguauuugcuacuauugcgcauguguguccguguguacacacuguguucuacucugucaccuuuauaugaguuccagggauccaauccagcccaggucaucaguuuugcauggcaagcucuuuaccugcuaagcuaccuugccuccccugcauauacucuuuguuguuguuaaaaauucuuuauuuugggggaauuuuauucauauauacaauguaucuuuaucauagcauucucuacuccccaucuugcuccuccugauaagcauuauaguguguguguguauaggggugugugugugugcauauaugugguauguguguugugugaaguaugugugcauguguauaugugugguauguguggugcauguggaaugugugguguauguguguguggugugcauguguuguguauguguugugugauaugugguguguauauguaugugugguauauguguguguaguguguaugugugugggguguguaugugugguguguguauuuaugugugguauaugugguauaugugguguaugugugugggguguguauguuugugggguguguauguauguguuguauguuugguguauguguauguaguguguaugugugguguguguauauguguaugugguuuguguaguaugugugcauguguaugugugguguguguauauguguaguaugugugguguguauauaugugguguguguguguauaugucugguguguguaguauuugugcauguguguaugucugguguguguauauguaugugugguaugugugguguguguauaugugguauguguauguauguguggugugugugauaugugugguguauguguaguguauaugugugguguguguaugugguguguaugugugauguguguaguauaugugcauguuguguaugugguauguguauaugugugguauguguaguaugugugcaagugguguguauguaugugugguauaugugugugugugugcaguguguauguguggugugcauguguguauaugugguguguguguguguguuuguggugugggugugcuuguucuauagcaggcaugugguggucaaaggaugaccuugaaugucagugucuaccuuaggccuuguuugagagagggguaccuuguuacucagcaugaaguuuggcugcaagcuuccggagguucuccugucccuaccuucucuuuuacuuuaggguuauauugauuacugaggcacacuaccugccagccuucugugggcacuggggauuugaacucaggcugcucucauauuugugcucuucccccauugagcaaucugcccagcgcuuguuuuguauuuugaggcaugggucucauauagcuccagcugcucuugaauucuuuacacagcucaggaugaccaugaaccgcugaucuugccaucuucuccucccuagugcugggguuacaggcaugcgucaccaggucaccagcagcaugugcuuuuaaaagaccuucucaguccucacuacuauguaguuggccgggaacucuguguaggucaguguggccucagcuuuauagaucagucugucauugcuucccgagugcuagggagauuaaaggcaggcauuaccaugcucaacuucacuagguauuauagguagccaaguacgguuuaaagcuucuaggagggugugcauaguucauauguacaggcuguaccguuuugguauccuugggcuuucuggacgccaucucccauggacacuagucacugaggacaaguugcuuaagaccaggccuuugucgugaaguucgguucuaucuagcucugcuuuucacuuguucuccaucaugucacugagcaccuuugggucucagaguccucagguauaacaaggcuaagaccagaacucccuucaggauuccucugaggaugaaguacaaauaucacccuagauaacacauaggccauauguaguucuggcauaccaagacucuuaguaagcacuuuauguucuagacauuuauuuguucuuuaaucuucacaguguucucuuugaagaccuugggaaaugguugguaggacuuccuucccugcccugucaggugaccuuugcucucucaccccuacagagcucaaggcaauugugaccccgagguaccagugacugaaggcacccgaugcugucgccaggagauguaccuggaccugcaggggaugaagugggccgagaacuggauccuagaaccgccaggguuccugacguaugaaugugugggcagcugccugcagcuaccagagucccugaccaucggguggccauuucuggggccucggcaguguguugccucagagaugaccuccuugcccaugauugucagugugaaggagggaggcaggaccaggccucaaguggucagccugcccaacaugagggugcagaccuguagcugcgccucagauggggcgcucauacccagggggauagaucuguagucucccuguccacagauguauucucagugagcuuguccuaacuuagugcucucgucagaccuuugcucuacagucuugguuuucuuguccaucacccaguuuaagcacuuacauggguaaaucaugucacuccaguaggacacacugaccccacuuagccaaggacauggcuaugcagugaacagguucgcaucugagucuguuuucuggccagaacucagcuuaauguacaacaaaacccuacggugagaacaggggaaucaaaagcucguuuacucuuacaccgugauuacuggcaucaacguaccaugucagggacugcccacagcaggcugggagggagacaucucagaagccugcggcagcuccuugugaaaaaccguuguucccauuucuccuaaccuuagcccuagacaagagcuguauagauuucaugugugugacugcuuuucaguuggccuugguguucauaguuauucuauauuauuugacuuuccuacuccuuucuccuucugcccuggugaauucuaugaaacuagauguuccuugauguaaugauucuuaaacaauuaaaaaguugaggcaugggacacagcacagcacaguccugauggcccaggugcaugcuguagauguauucugugugcucuuaucuuggaaacaaugcaauaacuuugcaauguuaguucagauuaauguuugacuugcaaagaaaguuugaagaaauuauuagaaagugaaauagagccaacacugggaucccgaaaagaaaaaagcuauugaaguuaugaaauaaguuuugcacaaaauuugagaguguuuccuggauaagcaaguauagaauacauaaaaucuuauauuaguaaaacuaagccaaaacaccgggacucuuaggagggucacugcgugcaaugugcagaagcagaaagcuggcagaacugccgaguuaaggguguaccugagucuuucuggccauugccuggcagcuuugcccaugucauuuauugucagagcuucacgggaaaaugcaaguagccgacuucggagcucugagcucuggaguauaauaagucaaaagguaaaguuuaaauaaugauaaguuugcaauaauuauuauuuuggccagaggccugggaauaggggaagcuugaaacucugggggaacaauuauaauucuugauucuuugugugauguggguauuguuuugaauuugauuuggcaacgauuauacaaugucuuuuuuuccuaucugcauuuggaguaucaauaaaagacuggggcaagagaaagggag

SEQ ID NO: 557 - RNA, 6002 nt, Mus musculus
cucccuuucucuugccccagucuuuuauugauacuccaaaugcagauaggaaaaaaagacauuguauaaucguugccaaaucaaauucaaaacaauacccacaucacacaaagaaucaagaauuauaauuguucccccagaguuucaagcuuccccuauucccaggccucuggccaaaauaauaauuauugcaaacuuaucauuauuuaaacuuuaccuuuugacuuauuauacuccagagcucagagcuccgaagucggcuacuugcauuuucccgugaagcucugacaauaaaugacaugggcaaagcugccaggcaauggccagaaagacucagguacacccuuaacucggcaguucugccagcuuucugcuucugcacauugcacgcagugacccuccuaagagucccgguguuuuggcuuaguuuuacuaauauaagauuuuauguauucuauacuugcuuauccaggaaacacucucaaauuuugugcaaaacuuauuucauaacuucaauagcuuuuuucuuuucgggaucccaguguuggcucuauuucacuuucuaauaauuucuucaaacuuucuuugcaagucaaacauuaaucugaacuaacauugcaaaguuauugcauuguuuccaagauaagagcacacagaauacaucuacagcaugcaccugggccaucaggacugugcugugcugugucccaugccucaacuuuuuaauuguuuaagaaucauuacaucaaggaacaucuaguuucauagaauucaccagggcagaaggagaaaggaguaggaaagucaaauaauauagaauaacuaugaacaccaaggccaacugaaaagcagucacacacaugaaaucuauacagcucuugucuagggcuaagguuaggagaaaugggaacaacgguuuuucacaaggagcugccgcaggcuucugagaugucucccucccagccugcugugggcagucccugacaugguacguugaugccaguaaucacgguguaagaguaaacgagcuuuugauuccccuguucucaccguaggguuuuguuguacauuaagcugaguucuggccagaaaacagacucagaugcgaaccuguucacugcauagccauguccuuggcuaaguggggucaguguguccuacuggagugacaugauuuacccauguaagugcuuaaacugggugauggacaagaaaaccaagacuguagagcaaaggucugacgagagcacuaaguuaggacaagcucacugagaauacaucuguggacagggagacuacagaucuaucccccuggguaugagcgccccaucugaggcgcagcuacaggucugcacccucauguugggcaggcugaccacuugaggccugguccugccucccuccuucacacugacaaucaugggcaaggaggucaucucugaggcaacacacugccgaggccccagaaauggccacccgauggucagggacucugguagcugcaggcagcugcccacacauucauacgucaggaacccuggcgguucuaggauccaguucucggcccacuucauccccugcagguccagguacaucuccuggcgacagcaucgggugccuucagucacugguaccucggggucacaauugccuugagcucuguaggggugagagagcaaaggucaccugacagggcagggaaggaaguccuaccaaccauuucccaaggucuucaaagagaacacugugaagauuaaagaacaaauaaaugucuagaacauaaagugcuuacuaagagucuugguaugccagaacuacauauggccuauguguuaucuagggugauauuuguacuucauccucagaggaauccugaagggaguucuggucuuagccuuguuauaccugaggacucugagacccaaaggugcucagugacaugauggagaacaagugaaaagcagagcuagauagaaccgaacuucacgacaaaggccuggucuuaagcaacuuguccucagugacuaguguccaugggagauggcguccagaaagcccaaggauaccaaaacgguacagccuguacauaugaacuaugcacacccuccuagaagcuuuaaaccguacuuggcuaccuauaauaccuagugaaguugagcaugguaaugccugccuuuaaucucccuagcacucgggaagcaaugacagacugaucuauaaagcugaggccacacugaccuacacagaguucccggccaacuacauaguagugaggacugagaaggucuuuuaaaagcacaugcugcuggugaccuggugacgcaugccuguaaccccagcacuagggaggagaagauggcaagaucagcgguucauggucauccugagcuguguaaagaauucaagagcagcuggagcuauaugagacccaugccucaaaauacaaaacaagcgcugggcagauugcucaaugggggaagagcacaaauaugagagcagccugaguucaaauccccagugcccacagaaggcuggcagguagugugccucaguaaucaauauaacccuaaaguaaaagagaagguagggacaggagaaccuccggaagcuugcagccaaacuucaugcugaguaacaagguaccccucucucaaacaaggccuaagguagacacugacauucaaggucauccuuugaccaccacaugccugcuauagaacaagcacacccacaccacaaacacacacacacacaccacauauacacacaugcacaccacacauacacacugcacacacacacacauauaccacacauacauacacaccacuugcacacauacuacacauaccacacauauacacauaccacauacacaacaugcacauauacuacacacaucacacauacacaccacauacacacaccacacauauacacuacacauacaccacacauaucacacacaccacacauacauacacauaccacauauacacacaccacacauaccacacauacauauacacacaccagacauacacacaugcacaaauacuacacacaccagacauauacacacacacaccacauauauacacaccacacauacuacacauauacacacaccacacauacacaugcacacauacuacacaaaccacauacacauauacacacaccacacauacacacuacauacacauacaccaaacauacaacacauacauacacaccccacaaacauacacaccccacacacauacaccacauauaccacauauaccacacauaaauacacacaccacacauacacaccccacacacauacacacuacacacacauauaccacacauacauauacacaccacauaucacacaacacauacacaacacaugcacaccacacacacauacaccacacauuccacaugcaccacacauaccacacauauacacaugcacacauacuucacacaacacacauaccacauauaugcacacacacacaccccuauacacacacacacuauaaugcuuaucaggaggagcaagauggggaguagagaaugcuaugauaaagauacauuguauauaugaauaaaauucccccaaaauaaagaauuuuuaacaacaacaaagaguauaugcaggggaggcaagguagcuuagcagguaaagagcuugccaugcaaaacugaugaccugggcuggauuggaucccuggaacucauauaaaggugacagaguagaacacaguguguacacacggacacacaugcgcaauaguagcaaauacaaauguuuaaaguauaugccuaauaagauggguuuuguuguuguuuguucuguuuuuagugguugguuguuugguuugguuugguuuggguuuuuugaaauaggaugucucuguguguagcuuuagcuauccuuuauagaccagacuggccucgaacucggggaucugccugccucucccuuccaagugugggauuaaaagcaugugccaccaaugccuggcuugaagcuaaaaaucuucaaagacuuacucuugaaggggacaguggaaauagaauguuauaauucaauauuauaauaccauuucuaaacgcaccgcuagaaaguauuauagguaggaauggcucaucucccggggcagccuacacaguucacaccuaagcugguacaaaaucucggcgcggcugggggcagagagggaggaggaccgggucuauugcaucccuagccacccaaccuccagccuacccguaguccuugagguccagcgugugcagcuccagcuguggcucgcccugccccuugccguccggcguccccugcgccgcgaaacggaccaacuugugugcgcuccagguccccggccccagaugcucccucugcaccgacaccuggagcagcagcggcugccucggccggcucagcugcugccagaaguucacggccucggucacgucgaaggccuuccagccgcucucguggauggacacgagccugagacacagcagugcgcgucaggcaaggggacuggcaggcuguuagggaggcccugaaggaggagucugucccguccgguacccaucccuaucaucugcugcuccccucccccugcaugggcgagucccucacuucccaacucccccaacacacgcgcgcacgugcgcgcacacacacaucagcaacaacagcauccagcagcauccccuaccuagagucgaugagggcagugcgauuggagccauccucacggacucucagccauucaauggugacccgagcccgggcacuguguggggacagccucucaaaccuccggagagcuguucugggcacaggcuccuggaacagccgcagcacagccugcaccagcucgcuguuaggcggcagccgcugcuccauuccgaacacuagcaggugaguggaggucucugacaucaggaaccugccugccaccucuguggacaaggacagagucagccgggccucuccagguaucacaagaccucuaggauggcagagccacuguacuugaaggaggccaggacagagccguuacaguucugugccuuuuuaaaaucuccagcaagagcuuguucacuaaaccuccccaagcaagcacaaagagcuuugggauccagaaguaaugaagcugaagagaguaggguccuuauagaagccgggucauggaucuggcuuucuuucugaucccagcccuaacggggagaggcuccauuuaggcuccugcaucucacuagcgggcuauacuguucucagaauacuggacguuuuguuugcuuuuaacccaaaguagcuucaaccaguaauuuacuucaguguucauagcacaagacacaguuggccacugucccagaugguccuagauagucaccccagaagucacacuacugucuccagaagaacuggguccuugcuacaccuacccauacccuaugauccuguuuugcccugcucuauucuucucugagucugggucuugucagucacuccagccugauguauaucuccuccuggccuugagaguccugaggacuuggucacaccucucaacacacacacaaagaaagggucuacaucaccagagugggcauggucagucugcccugucuagagaccagggacagcaggaagagcucaccucgaaaauucuggcugaaccucuugccucgggagcggucagcgugacuucccugcagcagggccacauacugggaccucacguggguagggauggccaucuccuccacauccgcgcuguccagggugggggccuggcugagcugcagcugcugcaguagacugcucaggaccuguuccucggucaucgcugccccagggccagccaggggcaguacccagagugcccagcaaagccacagggacuucauggcgcugcccaggaggaaucguggauauaugcgucccuaaaagugcccugaaaaguucuugggaccuagacggucug

SEQ ID NO: 558 - RNA, 3825 nt, Mus musculus
gacuagaacucaaaaauaaauaagaucuuuauuaaagcagcccugaacaucaccuucuaaugggucaccuguccagaagaguuaagcaagaggucacaggaugacuccccacacuuccaccugcaacaccaagacacaggcuucuuugcguguuuuuaauucagaggauucccguuuccucucaccucaccuggagaucaaucugaagcagccucggaucuaacuaaagcucuccacagacuuccgcugagggggaugcuaacucuaaggccuccaccucucucagagaggcaugcugacuucuggcaucagccgccucuucagagcaccuucugccacgggacaggagaaggacucgguggcaccaggugaacagauguaagcagcuucacccccagaccugagccugccccucccuguacuacaggggacagggacacccuacagaguccuccucacuccuucuugcuucccugggcgggguuucuuguaaggaguuucccugagcuggguggggccagcguggacaccgugggugacuccagcuucacucuguccagaagggucuucuuaagggcagcaggagacaccuuuucuuggucagccauggacugcaguucucuguaaacaaagccccaccaggaagaugauaaaccucggagccagagcuuugcgccuuccccagcuauacagacccagacucucaacccgacgccaccaagacucagaaucccaaaccagagaagcuccaagcuucuuaagagucaaauaacuaacaggggauaucccagucccccggugcgauccaagcuagguacaguguuccagugauaucggugaccacacaagaaaaaaaaaaaaaaaaaaacuaggggaaguuauagaauuugaagccagucagcaguugaaucccaucuccaucauuuaacuguuugaucucgaauguacccaucuacauaaacaaaguuaaucauagccaucagaagugcgcuaagaacuaaguagagaaagguuagcaaacccuugguuaaaggaagcuuaaaacugugguuaucaacagagcacagacucugaccgcgcucaugaaaucuucaagaguaacaccaacggaagaacucagacaggggagagcgagaacgcgcaccugguucggauacaggaggccucaaccgcauugaugagcagagagcggaagcccccacucuccaggaagugcagggcauggaugguggcccccccaggggagcagacguuguccuugagcuggccuggaugguccucugaguccagcagcaucuuagcugcucccugagauacaaagcagcauuagacucaacccaggcccagcucggugccccucccccaaaacacaacccuaaaaccaaccaccaaccgcgcaaagacacuaaccagcaacgccugagcucccagucugaccgccaggcgccgcggcacgcccaucuucaccccaccaucugccagggcguccagggccaugaaugccuguggagauauucucugaacacaggaaccaagcauccgcgcacccacacaccacaggcggcuuucucaggugacugggaccaauccugaaggucagcuccuuccaccagccagccauguccaagagaugugccggcugcccucucuuccgccagccccuccugcugcccaggaugcaugcaagccagugggcaagugagaaccacucacauaggcaggcccgcugccgcugagcccggugauagcaucaaugaggucuuccuccaccucugugcagaagcccacacugcucaucagcugcuccaaaagcuugccgucuuccaccagagcaugggugcccguggcauacacgguggcccccucucggaccaccacgggcguguuggucaugcagcggaucacuuugggggccggcuggaaagccaucagcuucuagaggaggagagcaagccaacugaguguccaggacauagcucccucggaucugagccacucccaggccaccccuccucucacacaaugggcaccggggcaacagcaccuucuccacagaacugauggugaccccggcugcacaggagaccacgaugugccucuccugcacgucggcuccaaucucauccaggaugaaggggaugauguggggcuucacagccaggaacaggacgucgcugugccgcacaguguccuuauugcuucgggucagauucacacccauccucugcaguaaggaguaggggacccuguccguaaugcuagguaauauggcugagcccgugccacccauagaauagcagacccucucugucaacuguagccaacacucuguucugugccuucagggcuccgugacuauccccaaauggcagcuuuccuuuccugccaccggacaaauagguacaaaaugguaagcugcuccaccauggccaggaaaguggcuguccccucaaccccagcaaucucgaaccucucugccaggugagagagaacugauggaaagagcugagcacccagagucuggaagcagagcugcaaagcccacucccaaccucacagcuguuuaccggaguaacaagucuccacggggcccccucuagggcucugaggugcauagcugggguccuacagcguuggggacauaagccuauacuaggcacaaacaguauccacagugcuucaucugcucaccugucccacauuggccagauguuagaagacuugggacauuaagcuuuauugaauaaagaaacuacguaacucaccaaguccccuagcaacgcugucauuuacaacaucgguaagcagaauuuuccagacuuagaagccaacacgggcuaugcagugaaauucaaagcagacuaacaaaaagaaccuuuuuuuuuaaagaauuauuuauuuauuauauguaaguacacuguagcugucuucagacacuccagaaaagggcaucagauuuuguuaagggauggcugugagccaccauaugguugcuggauugaacucaggaccuucggaagaacagucugugcucuuacccgcugagccaucucaccagcccaaaaagaaccuuucuuauaugccuacuuucaccccaguaggauccgacacuaacuuugccugggagcucccaccacacaaggcugccucagagaaggugcagggcuuacaaugaugacuucccuaaaggagagucggagccugccagacucagggcaucuccggacacgcuuuuccugggccucuuccucuugcccacuucccuccaucccuccuagccuacccugagcgcagacaccgugggcagguccauauccggggagcuggcuauuaucuugugagccgacaggacgccuacagaaaacaaaguuuuucaacuguagaucauggcccaaucaugcaguccaucaauggaagccaacagcagcucuagcagugccggccuccgacgcuaugcucccagcagauggaugcaaaucuaccauccauucacauucacucaucgcccacccacccacucacucacucguucacucuggugagagggaaggcugaccacgcgcucacccgcggccgugaagccccgcgccagagcacaggccagcuggccugcgccgaugaaacccacgcucauggccgcaggaucccggcgagcgccgauccggggacucuggggaucccggggucaguguccgcgcguggaaaaagauggacccgaauugcucggaacagcuuucaaaccgggaugcaccagaugaacugcuagagaggccccaaguaucccagagcauccaccgccaaauacgcagccuccgguuggccacg

SEQ ID NO: 559 - RNA, 3271 nt, Mus musculus
agugcagaaguuuuaacccaggacuugggaggcaaaggcagaugaauuucugugaguuucaagccagucggauuuacaaggaacuuccaagccagccagagcuacaugguaagaucuuaccuuuauuuuuuuaucuuaugugcuuugaugguuugccugcauguauaucugugugagggcaucagaucuccuggaaccagaguuacaaacaguugugagcugauauacgggugcuacgaguugaagcuauguccuauggaagagcagccagugcucuuaaccacugagucaucucuccagcuccuguaagaucuuaucuuuaaaaaaaaaaucauggacugggcugaagagaugguucagcaguuaaaaacauugaguacucuucuaaagguccugauuucaauucccagcaagcacaugguggcuuccaaccaucugauaccgucuucuggugugucugaagagagugacaguauacucacagacauaagagaaguaauuuuuuaaaaaccauaggccuaaauauuugcauguauguguaccacuaugucacuggcggcuaugggggucagaagacggagacggaucucuugggucugacguuaaggauaguuuuaagcugccaugugaguacugggaacugcaccucuucaaggccaguaagugcucuuaaccacugagauaauugucuagaccuguaaaaauaagccuuuuaaaacaagaaaauaaucagauguagaagcacacuccuuuaaucuugacacucaagauacagaggugggcagaccugucacacaugaguucuaggccagucagggcuacagaaugagacuguuaaaaaagaaagaaagaagccggacguugguggcgcacgccuuucaucccagcacucaggaggcagaggcaggcagauuucuuaguuugaggccaaccuggucuacagagugagauccaggacagccagggcuacacagagaaacccuaucucaaaaaagaaaaaagaaaagaaaaagagaugaaaauagaagauaacacagaagaaaauccagcugauguggggucugguaugggacuuuucagauacugcaccacagugaggagagacugccauguguccaagcaaggaggcagaugcagagaagcuacugcagagaaggcaagaagaugauccuacaugaaguucuuucuccuggcccaagucacagcuacaggccucuagacccagggcaugggccaaguaagaaggggucccacccacagagcagggauagggauaugcagaaaaggacuaggagugaggcgaccagccuacagagccaggggaugcucagaggaccacacccagggcccuggggaggucagcuggacagggaggggacagaggggugucuuuggcuacaucaguaguagagcaggaugggacacagcagggcugaugaucaggacaaaggaagccucuggaaaaauaacuaguagcuagauccuugagggagagaagcccaaagcccaaagggacaaagaaccaagagaagaugcaagagacacucacuuuagauagccacaggcugggcuagcaucaggaccagggaggcugcgaggguauuuuuaucuuuacaguagaagaugaaagcucagauguggaagugaggucagagaagcagcugugccuuggggaaagaggaacugcuucggguggugguggugccugcgagaacccagcagcaagccuuaguccacagucuagcagcacagccggggaagguggggccugcaaagcccaucacacuauuggcagcaggucugggcaggaggcaagcauggagggcccauaaucuaccuucgccuccaaacacuaugcuuuucccaggccagcccuggcucugaagcccucucuccuucagaagaacaaagagcuaauuaaaaagcuaacuauaguagcacucuccugugaucucagcucuguggaagcagaaacgggaggaucagaggcggcccaggacuaacuacccagaggccuuagaggguaaaggaucuuaccaccaaaccuaccaaugugccuucaguccccagagucacaugguucccagacccacacagugaagagagaacagguuccuauccucugacuuccacaccacacuaaagcucauccuucuauuguuuuguuuuguuuuguuuuguuuuguuuaauuaucaauggagugacuugucuacugacaagggaguugauuggucuggggccuaccuggccagcaucucagcuuuacuugacagaguguucuucagcuuuuuauccagcaaagugaaaaggacucuagucacgggggcauggaaagccccaccucagaucaaagcaccaggccucacgucuagucaagggaugguugugaugagagccugucuguagauccacauugacaagaggcccaggcuaccuugcaagcugcccauaccuaagaaagucuaagagggcuggacacagcccagggcgucaagaugauaugugugacccugggcagccaaggagguccucuagagaggaaaggauuuuugccuuggaccaugugugccucccucuaguaucccugucucugaaaucaccaaccguuccaacggaccuuggcaguuuccaccucccaucucucaucaggggcaauccucuugucagaagcuuccucagggggagugcacaugcaugagugugggcaccaguuacugugugcgcaugagucuauuacgugugugugugagcuaguauguaugcacaugaaaaugugauuaugcgugugugaggaugaugccgaguauauaugagugugugcuuguguaagaauguguggugaguuaacucuggguaaaacggauuagccuuaaaauuguaaacaauuguuagcuaaaugcucuugauuuucucugguugugguaucuaagccaacauggccggguuacuuucccuguuugguuggcacacaggaaagugcccagggcagaaaugccuaucuagggucuccaggcaccagugcugguuugucgagcagaguugacaaacuucauuuuuccuucauguauguguaguaugcaucagugccuucggaauccagaugaaggcaucggauccccuggaacuggacgacgugagcugccaugugggugcuauugaacugaggugcuacggaagagcaaccacugcucuuaaccccugauccaucucaucuccccagcccccaaacuuuuaaaccuaauguuucaauaaagucuuguuccucuugaa

SEQ ID NO: 560 - RNA, 3382 nt, Mus musculus
cguaccguaccauuccuccgcagacucaagacccuuucaggacaccucagggacacacacauccaaggcuccucuucccggacagcaccaugccauuccuguggcucugcugggcacucugggcacugucgcugguuagccucagggaagcccugaccggagagcagauccugggcagccugcugcaacagcugcagcucgaucaaccgccaguccuggacaaggcugauguggaagggauggucauccccucgcacgugaggacucaguauguggcccugcuacaacacagccaugccagccgcucccgaggcaagagguucagccagaaccuucgaggugagcccuccccuguuguccuuggucucuaggaaaggccggcugaucaugccuuccuuccaccugugguguguauggacccuugccuuguggugcucagagucagucauggggguggggggcacagggugaggcggauguuagaggggagaagaucugggagggugggcacuggggaucuggcugugcacugaaggagucucaggaugggaaaagcggggcugugcuugcugguaaauuaaggagcagagaagagggaggagaguggaagaaaacagaaccccuggagcagucagggccagguagaacuuccuggggucacugccuggacgaguggcugacuaugucuugccauggacagagaacaguggcuggguagaggcagcccugggugacagaauuugggagagagagagagagagagagagagagagagagauugagagagagaacagguauccagcugucaaguagcaaaggccuguguggugguguagcauuuuccagcuggaagcagcccucaugggcacagccacauccauaaacuuacuguccugugguaccuaggccuggagauagaaggaugcugguucugaacaggcaggcaagggagaugucugcugaggauagguguggcuggccucucagguaaccaaccacucugcuaucccagagagugagcacacuggcuggagccauuuaggaaggugacaacucccugaacacuugccccaggguucagcaguccugacaaggauauucacagacuccuguuccacugaacggaaccccucacaaaugcaucugucucuuaagaaaggcaccucgggcugggcuucuuuucucuagucucugcagccugauucuguauuccucccccaauccucuccuaaaaccuuccagaaagaagccagcauugccacgcucuggaaccccuccagcuccuuucuugcacaggguuccaaagucaccacuaagugugcaagaguuagcauucagggccucauugcaaacuuuauaauuccugaguagaaagaaagacuucuuuuucauguuguucaugggcuuccugcuuacaacucucccugaggauuuuuaaggaaucuuggccauuggucuugggucuugccacccuggaaguuaucugguacuuguagaggcccggcugacucuguccuuguccacagagguggcaggcagguuccuggugucagagaccuccacucaccugcuaguguucggaauggagcagcggcugccgccuaacagcgagcuggugcaggcugugcugcggcuguuccaggagccugugcccagaacagcucuccggaggcaaaagaggcuguccccacacagugcccgggcucgggucaccauugaauggcugcgcuuccgcgacgacggcuccaaccgcacugcccuuaucgauucuagguauagucucucucucucucucucucucucucucucucucucucucucucucucucucucucucucucgagaguugggaagugagggacucgcccaugcagggggaggggagcagcagaugauagggguguguaccagacgggacagacuccuccuccagggccucccuaacagccugccaguccccucgccugacgcgcacugcugugucucaggcucguguccauccacgagagcggcuggaaggccuucgacgugaccgaggccgugaacuucuggcagcagcugagccggccgaggcagccgcugcugcuccaggugucggugcagagggagcaucuggggccgggaaccuggagcucacacaaguugguucguuucgcggcgcaggggacgccggauggcaaggggcagggcgagccacagcuggagcugcacacgcuggaccucaaggacuauggguaagcauugugggcuaaguugauaagcgaaauugagagacaaauggggacuuugacuuaacugugaaaugacaaaauuucagaaugugagaauauuuagaaaaggcuuccucugacuguuaugaaacucucaauaaauaguauuuauuuaguucuuagguguccauccccauaaauauccaauauucaguuguuuccuuugcuacggcaguggguuugaaaucuaggccagaaaauuccuaauaagcuacacacccagcccaguucuucaauacucgaagaacuagaucuuacaucucucccagaugcuccugaccccugcccugucaggugaccuuugcucucucaccccuacagagcucaaggcaauugugaccccgaggcaccagugacugaaggcacccgaugcugucgccaggagauguaccuggaccugcaggggaugaagugggccgagaacuggauccuagaaccgccaggguuccugacauaugaaugugugggcagcugccugcagcuaccggagucccugaccagcagguggccauuucuggggccucggcagugugucgccucagagaugaccucccugcccaugauugucagcgugaaggagggaggcaggaccaggccucaaguggucagccugcccaacaugagggugcagaccuguagcugcgccucagauggggcgcucauacccaggaggcugcagccauaggcgcgggguguggcuuccccaaggaugugccuuucaugcaaaucugaagugcucauuauacugggagagcuggggauucuaacucccuaaugggcaaucccugugugugcucuuugcuuccucugaaguagccucaucccuaaauuuuuaccuucgaggaaugugacucgcuggccccuggaggcgcucugacccaguggucucuguccuucauauuguucacugcacuguaugcgaagcacuuacauguauagauacugcaaaccaaggacagaauccccaauugccauuguucccuuaauuugucgcugaaucugggcugagucccagucuugacucuggaccuaagccacaaguugggcaaacauguccaaccuaggcaauacuggcuuugcuagaugugaauaaaauaugcuuuguuuuguag

SEQ ID NO: 561 - RNA, 3382 nt, Mus musculus
cuacaaaacaaagcauauuuuauucacaucuagcaaagccaguauugccuagguuggacauguuugcccaacuuguggcuuagguccagagucaagacugggacucagcccagauucagcgacaaauuaagggaacaauggcaauuggggauucuguccuugguuugcaguaucuauacauguaagugcuucgcauacagugcagugaacaauaugaaggacagagaccacugggucagagcgccuccaggggccagcgagucacauuccucgaagguaaaaauuuagggaugaggcuacuucagaggaagcaaagagcacacacagggauugcccauuagggaguuagaauccccagcucucccaguauaaugagcacuucagauuugcaugaaaggcacauccuuggggaagccacaccccgcgccuauggcugcagccuccuggguaugagcgccccaucugaggcgcagcuacaggucugcacccucauguugggcaggcugaccacuugaggccugguccugccucccuccuucacgcugacaaucaugggcagggaggucaucucugaggcgacacacugccgaggccccagaaauggccaccugcuggucagggacuccgguagcugcaggcagcugcccacacauucauaugucaggaacccuggcgguucuaggauccaguucucggcccacuucauccccugcagguccagguacaucuccuggcgacagcaucgggugccuucagucacuggugccucggggucacaauugccuugagcucuguaggggugagagagcaaaggucaccugacagggcaggggucaggagcaucugggagagauguaagaucuaguucuucgaguauugaagaacugggcuggguguguagcuuauuaggaauuuucuggccuagauuucaaacccacugccguagcaaaggaaacaacugaauauuggauauuuauggggauggacaccuaagaacuaaauaaauacuauuuauugagaguuucauaacagucagaggaagccuuuucuaaauauucucacauucugaaauuuugucauuucacaguuaagucaaaguccccauuugucucucaauuucgcuuaucaacuuagcccacaaugcuuacccauaguccuugagguccagcgugugcagcuccagcuguggcucgcccugccccuugccauccggcguccccugcgccgcgaaacgaaccaacuugugugagcuccagguucccggccccagaugcucccucugcaccgacaccuggagcagcagcggcugccucggccggcucagcugcugccagaaguucacggccucggucacgucgaaggccuuccagccgcucucguggauggacacgagccugagacacagcagugcgcgucaggcgaggggacuggcaggcuguuagggaggcccuggaggaggagucugucccgucugguacacaccccuaucaucugcugcuccccucccccugcaugggcgagucccucacuucccaacucucgagagagagagagagagagagagagagagagagagagagagagagagagagagagagagagacuauaccuagaaucgauaagggcagugcgguuggagccgucgucgcggaagcgcagccauucaauggugacccgagcccgggcacuguguggggacagccucuuuugccuccggagagcuguucugggcacaggcuccuggaacagccgcagcacagccugcaccagcucgcuguuaggcggcagccgcugcuccauuccgaacacuagcaggugaguggaggucucugacaccaggaaccugccugccaccucuguggacaaggacagagucagccgggccucuacaaguaccagauaacuuccaggguggcaagacccaagaccaauggccaagauuccuuaaaaauccucagggagaguuguaagcaggaagcccaugaacaacaugaaaaagaagucuuucuuucuacucaggaauuauaaaguuugcaaugaggcccugaaugcuaacucuugcacacuuaguggugacuuuggaacccugugcaagaaaggagcuggagggguuccagagcguggcaaugcuggcuucuuucuggaagguuuuaggagaggauugggggaggaauacagaaucaggcugcagagacuagagaaaagaagcccagcccgaggugccuuucuuaagagacagaugcauuugugagggguuccguucaguggaacaggagucugugaauauccuugucaggacugcugaacccuggggcaaguguucagggaguugucaccuuccuaaauggcuccagccagugugcucacucucugggauagcagagugguugguuaccugagaggccagccacaccuauccucagcagacaucucccuugccugccuguucagaaccagcauccuucuaucuccaggccuagguaccacaggacaguaaguuuauggauguggcugugcccaugagggcugcuuccagcuggaaaaugcuacaccaccacacaggccuuugcuacuugacagcuggauaccuguucucucucucaaucucucucucucucucucucucucucucucucucccaaauucugucacccagggcugccucuacccagccacuguucucuguccauggcaagacauagucagccacucguccaggcagugaccccaggaaguucuaccuggcccugacugcuccagggguucuguuuucuuccacucuccucccucuucucugcuccuuaauuuaccagcaagcacagccccgcuuuucccauccugagacuccuucagugcacagccagauccccagugcccacccucccagaucuucuccccucuaacauccgccucacccugugccccccacccccaugacugacucugagcaccacaaggcaaggguccauacacaccacagguggaaggaaggcaugaucagccggccuuuccuagagaccaaggacaacaggggagggcucaccucgaagguucuggcugaaccucuugccucgggagcggcuggcauggcuguguuguagcagggccacauacugaguccucacgugcgaggggaugaccaucccuuccacaucagccuuguccaggacuggcgguugaucgagcugcagcuguugcagcaggcugcccaggaucugcucuccggucagggcuucccugaggcuaaccagcgacagugcccagagugcccagcagagccacaggaauggcauggugcuguccgggaagaggagccuuggaugugugugucccugagguguccugaaagggucuugagucugcggaggaaugguacgguacg

SEQ ID NO: 562 - RNA, 32778 nt, Mus musculus
cacauugggguucacugcccggcgcacagagcucgagguccugcuggggccggcgcgagcgaagaguccaaauuagguaacgcguggacacaguucugcgcaugugcaagaggagccggaguuucacuuuguaacuuuuaaguggugcggacgccaccccgccucgccagguacggacugaccacucccccgggcgcgcgcgccgcgccgccgccgcagguaaagugggaaggggagcagagauggggagguugcggccagccccucccaggacgcgccggcccggguccucgcggggcggggcgccucgggucgcuuuccccggggacugucuggugacaguagcgggguagguggcuggagagugccaaucaagccccgcgccgcugggacuuccugacagcucuuggcugcguggcggauccuucccuccaccuccucggcgggcuuuggaguuuguuuguggagucggaucuccccgccuaacccgaagggcagcgucggagcccucuuuucuuuaauuccuuacgaggcuagacccggcuugggcgggcuucguacuguccgggugaccacucccuccugcccggguagcaccggguggaggaaaacuggggacuugggaaagggcgggagggggagggaagagcugagacggcaaagaaaccacauccgacaacaacuuacccagaccugauaagccuggcuaccugacaccucgggugagguggaguugcugucuuucugucccaaacaggagccaacagcuuguagggacuuuugcaaaaggccugggaacauauuuucucuccugaagcuuuggcugggucccagagccugcccuguugagaguuuggggugccaaugauaugguggagugcugagcguuugcguguacgaauauucacuggaugugggaugguggcuauugcuaaguguguaccuaggcagggauccugagaccacagugucuaauugcuguuuuuaaggcccccucgcuccucguagugaugcgguuggaauacagccuuuugccuugcacauucuaggcgugcacuuggcuuugagcagcauuuccaucccuuagggacuuguuugauuucuucccuacacacacccagagccuucucucucuggcuuggcugccccuuggugggugugcucccaucugcccucucagagcguguuccuuugggaaggcaagaacggacuggcucauugaaagccuagagaauguuucuguagcagccucugacucugcugcugcugggugggcacagguugcuccgacuggaggagagggucucggacuguggcuucugaucccucucacuugucaagccuuucuuguuugcucugcgguauuugauuucccugauucuagcccacaggggauauugaggcagagaagcagcccuuaugucugcaugaggcagaauaggcuaccugguugaggaggcccuuaggccuucuguuuugcuuuugaggcagggucuuacuauguagccacggauggccuagaacucacagagauccaccugccucugccuccugaauguugggguaaauggguggguaccacaacacucucccuuccuuaguucuuaccaaacuuuguagauucucuugggaaaccuguuuggcaagagaaaaaugacuuaggaguguggcuuggccacuaggggaaggcagccacaguuacccuccuggggucaaggcuucucuguuccuccaggccucugaaagagcaacauuggugagucaccuuuccuacccacccagcacuacccguaccccccuuccuugggacagcacucccucugugagcauuuaugaggauauuuuuccuuuucuuuuccaagccuucuuucuuugcucuaggguggcccauuucccccaguucuagcuuuaggggaucuuugggugcugcagcagcccucuggauguucauaggaaaccuuggcuugguaugccaccucaagcccagagccacugugcuucugagggagagaggcccuccugaccuuggcaggaccuggguuccauuggacaagagacgagccauccugcugggugaagagaaaggaacaggguggcgcagacgaacccggggagguggcggagagcuuguucuaggaguuuagaugcaaagccagguagcaagaaacucagugggcaagaccagaaaaugggcgcaugggauaagaggcaugggcaggucucagaguaacaucagaguguagcggguuucuguucugaaacccuaaacuggaagguggcuccccugucacuuaugugacacugguggcaucaggacaguguguaaauguuggugcugcagggacaggacaaaguggacagccuagcaggaaaugagaagcaggccagaggccugacucacuaagacuuggagcugucagggguggggagugggagggcugauccaacugaagacaucuccagcagaugcccacaguccuuccucccuacguguggcaacaguacagccuugcaucaccaggcagggauguuucgaaguacuggcguccuggugauuuuuuucccccuuugaaacagccuuaugugauuuccauuagugcccagggugccugaaaccucaggaggugucagcacugagccuggagccaugucuguuaaucucaagcuuucuguguagccaaggcuggccuuaaaauccugauccuccuauccuugagugcugggguggcaggucuuccgggacccuuugcuccucuggguuugguuuaaaggagagaagcagggacaucacuccagguggaagugccauucgugauuguucacagucacuaaccggauggcaccagacacgucuaccuacagccacugcaaguuccuuauagaaggggaaaaaaugauccauucucuuaagccaaguccccucccccauccuucccucacuuucccucaggugcggugcaugugugaaucugggcuagggcuuguguguguugcaucugcgagucugcguaggggugugugugugugugugugugugugugugugugugcgcgcgcacgagcaugugcaugcgcacagcagugucaggagucagaauugggacccuaccccaacccagcacaccucacuagcacuuuuuguaguucagacaucuacuuccgguucucuacacccccuuuucucgucccuaaaacuucugccucucuagcagaaggaaggaaguccucugagaauuacaauuuaaauagacuuggggaggugggagccugaggugggaggggcuuccuuagacuucccacucauaaauaaugugaagcaggccagaaccugggcaccaaguuuucaggcuuccgugccaggggacagacuguagauuuccauuaaauuugccagggguucugggagccuucaggagucagcgcgcagccugcagcugugccuguuugaaacacugaaccuucuguuagaggggaggcgggaauggaagaggguggagcugagcacagcuuugccagagccucgcccaggagagggcuuaggccucuccgcucuggcugucccucccacuuuugccucucucuggaaagcccuaagugauggcagcuacagagugaagaccaaggcucugggagucagaguuggagguucaauccugcgguacccaacuguucuggggguggcuuuaaguuucuuggaacuuggauuucaagaacaaaucaaccagccuuggaguuccuggcucugacuuucugaggauaguuggagugggcuucuguccuuuucucugaugggccaacugugacccuggauuuuccucagaugacagcugaggcuuccuccucuucccagccuuuguggcccuuucuucucgcuccugucuguuucucugaggacucuugggggaguuauuuucccagcagcacuugaagcuagaggaacuucagcaguggcuaccccugaccacccugaccccuuuauaucuuauuuccuccuuuuuggggcaucugcucuuugcaucccugaagcggucgucuagucugaccaucugggcuguuccuguaaauggagcuagucuuugugaacucgaccaggcacagaggugugcuguccagauucugugcuccaccugcauggggguggguagauggggagcacuaaccuguggcagcacuggcugggggaaacuucaaguccacacucugaucauauacuucuuguucccuagggagagaaggcacaaugaccagcuccccguuccuggaucccuggccguccaaggcuguguuuguccgugagcgccugggucuuggcgaacgucccaaugacuccuauugcuacaacucagccaaaaacagcacugugcuccaaggggucaccuuuggaggcauccccacuguccugcucuuagaugucaguugcuuucugguaagauccccucucagugauguguuuaauccuuuguuuucuaggaccuucuaggaaacucacaugagguagguacuuacaccugugccugcucugugacccuggacaugggguagauggaccuugaguucuggaaccauuguaaugguuccuuccucagaggguuuggggauugaguagggcccugugugucagugugauccagauuacauagccacuagugaguccugucacgucucacuggcccucgggguggguggcaugagagcugggaauggggguuauggaccagaguuagagcaggugcaacuucuggugugugaguggugguuccuuuugccccgggaugccuggggcuuuuaaaagggaaccagaauagauccuuugagcugaccuuagaggacaugugucucuuuccuuaauauuaacuuucuguucacaaagauucuucccauuugaaacggguguuauuaucuuugcagggugacucaacaacauuugagauguguguguguguguguguguguguguguguguguguguguuagggauagaacccagggccuugugcauacuccacacuaguuuagguuuauugggguuaacauguacuguuuuuuuuucacaaacacccccagaacaguugcucccuugacccuggcuucuaagaacagagaccaugggguagaugggagggugaaguccacauccuaggucugccuggagcaggguggcuaguuuggguagggaagcuaggauggaaggggaccccagucccugcuaggcaggagcacaaagcaagcaggugaaggagagagcaaaucuuccuucuuccaauguccuuauauaggucuccagcagaagguguggcccagauuacaggcgugugccucuacaccuggaucuggggcuugcuuugucccagauguccuugaacgcagagauuuccuugucuuagucuucugggauucauagccacuaugccucaauaucuccaugucaagauccaggucagaaacuuguaucucccagccaccagauuaggaucacuggugagccuucuaauucuggaccuuaggucauuccagauagagucaaguugacaaccaggaacagccacuacaacuuccugauucaccuuaagaaaauccccacagaaauucagagcuuauggaucucccuuaaggaaauaacuucugccuucaaaaccuauuacaucuaaggugucagguuccaccccagcacuaaauaaacauaggaccaaagcaggcaagccugugcuauuugagaugucuuucccccuuucugucuuucaaaggagcccauguaaguuggggagagagguuaagacccacuagagagcuggccaagguggagguaaaggguccgagggggcaggcgagcgucucagacaucaggacccuuuaauaggcagaaaugggucucacuccgcacaugagguuguugcuaucacacaagccuguuuuuccaucccagcucucugggguugggcuggccuagagcaccagggcggaaugggguucacuggauggaugcacucucuguguggggcccucaaacuugccguuagggggagguuagugugaagaguuggacacaaaacaaaugaaauguaauuuaaaaaaaaaaucaagccaggugcacaccuguagucucagcucccaagagcuaaggcuggaggaucaccggagcucaggaguuggaagcaagccugggcgaccuagugagggcuugucucucagaauaagguucuggaaugagguaaagagggaaguggcuuuuccacucuggugaggucagaccucaccuuuucugacuuggagucugcugaugugcuugacuagaaagacuccauccaagccugaggcagugugacaccguuggugacgugggcacaguggaggaaggugccaggcugcugagccgugugcucuuucugggcuggauggaguccucugcccucugagucuggcuacccccagagcccagacaggcuacucugacuuaguuuccuuuuuccuuucaguuucuaauccugguguuuuccaucauaaggagaagauucugggauuauggccgcauagcccugguaucagaagcaggcagguaaauaaaacaucaggaacauuuuaccgagaaugugagcauaucugugcauccuucugagugugaauauugugcaugggugugugugcauugugaauauauguguguguguauguguguauguauguauguuuauguauguguguuucugggauggacuggagccgggccuaugcuaggagcuguaccuuccuuucuguuucucaccaaagaccccugugaggccucgcugcuuagagcuguauucacaggaaaccaacggcuggagacucucugcuuccuggggcucuaguuucagguuguggaaggucaacauugcauuuaggguuuugucaccagggaaggaagaugccauuuucuuguuccccuugcacacaucucccuuggaacaucauaucugaaguuaauuaacaugcgccagggccgauuaggaaggaaggcagguguggggaagcugcccacuuucuuuccuggucagggcuccagucggacaagcccguuaacaaaacauaggcucucuggccagaccucaggcccuuccgguuccugucuggguagggacuacugugcccuuuacuaaaggugaagaugagccggagaaccagacuuuccuguucuguccaguugcugugaaccucuggaacgugugucagaugaggcagaauggugugagugggagacgucaggggcccccuccaggucuguccccggggcccauggccaugcuugagcuucugaaaugucccagugguaggaugaggaaggaagguccauuuagggaggugcuucuuugccaccacuucgggggaggggguaucccuucaacaguuccuaguuagcguggaccugagcacgaguccugccucaggacgcaggagaggaugugggaagacgcuucaguggggauggcuuacuuccucacuguuacggauacaaccauucacacuuggggcuauugugcucgccucuucccuccgugucacagagcucccugacaaggggucugggaggacacuuugagucagaucugucugguucugagaugcggugagggcugggaugagggagcucaaacuacaccugacaguuuacuaauguaguauuuuacacacacuggccacagcaccgugcuccagguucagugcucucucaaaacauaagaugaagagacacucaggaggaugccaaguguuggccccuggcugccacaugugugugcacguacaucugcacuugagugcucacacacaaagaccacacacacacacacacacacacacacacuacuguauuuaacaugucaguucauucacuuugagauguacacuuuaaaauuuucucaccauuagaauuggaaugucucuuucuagucuaucuguccauccauccaucuauccauccauccauccauccauccaucuauccauccaugcaaccauuggaaugucuccuauguccuggccucccggguggaccuucuuugaacuuaugauccuccugccucagccuucaguugaguucugggaugauaaccgguguguaccaccaugcaaaacaugggaguauuaucaacuguagcuuaauuggcaacauugugucuuucuuaaugauuuauuaaaaauugugcauuugacuaccacugguaucuucuuuuuuuuuuuuuuuuuuuuuuugguuuuucgagacaggguuucucuguauagcccuggcuguccuggagcucacucuguagaccaggcuggccucgaacucagaaauccgccugccucugccucccgagugcugggauuaaaggcgugcgccaccacgcccggugcuaccacugguaucuuaaaugagauaaaaugcaguguguaugcauguacauguggaguuuuuuuuuuuuuacauuuuuuucuuauguagaaugcaaauuuuauuuuuccaagaagauacuuuuucacuugucauaggauuuuuuuuuuguuaaaaccauuuuauuuauuuuaugaaugugaguacacuuucaaucuucucagacacauuagaagagggcaucagaucccauuacagaugauugugagccaccaugugguugcugggaauugaacucaggaccucuggaagaguagucagugcucuuaaccacugagccaucucuccagucccuuauuuuuaucuuuuuaagacaauaucucacccaccuuccuuccuuccuuccuuccuuccuuccuuccuuccuuccuuccuuccuucccucuuucccuccuucccuccuucccucccucccucccuucuuucucucucucucuuucucuauuucuuucuuucuucauuccacaucccaauaucagccuccucuccucccagaccccucugcagcuccuccccccauuucuccuccuccuccccuccgagaaggggguguccccccauuacaguuuuuuuauuuuauauguauggguguuuugcaugcaugcaugucuguaccacaugcgugcuuggugcuggcagaggccacaagagggugucggguccucuggaacugaaguuacggaugguugugagucaccaugugggugcugggaauugaacccagguccuuuggaaaagcagccaguacucaaccacagagccuucucuccagccccauauguaaguguuuugagggggguucauuccaauaaugaggcuugcaaguauuuuuccuuaacaacuucgugggggggcaugggugacuugucccccugcucccucgugucccuguguccacuauuucucaggcuguuucucuggaaugaagccccuauaaccuuucauuccagucacugugguaggauaaaaugcagcauuacgcauugauuuggauguacuaggaaauguacuauaaacagguguaaacacucugaaguuccuguagguggaccaguuuagugcugagguuggaaggugugcacauagcuauggucccuugauacccuggcccuggggugugcacauagcuauggucccucugugcauagcccauacaacacagaguuuuaugccauaugggcuuaugggcagugccccauacaacacagaguuuuaugccauaugggcuuaugggcagugcuuccauauguuuuuugaaguaguguauauuugcugccacaacugagagucaauagcuuugaucaaauacuggacauguauauucaacccuuuuuaauuucagaauuauuuaucuuuuuuuuuuuuuuuuccuuuugugccuacagugaggccagguuccagagacuguccucuuccuccucagggcaacaagacuuugaaaacgagcugguugguauccaauggauggugguuuugugacgcgaagggccgagggugcagcuugguagcaaugauugauugaggucuaggcgguugcacuccugguuuagugacuaacagcacugugaucugugagaggucagcucuggggaaagcuccccuccauaugaauggaaacaugaggacuuggaagugucuagaaggagacagugguuaaaugaucccucccugcaaggcuccauugacuuuccaggcagaacaggcuguggaucuccugggcuuuggcagcaacuugucucuuacuguuaugguucuuguacaagaguuaauuauugacgugucugcuagauuuugagccaaaugugggcagggauccugccucauauagccuuguccccagcacuagauaucugguagguacuuagucagcuguugacugagugaugagcaaauauuugucuuucccaacugguaacaggcuagcuuuauggagcaguaggaccugagaggucauggaaccuacacacauuucuuucccucccuaaggccuaugcugggugcuuucuaaugcauuagacugguuccuguugugucuuuuuuuuaaaaccccaccugccacgggguugugccuugcaaagaauaagaguuagggggggucaacucaccaaaugugugaaggaaaauccuguucuacacagauccaagaggaauggugauuugaucucaaagaugugauuguaucugccucccaaagacaugggugcuggaugcuaauaccuguucucugucuccagggaugcuguccuuggcugacggccaucuuccgccugcagugaguaagaugggggugucuguuggagcauguggcuucgugugagggcuuugccauucaggaggaaguagcugagauguuagauucugaagugguaucucucauacuuuuccgguugaggaccuaaacgguguauaaggucuagaacaaagaugacugggaagucucuguagucagggcccagggaaagaaggaggccuucugcguauacaguccuacgggggcucagacauccccaaacugcaguuggauuucaaagguucuugaaucuagugauaaacauuugaauccaaucaagguggcuguccgaguaugggauugaacccagggcuuccugcauaggagguacaguaggcuagauccccaggccuuaguuaaacgaauuuaauuuccccacuuacucguucugaugcauauaaacccgucuagcagaguuccuaucccuaucuaaccaaugugacauaucaaauagaacaauuccugucuaaagcaaaacaaaacaaacgccccuccaaaacaaaacaacaaaacucuaauuagauuauauaauauuauaaaagaaaaggccauuguagaguuagugaaaugggcuuggggauucucaguuccucucucagggccucaguuucuccaccugauuugugugggaguuuggugggaguuguccccgagauugcuggugggaggcagggucacacggagaagccagggaacuuccugaagccgaggaagcaggugggcgugagccuggcuugcuuggaaguggaaagauguuagccucacagugcauccugaaaugaaucacugagcaagcaugaugcucgcugccuuguccgugagcacccuugggagucggaugugcuuuaacucauugcaucccggagcucugcuggcuguuugaggugggaaguggacagucaguucugaaccuauugggguacugugugacacaccagugcugggcacaccagggcugggcugugcaaauucacuuuuguuuucaugcuucucugcuugcuuuucugccuuuaccacauagggcuucccuggucacuggcuuuacuacacaaggcuuaccuggucucuggagcaggagccuuggaaccccucugugugcacaauaggaguagguggaaccccucacccuccucccucugugaaaaggaaaucugguuguuguggcccaggaauucuuuguggguaggaaggcggaucaaguuacuccuucauuucuggggccaaggcagggacagagggaaggaguuguacaauuggauggaaugagacagagaauguucaaaacauggcucaccucugucuccaagcccauccugggguuggggaaagggagauacagggugaaggagggccaaggcgagcugcaugguauucccaaaggggcuuucaguagccaucuugcuguggaagcaaguagggauugugggaaaguuguaugcauacgccucauccauccaucauaggacgggagcacagauguuucuagcaacagaacacaggagaugguaguucauucacugagagcacggugcugugucuggagauggccuggaacucaugccaauagcuuugccuuuacaaguugugugguccuuaaagcuacacagguuuucugugccuugguauccgcauauaucuaaguaaaagauguggcauaaaauacuaucaccuccaauucucacgagaacuggacagaugcuccgugcagggccucguaggccugccuuccacugcuaccuguuaagagugucucugcgugugucucggccagugacgaccagauccuggaguggugcggagaggacgccauccacuaccugucuuuucagaggcacaucaucuuccugcugguggugaucagcuucuugucccugugugucaucuugccugucaaccucucgggagacuugcugggugagacccuuucuuggccagugccuguguugggguggagcagggcucuagggaagggacucaguaugguaggguagacccugggggaugggagacagucugagggugacuuuaggaaaauuaccauccaaauaaauaucuagaagagaaucccuccgaaucuggaauaucaauuuuugguucuaaguagggaagaacuggcuaaccaaccaaccacaggccuaagaauugggcagguuucaacaaguguguuuuuuugagacaagauccuaccauguuguccaggcuagccuucccuuacccuccugaguguuggaauuauaaguagagccacugcccccagcuuuagaauauaucuuucucuucucuucucuucucuucucuucucuucucuucucuucucuucucuucucuucucuucucuucucuucucuucucuucuuuucuuuucuuuuuugagacaggguuucuccguauagcucuggcuguccuggaacucacucuguagaccaggcuggccuugaacucagaaauccaccugccucugccucccaagugcugggauugaaaaugugugccaccaccgcccagcuagaauacaucuuucaauuucuuaccuuuauccaagccuggaggccaccauucauggacccagaugcccgugaugcacagucaaagucauuguggaguuauaucuccuuagcuuccaaaaugcuaucacagauccacuugugacauccaggcucucaaccuucuugcugguaacaaccaaggcugauacuaguucucaacaaagcaucuuuaagacaaaccucugugccaggugaacuuaaauucugacuuugcugguacagcgagcuguagcagaggcucugagcgacggagguuuaaacagguggaugggugucguugucuuccaucuuggucuagucaucuuguauugugccuccccugagcuacagaccucuauaacccaaggucaguuaggccccuuccugguuucucacaguaacucuggcacuaagugucuccuucucugcagguaaagacccuuacagcuuugggaggacaacgauagcuaaccugcagacugagugaguauggauggaaccugcugaccgcaaagguggccgguuugggaguggagggcaggcuggaaacaccucaaagcugcugugcugcugggcugugguaugaacaugcccgggcagcuuugguauuacaggaggcuuagagcuccgugucaggacagagaagcuguggugugagcauaucucaggucuucaguuuuguaggaggcuuagagcccguguaugaauagggaucucuccgaaguacuguggccucuguugggggcaaagccacuggcucuuagcaaagugcucaccgagggcgauucagccccagccuugcaccccaucccuucuguugggaugcccagccuugguaacaggcgauaucuuccuuagcaaugaccuccucuggcugcacacugucuucagcgucaucuaccucuuccucacggugggcuucauguggcaucacacacgguccaucagauacaaagaggagagucuggugaguaaagcuagggccugggggauguucugccgggggcgggggggacucucacgugagagauggaggggacaguccccauggccuccacagaaccacaucaguagugaacucaagaacugcuggaaccugauuuccgucuuuaugcacucagcuggcaucaccaccaccaccaucacuaccaccaccaccaccaccaccaccaucaucaccauaucaucuaucacuguuuuuuuaaagacauugucauuugagguagcuagguagccaaagacgaccuugaacacauuuugcccccaccccccaaggguuaggauaacaggcacucaucaacauauccaucuuaguaguagggucguuauuauuuaaucuacugguaaauggcaauuuggaaauuuuccuuccuuugucaguugcuacucaaucuguggggucagggcuuguagcuacggcugugaaauaagggagucuauggaggacugugagccagcgcuagagugcucgccugaaaagugccaggcucuggcugauaacuuccccugcaaaaacaacacaaaacacaccccccauucuaguuugcuuuccgguacugugagaaacaccaugacccaaagcaacuuaggggagggagaguuuauuucagcuuacacaccagaaacugaaggaagucugggcaggaacggaaauagaaaggaagagugcuccuuccuggcccaccccuaggcucacagccuucuggcuuuccuauacuguccagggcggcuugccuagggauggugccacccacagugggcggggcccucugacaucaaucaucuaucaugacagucucucacagauacggccacagaccaaugggaucugagugauuccucaauugagguuccuucuucccgggugacucuaggucguguuaaauuaacaaaacaaaacaaaagccagggcuggagagauggcucuguggucaagagcacugaccacuguucuuccagagguccugaguucaaaucccugcaacccuaugguggcucacagccaucuguaauggaaucugaugcccucuuugggugugucugaaggcagugacaguacucacauacauaaaauaaauaaguaagucaauaaauaaaucuuuaaaagacaaacaaacaaaacaccaaccagcaucuccuucuccaaaccaaagcagccugggcuaaggacaggugccccucugugauucguugggcuucuccuuagagccacgucccguucuggacucgcaguucccugcucugcaaaggaggcguaugauuugcuuuggaaaaggaugcauuguguguaacaccccugggccucuucaaggccaagaaugagaaaauguggacuuucucucuaccauuucucucgugaugacaccccacguccccaaucaccccuugacuuucuccugcuauguucccuggcaggugagacaaaccuuguucaucacaggacuccccagagaagccagaaaggagacuguggagagccacuuccgguaagagagagacccugugagccacucauggugaacagggcuguggagggccccggggccccugaggccugugucuucugucugagugugcagggcugauccuucccugccauggguaucacguggcuuccagguguggcccugcugagcugugccagcagccugacugggcugguguguacuuggcagcaguugugguuaaggcucugggaccaggauccacauacacacacacacacauacacacacacacauacacacacauacacacacauacacacacacauacacacacauacacacauacacacauacacacacacacauacacacacacagugcaggcugaaguucaugcugaaugagagcugaguuuucaugccgagcuggucuccuaggcccauggauguuggcugucuacagggaaagccucuggcugucaagggcugucaaccucugcagccacaggcccugcagguagagcaggcaaugcuuacagccacaagcacagaaaaaggcucagcauugauucccagcaaaaagagcagcuccaaggcuccccccggcccccaccaggacacuccccagcugaggugucagccucucuucaucccuggucaguucugaugccacagcaaauaccaggcaggagcuagcuacagaugaacucugugcagcuuaugaagaaaacacuaggugaaucauuagcauaaagagaacuguaagagaaugcuuaaaguuacugacaagucucuccagccacuacaacaauuuaggagauauuugcauauguauaugaguauauuugcauauccacuugauacuggaaugauucuuuuuuuuuuuuuccagcccuugaaagaaaguuccucuaaguugccugcuaggcaacguuugagugugcccacuucauguauggacuuaaguaggaaaacaugugucugcauagccaugcaaacacugugugacuuagacacucccuguuuaggaaggcuuccuggaggaggcugugggagugcacagcaguggacuuguggcuuugcuccgcagcagggucacacucacugugaaucuccuucucuaagucuuuucccccucaucuuuuugugauucugauuauugaaucuuacacgacagaggcucuaccacugaaccacaucccaagccuucuucugagcucucggggucagaacugguccuaacgaccagcaagcuaguuggcucauccaugggcuugccuucucacacacuuacuaaaauucaagcuuaagcagguuauacuuccaggacccagaagagcagcagguggugccugaugugggccugcagucgucaggagucauguggacaaguguuuuguguaugguaccagggcaguuugugguagcucuuggcugaccuuggagcuaggcugcccggauucaguuuccggcucaaacauuuacuggcugugugauccuaagcacaagaaccccuuacccuuggugaggcagguauuugauugacuguuauguguguauguguguauguguguguguguguguguauguauguguguauguguguauguguguauauguguaugcagacauuuuccugccguuuucuagacucucuagagguucauuggcaucaggaaaguuguggguugaguaggauuucggugauagccuaagguguguauguguguauguguguguguguguguguguguguguguguguguguguguguauguguguauguguauauguguauauguguauauguguguauguguguauguguguauguguguaugcagacauuuuccugcuguuuucuagacucucuagagguucauuggcaucaggaaaguuguggguugaguaggauuucggugauagccuaagguagauccaucccuaggacagaugaccaaucucuuccuuucaguggcuggggaggauaguguugcagucuuucuuuuugguacuggggauaguaucaguggcuaagcacucgaccagugagccauacccucagugcugguauguuccuauuucccaugagaaauuuccaccagcccaaaaccgaaagaguauaaauuuguuagcuuaaggcaauuacuuucauguugcugaaaaaaaaaugccucuggggcuaggggugugacuguaacaaucgauagagcauauguuuagcauucauauggucguggguucagucccuacaccccacccccacuucuuuguauuuaauuuccccucuguggaaacuuaggggcaauuaucagacagaggcgucaugacucccauggaagaguggguggggguggucauuccugcaggaaugaucucuuucaauggccuuuuuugcccccgccuugcuggccacagagaugcguaucccacgugugaggugguggauguccagcugugcuacagcguggcuaagcugaucuaccugugcaaagagagguaagggaggugggugccagaggucagcuggccugcagcuuucccaccccuugccccgagaugcccacuggcuuccuugcuggcugcugccaaggggauggugguggguggcccugccucuuucuggaucucaaagcuaaccucuuaacccugccggugacugauuguuggcugugguguagugccaggauggagggucugaguuugugccucucuuccgccuuacagaaagaagaccgagaagagccuuaccuauuacacaaaccugcaggcgaagacaggccgacggacccucaucaaccccaagccuuguggccaguucugcugcugugaaguucaggguugugagcgggugagacauugccaucuaucugccuggagcaggggauaggcaggggucuggggcuagggauguaacaagugauagaguauguguuuagcauuuacacacacacacacacacacacacacacacacacacacacacacacacacacacagagccauggucacaucauccaggggcugugucuucuggcaggaagaugcuauuucuuacuacacucgaaugaaugacagccugcuggagaggaucacagccgaagagagccggguccaggaccagccccugggaauggccuuugucaccuuccgugagaaguccauggcuaccuaguaagugugacugguccccugaucccaccggcugacugacucuuguuucuuguguugaggcacacugcucuccgcucuugggggaaguccaguuuaugucugagugacagcuggaagggcggggcggggcucgguucuugcugaccucuaccagguacucuccccagcugccccaguccacccuccggcuucugcguguaacauucugucggguggauugacacucaggacccaaggcccuccuuuccucaggacaacuacugggaaacccuggagcaucuggguguuaccauagcuacaggauccuggagcugcaagcuuaugugaugcucacaggccuaggcucuuguguccucucaccuuagaguguguguagggcacagaggggaaaccgagccucuugugcuuucucuguggcucugggaauggccucuaggauguuaccaagggcucuugccucagacuguagcaguaggaagaggagacacccugggguagcagugaagagucuguggguuucuuuaugggcagccaaagcagacagaagccuuugauggaggaggugggccaggaguccuaggagggaauuucaagaacaggcaguguguaaugugaccuggccuggggacaaaaggagggcugggaagguggagccacuugguuggaacagagucagcuuuaagguccagugucacaaggaccuuagaggccuugaggguggccacuuggagcaugcuguaguagggcaguacaaacaacacagaagccaggccagguaucugggacacuaaaccugauguccugggccucggcuuucuugucuguaaaaugggguagcaaccuuuugccuguugagucaugaugaggacaaaucgcagccugaaguguggcacgugugguguuucuuuuugaucguuugagacagggucuuaaauagcuacgacugacuugaaccauacuauguggcccaggcuggccuugucuacccaugaugcuccugccucagccucuccagggcugggauugcaggccagucuuuccuagcacuaauuauaauaagauagugacucugggguggcguccugugcucuuuucugucugcaguugcuguggauguugguggcucacaggugacaugcaguaacagcuuuguguuucuugacagcauacugaaagacuucaaugccugcaagugccagggccuucggugcaaaggggagccccagccauccuccuauagcagagagcucugugucuccaaguggacggucacuuuugccuccuauccugaggacaucugcugguaaguuuccagacuugggacgagugggagagagacccggcuuccugccggggaugccugcuuaccuggggcguagauguggccugccuuuuuauuuuuuuuaacuuuuaaaaacaaauauuuauuuauuauuuuaucauuuuuuugauuguuuuaagauagggucucaguauguagcccuggcuguccuggaacuuacuauguagaccaggcugucuuugaacucagugaucugccugccugccugccugccucugcuuccugagugcugguaacaaaggcacgugccaccacuauacccagcuuuuuaacaaauauuuaaacaucuacgauaugccagguaguauucuauuuucguugguuuuauuauuuuaauuuuccucuuggggcccagaggagucucagccagagcccuagucuggcuucccuaaaguucacccgacgugccucagccacagcggauguccaugucugagagacuaagccucucucucggcugguguugucucugcaggaagaaccucuccauccagggcguucgcugguggcuccaguggcuggguaucaacuucucucuguuuguggugcuguuuuuccugaccacgcccuccaucauuaugucuaccauggacaaguucaauguuaccaaacccauccacgcacugaaugugagugaccagccugcaggaaaggggugguggggagccgugagaccugggcguggaggguuugaagcagggggccaggccguuguggaagcuagagaaggacauugguugucuugcucuauuacuuugagacagucucucagaccuggcaauaggcugguggcuagaaccaccccaucucccccgccccgccccgccccgugaucuuccugccuccacuucuugccgugcugugggcauaggcaugcgccaagccuggcuuucuacauggacugcuggggauuucauacuugcacagcaagcagucuuauagaauggagcacuccuagccuacauuuggccuuuuaagcugaaagcaggcauggcaauguuuauuguagugccuuuaugguaaugcaguuauagucacuuaauggaaccagucuauugcucacaggaaagaacguuucaguugaaugaaguguaucuagucuggaaaaaugugcaaaguuuaugaaaaauuacauagucauucugguaagguuauaaugaaagcagaacacguaggggugugauggcucacaccugcaagcccugcacuugcgaaguagaggcaggaggauuaaugcaaguucaaggccagccugggccacagagucagauccucuuucaaaaacaggccagccagguccagagacaugucucaugguuaagagcacuuacugcguuuauagaggacaugggcucuguucccagcaccauguuagacagcuuauaguugcaagucacucugcucuccacaccugacugaacguguacgcauuuacccauccacagaggcaagcacacauacacauuaaaaaauuaaaaaccaaaaccaaccaaccaauuaaacaaaacccccaauacacaguguagaaguccuuuuaagcugugcuuccaaugauacauacauacauacauacauacauacauacauacauacauacauaccacacacauacacacacacacacacacguagacagagaagggacguaaggcacaagacacaugaaaagagcuuuguuaguugggguggugggauaccuuagaucagagguucucaagcugugggucagugcccuuuuggaggucaaacaacauuuucacagagguagcauaucagaugucagcaugccagauaguuacauuacaauucauaacaguagcaaaguuacaguuaugaagaagcaaugaaaauaauuuuaugauuggaguuaccacuacaugaggaacuguauuaaagggucucagcauuaggaagguugagaaccacagccuuagauggccaggcaugauagacauucagaugucauacugcacaucuguaauccagagcuugggaggggcccuggcacugugguccugacgcugugguccuggcuuuuccauccguugccggugaauucugagccuauguuuuucauucauguuacaccugugauauauagagggagcugacuagaaaucguuacaacgcccuaagcauacacaacauaguuuucuguagacucacagccggucaagcucauccuuuugccaguugaugcgggacaaggccuggucuuuggaagagagaucugcuggguagaguucccuuuggcugucuugcauaaauuauauauauuuuuaagauuucuuuauuuuauguauacgaguacaauuguagcucuccucagacacaccagaagagggcaucagaucccauuacaguugguugugagccagcaggugguugcugggaauugaacucaggaccucuggaagagcagccagugcuuuuaacaacuaagccaucuuuccagcccccaguuuacucuuaugugauaaaacaacauauuuucaggaauuuuuucuuuucagaaaaaacuuccuuucagaaauuucuuuucaaaacauuuaacuuuaucuuuuaaauacauuuauuucugagguacaggcgauggaauucaggagcucacacacacucagcaagcacucgauauggaaccauaccccuagguggccuagauucuguaacauuuguaacugguaccaacuagugugaacaggauuggaaucagacacgguggagcugacuggugggccauguggagaggagcccuggccuccagauagcagcugucagcuuugcccuagggauggagacgccuccuucaucuggcccaucacugcucguaccuccuucgcugcaaagggccacauaaccgcagagaguaaugauggucuccuugcccacguuugaggacugcccacccuuuacccaucucaccuuuggcucuggaggauggcugugagccacuaggccaccagugaccacagccccagcgccaucuugacucucugugaugguucgugucuugcagaaccccgucaucagccaguucuuccccacacuccugcugugguccuucucugcgcugcuuccguccauugucuacuacuccacgcugcuggagucccacuggacaaggugagcacagccugggcuucucaccccacccggggccgcaggcaugcugccugaucuuacuuugacaacuuaaacacucaccucuguucccucgcaggucaggggaaaaccggaucauggugucgaaggucuacauauuuuugaucuucauggugcugauccugcccucccucggucucaccagguaccuuccaccucuugccuggccccagucagacucaggauggguucuugcugucuauucuggaagucccauaguccuuaaagacaagaagcuugugaacaaaacuuacagcggacuucccugguaggguggggcuaguccuagcuguguuuaucuuguggagggaagugccagcuaaagccugugugaccucaggggacaaaugucucaagguuggggcugcuuuuagaguggaagaaagggucucacacugcaugagugugagaaagaaaaccggaggguagaacucuagauuggugugagcaagaccuuggguuucaucuucaguacuggaaaucaaucaauuaaacaaacaaacaaacaaacaaacaagccgggcaguguggcccacgccuuuaaucccagcacuugggaggcagaggcagguggauuucugaguucgagggcagccuggucuacagagugaguucuaggacagacaaagcuauacagagaaacccugucuugaaaaaccaaucaaccaaccaaccaaacaaacaaacaaaaaccaaaccaaaccaagccaaaucaaaacacaaaaugaaacaaacaaaugaauaagaaacauauggaauucaucugcuuuucugcuuuucagcuuggauuucuucuuccgguggcucuuugacaaaacuuccucggaaaccucaaucaggcuagaguaaguauugacucggcugccauccagugcaugggacugaagagcucugggugugggguguggggugggggauggggguuguggguggggaguaaggggagugagggaggcuguggcagcagcuagcuagcgcugcagugugguuauuccccauuccccuucaggacaggcauccuccccugggaauaccaggccuugcacucacaccagccccucccacauuccuggagcauguugugggagcugaccuacuuugugucuacuugcagaaaugugguugucuuuuagcccaagacucuauuaguggcccccacuuuucuuguuuaagacuuacuuacagaccacagagccguuggggaagguacuucugggagguaguggugccccagucacagagggauaauaauuaaauguagugucaguguagcccgugggugguuuuugucaggagaauggaguucaguuuagggcugguguguguccuuguuaguacucaaagccuaugacacuucccucauagugacagcugugauuuaaaauggcuccaugcgaaauguuuaugcguccuuuacccuaugaagcuaugaggguguguggguaaggagauggaucugugucaagugcuugcuauguggucuagacaagagaagagagacagagacagacagagagagcugugggacagauguuauuccugucuccauuuuacagauaaugggguguagaaauauugagguugucacccaagguucuccaacuaguuauucagcccauuucacuauacucgagggcuuucaacagccccaaaggccccagauuggcugggaaugaucacggaggaggcuggccuauaaagauggagcaguugcuucuugcugacuuggcuggugaaucaggaacaaguagcuacagguagacguacaccuaccuaacucacccuuuccuggguagacacggcuucuggcugccacauccaauggccugcuccucucugugacuccucagccacaccugacauaccggccgaggcucuucccagacacaguguuuucauuuggcaccgagcucugcccuugccaucccugccuacagcaucuccuuugcaaccuucuugggacuuccugcaaagcuaccugagggagggcucuauccucgccccuccuccuuuggacucauggcuucauugcuauuuggcuacugcauuaaaauauguacacaaaggggcgagggguaugcagugcugggcuucaucuucagugccaaggaguuaaagaaaacaacccacaguauccauauuaccacuuuagagucuucugucuccugccucagcuucagguggagccccugcugugcacuguggacuuuaccggccccaacccagaucugauaugucccaguucuccucauagcucucucaauuuggccccccaaaagccuuggagcgcacccugucuuuuccuuccccucuccucccuccauccagucuaucagcacacucccccaguucuaucuccgagaaaaauagagaaucagacccugccuccucaucuccaccaguaccacccucaucccgcacacccuacaguugcgaccguguccgcuguaucuuucagccuccuguucugccuccccuuugcccgcugcuuuccagggcccccugcccuccuacuguugcuuggcacugccaggcucacagcucuucaucaaugucauuaucuguagucccuugguguccaggugaucugcuugcucagugaccuuuugauacaccuucuaagcucagugacauuguccucccccccuccccaccccagcuggacagcuccuggaacacugccugccauacuguguaugccauaucugauuguguccccagagagugugcaaaugcaaagagcaaagagaacagagucugaggccugguuuucuauuuuauuuuauuauuuugagaaacgauucugcuauguagccuagaagggccuagaaucaugauuuuccugccucuguugccucaaugcugggaucacacguauuauggcuuucagcacaguaacugacacucggacggucuccacagaugugugcugaaugagggauauggcaagagcccucccagaggugcccucccagaggugcccucccccacuccaguuauuuuuccagcuggaaggaagcucuggggcucccagcuaacagcccuguaucucguccuaggugugucuuccugccagaccagggugccuucuuugugaacuacgucaucgccucagccuucaucggcaguggcauggagcuguugcgccugcccggccucauccucuauaccuuccgcaugaucauggccaagacggccgcugaccgcaggaauguuaagcagguacuauaaccuuggguccuguccaugcucccugccugugggccucucaguucucuggaauaaauccuaggcacaguaagagcuuugcaaaccugggcucagggcugccucugccuggauccucucuggaucaugacaagucuuucccuaguuuucaugcugaccauugggccagagaaaagaccuugggguuuuuguggucuaaugcaucuggucacacacuguaucuaucagucuucucaccgccugugcagggaaccugacagaagcaaccuaagaaaggggggauuuggccuuccugucuuggccuucaguuugaggguauagcccauuguggugggggagguguuggggugaaagcguuucuagcugcggggugggagaccgccgguuacguuggauccgaugaggaagcagggaaacaugaaugcuaguguucaucucuuucucucuucuuccuuucauucagcuugggacugugguccacagagugguggugccacauacacuggaggggugguggucuucuuucucgguuaaaccucucuagaaacacagagaacugugacucugaggugacugugacuccagccaaguugaaaaucaaggucaaucaucacacaggaaaugcauagcuaaaagcuacacauucaauguguuaagccccugcuuaguaagagagagauuauauacaacccguagaccccuuuccuggggaccucuguuuggaccuauucuuaggaauaccuccaauguccaagcuauuucaggcuggcacgcauuccagaccuccuaaguugggugguguggggucgcuaugccuuggugaguucugugagaggacgcaggaagccagcuguccucuggauuuugugauggaugccacuaaucuuguuuuacagaggcacaaacugagcuggcccagguuacccgaacuaggguugagcugaugguggugguggugguggggaugcccagucuguguggaaucucucugguguauccuccagcucuaucugccccaggagcucauagcucuggugggaggguacaguuagaggaggggagcccugugagagcacacaccauccaccaugcuuuggaagaucugggcguggcuggagaggagaaagccaagccuuucagaagcauuccuaacuaccuaguccucccugaccccguuggacacccguacccgccaugcuuggagugcacagaagggugucuggggacagagccagcuuaugagauccuuaacccuuuccuucccagaaccaggcuuuugaauacgaguuuggagccauguaugcguggaugcugugugucuucaccgucaucauggcuuacagcaucaccugccccauuaucgugcccuuugguaaguggcccugguguccgucugucuuagggcucauggccagcugacucugucacaccugccggugacagcuaccaccaggucacauggauucccagaagagugcccucuuguaguuaccuaaguacaaaauuuccuuuccuuucuaaaugauuguuucugcuggccucuacuguggccucucucaacaugucuggugugaguuucuguguuggcucauuaugguaucuuguuugguuugugaaugcuuguguauguaugugugcaugggugaguaugggugcccauguacuugguguauagaacagauagauauuucuguucuuucucuucccuuccuuucccccuucucuucuuuucccuucccuucccucuuuuccccuccccuucccuucccccuuccuuucucuuuccuccccucccuucccccuucuucuucccuucucuccccuccccuccccuuccccuuccuuucucuucccuccccuccccuccucuuccuuuccccuccccugcucuccccucucuuuucuuuuuugagaccgagucucaccuuguagccuuggcuggccuggaauucauugucuauauauguauacuagauuggccucaaacucccgaagaucuucuagccuaagccucugccucccaaguucuggggcuaaaggcaugugcuguccagcuugucugcuguauauuuuuagagauggucucuggauaaagccagagaucucugacuggguagacuggcuagcucuggggcucugccugccuccauuuccuccucucagugccucagguacagaagugucccaccaugcucagcauuuacgugggcaugggaucugaucccagguucucacgcuugcggcaggcgccucaugagcugagcugucgccucaguccuaauuaucaucaucguugucaucaucaccaccaccaccaucaucaccaccacaucaccaccaccauuaccaucaucauuaugaucagcaucauguagauccuauauaguuuacaaagccucccuauguuguagcacaggucagcuucaaacacaggaccuucuaccuuagccucccaaacauuggagcuauagcugugugugugcucaaugacuggcucuuuuuaauguaauuuaauuuuuuuaaugaacugaaggcuagagaaauggcucaguggcuaagaaagagcauacacuguuccuugcucaggaccugaguucggugcccagcacccacagcaggcagccugccuccaauuccagcuucagagaaccggcgccuuccuuaccaccuuggucacaugcacguaaacauucacaaaaaccagauaauaaaaacauuaauuaguuagcuaauuaauuuuuuuuugagacagugucucacuauucagccucaaacucaugaagauccaccuaccucugccccccgagugcugggaucauggcccugcagggcuccagcucacagcacucuuuuauuuuuuuuuuaaagauuuauuuacuuguuuauuuuaugcuuaugaauacacuguugcugucuuuagacacaccagaagagggcaucagaccucauuacagaugguuuugggauuugaacucaugaccucuggacgaguagucaaugcucuuaaccgcugagccagcucuccagcccuaaccacagccacuauuuugcaggccucaucuacauccugcuuaagcacaugguggaccggcauaaccucuacuucgcuuaccucccggcuaaacuggagaagaggauccacuucgccgccgugaaccaggcccuggccgcccccauccucugccucuucuggcucuucuuuuucuccuuccuccgucugggugagggacauucugcucugugcccagugccaggccucauauccauccauucccccccccccgccccccccagccagucagcucacuagcugaugucccagugucagugugguagaacaaggugagggcugcuuggugugguguugacaaccgggcuacugagcuaggucaggugugacagagccccggaaauccccauggaggagagggcugcugggucaguucugagccagaggauaugaaacuguacagucagccccagagaacucccaucccgacuagccuuaggcucuggaggcuggcaggaacuguccuagcuagcucacugucaagggcuccuuacgugguaucccagugucucaaacccagucagggaugggucuagccaucaugugggccauauacccuguguugugugcucugagcugugaggauacuauucuggcaguuggaaugaggagcaggacugggggcuguggggaagucacccacagucuggacaccaggccuggccccuuccucaccagagcaagcauaacaggaagcgccagccucccucaagacugcgcguauguucccaggucugacggccccggccacgcucuucaccuuccugguuguucugcucaccauccuggccugccugcuguacaccugcuuuggaugcuucaagcaccucagcccauggaacuacaagguaccggaugguccgacacgccucaggcuggacagcgcagcucucuuuuuccccauccccgugugugugaauggaguaccaguugcccccagcuuugggagugggguguguuguggcuuccucccucccuucccucccuccccuauuccagcccccccccccccccgccccgugucucaguugggcugcauugggagccuggugccggcugcuccuauuauucugcuggguuacuggucuguuuguuugggggaccuuaguucggagagacuggcucuguucgucauuguaucugcuguuguccacagacagaagaaucagcuagugacaaaggaagcgaagccgaggcccacgugcccccgccauucacaguaagcugcuaucuguguuuccguccccauggugguuacuguuugucaugcugguugcaugauucccacccagagaagccauaagaaugugcuggaacaguucugccaggcuggaaaggcccgucuucuuccuggcuuucccugacucuauccuccaggaugcucccucaggguaggguguggcucuugagccccagaugguagagugguaacuucugcucauccuaacagaagugaggguaggacucugacuggccuccucagccucaggccuuccagccgcuaccucccuagggaaaagacucuucaaagcuggggagugccggagcacgccuuuaaugccaguacuuaugagguagaggcaaguggaucucugaguuugaggccagccuggucuaaggaucaaguuucaggacagucaggguuacauuuuaaaaacaaacaaacaaacaacaacaacaaaaagacucaagccccccauaaguagguguucaggaguguaguuacccagaggcagccauggcccaggcccugccagccagcaaggagagcaagcaaugaggaagcuuagaaccuucauuuccacccugggcccgggagggaugcauagcugacagacacauacuauagacagacaggcagacagacaguucccaaauaaacagacagucacccagaauacaguaccaggaaggagugcuuccucugagaacuggaggaagccacucuucauuucuucauauggucaugagagcugggcuguagacggcuucccauuuugcucuggcuucugagaaguguacuaauaaagaaguugacuuguuuuggguccagaugucccaugagaaugcuauuucuugauauguguccucccguugggagaaagagggguaguggggcaugaccaggaugugagaugucaggcuugccaccauccaagaucuaacucuuugccuuugccgacagcccuaugugccucggauucugaacgguuuggccucagagaggacagcguuauccccacagcagcagcagaccuacggugccauccguaacaucagugggacucuuccugggcagcccguggcucaagauccuaguggcacugcggcuuaugccuaccaggaauccugagaguggacaagcuggucuggcaggcugggagcaucuaggaauaccgagggacacaaggggcuagagccccagacaggcucuugaggguuuugcugcuuaaaacccccguauugugagaagaggaaaccagcgggucguggggcucuggguaaccgggcugaggguauccauccgguggggcugcugucccugggagccaucuguaagguuucuuuucuggucccaguguggggaacauuuacagcucccucuuguggucaucugaggauaugcacuuuuauucccccauacacugcucaggaugcucucuguagugagcaugguguaugucccuagugguuuguggccaagaucauguguugggcuuuugccuuuagggagaucauauuuggggacuucugguugauggggagaugcguccaggaaagacuuagucccucugagcccuggaacacugcuuagccuucugcaagcugaugaauagcgcaucaguugggucugagauggaggccauguggggcccuacaguacuguccugccugcagucccuuuucagggauccauggauuagcuguagggaccggggaauaccuuguucuuguugauggcagcagggcagcaggcucaugcccacugguuuguagcugccuccugcuguguuuccggguuuuuguaucauguugccugaaucugggcugugacuggguaaccccacagcagguggggacaugagaaccauuaauaaaguacccacugggcugguggugagacccugccucuca

SEQ ID NO: 563 - RNA, 6088 nt, Mus musculus
guauauucaacccuuuuuaauuucagaauuauuuaucuuuuuuuuuuuuuuuuccuuuugugccuacagugaggccagguuccagagacuguccucuuccuccucagggcaacaagacuuugaaaacgagcugguugguauccaauggauggugguuuugugacgcgaagggccgagggugcagcuugguagcaaugauugauugaggucuaggcgguugcacuccugguuuagugacuaacagcacugugaucugugagaggucagcucuggggaaagcuccccuccauaugaauggaaacaugaggacuuggaagugucuagaaggagacagugguuaaaugaucccucccugcaaggcuccauugacuuuccaggcagaacaggcuguggaucuccugggcuuuggcagcaacuugucucuuacuguuaugguucuuguacaagaguuaauuauugacgugucugcuagauuuugagccaaaugugggcagggauccugccucauauagccuuguccccagcacuagauaucugguagguacuuagucagcuguugacugagugaugagcaaauauuugucuuucccaacugguaacaggcuagcuuuauggagcaguaggaccugagaggucauggaaccuacacacauuucuuucccucccuaaggccuaugcugggugcuuucuaaugcauuagacugguuccuguugugucuuuuuuuuaaaaccccaccugccacgggguugugccuugcaaagaauaagaguuagggggggucaacucaccaaaugugugaaggaaaauccuguucuacacagauccaagaggaauggugauuugaucucaaagaugugauuguaucugccucccaaagacaugggugcuggaugcuaauaccuguucucugucuccagggaugcuguccuuggcugacggccaucuuccgccugcagugaguaagaugggggugucuguuggagcauguggcuucgugugagggcuuugccauucaggaggaaguagcugagauguuagauucugaagugguaucucucauacuuuuccgguugaggaccuaaacgguguauaaggucuagaacaaagaugacugggaagucucuguagucagggcccagggaaagaaggaggccuucugcguauacaguccuacgggggcucagacauccccaaacugcaguuggauuucaaagguucuugaaucuagugauaaacauuugaauccaaucaagguggcuguccgaguaugggauugaacccagggcuuccugcauaggagguacaguaggcuagauccccaggccuuaguuaaacgaauuuaauuuccccacuuacucguucugaugcauauaaacccgucuagcagaguuccuaucccuaucuaaccaaugugacauaucaaauagaacaauuccugucuaaagcaaaacaaaacaaacgccccuccaaaacaaaacaacaaaacucuaauuagauuauauaauauuauaaaagaaaaggccauuguagaguuagugaaaugggcuuggggauucucaguuccucucucagggccucaguuucuccaccugauuugugugggaguuuggugggaguuguccccgagauugcuggugggaggcagggucacacggagaagccagggaacuuccugaagccgaggaagcaggugggcgugagccuggcuugcuuggaaguggaaagauguuagccucacagugcauccugaaaugaaucacugagcaagcaugaugcucgcugccuuguccgugagcacccuugggagucggaugugcuuuaacucauugcaucccggagcucugcuggcuguuugaggugggaaguggacagucaguucugaaccuauugggguacugugugacacaccagugcugggcacaccagggcugggcugugcaaauucacuuuuguuuucaugcuucucugcuugcuuuucugccuuuaccacauagggcuucccuggucacuggcuuuacuacacaaggcuuaccuggucucuggagcaggagccuuggaaccccucugugugcacaauaggaguagguggaaccccucacccuccucccucugugaaaaggaaaucugguuguuguggcccaggaauucuuuguggguaggaaggcggaucaaguuacuccuucauuucuggggccaaggcagggacagagggaaggaguuguacaauuggauggaaugagacagagaauguucaaaacauggcucaccucugucuccaagcccauccugggguuggggaaagggagauacagggugaaggagggccaaggcgagcugcaugguauucccaaaggggcuuucaguagccaucuugcuguggaagcaaguagggauugugggaaaguuguaugcauacgccucauccauccaucauaggacgggagcacagauguuucuagcaacagaacacaggagaugguaguucauucacugagagcacggugcugugucuggagauggccuggaacucaugccaauagcuuugccuuuacaaguugugugguccuuaaagcuacacagguuuucugugccuugguauccgcauauaucuaaguaaaagauguggcauaaaauacuaucaccuccaauucucacgagaacuggacagaugcuccgugcagggccucguaggccugccuuccacugcuaccuguuaagagugucucugcgugugucucggccagugacgaccagauccuggaguggugcggagaggacgccauccacuaccugucuuuucagaggcacaucaucuuccugcugguggugaucagcuucuugucccugugugucaucuugccugucaaccucucgggagacuugcugggugagacccuuucuuggccagugccuguguugggguggagcagggcucuagggaagggacucaguaugguaggguagacccugggggaugggagacagucugagggugacuuuaggaaaauuaccauccaaauaaauaucuagaagagaaucccuccgaaucuggaauaucaauuuuugguucuaaguagggaagaacuggcuaaccaaccaaccacaggccuaagaauugggcagguuucaacaaguguguuuuuuugagacaagauccuaccauguuguccaggcuagccuucccuuacccuccugaguguuggaauuauaaguagagccacugcccccagcuuuagaauauaucuuucucuucucuucucuucucuucucuucucuucucuucucuucucuucucuucucuucucuucucuucucuucucuucucuucuuuucuuuucuuuuuugagacaggguuucuccguauagcucuggcuguccuggaacucacucuguagaccaggcuggccuugaacucagaaauccaccugccucugccucccaagugcugggauugaaaaugugugccaccaccgcccagcuagaauacaucuuucaauuucuuaccuuuauccaagccuggaggccaccauucauggacccagaugcccgugaugcacagucaaagucauuguggaguuauaucuccuuagcuuccaaaaugcuaucacagauccacuugugacauccaggcucucaaccuucuugcugguaacaaccaaggcugauacuaguucucaacaaagcaucuuuaagacaaaccucugugccaggugaacuuaaauucugacuuugcugguacagcgagcuguagcagaggcucugagcgacggagguuuaaacagguggaugggugucguugucuuccaucuuggucuagucaucuuguauugugccuccccugagcuacagaccucuauaacccaaggucaguuaggccccuuccugguuucucacaguaacucuggcacuaagugucuccuucucugcagguaaagacccuuacagcuuugggaggacaacgauagcuaaccugcagacugagugaguauggauggaaccugcugaccgcaaagguggccgguuugggaguggagggcaggcuggaaacaccucaaagcugcugugcugcugggcugugguaugaacaugcccgggcagcuuugguauuacaggaggcuuagagcuccgugucaggacagagaagcuguggugugagcauaucucaggucuucaguuuuguaggaggcuuagagcccguguaugaauagggaucucuccgaaguacuguggccucuguugggggcaaagccacuggcucuuagcaaagugcucaccgagggcgauucagccccagccuugcaccccaucccuucuguugggaugcccagccuugguaacaggcgauaucuuccuuagcaaugaccuccucuggcugcacacugucuucagcgucaucuaccucuuccucacggugggcuucauguggcaucacacacgguccaucagauacaaagaggagagucuggugaguaaagcuagggccugggggauguucugccgggggcgggggggacucucacgugagagauggaggggacaguccccauggccuccacagaaccacaucaguagugaacucaagaacugcuggaaccugauuuccgucuuuaugcacucagcuggcaucaccaccaccaccaucacuaccaccaccaccaccaccaccaccaucaucaccauaucaucuaucacuguuuuuuuaaagacauugucauuugagguagcuagguagccaaagacgaccuugaacacauuuugcccccaccccccaaggguuaggauaacaggcacucaucaacauauccaucuuaguaguagggucguuauuauuuaaucuacugguaaauggcaauuuggaaauuuuccuuccuuugucaguugcuacucaaucuguggggucagggcuuguagcuacggcugugaaauaagggagucuauggaggacugugagccagcgcuagagugcucgccugaaaagugccaggcucuggcugauaacuuccccugcaaaaacaacacaaaacacaccccccauucuaguuugcuuuccgguacugugagaaacaccaugacccaaagcaacuuaggggagggagaguuuauuucagcuuacacaccagaaacugaaggaagucugggcaggaacggaaauagaaaggaagagugcuccuuccuggcccaccccuaggcucacagccuucuggcuuuccuauacuguccagggcggcuugccuagggauggugccacccacagugggcggggcccucugacaucaaucaucuaucaugacagucucucacagauacggccacagaccaaugggaucugagugauuccucaauugagguuccuucuucccgggugacucuaggucguguuaaauuaacaaaacaaaacaaaagccagggcuggagagauggcucuguggucaagagcacugaccacuguucuuccagagguccugaguucaaaucccugcaacccuaugguggcucacagccaucuguaauggaaucugaugcccucuuugggugugucugaaggcagugacaguacucacauacauaaaauaaauaaguaagucaauaaauaaaucuuuaaaagacaaacaaacaaaacaccaaccagcaucuccuucuccaaaccaaagcagccugggcuaaggacaggugccccucugugauucguugggcuucuccuuagagccacgucccguucuggacucgcaguucccugcucugcaaaggaggcguaugauuugcuuuggaaaaggaugcauuguguguaacaccccugggccucuucaaggccaagaaugagaaaauguggacuuucucucuaccauuucucucgugaugacaccccacguccccaaucaccccuugacuuucuccugcuauguucccuggcaggugagacaaaccuuguucaucacaggacuccccagagaagccagaaaggagacuguggagagccacuuccgguaagagagagacccugugagccacucauggugaacagggcuguggagggccccggggccccugaggccugugucuucugucugagugugcagggcugauccu

SEQ ID NO: 564 - RNA, 2408 nt, Mus musculus
caucucagccuguggagggaagagggcagggagacaucuggagguagggaacuaaacuaaucaccugacugucugcugggucucagcaaauggugugaggacagccuagagcaaggggugagacuucccaugccuggauagaaugggcaucaggcuagagugccacucugcugacacaccauccaggaaggaggugcagacuaaaggcugcuagcucugccugugugugaugaaagcuuaugcaagccguuucagccagccugauuguccccugucccuuuagcugacucagugaagcagaugccucugaugagugcucugugaucugaauccuauuccgaccuuugccuagcauuccaggguuccuagucucuugacaacaacauccuaguuucagcaggaaguaguuauaaaaggggcuacauuaucccuuaucuuuuacagaaggcuggaguaugacaggacacuugaccuggucuuuguuuuaaaaagaauaaguuaauguauuguuuuaagaaaaaaaaauugggccugccgagauggcacagcugguaagagcacugacugcucuugcaaagguccugaguucaaaucccagcagccacaugguggcucauaaccaccuguaaugaaucuggcacccucguauggugugucugaagacagcaaucauguacuuauuuauaauaauaaaucuuugggccagagcaaguggggccaacaggaaaagaaaaaagaaaaaaaauuguuguuuguaugaaaacuacuugagaagcauuagaaauagucugucuauacaaaaaacaaaauagaaaaaaaacaacaacaaaaacauugcaacggggggggggggggaggaccaacgaugagauaaaugaccagcuaucacucucauuuggggcacuuccuagacagcaucucugauguuaggcauugcagggcccuggacccuucugguucugguaacuaugauuggccagugcaucaccaaugccuuaacgagauacaucaauucccuuucggguuccauugagcucaugguuauuagauucuaauaugaacagacacccaccacagagucaaggauuugacucagaaugcaacucaagggggggggaugugauggcuaaaguuauacuuuaaguuugcuguguuuaaacgaucaacaaaacaaaaaugcuucuaaccuguaagucccacuuguccauggacagacaacugucuggaauagcuggugaacgcccuaaugccugaaucccguccugaccuuugacuugcaugccaggauuccuggugccugacaauaacauuuucauuucggcaggaaguaguuauaagaggaaaacauaagcuauuauucauguaagauaagaagucaugugcuuuucuucuaaaaaccagcuuugcugccguaacugcacggggcgugcuugaucucacaauggcaugagcgaggcucgugucgucuugggugaauguugaugugauggacaucccugggacacuuucuagagauaguaaauugcuaucauggucucacacauuuuucuuuuuauguuugcuacacuauagggucucccauuccuucacgcuggcagugagaguuucuaaaaauguguccugcgucgccuuuuguccccauguccuugauaacaggggaggcgcacauuucauaucaaccugggaaauugauacacuuagaccuguuuugccccgacucauucccuuggguuuuccugcccugcucugcagagcagcagaccuugcaggcuguugcugaaccuucuucacuggucuuacaguacugcauacucgugggauuucuugcuggacacugaauucugcccccauuauuaaguucuuuaugcauuugucaguaauacucuguuuccuccagaauaaaucaucuguuucauacccauguuacauguuaccuaugguauuucuagcagggcccuggagaagcaagaguggaaucucauuuauaggauuaauccucuauaaagaagacccgagggagcuuccuuccacuucuaccacaguaggccucuagugccugccagggacagcaaugccaagggaggccugagaggcagacagcugacaggcacagugggauauuggccucacaucaguucuguuccaauuagucauacuuuguggguauuuuaacugaaaaauauuguuauuaaucuaaaagcacaaggaaaaugagauauuuauuggcaaagaucacugacuggauggugugcccacucaacguccagaagaagauacucugaucaauguugauuuaaagugacugaggaaugcuugcuauguuuuuccuccugugaauucacaucgacaaagcaucucacggacccaaaccuuuuaaagucauuaaaagaguucaguugaaagauuau

SEQ ID NO: 565 - RNA, 2507 nt, Mus musculus
cucuuaaccacugagccaucucuccagcccaaauauuaauaucuuuaauaaucacaguuacccucauaagauaggccaguuaacacuauucuuugaaaaggaauuauguguauguaucugugugagaguaugccacauauuuuguggugccuagaauagggugcuggaccuccuggggcugaaguuacaggcaguugugagcuaugugacaugaguacugggaacugaacucagaucuucugcaaaggcagcaagagcccucaaccacugagucucuccaucucccaauaguccucauuuaaaacaguucuuauuuuaucugcgucugugugaggguguugcauccucuaaagcuggaguuacagacaguugugagcugccaugugggugcugggaauuguacccugguucuuucagaggacacauagugcucuuaaccacugagccaucuccccagacccccuucuucauuuuuuuuuuaaaugagggcagaaacugcaccuuaagacuaaugaccaaaucacauaacucauaaguggcaacaccaguguucaaacccgagguggcaggucccagaaccugugcugcccaaauuggaugaccuugcaugguagaugguagcugcagauggagaccagaggacaagggagggauucaaggauuccugcggugucugcacagccagcaugcucugcuugcucugaacuuaguuagcgggugugaggugucucguggggacuguugggaaugccuugcaccuugcauugcgcugaggcuguacacaggucuaagagcgacuuuauacacuaaggucaagagaaggugagguaauccuagcuuaaucguuaggucaaauugacaggagaaguauaacauccauugauuuaucaguuuuaucaccuuaagauuuccuugaacuaacuggaagcugacuucuggucuuuugucucucugagguuacaagcgugucuauauuuagaucaauagucacgcuucuguggugauggaccagugugugccuccagaaacggcugugagcugaaaccgcauguguguccuuagcagagaagucaacggcucuguaggucugcauacccucgccagagggacucugcacagacucgcuuaguaagcagauaaacaaacuuugugcucgcacauagccggcugcuaggccagccuccacucguucacgggagccaggggccuccuguuuagcuccagacccagaucuuuucuccugucaccauugccauuaauauuuugcuuuuuuuucccccucccaaucuggauuagaugacagccuccuaaaugcuuugugcuguuuccuaacuaguugccuuuacugcuaccaagaucauuauaguaaggaauaaaaacaguaucacuuggaaguguuuuggaugguucucuguacauauaagccacaauccaauauccagagacuuagaaguuggccucuuuuuuauggcccucuaucccucacaccagcuaccccagaucuccugcuuucagagugcuuucauagucugugcaucuguugugauuuuccucacaugaccauuccuaaauccccauggagguuguccucagaaucaucuugggaagaagcgguuuucuuacccuaccaagcucugccuuugaggaaggccuuacugcagucucgguccaccacagguaccuggcaggcauuugccaaauggauucuucucuccacccaacucuccguccaacuccaaccaaugucuaaagcacuugccguaugucuaaggugcuguucuaggcccuggaacuauguggugaacaagacagacuccuauggaguuccuaugaaacuuauauuuuuauacgcucacaucacuguaaaugcucauuuuagauucugucuucuaaggaagacccaaaauaaaaaagaaagaaacaggaaauaaaucacauggcgcgcagugcuaagccgagacuuuaaguugggucccaugacgcagaugcuuucuuuguguugggugguuagguagggccucucugaggggcauccugaaggcugagaucugcaucagcugcucucaagaucgggcagagagcaugccaggcaggggagacuacacagaggcuuuagagaaagcacaacccagcuuuuagaacaagcacgcuaguuagcugaaagacacgcaggaacagagcagagugagaaaacgccucuagggcgcugagaagcgaacacguggacugcaguugguuugaggaccaaagguaaucauuccuuaaaacgcugcauucuugcuggcagcugcuaauagcaacauaaaaaggcccuguuguuccuaacugaugcacaaacgcucucaggaaugagguuccgcaugcccgcuucuuccugucacuugcagccaagucaucgugucggaaaggccggugugaagaagguaccugauuuugauucacacgaguucccaucaucccuugggccuuuauuuugccuaagauccaugauuaauaaagccacgaga

SEQ ID NO: 566 - RNA, 483 nt, Mus musculus
ugucggcugcugagcuuuggggcccgauugcuggggccugcugggaacaggacuucuaacagcaaguaugucuggaaggcuguggugcaaggccauuuuugcuggcuacaagcgaggucuccggaaccaaagagagcacacggcucuucuuaaaauugaaggcguuuaugcccgagaugaaacggaguucuacuuaggcaagagaugugcuuauguguauaaagcaaaaaacaauacagugacuccuggagguaaaccaaacaaaaccagagugaucuggggaaagguaacucgggcccacggaaacagcgguaugguucgugccaaauuccgaagcaaccuuccugcaaaggccauuggacacagaauccgugugaugcuguacccaucccggauuuaaacuaauggagaguaaauaaauaaaaguagauuugugcucuuguaaaaaaaaaaaaaaaaaaaaaaaaaaaaaaaaaaagcaug

SEQ ID NO: 567 - RNA, 28750 nt, Mus musculus
caugccuugcacacacaaacaucuuuagugaauauaagguaugauguugaauucguauacaggcuuauuugugugugugugugugugugcaaguguauacaugaaggccaaagguuaguguaaguugucuuucuccaacugcgcaacaucuugcucuuugagacagggugucucacaaaauccuagcuguuaccaacugaguccagggagaucuguuuguccccagcuaccucuguccccuucauuauaguuacagccuuuugagagcaccuuccucuuguuuuaauuuuagugcugagggucucaagugcucacaaaguucuuauucuuucaaggcaggguucuuuaucaucugagcuggcucuccagccucacuggccugguccuuuugaagaaacuauaaaccaaaguuuacaagguuuccccgccucuggucuuuuauuuuguaagugaaaaugcuuauauguccuguggagggaacccaacggaaccuuggcucuggguuugaggagugaaggaugucuuugguauuaguagaauuuaucucaaacgacauccuucccaugguguuuuccuguguuauuugccgcaggacucggaguaggauucgucuuuaagagcugaagcuuaagggauuugccaaacuuuacguuuagagguuucuugaugcacacaucugugguuuagauuuccacccagggcaaccccaacggcaaugacaaaucaaaucguggugagcacucuuucuuaggaagggcuccgaggcacgcacuuacucacucguuuguagcugagaaggugacagcgcugugcaccugaagccacgcugcggaugaaaagacuuauuucagccuugcaucugaacccacagugcuuccgaggcaggaagacacucagauguauuuaauaagggauguuggaaauaccuuuaaaaacagcacggcgaaguagggagcuuuaacgaacugcuuugaacucucaacccgagaggaaggaaacaaccagugguggcaaguguaagggggggggggaguuugggggcuccggccugggccugcuggggucggguccaggcgggacgcgaagcccgcgggcuucggccguggccggacuaagcgcgcggcccgcuggcucccgagguuacacacggaccgagagccgggugacagcagcggacgcuuuugccuggcgucgcgcgagcuucacccuccucccagaccgccggccuagaucgcuccgcaggagggcgcgagccaaagcgcggcuuggugccugggcugcggagauaaaccggguggggacgccggacgcucacgagcgggcgggcuggacgcgccacuggcccucgaccaaucgccagcgccggcgaugauucaaaaggucgagggaccaauggggagcucagggcagccucgcuaggggcgggaccucgggggcgcgagagcgcggccggcugugucgcgcgcggagucgccgcuggcugcuggugacuguccuggaguggcuggaguucccgccggagcgcggccaggugagcgucggcgcgggacuccgccgcguguggagagcggguuccccggggcggccggcgaggcuggggccgcgcgggccggaagucgagcgcggguuucggauggcggacaacccccgauccccgucucggacgcgcgcguugggugccccggccgggccgggcugggcugugcucgccgcggcuucccggcccucggaaagcgggcggccuucggaggagggguuaaccgccucuggcuccugccagggcgccgucccgccuauccgggccuccugagugcuucugcgcggugacagcggaccucgcgccuccagcagcuucgagggccacucagugcgcgcuggggugcggagggccugcuccggggcacuucggcgauggcgggcuggccuggcguugcgcccgcccgcccuguguagcgcacuuggugugcuagggccguggcucaggugcaggagcaggacuagaucuggggcuacaaaguagcagcugcucugaggguuagaagauggggcuacagagaagcgcgggauggaggaccuaauacggacagagagggugaugaugagcguugacuggggaguuggggcgggagugaguaaggacuguuaagauuagcgugcuuuuggguauuaagggaaaaggccacucugccaggacagccagcuuucuccugcacggcucugaaggggcacagacccugcgaacgccuuccuguuugcguuuugccuagcaggccugugccggcucagguguuaaaggguagcugugagccaccauuugagcuuuuucuuucugccacauuaagugaauuugggagagggggggaaacgauuaaagaucuuaguaacgcaccggagcaucguagaaagaaaucggccacacugauacauaguguuauauuguaccauaauaugugaggcguucagugccaaaugacccucggguuagcaagaaucuggguugacaggaaaaaagccugaggauucuugaauuucugcgguaugugguugaggguacaguuuagcgagugacuuuucuuugcaaacaaccuguuuguuuagggaagccugugugcgucucuuaugcguuacuugggugcauaagaauacacgggagucuggagccuccuuguccuauccaguauaauuaucuccuguugggcaauauuuugggauguguuauguaguuuccacugacuguguggaucuugugcaaaguggcauucauaucuuguuggcagcccauuuuuuuuuuuuuuuuuuugucuccuaagacaaggucguucuccacaugcuauauaaaauaucaccaucagugucaguucaugguuuguguuguuguuguuguuuguuuuuuugagacaagaucucugcacagccuuuauuguccuggaacacagugcaggcuaggcagaccuucaacauacagaggucuguuuuccucugccucccaaagaaugggauuaaagccaccaugcccugcuagucucaguucuuuuccucccuuuuuuucuggggaucaaauuuuauauuacacauuauaggcauauuuuugaaaaauugaggcucaaauaucuacugggugccuugauuauguauuaccuacuauuuaauaaguaauagaauuuuuuuuuuuuuaaacuuugacuuguguucuuuguuggacucauaguuaauguggugucuucaagaugcaguagagaaacagcagugagucuagggccauaccauucuaauccucuggauuucaucagaucucugaagccaaacaggaucagacgugguuaguaccuggaugggaugaauggcaaggauuggaugcuucugauaguucagaauaaaucuguuccagggccuuuuaaagaugcaggcgguccccaagccacaaagugcuccuauugcaaguuuuugaaguguuguuugagauccuacuggcaccuucauauagaaagacauugugggcuuucucaaacuuuggaaagaguaggagaaccuaauugaucuggggaggaagagagguggggauucagagaaggaagcccagcacauuuccuuccucuuugucccgggcaacuuggaacugaguguugaaauggacagaguuuucuguugucaccuuccuuuuuugugccccuccuccuugugcagaugugagccagugcucuccugcuucccgagggcccucauggucgcuucugccagucugacuucauuccuacagcucccaagcauacuccuuaucccagagaugcuaucucacaaguuagggggacugaggcaggcucaguaaugaaccucuuaucaccagauaagcacuuucguuuucuuucaucuguugucugucuaaacagauggagcuugggaagucuuuuuuuguuuuuuguuuuuuuuuccuucaggggauuaacagugaagaaauguuauuuagaaagacuuucuugggagggguagguaaugcaacuuucuccuuaauuccacagucugcaagagucuuuagcguuccuguagaguugcauaaccagcucuuggccuccggagugugucuuugugugcuugggugauguauggagacuugcucagcaggugaaggagucuuucugucugcugcuugcuuaucuuaucauugguaucagagcacuggcuuuuauccuguggaucuguuggucaccggagugagaaauaacaccucagagagcuccuagcacagccaucauuugauauuaccucauguaaaugauaauucuugaaaguugugguuucuugaaguauugaagguuucaugggccauguuuugaaacagcgguaaaagauguuacaguuggaguaggugucagcugugggcuggagaggugcacacguuagcuuaggugggcggcuggcagaguuaauugaugugcauuugggauuugacucagagaaugcaaaccuuaugaaguaaaccucaaauauguuauucauuauagauuugaaguccuucuuguugguagguuagaguaaugcuaauguacauuuuuuaaaaagauuuauuuauucuauguaaguucaccguagcugucuucagacacaccagaagagggcaucagauaucauuaugaguaguugugaagccaccaugugguugcugggauuugaacucaggaccuuuggaagagcagucagugcucuuaaccucugagccauuucuccagcccacuaauguacauuuuuaauuuucccaguuugucucaugguuuuauuacuuuccaguaagguaacuuguuaaaaauauaacuucaugaauuuuaaagcuuuuauaaaaaugacauguagaucuauaaauaaaaauaaguguccuuuuugaggugugcccugauuuuacugcaggggguagcauucuaaguuguccagucugaugccuguuacguugucaggguuuaauccucagugccacugucugcacggcagugacuaagucgucuccuacagagugauuccagaugaaauagagugaagcucacacaauguuuuguguugcucugcuguucccuccccuguguuugugaacuuugacaaagcguuaacuuuaagcucaaguucugucaucuauagaauaaggaguugcacacuccuuccuuggcuuucuggcccuaaagcuaaaaccagcuagaaaguuguuuacgugaacaaccuaguccagaaaaagaaguaauaauuauugacuaacuuuuuuuccuuaaaauuuuucagacuaauuuuagaaaaugccaaguaggaaguuuguugagggugaaguggucagaggccgauggccugggagcucccuuuauuaugaaguagagauucugagccacgacaacaaaucccagcucuacacuguaaaauacaaagauggcaccgaacuggaacugaaggagagugauaucaaggugaguaugucugccuucgucugcaguggugggaggagcugggggcucaugccagacuccugccuuggggcuccagggcacaugcuguucuugccucugggaguaugggagugagguauaggcccagaucccaaaagcucaugccauugggucugugaccauccugugaggugcucuuacacaagaaaggacccuggcuuuuagggauuuuguuagcacugcuuuuuuccgggcugagugcuaggacagaugggaaacuguagggagggcagcaucccaaagcuuguggaugaugugguguggucaaguacuagccggagacaggcuaggggcguuuaauaggcuuggguuuucucuucaucuuucuccucuuccuccucuuccucuuccucuccucucuuuuuccuuccauccucucuuccucuucucugucucucucuccuccuccucccuuccuccccucuuccuuuccuccccucuucuccuuuccucuucucuucccuccuuccuuccuccccuccccuccucuuauuccuccccuccucuuccuccucuucauccucucuuccucuuccccucuucccuuccuccccccucuucuuucccuccuccucucuuccuccuccccuccucucccccuccuuucucccguccuuucuuuccucuccucuccccuccccuccccucccuuucccuccccuccucuccucuccccccuccccucuccccucuccucuccucuucccucuccuuucuucccccuucuuccuucccuucccuucuuccuucccuucccuucuccuuuuccuucccuuuuccuuccccuuuuuccuuuccuuucccaagacaggguuccucuguguagccucugcugucuguccuggaacucacucuguagaccaggcuggucucaaacucagagauuggccugucucuaccucaugagugcugggauuaaagguguguacuaccauguggcaggacuugggcuucuuccucaacacuggugauguaaucagagagugacauuuacuagguuugaggucagcucacagcuuccccuuccaaaccuaucuguuaaugguauggguuuuaaaauauugagcuaugguauacaaauacuuauaugaaaugcauaaaaauuaauuucuaugaaaaaaggauaaauaaagcugcagaguuuuguuagauuuucuaggcauaaaauugcuuagucgggaugcucuaaaaccguccacuuagaacauagcaguuuuggaccuuguggcccauugauaaccaauaguuuggacccaugcauggucuguggaugaacacuguguuuuaguaaauauuuuagggucauggcucauggggugucuguaguuuaggggcagcuccagccauaugaaauacgacuucucuugaugcuuuagugaucauuuaagacauguaaaugccuuaaaugauuagcugagggacacauacacaaaacagugccuggacagagccccagggguuugccugccuuaggccugccuuacccuggaguggauuagggcagaguggcagcugaccaaggaguuuaacuugucugcuuuuaagaacucgaguuugagccgggcuuggugacaaacgccuuuaauccaagcagaggcaggcggauuucugaguuggaggccagccuggucuacagagugaguuccaggacagccagggcuacacagagaaacccugucucgaaaccccccccccccaaaaaaaaaaaaguuuguuucagagugacucuguagggcugcuguuugaaaaauugguugcaugcuaauuaucuuuucucaccaugucaguuuuagacaguaucaguuccaagcuuuccugguguugcugggaguauauaauauguaugugauguagucacugauuccagggaaaauacccuccaagcucgcagagcaggcgaagugcugugucuuuccaggagcugggcuguuguagcaucacacugugugcuccguucucagagccaugaguguagaaugcacggcaacagagaguggccacaccggacccgagugcgcugaugacaucucugugcccuuucccuuucuagccuuuaaaauccuuuaagcaaagaaaaaguggcucgauuuccagcucucccucucgacgccguggcagccgcagccgcagccgcucaagaucacguucccgauccccgggcagagcaccgaaaggcuccagaagauccgucucugcuucccaugagggugacgugaaggagaagaaggagaaggagaugaggagggaaauucugcaaguuaagcugacuccgcuuguguugguacuuacuucaucuguccacugcgccggcuucccuauacaaaugcguguucagauuauuugugcuuuuguuagcaaguauugaaauagaaagaauaguuucuuugaauauccaagaaaaaugguuuuuguuuuuuuuuuaauuagauauuuucuuuauuuacauuucaaauguuaccccuuuccugguuuccccucuaaaaaucccauauccccuucgcccuuccccugcuccccaacccacccacucccauucccaguccuggcauucccuauacuggggccuagaaccuucacaggaccuagggccucuccucccauugaugacugacuaggccaggccauccucugcuacauaugcagcuagagccacaaguuccaccauguguuuucuuugauuggugguauaguuacaaggagcucuggggguacugguuaauucauauuguuguuccucuuauggggcuccagaccccuucagcucccuugguacuuucucuagcuccuucauuggggaccuugugcuccguccaauggaugauugugaccauccacuccuguauuugccaggcacuggcagaggcccucaggagacagcaggcucuuguuggcaucugccauagugucaggguuuggugguuguuuauaggauggauccccuguuuuuuauuuuuaacuuuuucauuuucaguauauguguccguccauguguuugguguguguguggccacgccgguggaggucagaggacagcuuuauggggccuuuccucccguuccacucgugggcucccaucauugggcuugggggaaagcgguucugcccgaagcuacuguaucagcuucaaaauaacauuacuaggaguccugauaguguguggucuucaaagauguuuccauugagaccggcacaguuuguaggccauaaagugaggagacagcuacucuguuagccauucuugcucucccaguuggcauccuucugcuugaucacuuucacuguuuaaaaauggcgguuucgggcuggagagauggcucagugguuaagagcaccgacugcucuucgaagguccugaguucaaaucccagcaaccacaugguggcucacaaccauccauaaugagaucugacgcccucuucugaugcauuugaaaacagcuacagugaacuuggauauaauaauaaauaaaucuuuaagaaaaaaaauaguuuaccaaggaggcucccuuggagaaaacuaugaaaaaaaaauggcguuuucagugaacauguguggagccuggggaccuagccaauaacuuucuuuuuuuuuuuuuuuuuuaagauuuauugauuuauuuauuuauuuauuuauuguaaguacacuguagcuguccucagacacuccagaagagggagucagaucucguuacggaugguuaugagccaccaugugguugcuggaauuugaacugaccuucggaagagcagucgggugcucuuacccacugagccaucucaccagcccaauaacuuucauuuuauguaguaguauacauuuuuuuuacuuuuugcuuuuuuucuuuuucuaagacaagguagccuaggcuggccaagaccuugauaaaauucuccugccucuguuugcuccguucugagauccuaggguaagcuaccacaauggauaaugaauauuuuaacuccuuuguuuucaacuuucuucaugcugugacccuuuagaacagcaguuccucaggcugggcugaccccaaccauaaaauuauuuuguugcuacuucauuaacucuaauuugcuacugcuaugaauuuuuuuuuaauuaaaaaaauuuauuuuauguuugugaguacauuguagcuguacagaugguugugagccuucgugugguuguugggaauugaauugaauugaacccccgcuaacugcaguuaaccccacucgcuacugucaacucugcucacucagucccugcucgcucuggcccagagauuuauucauuaauuauuuacuuacuuauuuauuauuuacuuaauacauaaguacauguagcugucuucugacacaccagaagaaggcauccgaucucauuacggaugguugugagccagcauguggugcugggaucugaacuuaggaucucuggaagagcagucagugcucuuacacacugagccaccucgccaguccucuaauaaugcacuuagauuuuaaaaugucaaauauugagaauaaccugcaauuugauaguuuccuguuuuuguauguuacauaguaaacaucagaagaagugcgcgugcgcgcgcacacacacacacacacacacacguuaguguuaacguuaguucugcggugcaaccuuguguuuuucucucaguguucacuguucuaaacaccuacuuuucugcaguaucuaguuaucuucuuaggcuuagcuuugaggaaauugaagcugcuuggucagauggacagggcagaacagaggcuuguaauaccuguugcuagacugggugagcaugcuuaugucagugucaagaccguggggaaugcuugguuuucaucugaggauuguaacaggccucccccacccccacccccaccuccacccccaaguugaugucaaagauuuucaccucccuuuuucagacuuuauguuuucuuacuacaaugagcuuguuguugcuuugagugccucucucccacauggggggaggggcagaugcuucguacuguugucugugauagcuuucauauucacacgugcucuuguugacagaagagcuccggguugucuuugccccucaucaucuacuguguggugugugugcaaguucacaguuaggcugccucagcuuuggacaucaugcuaugaucgcuccuuuccacacccgguugugaucucaguaauuucccucccaguguugagugcuuaaccuucaucguaagucuguuuacugcauggaaagcauuggcauguagucagcaugguuucgaguuagcugacuggcugguuuaucugugguuaguagagguuauucaaaaccugagaugcugcacauagcuuuuuaggugugucuucguguggugacagauggcucauucacugacacuuggguaaacucagguguauagcgagcgggugcucuauugcuagcugaccuagaaucccuaaugugcaaagcugccaucugccggcaucugcugucuucugaaggaugugcuuggacucuguuuucuucuugacucaggaguguuuuaguuuguugacagucuuuacagaggaggagagaggcuguugcaagcauugccuuaacaagcacuugcaagcuaaauugcuucucuuucuucuguaagaaacucagaggcugagucaagagggacauguaggaaggaaaaaguaagggcaaauaacauguugcaggaaacgcaaacacccagccuucccacuauagacuguuuagggccacggaaagucuuuuccucauuuuuaugucuagcuaaugaauaaauuugccagguuuugcucacccgccuuucauagaaacguuaccguaugacagugaaaucauugaagcguuucguguacaagugcagaugggaaaguuaaugcagaagucuguuccaaaauguaguguugcccagcuggaaucccagcgcucaggcaggugaggcuggaggauugccacaaguuugaggcucuguaagagcugacuguugaggaccugggggcugugguugccuuuacuccagacgguuuagcgaggcucugcucccugcccaguagaaccugcuaccccucuggugcugauucugucgcugcuucuuccauuuagaagccguucggaaacagcgucagcguguacaacggggagcccgaacacauggagaagaacgcuacgccguauaaagacaagcaggugagagacagacacuccuucaucugcggcacacacucuguuccuuuuccuucagacucacacuggaauuuguuguguuguguuuguuuguguucuguccugaagagugcaugugauuuaacacauuuauucuuuuuuuuuuuuuggcuuuuuuuuuuuugagacaggguuucucuguguagcccuggcuguccuggaacucacuuuguagaccaggcuggccucgaauucagaaauuugccugucucugccucucgagugcugggauugaaggcguuugucaccaccacccggcaacacauuuauucuuguacauucacagcucuauagagaugcugaguuaguaguguuugcacugaauauagacuagauauuuaauacuuugguuuuuuuuguuuuuuguuuuuaaacuaggaaagaaucauuuugucaacagaagacagauauauaguuacacaguacagccuucgucccaggagagaagaggucaaagccaaagaaauagagucugaggaacaaaaccuugucaccaaaggacccgcaccuuugggaaccuuucaagugaccacuccacagaggaaggacuuggaguuuggaggaguaccugguagguauuagaagcccauuagggaggagaaaggguggccagagaugcccuuaugugcacaggaaaggucuuugugcagcaggaagagacuaaggagguggaggacuagggaagaacuuuacagagaaggaacagugguaugaaggccugagcugggagcuacggcaguguguguacagggcacaacuggggugguacaugggacacacggaggcauagauggauaggaugaugggacaagccauaaaguacaaaggaugcuaacuuuaaagucauaauaaagggagcuugccauggggaaggguacaggagggguaguggugauccuguagggacugggagcucugcuacugaugaguagagaaggcagggagggcccggcugguguucccugcagaagcaagcugcagcguaaggcauccugcugccuucccaaugggcugaucagagagugcaugcguggagccucccagaagacaguuacguuaggcucuugucugcaagcauaacagagccauugauaauggcagggauugguucuugcccaugggaugggucucagguugggccagccuuugguuggccauucccucagucucugcuccauuucugucccccuuuuuuuuuaaagauucauuuauuuauuauauguaaguacacuguaguuguuuucagacacaccagaagagggagucagaucuuguuacggaugguugugagccaccaugugguugcugggauuugaacucaggaccuuuggaagagcagucaggugcucuuaccugcugagccaucucaccagcucccugugcuucuugaaggcagacaaauuuuggguuggagguuaagugggugggugauuguugccugucuguggcucuuuuuuuuuuuuugagacaggguuucucuguguagcccuggcuguccuggaacucacucuguagaccaggcuggccuugaacucagaaaucugccugccucugccuucugagugcugggauuaaaggcgugcgccaccacugccaggcuuuguggaucuuguuccucuaacugggcugucuuaucuggccucagugggugucuuagucaggguuucuauuccugcacaaacaucaugaccaagaagcaaguuggggaggaaaggguuuauucagcuuacauuuucaucacugaaagaagugaggccuggaacucaagccaggcagggagcaggagcugauguagaggccauggagggauguuaauuacugucuugcucagccugcucucuuauagaacccaagacuaccagcccagagauggucccacccacaaggggaccuccccacuugaucacuaauugagaaaaugccuuacaguuggaucucauggaggcauuuccucaacugaagcuccuuucucugugauaacuccagcugugucaagcugacacaaaaucagccaguacagugggagaggaugcuccuagcccugccgugacuugauguuccaggguggguugguacccagggaggauggagggagggcugugagaggggggcugcgacugcgauguaaagucaauaaauaaugggaaaaguucccaaacaaaacacagaguguaugucaaagccugcggugagugagcaugugagcugguggcagcccauagucuggcuuggguuaccugcucugcuugcuguccucgcccauaaucuccacgugugugacaguaagcugcauguuagaaaccuauggauagaaagucuacugugaggaccaggggacucauugagcuaagaggcucuugccuacaaggcagagcuggaggccaaggcuaccagaggcugugcaaccacauuagccuagccguuguuuggugucugcgucuccacacugcucuuuuuguggcuggaguugacaguuucagagcuuggucucugagguggacccuacuuuugucacucacccaaggcugugugcucacuggaagugauggggagagaguuuaaaaguuacuaaauuuuaugacuuugguaggggagggauggagagagcaagcaagcuaaugcucuggggcucacaugaaugcuggcugugagcuccaggugucagaugcccuucccugcugagcauuuucccagccaagacagggagagguuuuucuuuuuuuuuuuuuuuuuugaggcaggguuucucuguguagcccuggcuguccuggaacucacuuuguagaccaggcuggccucaaacucagaaauccuccugccucugccucccgagugcugggauuaaaggugugcuccaccacgccuggcuuauuuccuucauuuuauauguaugaauguuuaccugugaauuuguuauguguaccgcauguaugccuguuguucagggcagucagaagaggacauuggcuucccuggaacuggaguuacauacagaugguugugagccaccaugugggugcuggguccucugugagagagcaagugcuuuuaaccaccaggcugaugcuucugcccccuagaugaggaguuuuugaugguaccuuacaaauugguuucagacagcuaaccagaucuaguuuugcccugaaaguaaaauaaauauaaauacaaagcccacaugaggucugaugccuguccuugcaggugcgguccucaucaugcugggccugcccgccugcguccucuugcugcugcugcagugcaggcagaaggacccggggcugcuccacuucccuccaccucugccggcucuccacgagcugugggaacccagggugugcggcguuuaccuccucugguuuuucguucaagcucucuuccaccuucuaccaguugggaagguaagguuuugggguuuguuguauguauauuuuuuguguuuugagacaugguccuggcuguguguuccugaccuggaacucacucuguagaccagguugguccugaacucgcagagcucugccugccucugccucugcagugcuuggauuauaaacgugugcccccugguggaaguaggguuuugcugaaggggcaugguuuugugaaacuugacugacugacuugucauuuuuaagauuuccagcaguuucaaaguuaagcggucagucaugcgcugagccuuauuccugagcucuguagcuuuccucuuacuaaguauaacuuuaaaaauaugauuuggguuuaucuaauuuccuauaucacuuuucuuucuuuuucaacaaaauaccugacaaaagccaaggggggcaggggggggggaaacaaacaacaacaggauuuauuuugccucaagcuuugaggguaacguccaugauagcagaggaaugguguuggggagagagguggcuggucacuuugcaucagugccagguuggaagcagagagacagggauacugauucucagcuugauuuccccuguguguguguggguguuuucgcccacaucuaugucugugcucugugugcgcagaacuccgaggacauuagccccccuaggacuggaggcaugguugugaaccaucaguguguacugaggacagcccccggugcucgggaagagcagccuguguccuuggugagccggugcuccagcucuucuuccuuuucugcagugugggaacccagcccaagaaacggagccacucacauuaggguggucuuuacaccucagcacagucuagagacugcgagauaggugugccuagagguuugcuccuaggugauucuuagggcauugaauccaauuauguguguguacgcuguugcuguuuucagacucaccagaagagggcaucagauccgugagcugguugcuggaauuugaacucagaaccugugaaagagcagccaguguucuuaaccacagagccaucucuccaggcccccccuacauacauauacauauacacauacacauacacauacacauacacauacacauacacauacacauacacauacacauacauauacauauacacacauacauacacauauauauaaucauaccuauuuccaguucuaacaggaaagaauaaguuauuugcuauuagccuaacucuuaguagaggcagcugaagagcaucccccucaguguguuuacuugugggugcaacauuuuaaaucauugucuucugagcucaguggauuuaacagaaaacaaacaaaaaaccccaaaacacagauucagguauuuccaguuuugauccuuaggaacuguugucaagaacacaguguccuuuucagacuccauugcuaaguguggucuuucaguuguuauaccuuuccuuagagauguguucaaagaacaugagcugcccuaagcaguacauaauuuauuucagaucuuauucuuaggagacugcaucuuugccagcuggaaauucuguuaggaggguggggcuguggacauggugcuguggacucucacuguaaguggcuguccgcuuuuacuacagggcucuguucagagucaggugaaaauaaccaugcauacguacaggcagaugucgagugucagucgagagauccucucucuauugucagacuaaggccaagaagacaccugcaauugagaaggaucgcuuaggguuucgccagugcugugaucucagguuuuauguuucuguccuggguuucccugccagcagaggaacaggugcaggaagaugaugccaucuuaauauuggacagcuuaaagugaauggcuacauuuugauacuuggggauccauguggcugcccauucacucaggugguuguugaaaagaaccucuguucuuguguuaaacuucuuuacguacauacauauuuuauagcuagacuccccauauagaaacagcacgcacauuuucuuuuugaguuugcaugaucucacuucauauuuuuuuuuguuuuuguuuuguuuuuucgagacaggguuucucuguauagcccuggcuguccuggaacucacucuguagaccaggcuggccucgaacucagaaauccaccugccucugccucccgagugcugggauuaaaggcgugugccaccaugcccggcuacuucguacauuuuaagcccauugguuuuccuguggccggccggccggccugccugccugccugccugccugccugccugccugcccgcccgcccgcccgcccgcccucccuccucacauaaauaaagacuaaauauaaggagacaaggaaggacucaaugcaggugauaaauaguuaugaaaggauuuuaaacaaauuguuuuucugguucuaauccugucaugguuuuucuggauauguguguguaaaauuuuuaaggcaaaccucacaaaugagagauagugggauuagacucuucuauuguugaugggcaguggagaguuuugagcacacuaauauuguucucugugugggaugguuugaugagggugguuauugcaauagucuuggugcacugaaaacaaauuaacuacauauguuuaagguaaaucccuacagugggguugugucaucaacuacuagaauacuauuguguuuccuacuuccuuucuuggguauaauaaugaauuucaagaguuugagaagauuauauauauacauauauauauauauauucucaacaauauauauauauguauauauauguguguguauacauauauuacauauguauauuaaaggugugugagugucgugccacacaccuuuaaucccagcauucuggaugcacaggcuggugggucucugaguuugaggccagccuggucuacaaaaugaguuccaggacagccagggcuguugcacagaaaaccugucucaaaaaacacaaagaugauaauauccuuuaauuuuuaaauaaaaaugcaauuuguuuuuuucuuuuaagguugcagaaggaacaccucuuguugauggaagaagacuccaguauagacugaauggugauuuucuuaaauacucaaugacauaacuuuuacaguuuuuacaucgugggagcugauucacuggguggugaacggaagguuaucuuuuagaaguuugaagaacuuguagcuaaauuagcuuauuccagcuuaggaaaaacguguguaaaacagaauaguacacuuaguaucuucuguuuuccuuuuacuuugagauaaggcaucaccaugucacccaggcuagccuggaguucacuuuguaguacaggcuagcccuucugccucagcuuccugaguucuggcauuacaagugugugcuacuggccugguuaguuuuguuuccuuuuuccuuuuaaaguuuaauuuuuauuuuaugugugugagugccugucugucugugugcguguaugauauaaauuauauaucauauaauuuaauauauuuuaauuauauauaucacgcgugccuggugcccauggaagucagaagaggguauuggguacuuugcaacuggaguuacugaucauugugacauccugggaacccagccuguuuuccuaggcugagaagacguugccccaccauuuuuuuuuuuuuuuuuggugguuaaauauuguuuuaaaauauuuugugugugugccugaguguauguugugugugcaucauguguguguaguggaagcuguuagacaccuggaacuggaguuacaggugguugucagguacuguguggugcugggaacuaaaccuggguccucugaaagagcagugugugcucuuaaauucugagccaucucuccagugccuagcaaauacuuuuaacuagagcgaucucuccagcaugcuucauuuucucaauagcacauaccaucugucuuagucaggguuucuauuccugcacaaacaucaugacuaagaagcaaguuggggaggaaaggguuuauucagcuuacacuuccauacugcuguucaucaccaaaggaagucaagacuggaacucaagcaggucaggaagcaggagcugauucagaggccauggagggaugcugccuacuggcuugcuuccccuggcuugcucagcuugcucucuuauagaacccaaaacuaccagcccagggauggcacuacccacauugggcccuccuacccuugaucacuaauugagaaaaugccuuacagcuggaucucauggagacauuuccucaagagaggcuccuucucugugacaacuccauccugugucaaguugacacacaaccagccaguacaccaucauucagcauaugcuuuaagguuuucccauagcaggcauucucguggcucucagaaggcuccccuguuguauacaucccagucacucccaccuaggagcccgcugcuccuguccuugugugccuggcuccagcugacuggccucugagagcugucucuugaauguguguccacucuugucaacccuuugcuugaaaacaucuuucccuaugcuuuuugcaccacggagcuguagucaguauugcuucuucaugaaggggaagacgcaaggaaagguguggaacuuggcuggaacugcacaagcaaggagaaagcauuggcuucuuccuugccucuuuuguuuuauuuucugacaguuauggcuugccacaucagugucuuuucuguuuaguggacuuuuuccuggugggcacuaguuuugugggcuagcuuguguuuaguacauacuuggcacuagggagcuaugcguguugagcagggaaggcagcguggagcuuguguaacagagcuugugaaaggcucuuuugucugaguaucuugauagucagcacauguacagcuuuaccuuccgaaggcugauaaagcgccauucaugugacuuuaggagucucugugguggucauccuuaacagauuguccguuuuacuaaauuggguagagugaugccauuuauuucuagaauuuuaugaaagaugcucuucaacuuaugauugugcuuauguucacauaaguccaucuuauguuggccauaccuuagguugaaaauguauuuucugcagcugaccugccaguguccgggcuuagcagcacuguagaguuguaggucaacugugauuuguugagaucauugcacugcccagcacugggagaggacauuguauguugcuagucugaauccacauuugaguauggugcuggaugugucuagcuucugcauguguaugaugcacugccaaacucccuaaguugaaccacuggaagccaggaauggucugaguaaauuuuaauguuuggcuuccaucuuauuccaucuuauuuucuaguuugggugguuguucaugggcuuagccagcauuuuuaacugaaaucacucugcagggugcaagccgggaagcagaaauguuuucggggcuaccugccuucaggugccgagcugcaugccauccuagccggcugugcaccugccuggaaccaugcuugcucgugcuggacaucuuucuguucuugcccagcuccucgcuaacggaagcugccugucucauaaucuuaggcgugccauggcucuugcuggcucugcuggccugcuacaggcugucugcucacaguucugcucuugcuguggagggcauugaggccaagcccugcgccugggcccuugguacuuggguaaagacuucuuuguuggucuguguuucuaguguuacuccauucccuguuacgggauuuuaccucuaaggaaguuccuaagacauucugagugauuagucugcagucuguggagugaaaaacaguuguaccacuucauagauuuuauaaggguuaaauuauucuuuggaguaaacuugguauguagcaaacauggcuuuagaaagcaaacuuguggcgauccucuuuuaucagggcuuagaaauccucucacuaaugaccaugacuuguuugacuguuaauugaaauauaauuugaugacuucauguggaaccuaagcacuucagcuuuuguaagaaaaaugauuucuuuagccaaaaggugaaauugugcacucccugcccccagauugggcaggcagcacccuuagacuggcuugugacuugucuccugggcuuuuagccugcuggcugccugugcaucagaguggagccuagugugcccuugugugggauuacaagugugagugaccacacuugguuuccccggguuuuauuauagccucuacugugaagguacagcauccuuuucuuccccccaaagcuuuauuuauuauuauacguaaguacacuguagcugucuucagacgcaccagaagagggugacauacucauuacggaugguugugagccaccaugugguugcugggauuugaacucaggaccuucagaagagcagucggugcucuuaaccacugagccaucucuccagcccgaggguacagcaucuugauauucguuuucuauguggcagaaugugacuagaaccuuuuuauaccauuaccaacucgugaguuccaacauaaauauuuauaacuguauaccuuaagauuauucugcugugagguaauggcauuagacuugaaaauguguucuuguacaucucuuuugggagcuacuuauuugacuuuggacucugaacguuggaguagugagugcauuuugagauucuuuucaguuuaacagugaguuugagcuuggcuuuaauuaacaguggguaaggaugguucauauugccaaauaauguuagcauucuuaaaagacaguacaagagcugugguauuuacacugaagauuguaccuuaaggacauugcuuauuugcauauauaugaaaauaaucuggauaaugaaauuuaagacuuaaacagaaaaacacugcauugacugguagcuccuguguguugggggggggggugucuuuuugagcccggggacuuaaggccagcuugggcaaccuagugugacuugucucaaaacccccaaauguagccccaggaugagugacguuaauuaacccuguucucccucuuuaaaggauuguaugccuucauucugacaucugcagcccugggagcagcugucuucugggguguugagcugugcuaccuguacacucacuuccugcaguuggcacuggcagccaccggguucuccgugcuccugagugcuuaccucuauguucgcucucugcgagccccgagggaggagcugucgccagccaguuccggugagcaguuccaucaugggucacauggcuguguccagagcccuggcagccaugacuacucauagagauugguuuuugucuaguuuaauuuugggaaauaaagacauagaaaacaagugaagaaaaaaauugaaggcaaaauuuaaguuuuuuuccucaugcuuuucuauuuaguucucauuaacucuaaguaugugacuaaaauccuucagcagcucugacucucugccuguuuacuuuugucaaguaguaaauuccuucaaaacaaaacaaaaaaacaggcugcaaguuauuugguucugaccuaagauauuuuuuuuuaaguuuccuauggacuggguguggaggcccauaccuuuaaucugagcacuugucaggcagaugcaggaggauuucugugaguuugaggcccuccugauccaaauaaaguuccaggccagccaggacuacauagugagaccucaucucaaaaauaaaacaaaaggucguauguuuaaaaauaaaccuguaguuucccuagaggugaagugagcucucaagaucaguagcggcccuggcuucccaguccuguccuucgcuucccccucugcagucgucuccucagggagcagaggcccaaggucagcacuuggugagguaaaugcuuucuccuucccaggaaaugcugucuacgacuucuucauuggccgagaguuaaacccgcgacuuggugcuuucgaucucaaguucuuuugugaguugcgcccuggauugauuggauggguaugucuuuuuuuuuuuuuuuuuuuccaauaauuucaaugguaugacuucaucuuguauuuagaaggaaauguaggcaauuuuuaaagauuauaguuuucccuaauugugucuuaacacauauauauuuauuuauuuuuuuacugguuuaagagaacuuguuacggauuguuaaacaucacagauauuuuucaauuuuuauuacauauaucuaggaagugauagugaagauggaaaguaaagccuuauuugacccaguuucaggcuuggaggacaauuacagacauggaaccgagacucccauuuucuuucgccggauuccuuacuaacagcaggcucagucacagucccgucaagggcagugcuacugaggggaucuguaacccuuauugggguucauuggugcuuaacuguugcuccauucuuucaucuuggucuccucucacuaugcugguuccuuaggcucuugugacggugucgcccuuuugaagagcacuguucguaagaccaucauuccguuguucuccugaucagagaccccauguguugucaggaagcgcagacaagugacacgucagggcugaggugucuuguucucugguggccauggcggugugcacugggggucucggcucugcuuggccucgccagugccuuugaggcguugucgucuucucuucccaggugguuauuaacuuagugaugcuucugauggaaaugaaaauucaggagcgagcugcuccguccuuggcaaugaucuugguuaacaguuuccagcucuuauaugugguggacgcccucuggaaugagguaauuuguuggauuuuccagguuauauauauauauauauauuuauauauuuacuuauuuuugagguccuaguaguccaugcuggucugaacuugugaucuucccaccuuggccucccacacgggauuagaggaauguguucuguaccugcacaagauaguuaauuuuagaaagagaugaauucuuggaggccaugaagucaagcagcuuuuugagaguuggugggugagguuuuccucuggggagcucucgaguugcuuauauacagaauuagggcaguuauagcuugcuucuucuauagcuuguguugauaaagaugagguaguucaaagggccugcacaugaacacuggugggugugucgacaacucuauucggaaaugacuuucuaagcaguuaacaucauucugaggucuagggugugagccuuagggcccggauccgugagcucugacucuuaccuugcccagugugaucugggcaagaacucugagagcuacuucuucccacagauacauuuugaaccauuacuuuuugcuaggcacuguggcauguacauuugaaaaaugagaggcuuauuuuucaaauaucaggggagauuguaggaugagaagggcuguugagggaagggacugaagcugggguuggaggaaggugaggucagggaguacugggcaaaggccugugaggguuuuagacaucuguuacagcaacuucugugggaggagacaggacuuaagccagagcaacuggaccugccuuucaauauuuuggugugccuucacuuaauauacuugaccguaaacuaguacuuuaaacauaagaugguuuucuuucuucccaccugucauuuuaggaagcacugcugaccuccauggacaucaugcacgacggcuuuggcuucaugcuggccuuuggggauuuaguguggguuccauuuaccuacagccuccaggccuuuuaccuggucagccauccccaugacuuguccuggccauuggcuucugucaucauugcucugaaaugugagugcuagucuuagccucuguucaguccaaggcacuguguuuacuguuuucugguuggugucugucgcaugccaucuuacuugaucacagacuugaaauaauuuaugauggauaagugcugaaaaauucucaaguuugcaaagagagggaauacaugcuagcucuccacuaguucuuacaacagacaucuuuuuuuuuuuuuuuuuuuuuugguuuuucgagacaggguuucucuguguagcccuggcuguccuggaacucacuuuguagaccagaaaucugcuugccucugccucccaagugcugggaggguggcucaaaggcgugagccaccacugcuuggcugaacaucuuacuuuuauuguuaagcaauuuaacuuaaaaugaauuccuuuaggaauaauuucugucaaaugccuguguuuuuaaaagagaucuuaaaaauaaaauuggucuuuauacaguuuuuggucucacugucgaaacaauagcagggaauauggccugaguagcucaggcaaugcauugaaggccucugugcaggagagggagccaguccucuggggagugguucagacaggagacuggcugaaugagacagcagcaguguaaagggugcucaggggcagagagacagguucagcuuggcugcucugaguucugccacacccagugguuuucaguucagauaguuuuccuuuauuucuuuguuguuuaaauaaucuuccaaaaccuccuggauaggaaaaggaccauggaacuucaaguagagcuaguguuaugacauugaugagugccuguaauggaagaggaacucuaagcaccuuguuaaaaggaagguuuaguuucuccauugguuugauuauucaugucgguggccccugaguuauccagcaguuugcaucuauccgaaagagucguugaagugaaggagauuugguauuucuugcuauucagaccuugucauaguaguuccaucuuugaauacaucucccaaguggcgggggagggguauggacccugaagugccaacacuguuuucugacuguuuucugcugguauuuuacugaggaaauaugccucuggcugaaggucucagacuagcagauaagguagccuguagucacugucgcuuguugcugucucagacacuguucuuugugggcaugacuggaaguguuugccuucaagauggaugaugacaagugagauuuuagaugcuaggugacaucuaaauuacuaacaggaaaauauuuuaaaauugcaguguguggauauguaaucuuccguugugcaaacucucagaaaaaugcauuccggaagaaucccacugauccaaagcuugcacguaaggacugacuuuuaauuuguugauuuauauuuauuauguguagauuuuuaugccuuucuuagaauucugucauuaaaauagguuuuguuuuuaaauagauuugaagaccauucauacuuccacggggaaaagucugcuuguuuccggaugguggggcuuuguucgccaucccaauuacuugggugaccucaucauggcucuggcguggucccucccaugugguaagcaacucaguguuaaugugacuuucccuggacagacaauaucauugguuggacuuguaggcagcuccgggcucuacucucuuggugucuaacagguguugccuaccuuaugagcggguuggggguguugugagauagguuuucuaaggagacuguaaugaacguuugguuugcguuuggcauagcuuggcuuucagugggugagggaaaugggacucacugagccacuguuguucccugcagguuucaaccaccuccugccauacuucuacauuaucuacuucaccgccuugcuuauccaucgagaggcccgggaugaacaccagugcaggaggaaguacggccuggccugggagaaguacugccagcgagugcccuaccgcauauuccccuacauuuacugaccugugcugcuugccuggcagcucagaccucucccagaaacaagggaaaguccaaaugaacuaaugugaugcacugacaggaucucuagguuuguuuuugagucaggacuauagagccaaauaguacaucuuuuaauguaguuaaauuuauucuuauggcaguuaaggaugguaaaauuugcuuauuaggaaaauuuuaaucccuaaaaaucuuaacuuuuauuuuuguugguuuuuuuuuuuucaauuuuuuuuuucuuuuugccauuugauuuuucuuaauugaaaacucuuauuaaaguacaucuacguuucauugugcuuagaacagaauucucuuuaagucaguuuauuagucuauaaaucaagcaaaacccagcccaauauugguguuauagcugaagaauaagggcagauuacuugcaggaccuguuuaaaggaccauucauagcagugacuccacuucagccuuuaaaagugcauuuggaaauauaaacacauagacgacuuuuauguaauauaugguaacuuuugauuuuucuguacaguuuuugaaugugagauaauugucagaaacuaaguaguuuuuuaacagaauauuuucaguguuuuaaauuaaguuuuguaaaguaauuacaauucauuuaaaguuaaaacauaggaaaguuauuuuucuuuauccaaaguuugugaauuuggcuuugcuaccucaauuugcagguguguguuugccuuuauaaaauguugcaaauagaaaaaaaaauauauauuuuuugaguaacagcacuauuuaaacauuuuuacacacauugguguuggaaaaauugccauuuuaggcuacuauuuuuauauauuuuuugacuuaaaauucaacaguguuuuugcuacuguuuagcuaauacaguuuauauuaauuuguauccuuuauguuuuuagaacucucuagaaaggaguucuaccugauacaacuuuaaguuuucucucuguuuaauggauguguauaagcuguuuguagccuucaguacuagugagguuggauaguuucccagucacugucccugagcaggacaaguggcaaguucacuagacuuuuuuauucaaagcuacauuguccucagaguaaacauaaggaugcaauacauauaguguguacauuuggguuucuauuacacauaccacaugugagcuagaugcaaaauauucaggucuuccugcucuguagcuuagagugucaaguggcugugcccgucugaucaugccgugcuacgcucugcauucugucauucuuuacuguuuuacuaguccuaagguguucagcaggugguuuucuaucaugcuuucugcuggaaucaacaugguauguguuaauaagcuuacaaggaaacaacuuuggguucuuugccugguucugaaagggcggacagugccacaguaucuggacauuaggugcaaguuguuuuuaauuugauguuuggcaagcuuuguaauaaaauuuugguuggaaacaaaaaguugaaaauaaagaguugcuguuagagccucauuucuuugccacagcuuugggauuaccagcagcaagauggccaacucucuguuuugucauaccacucccccucccccuuuuuuccuuuuuugagucuuucugaacucuaggaacccagggacuuacuuacuuagcaaagcaaaaacuguagggccugacucagugguggcucgccccuguaauggcagcaggccaagagggugggucaggaggaucuccauguguuugaggccauccugggcugga

SEQ ID NO: 568 - RNA, 5057 nt, Mus musculus
cagggaccaggaaggagaaggcggagccagucccacacucagguaucucuuugagguuccuaggacugcuaugacagaggaccacugucuggagaaaggggacauggucccagaggcuggaguccaagaucaacaggguuguuucccucugaggcaccuccuuggcuccucuggccaccuucuugccacaugaccuucccuuuguaugugugcauccaaauugcucccuuuuuaaacaaaacaaaauaacgaaacaacaguuauuucuuugaaaaauauuuuuacauaacacuuauuaucauuauuauagugcuauaaauauuauauaauguuuuuuuauuuuauuuaucuuuauuuuauguauauuaguauauuaguuacuuccccauuuccuauugcaggacaacuuacagaaagaaggauuuaauuuagguugcaguuccagaggaucagagucugugacagcagagaggagggagaaggcagcagacagagaaaacagagagaguacuugcaaugauuuugcgucuucugaaaccaagagacauacuuucuucaguguccauguacccaagacuuacaggacuucuuacucaaaccaccacagugaguuuuugcuugugugugugugugugugugugugugugugugugugugugugugcagcaugugcguacagugcccaaagaggccaaaagaagccaucagauccccuggaacugaaguuacagguaguugugaccugucaugugggugccaggaacugcaccagcucacauuggugucuccaucaaacucauucuccuucagucuaucuagaagggugguucuccuuccuggucccugccuuccucugcuuacaggugugauggcagcacaccaauggagaacaacuuugggacaaagccuccaguuaccuugcacuucaugaacacuuuggcucaucuaagcaacgggcuccgugggaccccagccacguacgauagacuaaacagguuguuguccuaacagccguguggggacauuuggcccguggauguaaauguuccucgguagccaugggauuguccucuguaagagcagcaggcacucugagccaucucuccagccucacaaguugcucuuuacaaagcaccagcucacauuggugucuccaucaaacccauucuccuucagucuaucuagaagggugcuucucaaccuguggguuguaaccuccuuuggcaaaccucuaucuccagaaguauuuacauuacauuugcaguagcaaauuuacaauuagaaaguaacgacaaaagucauuuuaugguugaggucaccacaacaugaggaacuguguuaaagggucauagcaguauugggaagguuuagaaccccuggucuagacaagcccuagaaaugugucacguucccagcuccugggaucaggacuucugcacagggacugauggcuaacaacucaaccuugaauacuucccaacuccagauugcuguggucaccgggggcuuucuauuagaacagucuagaauagcuguaauuucaaaugaguuaauuucuuuuuguguuuuguggguuuuuuuguuuuguuuuguuuuuguuuuuguuuuuguuuuuuuuuuguuuguuuguuuuguuuuauugagacaggguuucucuguguagcccuggcuguccuggaacucacucuguagaccaggcuggccuugaacucagaaaucugccugcuucugccucccgagugcugggauuaaagguaugugccaccacugccuggcuaauuucuaaauauauagaaagcaaaaguuaaaaaaaaaauaguaaguuguagaaaauaaaaccccaucaagucaggcacuuaaagcaucccgcagaagugccuggggacauccugcugaaacagucacguuggaguccccgacuggcagauucccggaggagcuucuggcuuuguguucccaugguggccauuuccgugagacaaaugaaagaaacuagaguuggaaauagucuuucccucgaguugucucaaggaagcaaaugcuuucuuaaucucuguagcuguuuguucuucucuuccucccuguuagaguuagggcaggaaguucugcugagccuccuauggcccugaaggcuccagcuaaugccugccuacucucagggucgaggugccagaagucccacggguguaggguugccagagauagcaacucaacggcacaggagaaacuguccugggugguacaggagaagcuguccuggguuucccagcaccccacaguggcucucgauagccuggaacaccaauuccagggcuuccauugcccucuucuguuucccacaggccccaggcacacgugguggacagacauacaucuaggcaaagcauccaugcacauaaaauaaaaauaaacagaucucauuuaacuuauuaacaaguaagugguuagggcuggagagauggcucaggaguuaagagcaccgacugcucuuccagaaauccugaguucaauucccagcaugguggcucacaaccaucuguaaugagaucugacgcccucuucuggugugucugaagauagcuacaguguacucacauacauaaaauaaauaaaucuuaaaaacaaaacaaaacaagaaauaagugguuaauuagaaauuggacugcagguauagaucagugugggaaagccuguaugugucugguaugugcgaggucccguguccacuuccugucaccaaaaauugacgccaagaaaaaccaccaccaccaccaacaacaacagagacacuacccagaugcucaguuacauuuaaauuucagguugacaguaaccuuagaguaaaaaugauuuuaucgcaaauauugugugacauacaccuauucccaaaagcaauuuguucaucuguugagaaaaggccaagaagcagcucuggugaggacuuccagaagaggugaacaccaagaaaagacguugagggagcagcggguguuccugugugcucggggccuuucugaagccaguguggaugggcuuccuugaguguaacuguguuaaagugcagauucugggcccucuccuaggcuggugacugaugggagcggcugcggcucuacagcucugggugagcagacaccaaauuugaggcccugcgugcugagguguuugucucaugucuggggauucugugcaggcagcagugaaguggcaagacugucuugggcagccuaagcaggagccaccuuagaaacagugauuuccccagggccugggaccaggcuuccccacauugacagaggacaaugguagagaucuaggccaaccugcuuccucaaggcuguggugaaguugaaaugagaaaauaaaaaaccgaugucguguagauuuugacaugcucaggaccaccucucccuccucucccucuccuccuccuuuuccuacguuuuuggugguuguuuugagauagacucucacuauguagcucuggcuguccugcaacuuagacuagauuggcccagaacucacagagauccaccugccucugccuccccagugcugggauuaaaggugugugccaccaccacgcuggguuuaggaucuucuugucagagcuggguggggcuuggcauggagugacaccuccugucuuggggcucuucugccaugggucugacaggugcuaaaugagcauucuaccguggagcuauagcccauggacuuacugcccuuuccugucagucaagagggucucuugcaggaggaacagcugucuaacgcugaacugggaacacacagccagccauuguuucccacaucaaguuaagccuaacaccagcuugcaccucccugaggaggacugugcaucacuguuccaucucagggaucccucccacccagaguuuaccuaggaacuccugagcucagaggucccgucucugccacauugaccucaggcuaugcucaagagucccucacuguucuccaucccuggggaucugugugccuauacaaagcccaggucacugcccagagggcagugugcacugcauugcugccucgggaagcaggcuguccuuaaacugcccagcagagaaagccucucccugcugggccaugggcaaccccauggauggcuuuuacauccuuagaaaggcuguucuuuccugccuggacacugucaaagcacaaaggauuccuucaucuuuucauccuuccugcuccccgccccccaacuuggcugagaaaggcaaagacaugccuuacccucugggcuuggggaagaggcuaccacucucacuaaagcucuggccuccagccagauaacugaccagugucaaagauggugcaugggucaggaaaacgguguuugccugaugaucgguaguccaaaaccagguggcgcucuaggcccacccugggaccugccagagcuugccacaucuuguuuccggucccacucaaccucgcuaaauugcggcucacuucccucucacuugggcucccaggaggagugcugccaaauacccagcuuacccagggcuggcugacugggugcagugccagguguauguuggucugugcuuucuuucucaagucaaagccaguagccagggccucaugccaacccugugcagacuggccucugcggcauagcgguucuucccgaauuuccuugcugaaacgacacuugggaugacccuaguuggcgcauccucugggcucacccucccccaccaagaagcugacccacuuuucucucuccccauccauugcugcacugaacgcuaggcgccuucacccagagaacaggaccccaucuaggccucuagucucuuacucugaggauuuaggacuuuccugccagaguacgaguuaugagacagaaauuucccgccaaccuugcguccuaagagaguguuggagugagguccgccagcugggcagggguucaagucccucuggggccgcugcaugaaaccuggguuaaggaagaucugaaaagggcuucccagagguaggucccucagccuagaggccaggcuuucaggccccacccg

SEQ ID NO: 569 - RNA, 7681 nt, Mus musculus
uacaagaaauccaaaacuucaacaaaaccaggaugcuuguauuuuauuuacugaccucuaaaacagacuaaaauucuuauaacuaauaaaaauuucaaguuauucaccaugacaaacuuuuacaaaaaacacuugaaugcaguaucuucuucacuuccgucgugagcggacaacacggaacuuuacauucagacgguaaacucagacuuuacaaauacaagcuacauagaaacgguggauuugugguuuauuaggaagcuagcaguucugagaggcaugcuauaguaauacuuuaauucagucugaggcgggagccacacugaguaaacacugcguacguugcacaccggcgugaaggacgcacacacugucagccaucagugucaguaucugccggugcacacauaacugcgucucgcucuguucaccgcucagcaaguggaugccacaaaucccuuccauuuaaaaacacaguuugaaccuggcaagaaagguaaagcagaccugcucuucacaccacaggaucgugcgcaccauggagcaugugauccccguuaccauguguguguuguaaacggcauacauguuguacuccaaaagaaacauaccacugcagcaaaaguuacauuuuauuucaucuuagacacaaucuagaaagaccuuuucuuguuaacucuucaacaaauuacugacaugaauuuaccagaaaaaauaauuauauauauuugcccaacaucaaauuaucugcaaaaguuucuaagagauuuuuauuccguuuccaaaaauaaagguuuucuaacuggaaaccccgacauuccuacucucuaaagcaaacuuuaggacgcaggcuggucucucggcuuugacagcuccauuacguaaguauauccuucccaacacucucaguuucaaaagcugauuacuucccaauaacggaacagucgucuucaugucaaaccauucauucuguuuccauagugacauugcgggauuccuuggccaccauaagucgcauuaacugacuguggaauuucucaaucuucuuuacgucuugcgcuuggucuguucuguacaccaaacacugucagagaaaggaaagauacacaaacugagcaaauccagauagcaguagugacagaagccagugaguaggcaaacacgcgggagccuuuacugccggauucugcucugcucucucaggugccauaccgagcagccagcaacugcuuucuuacccuuuucuuuaauccuagcuuaauuuucuauuuuuaaaugccauugccauagaggaaaguaaagaaacuuucuagaaaacucucaaacacugcaaguuaagucccacugucuacagccaccuauagcuccagcuccagggaacuggcgcccucuucaggcuugcuaaggcacaggcaugcaucuggcacacagacaugcagcaaaauacccaaacaccuaaaauaaauaaaugucaaaauguucaacauuauucucagauacacagcaagucagguuagugugggcucaugagacccuguaucaggaaacaaaagaagacuuuuacuauuaaggugaauuuauauauuuauagauuuccaacuugagaaaaauagucucuuaaguaaaguagaaaaaaacguuagaggggacaugaggaugaaguuuaagaggauuuuuuuuuuuccauuuuuuauuagguauuuaacucauuuacauuuccaaugcuauaccaaaaguaagaggauuuuuuaaaaggaauuaaucaaguuugcacuuuuaaaaaucauuccagcaggcuagagauaugcucaauaguacagcagguguagcuguggaagacccuugaaugggggggggggggagaagagagagagagagagagagagagagagagagagagugugugugugugugugugugugugugucauguguauuauaagggaucaaaaugccacuuuuucaaguaaaccagcaguaggcauaacaggagaagggaaggggaaaaugccaugccagcugugaaugcuuguaugugcuuggcccagggaguggcacuauuaggagauguggccuuguuggaguaggcaugucacuguagguuugggcuuuaagacccucauccuagcugccuggaagccuucaggugaagauguagaacucucagcuccuccugcaccaugccugccuggacacugccaugcucccaccuucauaauggacugaaccucugaaccuggaagccagguccaauuaaauguuguccuuuauaagacuugacuuggucaugguaucuguucacagcaguaaaacccuaagauaccagguuucuggcaggugguugacagcaugccuacuggcaggaagagcugaaaagauccacucugggaaggcuaacucuaacagcugcaugaagaaaaauuaccugacuucagaguuagucagagccucagaagaaagacggaccacauacauaaaugcccaagcagacaugcuauaggaagcaccagacugcaggaaucaaaugaacugcucagaagaauagccaaggccagaaugcugguaaaaugcaguauuuauggggaaacuguuagcauuccuucuaggcuccaccccacaguuacauggcaaccgcuaauauggcuggauuacuauaaaaggggccguuugcccccuccucucucuugcucucugccccuucucuuucucugccucucuucucucugaacucuuucucccucucuccccuuccccucuccuccuuccccacauguuccuggccagccucuccucuccuucccccacccccuucugucucuacucccuucccaacucccuuucccaugcccuaaauacacuauucuacacuauaccuguccuauggcuggucucucagggggaagggaaacuucagcaugggcccgccgaggcaccccucccaccucaccauaccgcgccucuuaucaaacacauccuuggcucuuuuuccuuuguuauaaaacacaauagaaacaucuaauaauuagcagagggggaacacagaaaagcaaaggcaacauaaaguagagcuaccagggcuagaaaaucagagaauggucuucacaccacaaaaaaggaacaggaggugauaagagcaaagagcuagagaucacagcacggaggagcucacacaaggagcaguaccaguggagggcugcacagggagggggggaggcagacagacagacggacaguaacgagucccuggcucuguuugucaucauuuacagagcaaagcaugguaguauauguugauaauagcacucugaguucgaggccggccuggucuacuacauacugaguucauggacagccaggaaaacagacagaaccugucccaaaaacaaagacucuauauaaucauuugcuucuucccaugagaaggaaaccuacucaguuugucuuguuucucuggccaggucugaagaaggucuacugagccacagcugacacacugucuucauggagcaaguucguuauuuguugagucuaaaagaagaacuuuagaaccaaguucuuccaugugggacgcaugcaccuaguaggucaucugcagacucuacaugaacaaccucaaacaaguagucaacucaaaucccccgacccaacaaguaaaaguguauacuuacaacuagaucauccguuacuuugauacacaaauucccaucaacaugccuguauuugagaaccacccguaccugcaauaaaaauacuuauuuaaaagcagcaacagacagagggcacugguggcacacaccuuuaaucccagcagaggcaggccugaguuugaggccagccuggucuagagugaauuccaggauagcuacuagggcuagacagagaaacccugucucagaaaaacaaaaacaaaaacaaaaccaacaccccccaacaaaacaaagcaaaacaaaaacaaacaccaagaaucaccagccuuucccugcucccuacacuucccaaagccccacaaacuuaaaguuaguucaguguggcaaccugaaggauuuuaacuguuagauaaaaaauacuguuacaguucaaaauaagcauccauuucaauagagucacagagacaaaaaggucaagguuccugucuaguuaagaacuuuuaauucaacaaccaaaauaaucaauacaaaacagagugaauuaaaauaaagguccuagaaaggcagccucuuauucgggaaauggagaugauccuggaaccccaggaggcauggaggaccuggggccaggaguaagagguggaggcagugaucuggcagccgugggggcugugaucagacgaggccagggagcucuuggaggcaaagccaagacaaggaguggguccccgucaccaagguaaggacaugaggaccaagucguggagcucccagacuacucaucuucccugagcacaucccucccucaagggagguucuaaaacccugcucauacagaaacagacgcuuggcggccgguggacagguucaaggcuuuugacacuacugggaacuacaauggucauguuggucuugguguuccaugcuccaaggaggaacccacagccaucuaggggccgccaucuuggccaagcucuccauugucccuauuuggagaggcuacuggggaacaagacuagcaagccccacaaugucccaugcaaggugacaggccacuguggcucugugcuggugcaucuuauuucugcccccagaagcacuggcauugucucugcuccugugcccaaaaaacuacuaaugauggccaauauugauaagugccauuaaucagccaggggcugcacugccacccuggauaacacugccaaggccaccaguggugcaaccuccaagaccuacagcuaccugaccccugaccucuggaaagaaacuuuguuauucaagucucuuuaucaggaauucacuggccaccuugugaaaacccacacuggaguaucuguucagaggacccagguuccaucuguggcuaucauaugaggguuuuuauacaagaaaaauaaagugaauuaagucuauuuaaaaaaaaaaaguccuauaaagaaaaauacugguaaaagugcuaaaggaaaaagaggccaagaaccacuuuucuugggauguggcuuugaaaauacauguuuuguuuucauauagagaaggcugaagaaaguauaagcacucugaacaaagagcugauguaucuauggcuucaccaagucugaagccagaaugacugaaucaagacagugcgacugggagucaggacuucauucaguaaucaaugaagaacugguuuuaagcagaggacacggcagugucgguauucucagaccacgguagcagaaacguaagggagggacuaaaaggaagacagagcaaccacgggcucuuucagcucaccagcaacagcauuucaguucaagccauaaagggaagaguaaagggugaaaagguacauugguuccacacugaaugugcuggguacagaaagcagaauucccgcacacaaauccuagagaccaacaaacugucuucguuagcccuacgaggaccagaauggacuggaguucagauccaggguuuauacuuaaguuuggaggccacaaggauuuucuccuggacagaucuggccagcuccuccucugugucuccuucucaucacaacucccugacacuucuacuuucacuggccccgcaacuacaucuucaaauagucacucaaugugugcugguguaucuacagucucuuuacuaaaugcagacacuguauacuguugucaguaucaggcccuucuggacaaaccuuauaccaccuuacagcacacugcccaacugaggaaaugaaccacaugaaaguacauacaagaagccaccacugucacaaacuacacaauuucaaaaauaccuaaucuaccuagccauuuauuaucacuuuaauaagaucauuaguuuuaaauguugccuuaaaaagggagccugcagccgggugugguggcacacgccuuuaaucccagcacucgggaggcagaggcaggcggaucucugaguuccugagaaauaaaaagaagggccgggggagcuaacacccagaguucaagaucacucucaucuccacaggacauuaaugaggcccaucuaggacgcaugagaagauaggagcuuaaaaauacacaaggaugguuccgaauguucuacugucuacucuggucuuccugugguucuaaugcagguagacacagauuuggcucccagcacccacaagguggcucacacccaugccuaacuccauuucccggggauucaaugcccucuucugaccccagcagggcaggcaccccaugugcacaagcaaacacugacauacguaagaauuaauggacugaccuucuuaaaagaugcuuccugugggcuuggagagauggcuuagcugcuaaaggcuaugcucacaaccaaaaguaaaagaugcucccuguaaaauccuguaguaaguacugccaccgcaagcugccaguaccaauauauuuuugauuuuuacuuacaugugugugucuguguguguacauguuagugugagagauguguggucagagggcaaauuuaaggaguagauucccucuuuccauccuuaagugaguucugcaugcugagugucucugcagucucauuaugauacacacacacacacacagaguucguguuaugcacugagcccggguucuugagauuguuagcugcucaucgguuuuuuuguuuuuguuuucuuuuuccuuaacguguauauucauaaaacaugcgucuaccauaccuucaacaauccuuuaaggaaugaugaagcugaccuuugugucccccucccggaacuuguucugaacugcugagaugggacuggguaguuugcuuuggggaaugaaaccgcuugcaaacauuuaugucuaacgugagagugcaaacagucuccauguuucaacugguccaggaaaagacuaaaaauccccacuauccaaaaaaaaaaaaaaaaaaguagagcaggugcuuccuaacugggacguacaguagcaccauuuuauaagcugguacucucgggucuggguaggaaaggaaaggggcacuaaacuaagcgacggacaggaaagcgacggugcagggggaggagcccacucagcgacacguaaaccaaccagaucccgagcggaaguuaggagcucccccgggugcaggccgcugugggguccggcgcugcggaaaccgcccugccuguagcugcuggggucgccucgcugggucacugggucuccgggucagucggaagcagacgaagggacaguggcaccgggugggccgacuguuuccugggcgugcucaggccgcgccaaggguagagaagccccgggccccagggcggucccugcagcgacucaccuucaugggguccgccagguagagcuucucggccgcccggcugaacuccucccaggucuggaacugaggcaucguggcuucaggcagcgaggaacaaggccgcgaagcgagucacggcgcugucgccccggcggcccgccgcucucccgcaaccgcccacagcgcugcacuccggcggcgcaaagacggaggcucacgagcgcucacgccauuggccagccucggccgcgcgccugucca

SEQ ID NO: 570 - RNA, 1178 nt, Mus musculus
gaaggaagcuuguucaucacagaauaaucaaauauuuacuguuggcccuguguguuuuucaaacaguuaaucauacguuguucaguacugaugaacaccaaaggacugaacguggcauaaccacuggacacaaacaucuggacacagcgauggguugggucauuauuccacauaacucuccaggaggaggcaauggaauccagacaguacgugaccaaaaagaagcucacuagcaacagaauguuccggacggcccucugcucuggggaugcuuugcgggaaaugcugguguugugaagguacugacacugccuuuuaugucugcacaagacagucaccauguauauacuugaaaguaccaugagcccuacuagagaggcaucccggaaggcagccaguauagaaaguaagugucucauggugucacuaacaacccagagagagcaggauuuagugaccaguaugagaaugugugaggucacauugugggcggccacaauggaguuugaaaaaacauuaauggacauguggaaggcccacagggaaagaaagcagcacaaguugugccagagggaguuagguuugaccuuugccaaacaggaacuucuggggcugaggaggaugaccuggaggacgcucaggugacauguggcacaaauggagacaccccucaucagccuguacaaggagaucacugauuuacaugugaagucaucccaaaaccccugggaccccaaaaugucuguagccauggcagccauggccagcagcaucacgauguggcuuagagccaggacaccaaugguuauguugaugggcuugugccugaguuccugaaagaaugugaccacgugggagagcaggaggaugguguuggcugagaccccaaagacaauuucagaaaaaaaagcauuucuuaugccauugauauuguauacugggucguuucuguucaucuuaugggggaaaggaacacacaaggacacaucugaaagcaaugcaagaaaaaccaguuauuacccacugcugucguuauccaucucagcccacacuauggcugucucggaauggauaaaucaugguguagccugaucugauccucauguucuccagggaccauccccucucccuucuccccucuccuccccucuccuccccucuccuucccucuccccucu

SEQ ID NO: 571 - RNA, 4144 nt, Mus musculus
gaauuguauaaauggauaguuuauuguaguuauaagugaauacauaguauguguaaauauacauuuaaacugcauaaugauuguuuauauaugaauaucaaaccauucaucauucuuuuuguguggccuccacacuuguggaguucagaggacagccugcaguagucaguucucuccuucugccuugugaguucuggggcucaaacccagaucuuagggccaagagccucugccugcagagccaugccacagcccguucuuuugcucaucauuuuagacaucuuaauucaugucacuuugucacuuagcucuguuguuuagggugauuugggggaggcagcacagcacagagcuuguacuaggcaugaguccaggggcccaggaacuuccucccuacguuccaaagugcuagaauuccaggcugcaccaugacucugggccucuuuuagauacuguccucuggcugugccucauguuuaaucuccccuauaaacuuaggugucgacuagauuccaaauuuuaaaacucuuuugcuauuuuuauugggaucguguuguuuauaggccaauuuaagagggaaagacauuuuuaugaaaaugaaccuuuguagcugagaauaugggcuacuuuaaaaaaaaagucuuuaaaaacacaauugucucaguccccacaggcuccugugcaacuguaucaguacaccucaacugcugcccagggcucuucucugaaucuccuucugcagguugggggcaauugacagaauucuagaacucccagugggacuuagugccaccaagagagagccguuaucagaggaagcaggggaaacaugcucuggccuuugaucuccaggucccccaguggcuaaggcacaccagcagccauagccccugggucuacugcucagggggcuucuaagcagauaccagguuggaggcuacaaacuaaacacaggggcaagcagaggggaugggccaggcaccucaccucaccucaccacaguccagcgcucaggcuccggagacaaguguuucugguugagguaaacagaguaauuuggggacccaaaaauaguccacagaagauggugugcaaagaagcuuuguaccugugugacaacauugauggcuaacgggagaggaagacgggauuugaguaauucaaguuaugacacagagacaguccuuucccccagagugggccgaggucugaguggacgucuuguccucccucccucccaccaguguuguccuguuaugacuggagagcagagccaagagcaggcugguggggaacauagcguucaagucuugagucucuuacaggugcagguuaaaaccugugcuuuuuuuucccccaagccacauccacguggccacauuccagggccuccgccccuggacucuaaaggcacccuuuagagcuguuugcuggagcuaaaagagauuaguugaaucccuuuguggcgguggagugaaucagauccucccaaacuagccagcugacuuauuaacuagcccagguuguaacugccccgagcaaguucugcugagagggaaccaacuacagggacaucuccaacuagggcaccugaccaggaacaggucaucaugauuauccagaagggaaguguucccauaaaaugcuacagguggauucugaccuugguggggguaaaaucaaggauggguggggcugagugaggaggccgugguugauagaguacugcaggcaucauggggauaaacugccccaugcagauggggcuuacaggcagagugcacgcucugcagagacgucucagguuacgucucgaacauccaagucucccaacauggcucugaguccgguggaucuggaagaggcaccaagacauccgcaaagcaggacgugaaaggugugcaaugaaguguuuaaauuagcagacaacugugguggguguucagcagcccggacggcacccauggaaacugguguccaccaugaaauaggcacuguuuagugaccaugaaaggaugagguacugugaagaugugugcaaaugcuuacgcaggccuggcacaugcguagccucugagugugucagcugcacaaucacuguguggagauuggugccaguacauuuuguaugaaucaguacuuuuuuuuuuuaacggguaguggagcuucccaacguaucacaaaauacucugcugcuugggacgagggagaaugugagggaauuacaugugaaaugggauuucaaguguuuccgccuuacuaaaaacuaaaauguucucccgccucuaaggcuuccucacugggcucgagaguuagaagaguugaaugugugacacuaagauguguauggcucgagcagaguguauuggggcacaccugggaucucagcacaugggaguccugggcaggagaguuuucgaguuuuuggcuagccuacgcuacaccgugggaccuugcuucaacacaccaaguccaaagugcacaucuuucguugcuucccgccuuggcuuugauuguaguguugucuuggcuguguaacacuaagcuuucacauugucuuggugaauugcguugcacugaagaaauuauaggcuuuaacauuucauaaauguggcagccuggccacauuuaugaccccgugggcucauauguuugaauacaguuggaugcuuaguugcucuuuggaaggacugcaaagaucaggagguguagccuuguuagaggaaguggacuuuugaaaacuguuggcuguuagcauauucuuccaaagaguugaauucaaauuuacaauugagcguuccuagugggaacuggauaaucuugaugaaaagaaacuacuaucaugguguuauucugaaacgaaacccaagguuuagcugguuaugauagcacaugccuuuaauuacagcacuagagaagcagaggcaggcagagagcucugugaguucaagagcagccuggucuacacaucaaguuccaaaccagccagagucccauagugagaccgugucuccagaaaacaagaaacgucccaggguuuggacucagagacuguguguguaagaccugccaaaugucuaccccaugaccuccugacgcucagguccagcugcuauccagagcuagaaaggaucaccaccaguuuucuccagcucccuagccuccgugucagagucucuaguuugggccguauaguggccucagugacccaaaagguuggaucccuuggaagucugacagccaauaaagccccaccucuaaaccuugggccugcggcuguguuugacugugcacaguggacacagaggcuugcuaggccuugucauucuuuaacguggagacagcguuugcauugcacgcccuccuggagcuguugugaggaguaaugacaagaauuugaaucuccuagagaagugggcagugugcaggaggccugaacaagcaauggcucuuguccaccuucccccagcaguaagccgcagggacuuguaacccagugcgcugggucaggaaacggggaaauggucagcccaugugaggggaauacuguaagccaggucuggcuucaggaacaacucgaguaggggguggggguggggugagcuuccucaucucucagacuuucuucagcagcauuggcagaguuucauggaggcaagaugaugucagcccuucagucuacacacaucuucauagaugcaauguagaggccgccugcccccaccccccaaguucaaccggggaucguuacacuuuguuccugaauucagacacugccccagucaguguuccaguugucuggaauuagggacagagucauagcuucugaaccuuggagacagagucccgggaaggcccuggugucacgcggagaacagcaaaugguugcagcggaaaacuacaaagugugcagugcuccacaacccacccaauuccagaagcagcagauucacuuucuuuuggugaccugcuaauuagggggucucuguauccacauaccacccacugccaccauuugucacacagcacaacccgaagaucugagugccguccugucagagggaucgccucucucaggcuccagcaggauuugcccaguagccaccagaauucagaacuccauaaagggcacaaguauucuaau

SEQ ID NO: 572 - RNA, 1956 nt, Mus musculus
aaagauguuccaggacguuugcuuuuaaggaagcaaaaaacgcagccuccaacccaagcaucuccagugugaaagcuuugugccacaggcccagggugaagaaagacgacugucggaacauggcugcccaccacaccucuaccugcugguugacccaccagcaccguuucuguucugguucuguuuccugcucagaguuucagcagagagcaacauccaggaacaucucugagguagcguaacguagcgcuuggcauggaggaggagacaccuguggcuggggcaacuguccugaagcagcugcaguaacaguggagacacacccagccagggucacagggugacuaagugugcauuuggaggaagggcuuggagagacauggaugaauucccugugaaucaaucaucuugucaggggaagauccgaacccugcucuccuccgugggugugugauuuucagcauggguggcuccucccucuucucucuugaaucuuaaaggauaaguggaaaugguugagccuggcgacuugaguucaacucccaggauccucaggaggagagaacugaaugugguugugucacuucacugccacagguguaccuuggaauacacgucugggcacuuagacagacagacagacagacgcucgcacgcacgcacguacacacaaaauaaaaaggauuuuaguuucacaacucagaucuugauucuuggauuucuuuccuuuccuaagccuguucucccucccucccucccuugcuccuggccuucuacucuuaggcauugggcaccugccauuacagaugcugugaacauuaugguaccagcucuggugucuucagccacauagaaggaucuuggugguucagucucuugccuaccacaagucuuguuucuguagcucuggcugaccacucaggggaguuaagugagaagggcuuagcugucucaggaucuuugcaucucaagcacaaagcugggcacaacagaguagcccauuacuggggugggggugccacagagagcugcccugggacagaagaucagaagcccaagccuagagcaugguguagugucggggacauaauuaagaauagccuuuccaguuuucugcugcuaagggaacacaguagccagccaguccccucauggugccauugauggguguuuuauuguugucugagcuaacagauauugccaucucaucagaauggcugugaccacuugcaagagacugucaggaccaaaccuguggauguucccucagaagaagugggacgucucaucagauccuuacuugagagucuacucccuccauugccucccuccugccucuaugugauucugcacaagccgaacacagucuugcgaccuugggauguggugaagucuauagaguguauaaccgaaggggagacuccaucuguguaacugugggaacucaucccugcugggguacagcuuuucagugaugccguaguuuugggguugcuuacguuccuguaaguaacaccucacccaugugaggccaacaaacucauuggcucaccaaguuagacucucggcggaaucauugcuuuggccuguccuugaugcucugucugggggagaacauacuuuguucaugucucccccagaaaaguucauucaacaacugagucaauuuggaccaauuuccagaaaauggaaacauguaugucacgagaauuuagugaguguuuuauuuaaaugauguugccuuuagaguugauuuugauuuuggaauguauuugccaggaugcugaugcuuagacgaacugaaaagaagcccaugauccguucuguuuuauagagauggucugcucagagggucuugaaccaacgaccauaaccccuucaagggacuguuauaaaugcuaauagugcugagggcuugggagccucuuugacauuaaaagaaguuucucugucauu

SEQ ID NO: 573 - RNA, 501 nt, Mus musculus
uggaauucacuugccagacauggaggaagucagauguauggggucugaauuagagguaacaggccgcaugguaaagauggguuaguauaaacagguuauuacguuauacgagcugguugggaacaagccuaagcuauaaggucuaagcauuuauaaauaaauauaagucucugugucauuacuuggcagcuggcggauccgagacuguucugugauacacgucagaaacaaauacucagugaacacugcuaugagccagcaccucaaucguuguggagggcaguguccaaagaugaaaagacccagcagccccggaugcagggcuaccucuuguguggaggauggggcuugcugcaaagagaguuaagugugaagaaccacggaugcuccaggcaugaggaggugcacggggcccucuccaggaucaccgccguuugucugcaucaaaacacacucauugagcaacuaaucgcaccuggcucugcacuucgauuuuguuuu

SEQ ID NO: 574 - RNA, 1274 nt, Mus musculus
ugccacggagcugauaauguuuuauuccacuucaauuacuucacauuuuggucuuccucucugaggggguagggagguauaaaaagcucuauugcuuuaggauucuuuaacgcaacuucaucacaguucaucugggcuuuuccacuccuuugaauuccagggucauucuucuguaccuucccugauauuuuucuggcaaggcgcuagcaggcuugcucagcuucccacuucucuucaccggugacauaccccgaccaguagugaccccucugauggacaaaguucggggaaucgggagagcuggcgugggcccuuccaugcuccucaagcgccgcucauucuggcuguucaacccgagcucuggcuccuucccgccggcgcuugcuguuccaggcuggcgcuccuuggcucgccgagggcccugcgccacugagggccgggggcggcccagcaccggggggcggauggacugcgggcuccaaaacaucgcacagggggagguggccgcgggagaagcggggaccgcguugggaggaggucggugccugggcugcggggcuuguggggcguucggagggcccggccacgcccagcucugcgggacggcgcccacgcugcccuucaacaccggcccccaguggcugcucucacagagccaggcguccuccuccgaguagcucuccggagugccgccuucgggaucggagucgggcuccugagaacagguuggggacggcggaggagugacagggucacggaaguaggggaacaagagcacggcgcgcagccgccgcgcgggagagcaguagggcagccggaggggcagcgacaucugcgggccgggccaagcggggcugcggggaggccggcccugugcacgcucacgucccgcgcggcgcagccacagccauggagggacccggcuucgagucgucuccggccuggggaaaguuggauggacacuccaccuggagucaaaaggcggaauggagaccccgcgaggcugauguccucaacagggggcgggggagggucagaagaaccaguuucagccggagcgaccagagcaagccauugacacuucagucccaggaaggguuaaccgcguccugcugccuagguuuacauguaaauagagagccgcugcuccaagcgggcccgggcuagcacuuuuaaguuuuugauugguugccaaugacaucaccacccgcgcguucuaacacaccaaacccacuagcggguccgagccggccucccucccaaggcgaggccuc

SEQ ID NO: 575 - RNA, 1274 nt, Mus musculus
gaggccucgccuugggagggaggccggcucggacccgcuaguggguuugguguguuagaacgcgcggguggugaugucauuggcaaccaaucaaaaacuuaaaagugcuagcccgggcccgcuuggagcagcggcucucuauuuacauguaaaccuaggcagcaggacgcgguuaacccuuccugggacugaagugucaauggcuugcucuggucgcuccggcugaaacugguucuucugacccucccccgcccccuguugaggacaucagccucgcggggucuccauuccgccuuuugacuccagguggaguguccauccaacuuuccccaggccggagacgacucgaagccgggucccuccauggcuguggcugcgccgcgcgggacgugagcgugcacagggccggccuccccgcagccccgcuuggcccggcccgcagaugucgcugccccuccggcugcccuacugcucucccgcgcggcggcugcgcgccgugcucuuguuccccuacuuccgugacccugucacuccuccgccguccccaaccuguucucaggagcccgacuccgaucccgaaggcggcacuccggagagcuacucggaggaggacgccuggcucugugagagcagccacugggggccgguguugaagggcagcgugggcgccgucccgcagagcugggcguggccgggcccuccgaacgccccacaagccccgcagcccaggcaccgaccuccucccaacgcgguccccgcuucucccgcggccaccucccccugugcgauguuuuggagcccgcaguccauccgccccccggugcugggccgcccccggcccucaguggcgcagggcccucggcgagccaaggagcgccagccuggaacagcaagcgccggcgggaaggagccagagcucggguugaacagccagaaugagcggcgcuugaggagcauggaagggcccacgccagcucucccgauuccccgaacuuuguccaucagaggggucacuacuggucgggguaugucaccggugaagagaagugggaagcugagcaagccugcuagcgccuugccagaaaaauaucagggaagguacagaagaaugacccuggaauucaaaggaguggaaaagcccagaugaacugugaugaaguugcguuaaagaauccuaaagcaauagagcuuuuuauaccucccuacccccucagagaggaagaccaaaaugugaaguaauugaaguggaauaaaacauuaucagcuccguggca

SEQ ID NO: 576 - RNA, 5666 nt, Mus musculus
cgccaagccccucaguacugggugaaaccccuaccaucugaaagggguccgaucaguaaugccgcucgggggcuacuuccucuacuccuccuguugccaucugcaguguucgggggcuaauguccuggucccggucuuugagauuuaauaagcucaucacccccagcaagccagagcgccaaacggccuuuuacaaaccguaguaaacauuuuauuuacaaguuaaaggccuccuaagugcagcaaguccuuaugccaagaccccuggugcucagaggaacaguuccaccgaacauuucacagugugagcugcuuagguagggaaaacaguugaauucuuucuuugugacgggggagggggaaccuuaaaacucuccacugggcggacgggggugggggcucuggcagccggggcagcaagagaaaaaguaugaaccccgaagaggcugcccguggcguccggcuccaaucuaggcaacccucgccaccaacuuaaaguaggcacaaaguccagccaguguagaggaagcugcacgcuaugcccucgguccagucuauaaaccugcaagcggggccugggcgaucuccgggcuuugaggacugcuggugacugagggcuggugagccgaaggcagcuccgagcaguugccgccaaggcugcuggcgcuccccacguggguguugccgcuacccaggcugcuggugcugcugaaacugaagcugcuaccacucgugcugcugcuggcagugaugagggcacccgcggcugaggccuugaugaccgugguuugaugcagggaccucuccguucccucaguccguuccgugucgcugggggccauguccagggacuccgagucacugcucucgcucucggcuucgcccucagaacggcuggggcuccucuccucccguucacccucggcggggacuccgccggaaggcuucucgcccgcuuccuuguccuuguccuucugcgccugcgccuccuuagagugccgccacuucauccuccgguucuggaaccacaccuucaccugugcgcaacagcagaagagaugcuaaagaacaagcucaccagacccggacuuauccccagccccgguaaggcuggacagcaaggcagacgcuugcuaugccuccgcuuugcagacgcagugaccaagcauaaaaauccaggcgcaaucaaggcgugaaacucacccaacccacuagggacaauucuuuaaguguggaccucgaaucucaagccugaaaugacuugagugcaaaauggaagggcagauuuuuacaaacugcuucguaaucucuucaaacucaggacucuuguaaaaaggauuuaaggaguccugacacccaaacugcccauauauuucaacucuauacaccaugccacggguuuggugacucugguucugugaacccucucaucuccacacacuacccgaagcuauuaacuacaaaagccacaccaccaccacuacuaccacuguuaggauuuuagagacagggucucucuagaacccaaggcagccuugaacuugagguccuccugccuuugccucuuagguacucagacuacaguccuuggccaucacuguuauaaggguggaagugggcaaaaggacaggagaaaccaaagaguuaaucccacuagaauggcuuaucugcuggguuuuaaguaaaggagaaucagucuggcuuauuuuuuuaucuuaguugauaaagaucaucuuucuggggaaacaaacuuauuuuccuggggacuccgaaaaugcugggauuaauuaaguaugcaucacggaggaauaggggagagauggagcugagaaucuauauaaauauaugauggggcgggggacccaaugcagucacaggaguuacagcuuccccuuuaaaaauaacaugcacagcugguagagcguggcugggcuuuccaguaugaugaccgggugugcugaggaagcgcauuguguaacagaacagaaagacacagggacagaagucugacaggcagcucugagaaagcagcuugcuuuggcuucagcagggaagcaagagggcccaacaggaugaguaugcugugggcaaaaaaagaaaccaaggagaaacucuaauucuugagagagagagagagagagagagagagagagagagagagagagagagacagagagacagagagagagagagacagagagagagacagagacacagagagagacagagagagagacagagagagacagagagagacagagagagaaugaauccgggacaacagguuuucuaaaucaaaucggcaaaaccuacugaaaaaaaaauggacguucuaagaaaauauuuuuuuccuuucccucaacuccauugccaacagacacuaccuccagagacugagcugucuguuagaaagugggacuguggcugcuccaucccugucuuaaaguaacgcuaagcaauuccguuugaaauuauauuuucaguuccucacaacugggauuucacaauccaguggggguggcaggaaccaacaacaagcuauugacuuugcuuuuuuaucucuucaaaaauaaacugccuccuacagcccuacagcgaagugugcuucggucgagugcauaauuauuaucucccguggccuauuugcuuucuccgggguucuuuggacucuuggccaaaauaaacaggcgugcuuguugacauacaucuccaggaaugggcuguucucugugucccucuccuucaucuccaucccuacccaccucuccccuugcuuugaguugcuacaccacaaacccuggugaaauccaagaccuuguguuuagacugcuggagcugcucaguuccgagaggagaccugcugcccaccuuguuugcucuccguuugccuggagaguuagcuuaccugugcauccgugaggcccagcauggccgccagcugcuuucggucuggcuuggucacguacuucuggaucucaaaccucuucuccaggccuuuucuuugcagguuggaaaagacagcacgggaccacgagcgcuuccgcuuguaugucuguggcaugguguccuuagugagcacagcauagggaccugccaagcagcaggaagagagauucagggccaugaucguguuaaggccacagccuuccagucuucuggucucauagauauuuuaaaguguuuggcuugugcgggaauggccuaaggaagaauuuuacagaucuuuucaggcuaccuugggccuaacgccgcuaagaagagccagcuauuugguaaauucguucaagacaaaugcauaaaccaaacccaaaagcgccagacacgcuaaaacaguuggaauugucccuggagucugaauggccugcccgugauaacccuauguuccccuagauuugucuuucagagaagauauaaccagucaagcaaaacucugugugugugugugugugugugugugugugugugugugugugugugugugugucucacgcuccugcuugugcacaaguguaacccucaccuuugaauacuucauuuucaaaccacccucucugggcgaaaagaauagggacagugacccagacccauauacacacuaucuuagcuccccuagcauggucuucuccaaaugucccacuaaaaagaauauucaguuucucucauaggacuuaggaggcuccuaccccaacuuuccacacuaccgcuggccuuugcggcacuggcugaauuuuucuaccuggaaaugugucuuggaauugaugcugaacagaauuucuuggguuggagcuuaaggggcugaggauggcagacgccucgcuaaugggaucuagagaugcgaagaacugucccgcugaaggcugcaggccagcuagaugcaccccugcaggccgcccaccgguuagcagcgaugugagaucuggguagggggaaagaagagucggucacaaacucauacugugggcagauuuguuccuccuuucccuucucccccuuugaaccuacuaaacucaaaauggacccuuucuccaacagcuacggaagaguggggccugaauugccccagagugugugucaggcauggccgguacaccccauaauaaggaaaggcuugucauaaaauguugcuaaaguggucauuucggacgccuuccagaaauucuacaaaccccuaauuuacacccuucagcccccccccccccccgccuuccuucaggagcuuagacuggccgguuugcuuccccgcaauucuuaagaaauacuggaaaucaaauaaaugcaaaguguccccacgcugagauuuccuugucagaaagaucuaggucguucugcagauauuucauucaaaagauggauaauacacacuuuugcaaaacuuugcagcaaccagaguauggucauccguuucuaugcuguuuaagcaacacgaagauauguuuuuaaacaugggauagcugacuuuuacaugucacuaaguuuuccuucauuucguuuucuucgcccucauucuaccguucuguccuuaaaaauaaacgcaccccaaauccuccugacaucaggccccucaugggugguggugaggccugaggccuuccagcgauacguaccucucagaguguugccuuccuuaacuuuugggucaaauuccgcagacaaaauucgaucgauaccaaauuugaggucuuugcuggagggggcaggggcggagccgcuauggugggggaccacccgcguccccgaagucgguggcugcagggagaccgcccgggguggaggcgggggcugcugcugcgguugcuguugcugcguuggugauugcugcgggagaugcugguggaaggcggcagagagcggagacagccgcugagggaagccagccgggacuucugagggcgccaccaccggggugggacggagcggggaucuggcggcagcuuggaaggaggcgugcgggugcacggagcccaagugugcggugagggcugccgaggcccccaccagucccucugcagcgggccccggcuccccgacgccggcgugcaggauguccgcgaugcagaaagaggguuucuugacagcggcuggguccagggcgaaggagcagccgcccgggcccgccgaggagcaguaggcggcugaccagagacuaaaguuggaagcauagaagggagccaggccggcugcgaacauccuggcaggaucccggcgggguccugggugaguggggaagugggugggcgcucgggcagaggcggugucccagccgagcccgagcugcuuucgguucuucgcccgcccugaagcggagggccaaccggggagcccuagcgccaccgagggacgaggcgagggcccgaucgccgcccgccacggccugggccccuggcuuggcuugaaaggcggcgcggcgggcgcgcuccccgccggguggauggaggcgaucgccaggcgcuggggcgacaaggcgagcgcggccucgcucugcuacuccgcagaagccggggagacagggacccgacaccgaaagaaaaacccaaacagcuaagcccuaagagcuaaauuuaaaacaacaauaaugauccguuaguuuaaaaaaaaaaaaaaaaaaaaaaaaggaaaaaaauuaaaaaaaaaaaaaaaacuccucucuaaaaacucccaaaguuuug

SEQ ID NO: 577 - RNA, 11295 nt, Mus musculus
caguacagcugaacuugccuacccugagcaaugguuucugcugcaggguucuccggaaagccuuuuacgucugcccccguaauccuggaccccaccgcaugggugugcugcgaccucugguucccggagcgcacagggccggggcgguccgcaggggcaggagccgggcggagcguggagcaaagguugccucauagccugggcccuucuccagagcucggcggcaucaugacggugggcgcccggcuccgaagcaaggcggcgagcagcuuagugggccgaaggccccuggggcgaucgcgccgcgccggugacgaggagacagaugccaucguggagcaccuggagggcgaggacgaggacccggcgagcccggacugugagcgcgaagagggcgggcggcgcgcggggacuccgagcgcacgcagggugcaccuggcugcgcugccugagcgcuacgacucccuggaggagcccgcgccaggcgacaagcccaagaagagguaccggcgaaaacugaagaaguacggcaagguagguccccacggcccggccgcccugauccagacagaaccgggagucgcgcuggguggaguugugcccgcauccccgcuggccuccgggaccaucacuaggaggguguguagcugagcgcgcgggcaggacccuugcucccaguuggagcugaugguaaugcugaagccauggugagguuaguugacuugagccccggacccagcugcgaaguugcagucuagguccaccuauuucccgcacucucucuggggcaccccgccacaggagaauauuaggugauucaguccuagaccccgggguuaacccgcgcggggccugcuaacucagccaguacauaccuagaaccuguuaccccucccccuucucugaucaacaaucucugcaccccgggacuucagauguucuucggccugccuuuuuacuuuggugggagagccaaaggaaggauggauggggaaccgaaugaguuucguuuucagggcacaugauuaugguuucuaggugcucugaccuagacagggcuagggagggaguuggaguggaggggaaucacaaaacucauugcuuguguuuguucugaccaaaguccucugaacucucggaauuauuguccagguagucuucagugggugaccuucaucauacccgagacauucggucccuugccaggaguuuaguuuaucauucugaaugauaugaccggagcuuccucacaagcaggcaaugauaacaugcguuguugaagugaaguagggcuuuugggaguaaggaagccaucugaaagugaauagaggacacagguuucuuaguugguagcuggcauuuagagauguuuugggggugaccacucugugccaggcauugugcauacacuagagguacaaauagugggaggggagauagccacccccacccccagggagagguggcagagcuggggcacccuggucccucacuucuuagcaguguauuagcgauuacuuaucugggcgaggcaaauuaagacagcgacgcuuucaaaucgcccugacauggacacugggcaggaaagaagccaaggcuucaauaugaaguaaaagcuaggaaacccacagcuguaaucccagauacucuggaggaagggacaggaugguugauaauacaaggccagccugggcuguaugacaagauccuauuaacaagagcucauccuggcugaaacugagguacuagacuccgcucguuaggauggcuauucuaagacuaagucagucggucagugguggcgcacaccuuaaaucccaucacuggggaggcauaagcagucugaucaucucugacagcaaguuccgggacagccagggcuacacacagaaacccugucuauaaacaaacaaacaaaugaaauagaaggcugggcuggggcucagugguugggugcuggccuagcaugccugaaguccugguuggaacucuugagguauauaaacaaggaauagugguacacaccugcaaucccagaacuuugggagaggaggcaagaaaaucagagcccaagaucuggcucuguggguaaggcugcucacggccaaaccgaaucaccugaguucaauccccagaaccuuccaaaacugacuccaacaaacugcacuugaccaugugcaccugguagcacaugugcacacauaugcaugcacacuaaaugcauuaaauaaauguaacuuggaaucuuuggaaaaauaacuggguggugguggugcacgccuuuaaucccagcacucagacagaggcagguggaucucugaguuugaggccagccuggucuacaaagugaguuccaggagagccagggccacacagagaaccccucucccaaaaauacaaaacaaagcaaaauuuguaaaaauaguucaaaguaauuuuugguuacccuagagaguuucugggcuacagauacacaagacccucgcuuuaaaacaaaaauugaaaacagcuacccaagcaaauauucuuauauuuuaguguuucacguguauggguguuuugcccucauaaaucuuugugaaguaaauaguuuuacacacguuugcagaaguaucaccaauggccaaaagaugaaaauguuccaaguaucuaugagcagaugaaccaacaaugugggugagacacaccacggacguucaauagccacaguaagaagcuaucguguugguugcugccacaucgugcuucaacaugguauuaggaaagccagacccaggguuauauacgguuuccaugauucccuuuacaugaacuacauuuuucuacaaaaaucuagacaggacguagcugggugauuuuuagggacucggcagaggcagagagaggucuccugggucugugguuuccuucugggauaagaaugucugggaacucgauauagaaccuuacaacgucuggggaccaccacuguuucacuuuauaaaaucauuuauuuaaauauguauaugugcguuggccuacauguaugucugugccacuugucuuaauguccacagagaccgggagagggcauugcuucccuuggaacuggaauuccauauggucugagccaccaugugggugcugagaacucauucagguccucuauaaagaguagucaaagcucuuaacugcugagccaucucuccagcaaacugguugauuuuagguuauaugaaugugugugugugaauguguguguguguuagagagagagagagagagagacagagacagagauuuuugacauggaaaggguuuuuuuguucuguuuuguuuuuuuggcuaggauggagagaagggagcuaugggaagguucuggaaucuuaugcacuagcucaguagacccaagaagucuagaugagauuacagccccaagugaggagucaaaggggucgucuuggccuguacuuucucaggccagcugagaggguacccggcuucaacaagaagaaagacaaccauggaaccccuuucccugcaaagccaugagaacagccaaggcuccugcggaagaugggaggugaccugcacccucucaguugccaggcaagguuuucuuuuaaaaaugaacagcuccaguuauuggcuauuauggaaugugauuuuaguuccauuccuguuaacuucucagacccuucacacgagcccuuuccugcuucuauuuaaggaaaguugcuggcuuuugugcaacaugaaagagcaggcucucuccccugcugccccacccacccaccagccugguccuacccaggggccaggccucgcugcucuggucuggcuuucuggaagucuuugugcuuaggccucuuguagagaccaauguucccaguugauuguaacggaauaauugcauuccuacggugcacauauugcuguuuaagugcugucugcggggcacuggggaaaggaggggcuccuccugaggcuggauagcuguuaccuucuuuauguuucaugccucagcccccgcagcaaucuugggaggcugcgguugugcccucucugcagugaaggagacuggaguugaagggauugaggcuacacagucagacagccgaagagcugggaaggagggggaggaaggcuggccugacugaccccccuccucugcagagcugugggugagaaagaauggaacauaccucagaacuuagcugaaagucauagcccgcccuugcaggcacccuugagaggcacgggagaaguguggugagagaaagaacuaagucguguuaaucaguaagcuaagagacaagguugaggguaaaacagaaagugugggauuaguuauguaggagggucaggaaggaguucagggucaaccugggcuacacagugaguaagacccuaaaaaaacccaacccaacccaacccaacccaaaccaaaccaacccaaaccaaaccaaaccaacccgugagcacugaggauggagcuagcuaguauaacacuugcuuagcauguaccaagaucuagguuugaccaggccacaaaaagggggugggaggaguaggagaaauguccucuuuaaaguaggggccaaaagcuggucuaccagauguucaagcugccuguguccaacggccugugacucugagcauggcuuccucaaacugucucacucugaugcuaacgagggcaucgacugagcauugugggcacacaccuuuaaucccaggaggcagaggcagguagaucucugaguucaaggccagcaagggcuacacagggagacccugucuuggcagggguucgggaggauaaaaacuaaccaaucaaccaaacaacaacaacaagaaaagaggcugguuugggggaagugcuuaccaagugagcaugagaacccaggcuuuagccaccaggacccaguaaaagacacagacauauaauuccagugcuguggagaugaagaggaaagcgaccggguaggagaaucugugaacucauauauagagggagauccugucucuaauaaaucaauaagauggagaguaacuuaggaagacaauggacauugauccugcccccaacacacaccacaccuuaccuuaccaacacccauagcaggcaguauccacagccaauaaauuaagccauguggaaguucuagguaccagggcaccuggcugagguccuggaacuauggcccuuugagggguaggcucucauccacucagaucuauagcugaccaccugccucagguuggcaccagacccgagagcagcccaacagaaggacugaccucugugaagagaugguuucuucuaaaucagagggacaaggaguccccagcaccauugggaacuggcugccaugucuucuacagucaucaaggcuguuccuucauggcucuuugcagauccagagaccaucuuccuuccuuucaaagccaguagugccccaccaccaucaccccucaccccuagucuuuuccuccuucccucucuuccuuccaucuucugccugacucccccugcaucccucugauuaggguacuuaccagguagagccacuuuuugcugaguauucaggaggccccagggauccucccaucucaagaaccuuagcugacucauacugccaaaguccuucuuaccauuccaggaaaauauagucacaggcucugaaaguaaggugugaaucuggugggcuagccuggcaccaagucuguucccuugaauagcacuggugugauaguuaagucucuucucaaagcuguguguugacagagaugcaguuagagcuaucuagcagccccccccucccccgacuguaaaggacaguguuggcugagaugauuucccagggacguggcauuuguuguuucaaacaugugaaauucucccacugacucuuuucaacaccucucucucugaaagaguaaaacaaauugaacucuacuuuuguguuuuaauaauaacuacauuauucauaaaacucuuucuuccuccuccucuuugagaaauggaaaaaaaauaguguugagaagacauagaugcaccaguuucuuccaaaacuugccaugaccuagaaaggaacucagggaaagacucucuacaggcugggcguaucuacagguaugggacucugccauccaugcuguggaaaacucaggacaaaacugauaaacaagucuguaugcccuuuagaaacuuuccuagccagacguuguggcccucaucuacaauccuagcacugagugagcugaggcagggggaucgauaggaguugaaagccagccuggguuacaugguauguuccaugccagcucagccacugggugagcucgauccuuucacaaaaauaauaaauaaaugaauaaauagauaaauguaaaagggaaaugaaagugugcugagaaauaaguaugucagacugcuauauugccaccacaaaccuaaguugcucuguagcaaagagaaguccuuguucucuggaaaggcugggcacuagccugccugcugcaugugcacugcucucaguccuccccuugaaaaaaauugucccaaaaggauaaaaaagaaagaaaggaagggagggagggaggaaggaaggaaggaaggaaggaaggaaggaaggaaggaaggaaggaaggaaggaaggaacuucuugacccucuuuaccacaugaaaaggcuacuauguauucccauuuuacagacaaggaaacugaggccaaggagcauugaggaagggaugggauuggaaaucacuccuggcugugagcacauagucacuuauagacuuccuucauuagacagaaaaguguaacauggggugaaggccuugggcucugaagccaaauuuaucugggggaggauucagcucugugccauacuggccauaugagcucaaagaucuguaacuucccaguucuucuucgucuuuuuguuuuuguuuuuguuuuuguuuuuguuuuuguuuguuuguuuguuugguugguuuuugguuuuucaagacaggguuucucuguguagcccuggcuguccuggaacucacucuguagaccaggcuggccucgaacucagaaaucugccugccucugccucccaaguguugggaguucccagugcuucuuguugaucccuuuacgauguagcaguuaccugaguuagaccagcuugcuucagugcccgaggaauugugggguaucaaaacauggacacccugaacagagagcugaaugcaugaaucugagcagaagagcuacuagcaccuaagaugauacauucuaagucucggguguucuaggcagagagcagaagcggguccaggauugaggaacaaaaaccucagugauucagacucugcaagauaaaaucaucggagagcggagagaguuuaggaggagcaccccgagagguaggagagaacggggagaagcugggguuaagugaucacagacugagccccugagagccuugggaggggaaagacaucccucugugaaucgggcaacauggagguuguaggcaugcauccuugaccaggcagucccuggaugggcgugggagcagccgguaugccagggaagaaguguggauugcagucagugucugguggcuuuuucacucagagagcagagacacugggcaggaaauaguaucaaggugaccccuggggugguacaggcuaagagaugggcugacagagaggaggagaaggaugcuacuggagaagagaaagugaggaaugauggagaagagccaagcacaaguguggggaagaccagagaaaacgggcugauuccgaaccaugguuaaacuuuagggggagggaugcggggguggggguugccgggagccagagcacugggcuuggaggcaaugggcgaagaugaacacauuuuccaaggauauguaauucaggcaauaaagacccuggacucugagguuggggguguauccaaaagagagaucaggccgccugggcacgcgggcuggcuucaccagguagcacugguuaucgcggugccucuuguaauugggaucagggaucuucaguggaaccaggcuguguguucuguauucagaaaaaucacaggguugaaagcuuagaggugugagagaagguucugguuggcuacauggaugucaaagucacuaagaaugacaacagaguuuggaggugggaagaggacuacuggggaccacagcgcaguagaugcuggccaucaguggucucaaaguuuugaugugauuucauuugauucccuggaaauguccccucucccggcagcacccuuaccacggaggaacagaagacagaaaauguugccugguccuuacccucaacaaaugucagauuguucaggaaacauaaaaaggcuuccggguuacaaaaguguggguuagaccagaguagggacaugguacauaggaagggccagcugggcugucugacagcaugccugaaggaaaauucgacccgccucuggcccuggcuguggggcuagucuuaguuuaaaacaacaaaggcauuuuaguucuggagcuggcagccuccauucuguuauuaaggaggcucgcaaauuaucuggaaauguacuguguuuccacacgcugugcaaggaggaugccuguugagcaggggucgggaccuggggcgcuacagaugugaagacacugggucucgauagauugcuggauacacgagggcacacgauucucugugugcgucacgaugacccguggaagaaucaacaccuaacuuuugccucaccuaacuuuuguuuuucucuuccugaaaauagaauuuugggaaggccaucagcaaaggaugccgguacauugucauuggccugcaaggauuugccgcagcguacuccgccccauuuggaguggccaccagcgugguguccuuugugcgcuaaccagagccgcaggggcaggugacaccagaaugcuucugcccaggggacagugugaauccaccggcacuucagacucagacucgugggaagucagaagaggaacccugcuucgugugcuauuguugaacugguugacugugaggcacgagccguccccgcucauucgcugagccagucauggacuuggguggauccaggagucaguucugcagagaauugggccaaggucagguugggguuaggauuaguuugcuuccugugcuaguuagaggcuuucggggauacacgcaggcaggcccauggcaggucuggggucugagccaugcagauagugggugaauuugccggaggaggacacagaccucugaugugaagguugcuaguuucugaaaagguuggggagcugacggcacuagccuugaccuuccuugauucuuucacugaauacagcgagagagcuguuuguuucagaagucuaucucccccaucucuuuucuccacucggacugucaucugggaguuuaauuacggguuugggaagaaagaaggaaggaaaccaucuuuaaagacuaugaugcuuuguaacguguacucacagcuguguggggacaauugaaagaagaucaaaguguaucauuuucacccaccuacauaagcaugcagcuggcaaggagggagggagggagggagggagggagggagggagggagggagggagggagggaggaagggagggagggaggucagggccagaagcaggcugggaggcugcaacaggugcuauuggaaggucugggccagcuauugugaucugagcugucaggacuccugcagauguggcaagccacaccaguucacugcaacaggugcccaagucccccauuugauugaggagagggagaggggaagggagagacagagacagacagagagacagacagagacagagacagacagacucugaaugggaacugacauguauauuuagaggaggaaaugguaaguaagagacaggcaugaagaaaggccaagaacaacauuggaaaagugauggaguuugggaccuagguuugcgauggggauuuucuugggagggcugggcugguuguguauaggacuagaggaagcugggaggaccagagucaccauggugguuggguucaucccucuuaggccuacaucucacuuggauucaaagacuaguguaagcaagagucccaggcuuggcacacaccgagcaucauuuguagacaaccacggaaugcugggagaaguggagaagaaacccuuaaaaguugaacuggcaugggucacaauuguuuuuaaaguaccucacagaggccaagauuccaacuuugcuucucgaauauuccagauccagagaagguguugggaccacucugcaggauccgggucagcccguuggccugaggcuuccugggggcacacaaagaaagccauggucuucauaccucacccacugaguccaaccauuaggcacugguggguggguaggguaggaagauggacagagagacaggcacagaagacagugguaguugcccauuuagacccagcccugcugaauaugcccaggcccuagagcugggaaauagucuugcuuuagccccaguagcacuagcugcuaugugcauggauucacacucgugacagagugaugcuugcuggauaggccuaggaugggaaaggagagguuaauaggagaaagggcagcaugcaguuaguuggaaagagacagaaaugggaggcuuugcaggaugccuccccuuccaaccacagcugagcccccaggagccaacaagggagaagugugagaagggagagccggguagggagaagugugagaagggagagccagguagggagaaguguggcccaaggaagggaugggauugggagucaauguugcuuccuccccugggagucucucccuccccaccucccaaauugugaaagcaacaaagcaaagcacaucuggccaggugucucucaaagucuggcuaagaauuaacucaaagcguccaaagucaaaagcucucagggguuuuccugggacucggugggguuugcugcaagguggacuucagccccuggagcaugcuguguggucacaucgucgccugugugggacuuuugguucugagagccugguucuuccagccugcaaacuugguuccugcugcagacugcucuucuucgcuuuuccugguuauucucuuguguccagcagcagggcccacaccccacugcaaccgaguuuaagagcuuagcucucccacuacuggcuuccaaccccuuccucuguaucccucccuugccuuugcuguaaauaaaaguuccagcuugucugguuuuccugugu

SEQ ID NO: 578 - RNA, 7559 nt, Mus musculus
uuucuuuagcacagugaguuucuuagggaacugcaggcucgggugcgggggugcagggugaggggugcggggugcagagugaggggugccgggugcagggcacaguucccuucggaugguuuccucuugaguagcguggagagcgaagaaaauccauaacugaccgaccccuucagaaggggaaaugcuaucaagaguuuuuccuuuuaugcuuuuuuucaguuguuuucuucuucuaaagugcagcggugagugauaugacgcucuccuguugcagggcaguauugguguucuagccaagucuagagagaauagcaaccagauuugcucagagggaccaacuucaaauuugcaucugaaagugcccaaggcaaacagcggaggcagcguuuacgcccggagagaggccuugaaugcauccuugagggcggucugucugaggucucugccuuccugcaagagaauucuggauuuagaacuaacucucaccccuuccagaguauccccaucauagaugaaauauccuauucauuugggaaucacaauacauuuuucauuuccguaaucucuccauuuacuuugucuuuacuuuuguccuccuuccugcuggaucuuucugucagucuccugagaggggauguagucuccuauuccuuuauuccaucguucgaaaacucgugaggggcucacucaguccaugaaguaaguacuacagauugcaucugggcccugggaauccgaacgacguuucccucccagauacccucauucugugaguucucugaauuauucgucucggggaacucuuucuuauggggugggaguggagguggggcugagcaaagaauagaauggaauccuacuuccuucucgggaaaggaaaaagguugaaauuguaaaguuucccaggcuucucaugggacuucaaggaagaccaaauugcauaaucucacaaaaaugcgagcagcagcccccgccucugucagcccugauaauauacagucgggggauuagagagacucaaaaacacuugugcugcuuccugaccugaguacaauuaaagaucuuccuugcaaggcuuaagagccucaagcccggagaacugcagacaagggaacugcgucuuccccacagcgggauccuccugccucagagcuuagguuuguaagagcuaucggggaacuuggaggcuccugcacugcaaacucagcaagcucacacuacaaaccauacccauggcgccaacagagacugcccugaauggcaaaggcagcuucuaagccauugcuaggcaauagauuuccuuguacuuagaccuaaggcuaauuuuuugauagucaauucuuugcauuuguuugugcuuuaaaaaaccauauugaucaguugcugguggucaauaaggccagacuaagaguaaaacugucagccuugggauucucagccacugcucccaagcccuuggcucuacuguuccaguggagacccagccugaccaauaugaaggauggagccuggccuggccgcccaggaaggaagggucugugggagcagggcacuauuaaauugagugauuaugggagccacacacgggacauacaaagauaaaugagauaauccuugaccuugagacugucacggcucagugccagguguaguggcaugucuucaauccaagcacucuggagacacaggcaguguaucaacucacagcauugugaccaaaaccauagcagaaacagcuuaaggacggcaagacugcuucugguucauaguuuaaccagucucagcccaucgucauggggaaaugguucugucugcaauggcaggaacauguuaagggaucuaccuauucaggucauguauaccaggaaagagacagugcaggggcuaggaccaggggcagauauaaccuucaaagacccacuguuguguuagaagcccugcuccagacagaccaugccuggccaaacaguuccacaugaaguuuaucauaggagagaagggcaaagguggcagugaaaagagaaggaggucggggagagggggagagaaagagagagagacagacagacagagagagagaaagacagagagagagagaucagaggggucuuccuuuuauuuaguuagugacauagcggcagguaaaggugggaggugagccaaguggauucugggaacauggugguuauugccuuggcaacaggugugcugguggcugucaccuaggugugaugucacuggguucagagcugauccugauaccaacacccaccucuaguagcaucuuuccuccugccaggaagauuccacacucuaagguucuccaucuucaaggcucuauagccuuucaguauucaaaaccugagucuguuggggacauuucagguucaaacacagaaggaagggacgcaaagaccccauagugaguucaaggcugguaugaacuaacagcaagaccuugucccucuuucucaagaaagucaucauccagauaaucauaguugguaucaaaaggccagaucuguuccaaagucaggaaugucacacauaggugacgccuguugccaugacaaccacauaccuccccagaauccacuucccacacuuuaccugggaacagguuacaucagagccuaaagacagaucuuuccccacuuuccccccuuugucuuucucucuuuccccucuuuguccccaguaaaccucuucuacuuggaacugcuuuggccugggugugguauauccagacucgagaugcuauuucuaacacaucaaucgcugcuuaggacuuugagcaguuuagcugucuacacaaguuaaagcucccuggaccaucucauucaucacccaagcucaaaaaagcaugaccuguccgcaaauggcaucccaucucuguaucacuaggauguuuuucugcacuuacaccacaggugcaggaggcagcagacaccuagacagaugucuugcccuauaucagagggaguguauauuuguauacugaugugcuaucagaaacaagcagcaaaaagcaggugggcaguuguaacucaccagggaagcgucugcuaccaccgucaaggucuuaguuuccuucccuagcuucccaaacaaagaaaacccauccuaauuaguggcuaugcuguacuggugagaaacuagccaaaacccucagcaacaaagcaaaaccaaugcaaaaucuauuccugcaggauaacaaaagccccaaaauuaaugcagagagguaaaugagucagcauugaugacucauggucacuggugagauuuuaaaaccugaguuaaagucuuaccuuuuccccuuugagucuaagccacaacugaaccuauaugagcagcaaggaguacagacuagcucuugagaacacacacuguacccagggggggcuauuguuaucaggguugaucaaagaacaaaaagaagagcuuaaagcccggcccacuccaaagauccuggcagggaugcugaguauccugugucuuuaggacacuuagcucagacaauccuauuuuggacaguguuugaguucugggcugcuauguccacucaaaaugcaaguucucagaauagaguuucugagcggccugucuaggaggugugcucuaccugugcaccgugauuggacagagcugagguaaaagcccuggugacuuacagacuaggagaaaguuggucuuccaaggaaggaaagcagagccaacaaaagcaaaccacaucuacuacauuauccuucaguuaccucaccaggaaaauggacauaaaaauacaggucugguaggaucguuuggaaggguaacugagcaaggugaugauugucaaagugcauacugcaaggcccagcccuuuguaaguguuaauggcagccauugcuaagaguuguaugggauaugugucaucugacaccuuuaaaauaucagacucuuaaucuuauguaggcacggauuuaagugugaagcucuccuuguaagaccuauuugcuuaaauauugauuuaaguauugauaguggaauaaauaaacauuuggauggagaugugacuaauugcuuuaacaagaaacuuguuacaucuauuuuuaaauucuuuguguauucuuugcguauuagauccugucucauuguucuuuauauucuucacaugcucuguguguguguguguguguguguguguguguguguguguguguguguguguguaugugugugugcaggcgugcaugcacacauguucaagaacguauggaagccggaggacaaggacaaccuacuguagcauucauucuucgggaacugcccuugacgcucaccaaguagaucaggcuggccagccacucuccggguucuucuucuuuccacuuccccagggcuuggauuacaaggauauguuggcagaacuggcuuuuucuucuugugugggucucagauacccacgaggcaaacagagagcuugguuccccgggacccuauuugguuuugauuauucacaucuucuucuucuaaugauaccuuuggcaacuuaguucuuuugcuugcaugugcuaugcgcacacgguguuccuguccaaucauugcaccuugaagccccagacuucccuagaaccugcuucaggauacauauacucuuaucucagaauaguaauauaggggcuggcaagauggcuuagcggguaagagcacugacugcucuuccgaaggucccgaguucaaaucccaggaaccacaugguggcucacaaccacccuuaaugagaucugacgcccucuucuggugugucugaagacagcuacaguuuauaguaauaaauaaauucuugggccugagugagcaggguugaccagagcuagcagaguuccuaaaaauucaauucccaacaaccacaugaaggcucacaaccaucuguacagcuauguuauacucacauacauuaaaucaaucaaucaaucaaucuuuuuaaaaaagaauaguaauauagauuauccauccuuaauaacaaucacacucagugucuauucaguguauucucaguguagcuagguaugaagaguagaaggguccaucuagccuaaacugguuuugggugcguguaggauaaacucgauccuuaaagugaacuucuggagaucuccuguauuuaaccauaucuguuaccaucuaugcauaguugggcaugcaguugauuaagaucaaaugcacuaugagagggucauguguaauaggaaggauaaauaccugaccugagauaucaaccgagauugagaaccacuugaguaauaacccuuggcacuagccucuacuuccuucagacccaagugguaaccuggggccuuuggguuaucuuuauucagcuuccugcuaucaaucuugaguguaucccucuauaauccuauugcuucgcaccccaugaaguuucuuuuucuucuucuauaaaucuauaaaccauuauuuuugacuccuuagauaaaaggcagaaaaccuggaaauaucuggcccaucagugagccacagggacacuggugcaaguauucacucucugaaccgccuccccaguuccuuccucuccauaggcguaugugccuuguuuucaaauaaagcuucacaaaacauauuagaaacuagaaacacgaccucucacaagucgcccccucuucaguugcucuucccauagucucuggauucuucucgugggcucuccgguuagggagagaggccauccugccuuugaggauaagcuacucaaaagaagccucagcgagcuuccuaacauccaggcaaugcugccgagucaaagccacagagagaaguucacucuucaugcugauuaaaugcauauuugugucucguguuuauguagccucaaacuuggcauuagcuuguuccuggauugauuaaauagucuccaguuauacaacuauucuuacgagaaaaauuggggagucuugccggaguuaccucauguuacuuaggaaaugggggccccuuuugggguucuuggucucaucaguaaaagaauuuaagaagaggcuuguaaagaaacuccaagacuguuuuuuuuuuuaaaaaaaagacuauuuauuuuauguauaugaguacacuguaguuguacagauaguagugagccaucaugugguugcugggaauugaacucaggaccucuccuugcucuggcccugcucgcucugucuccaagguuuauuuauuauuauauguaaguaaauuguagcugucuuuagacacaccagaagagaguguuagaucucauuacagaugguugugagucaccaugugguugcugggauuugaacucaggacuuuggaagaccagucagugcucuuaacugcugagccaucucuccagccccuccaagacaaguuuuuauuuuauuuuauuuauuuauuuauuuuuuuauuuuuuagcauuuaaaaguaaaaccccaacgcagacaagcuguaaauccugguggcugcuuggaggaggaagacggagauaaggaagaguaaaggccuggugguuuuuguaaagccaccaggaggaaggucagacacaugguagacaggcagccacaugacggagagagcuuuucugagucauuuagagaaguggacuggacuuagaaagcugcauugcugaagccucagguggcugcucuagagaagggaaacucugguaagaaaaagaacauuaucucacaaaagggcucgcuauuccuccugucuguguggcauggcuuaagguggcucugccuuccagaggcauuccugaagcaggguggacccucggccuaggcucaccuggaauguuaggucuccauaccagcuagagauuccacuugaauagaagaugauaguuuuuccuauaugguacugcugcagcacuauaaccaucuaaacaucccgugcauccuugcacacucaugcaggcaaagguggugugccugagucaggugugugaacacacagugggaugcucagggcaccaucucuguugaggcagaauuuuuaucucccuggaagggugcuaguuagucagugacccaggaaacuaagugcccccaccaucaaguaccuucaggcaguugagggacgaguuaaguucaagaugaccagaaacucuucagaugagguuggucccgaccaaccugcuccagaugcuaaguaagcagauggcucuugugugcaaauugggguggugccuccacacacgugggugagauuccugcugaucaagcaaaaugggaauguggccugauaagguggguggguaacuaaagcaacgggcucuucuuugucugguuuaacugaguacuucggaaaggucuggaaaagucaacuucagcaaagcaguucuuugaucuucgaggcuucuccccgcuaagucuagcacgguccccccucccccagucucccgcuaagucuagcacgguccccccuaccccagucucccguugccuugaacagucugccgccccucccuacuuuacccacugacugaguccuucaaaaacgaccaacaguaucccacacggaggacauccggggagaggcca

SEQ ID NO: 579 - RNA, 45558 nt, Mus musculus
cgccccggagcgcgugcgcaguuccucgccgccgagcucuucaagggucucuaccuuuagguaccgggcggcugccgugggccgugugcggagggcuccgcccggcucguccaccaugcacugggggcugugcccucgcgggcccggggcggcggcggucgccgcggcugggagcuucugggggccagcccguuugcccagccgccuagggugucuggggaugacgaggaggcucgugguacgauccguggccggggcggacagcccccagagcagcucgaaaggcggcagauaccgugacacggugcugcugccgcagaccagcuucccgaugaagcugcugggccgccagcaguccgacauggagcuggagauccagcagguaccggacgcggccacccgagcagggcggggcgggccagcucugcgggaacccugcaggccgcgcggcuuccccggcgagcgcccagcgggccggguuccaaagugaagcccggagccgcaccgagcaccuuccgauuuccgcucccagcgagucggcuuugcacacuuuucccuuugucacuugucagaaaguagccagcgugagcauguguaaaugaaacuucaggagugggcuggagagguagcucggcgccuaagagcgcuugccacccuugcggaggauccgcguuccguuuccagcacacaagucuggcaguucacaaccaccuguaacuccaacuccagaagauccgaugccugaccucugucugcaggcacccgcgcucgcgugcaccacacacgaauaaucaaagagaaacuuaaaacuaaacuuaaaacauuauaaaaguauuaccaaagaagggagguugaaccccaccuuagucacauguuuagguuuuucacaggaaucaugauuucuuugaaggacaaaguagcggcccuuuucuggguccccugugucgucgguaucugucuccuaugucauacugaauuugcuaacgucugagauucauucguuagugucugcacacuagaguauuuaagauauuucugauaaucaggaauacugcuuaagugaauagcguuagccugaauauucuuuggauuuagggaauuauugaggccaaagaauugaaagaauaaauuaccaguguguuuuggguggcagaguggacugggaauagacagguuuuucagcaggucuguauugagguagugaauacugagagacuugcuaagaauuuagagccaccaugccacauaaacguuuacacuuuagucugaagaauuguugggauuuuugaagacuacugaagggcuggagagauggcucagugguuaagagcacugauugcucuuccagagguccugaguucaaaucccagcaaccacgugguggcucacaaccaucuguaaugggaucugaugcccucuucuggugugucugaagacagcuacaguguacuuauauaaauaaaauaaagaaaaucuuaagaauaaauaaauaaagacuacugaaaguguuaagagaauucuaguuuauuccaaaaaguuuuccagguucuauuucugggcugaauggauuggaaugggauaaaugaugaccagguauugauaagggucuauguauuuaugugauaucuaaacauuggcuuuuuuuuuuuuuuuuuaacagaaauguggcuuuucagagcuuuauuccuggcaaagagaaagaaaaguaaagacggaauuuugccuucaugacgggccuccuuaugccaacggugacccucauguugggcaugcccugaacaagguaauuagaauugaaguguagagcuuggaaguaaguacucugcuaaagaguuuauauugucuguguaugguaauuauauaaacuaguauuggccugugcaaauacaugaauuauuagugaguuuauguauuuauuaugguguuugggagucaaacccagggccuuguuugugcuagguaaguauucuucuagugaacugcauuccagauacaccuugugugugugguaaggaacccgggauguaccaugugggagacuagcccugcuccugcaucuccucucuguaucugcagcucucacuagacacauuaguaaccaugcagcucucacuagacacauuaguaaccaugcagcucucacuagacacauuaguaaccacauuugaugcugcauggacacuagcauugcuggaguuuccugccagccuuuuguuacucuacacuuaaguuccaucuuacuugauacuugcuguuuaugugucaagcaucugucuguauuccagguagugaacaacaaagucauauuccucccuugcucucuaccuggaaaggugagcagguaaaacauguaacacacuagauagugaugauagcuguggaggagacaggacggggaagaagagacagcaggagacucagugucaagccuuucuaacagaggcuuaguuuacuuuaugugcacgggugcuuuguguguguguguguguacaucugugcaccacugccaugcuuagugccuguagaggccagaagaaagcuugcagaugcccuguaacuggaguuaaacacgguugugagccuccguaggugcccagcuucucugggagagcagucagugcugcuaaccacugagacaucucuccagcccccuguaacaguuuuauauagguauauaugcuuaugugauuguauguacaacaacacacacacacagaggcuuuguuuuccccuuauccuuauuggaauugaacaaaggggcugugugcaugcuggaaaagugcucuauugcugagccacgugccgaguccucuuuauuuuuuauguuuuauuuuuuuuauuuuuuuguuuuaaaacaaggucucaguugucuaggcuggccuugaugccacuguaguucaggcaggccuugaaguugggauccuucuacuuuagccugugucuguguagacguaugguugauuauagucucguuuucuugggccuggcugauaguacauuuuuaagucuuucugccugcuccuuucuaaagcggugugagcagggugacucagguauugaugugccugcugcugaagccuguugcugaccuagggccuucucaguacaaaacagugaggaugagguugcacccaccaugugcaguguuguucuguaggggucugcacugcucagcaggccugagcagcucauguugcuuuauuuaugguaauuuuccauaagcauaauacuaauuucuaagugacauauuucuugucuagaauuuagaaagugagaaguguuucucugaaagguagaauggaagcuggcuugguggcacaugccuuuaaucccagcacucaagaggcagcacugguggcaggaggaucucugaguuugaggccagcguggucuauaaagugaguuccagacaaccgaggcuguuacacagaaaaaaccaacaaccaaaaaaaguagagugggcugaaacuuucuccaaacuugacaaauaaugaacuuuggggcauaaagguuuucauauauaauucucuuguuugauuuuuucccccuugauagcauuaauauuuugaaauucaaauauuugucauucuugugugaaugcugcaccuuaauuaguagauuuaaugguuuauuuuacggaaauacuuuaaagucgagcuuugugcuuuaaaauaguauuucuagaaagagugagauuauuagcuguguguuuucugcuggugacugcacuuucccugcagauuuugaaagacauugccaaucgauuccauaugaugagagguuccaagguacacuuugugccuggcugggauugccauggcuugcccauugaaacaaaaguguuaucagagcucgguguagaugcccagagucuuucagccauggagaucagggagaaagguaagcucuuuccguuuuucacuuuaaaccuuccugucaaaccaggcucugccagagggacuuuguguucucagugagaccuguuggaugauacuuguuuaucccagguuggccucacaguccucacauccuccugccucagccuucucaguggcaucacuggcauggcccuccauauaaucccggacuuuuacaaagugacuuucaugagacuugguauguggagguuggcgggacaguguugggaaugucccagcugggccaguuuugcaucuuauugucacugaguugcuguuucuaaccucuucagguggagcucacugccuaaaagcagguauagaacuagaagucaguuccaaacuacaccuaucucaaaucugggugugguggugcuugccugagaacugagagugaggagccuggguuguaguccgagacugucucuaagugaagcccacagaucucuggcagucccugccuugaucaggagccugcgccaucagauacgucagauacgugaaggugguucuccuucugaagcauauucacacacucccuuagauuuguaucugaggaccagcgggaguuugcagugcugaguauuagucucuggccauuucuugaaugaauaacuaaugaggaggacuagugagaucgcucagcggagggaggggggcacgagucaugccugagccccugagauugauccccguggugagggagagaacccaaccaggaaggagaaaguuguccucugacuucccuacaugcacugcaugacaugcauaucacaggcaugcacacacacaggugugagcacacacacacacuacauuauuacuacuaucaauauaaggaaugaugugggauauuuuccaguguauuuauuuauuuauuuuaaauaugagaugcauagucuggaagauacuaaagacaguauaugauucagauuuuuguuguuuuuuguuuuguuuuauuuuuguuuuuuaagacaggguuucuuucucuguguggccuuggcuguccuaaaacucacuuuguagagugaauuugaacucagagaucugccugccucucucuugaguguugggauuaaaugcauguaccaccauugcccaucgaaauuucaguuaauuaaaaacaaacaaacaaacaaacaaaaaccccaaaaaacccaaaacuuguucuguauuucaaaugcuuuccaauaaugucccuguuaagaauuuuucauaggacugggaagguagcucaguaggaagagcagcugccuggcugcccgaggaccugguuggugcccagcacuacccguucugagagugauggcucucuccugggcucccacagucaggauggaaaaucccuacuaagugugcuggagccagcgccagccagagucagcaaggacuuucuggucugacggugcauagcaccuucccguagagacgcucugagcaaaucaugcuuaaucuacagaaaaggucagccugguggcucauacuccuaauccugcuacuugguacucugagacaggaggauuguuuugaguuugaaaccacuuuaggcuauauagugaguucaggccaggguggguuaaagggugagaccuuucaaaaaaaggaaaaaagaaagaaaaauuugccagucucucagaggccuuuucucucuccucccuuaccccuucuagccagaucauuugcucaggcagccauugaaaagcagaaaucggcguuuguccgcuggggagugauggcagacuggaauaacugcuauuacacauuugacccaaaguacgaagccaagcagcugagaguauucuaccaaauguaugagaagguaacaggauaaucuccuuccuccuaguguaugaaaguccacaucucagaaaucccagccucaguacugcccugggcugcuucugcugugaugaaaguggagaaaggcagccugggaagaaaaggguuucuguggcuugcaugucaccaucacaguuuaucauugagggaagucaaggcagaacucaagcagggcagggacuucguggccggaacugaagcaaaggccauggaggagugcuacuuacugcucgguucccuggggcuugcucagcuuuucuacaaguacagcccauggccuccuguaguccugccugggucagucugaaggaggcauguucccaauuaauauucccucuuuucagauauguauagguuuguuucacuuaacaaaaaccaaccagcacaauaucguaucuuugucguuuucagggcuugguuuaucgaucuuacaaaccaguauauuggucucccucaucaagguauguguucuuuguuaauuaaaagcuugagcaccuuugugacgauuccccauguuuauggacuaugauaucuuaaacccuaggacugcguuggcugaagcagagcuugaauacaacccugagcaugucagucggucgauauacguaagauucccccuccugagaccuccuccgaaguuggagucucuuacagguagguuuagcuggagcucaguuuugaugacgucauggaguuacgaugcuugcugauauauucacaacuuuauuuccacagaugccucauccccuguuagcguuuuaguuuggaccacccagccuuggacaauucccgccaaccaggcaauuugcuauaugccagaggcaaaguacguagugugucguaucuuuuuauguaaucuacaaauaggauucguguuaaauuuauuucacucucaugacccuguugaaaugcagugaauugucauuuaguggcauugcugugacugucacugcacucuagagaagaugcccuuuggagaccuuuagcugcuuaugaaagugaaacacacgugaagcauucggugcuccauaaacuagucucugaccgugugacccgucuuucuaaagaugucacuuagcuguggcuugucucuuucugucacgggugacgugcucugaacgucaccuucagguaugcuguggugaaauguucugccucugggcaccucuacauccuggcugaagauaaaauagcaccugucgcuucugccuuggaaacaacauuugauguuguugcagcauuuucaggugaggauuuauagacauugucuaacugucaguuauuaaaauguugggcugauuggcauuuaguaguuucuuggauauuacccauuguaaguugaaacagauccgacauccguguuucuagggggcgaaaugagaaaggauguuguuuguuugucugugacagaguccuaccauacagaccuggcuggccuggaacucacuguguagaccaggcuggccucaaacuaacucacaaagaucugccugccucugcuucgcaagugcuggaauuaaagguaugggcuaccaugccuggugucaaagauaaugcuucuaucagaaguuacaaguaauaauuuaaugacuaguuuuauuuaacuguagaauuauuuuaaaauuaauugugauucuuagagacgauaaugucuuuugaauuguugaaaagcggccuuauaguaaguauaauuuaaaaaauagacugagccuauagcuaaagaagcaagcccucuuccacucaucaguugagguauaagacgguuugaagaaugaccaugcagcccuguaagaacaaagaggaguuuuguaagaggcaagggggaccuggguucccaugggcacuagggaaggagagagccugcucugguuuguuuuggguuuuguugguuuuuugagggcuugaacgcaugccucauacaugcuaagucaugaguuugccuccagcuuuuuuuuuaucuugauuuggagacaggaccuuguuaaguuuucuuggacucagucugauuacagauuugcuguaauagaccacaacagauaaaaugguaguauuuuaaauuauuuauagugaggcagaauuaugccuaacugcuccaagaucgucacagugcugcccuaacaguggugcucucagcuggguuguaccugccugcauucuauagauuacugggcaucauaacucaggggagccaguucugagcccagccagucuugugcuuggugucuguucguucucuuagcgaucuaaguagcucaggggcagagcacuugccuaaugugccaagcuucggguuucauccccagaccaagaaaauaaagaugcuggcuaccucugucugugcacagcgguuacccuagcaacugagagauggaagcaguggaucagguauuucaggucaucuccagcugccuggugaguuugagaugggccugagcucugcaagguuuuaucucacugaaagacuaaagaaaaagauggacuuagacugccaagcuuaagaagguagaacuacccaguagaacaacuccuuaaauaacuggggacugaucccaggcaucagacauggggagagcucugccacccagcugaggccccagcccuucgcagaguacacuggguaaugguuuucuugacccacagguguggaucuggaagguggcacuuguagucacccuuuaacucccgauaaagugucuccucuuuuaccugcuacccacgugacuauggccaaaggaacaggguugguucacacagccccagcucacgguauggaagauuacagcguagcaucucagcacagccucccuaugguacuguucuucucucuuccuuuuuauuacuugccuugcagaaugaaaauaauugcuccuaacuaacaucuuugugucuugguaauaacaauuuuugucauuauaguuaaacugugaaaugauuacauuugugcaacauccuaaaacguuauuaagccauacuaaauuaagaaagauuucccugaagcauauccacugacaugaaggcacuuuuuuuuguuguuuuuuuguuuuucgagacaggguuucucuguguagcucuggcuguccuggaacucacucuguagaccaggcuggccuugaacucagaaauccgccugccucugccuccugagugcugggauuaaaggcgugcgccaccaccgccuggcgaaggcacuuuuaaaacacacacaguguuugauugugugcccuuuacuguaccuugcagaggugcauuugucaucagucagagguuuggggcaaaccagaguugagcaaguccagcacuguguuucuaaauuauuuuuauguauuuuauguguguggauuuuuugccuggauguauguguaagcaccacaugugugucugguccccauguguggcauguguuggaucuccuauagcugcaguuacaauggcugugacccacaugucucaguaccauuucuccaacagcucagugguccuuaacagagguuagaaaaacgcuuuuuguaguugagguagauacauuauucagaaccugcugcucuggcacacuuaguagccuauaguguagcugagacccaggcaguauuugcacugggaagcugaauaauugaugggauugcucugcuugucuguugcuauccugcuguucacauuuuuuccacaguggucucaaagcaagccaguacagaaauggaauaagagucaccaugcugagucaccaaacacguuauagcuguguacacacacagcugcgcugaugcugagucacagaacacguuauagcuguguacacacacagcugcgcugaugcugagucacagaacacguuauagcuguguacacacacagcugcgcugaugcugagucacagagcacguuauagcuguguacacacacagcugcgcugaugcugagucacagaacacguuauagcuguguacacacacagcugcgcugaugcugagucacagaacacguuauagcuguguacacacacagcugcgcugaugcugagucacagagcacguuauagcuguguacacacacagcugcgcugaugcugagucacagaacacguuauagcuguguacacacacagcugcgcugaugcugagucacagaacacguuauagcuguguacacacacaggugcgcugaugcugagucacagagcacguuauagcuguguacacacacagcugcgcugaugcugagucacagaacacguuauagcuguguacacacacagcugcgcugaugcugagucacagaacacguuauagcuguguacacacacagcugcgcugaugcugagucacagagcacguuauagcuguguacacacacagcugcgcugaugcugagucacagaacacguuauagcuguguacacacacagcugcgcugaugcugagucacagaacacguuauagcuguguacacacacagcugcgcugaugcugagucacagagcacguuauagcuguguacacacacaggugcgcugaugcugagucacagaacacguuauagcuguguacacacacagcugcgcugaugcugagucacagaacacguugcucucagccuccaaacaauggcaaguggcuuucauugagucauuggaggggaugguuaagcuuugcccucuuuaaacuccugagcuucuuuuccacacuuuccugagcaaccuuuaccauuugguuaagagggaugcaagcaaagacagaggccacuguaagaguguuuuagaacacuuguauugcccaguauuaaacuucagauaugugcuuuaaugauacguguugucuuuggugguuucaauauauagaauuuaggaauuuuuauugacagaggaagaaauuuccaaguuuuuaaaguaaagaaaagguagacugaauugagaugcuuuaaauauguuguuuuacuauagauugccguaagguaacuugucucuauguuuuaacuguucaaaaugguacauuguaggacuguuuaguggaugaaggcggaauguucaccgaugccgcaggcccugaacuucagaacaaggcuguacuuaaagaaggaacagauguggguaggugccaucuguugauaacgggcccgguaaaccaccauaguaacacaagguauuucugcuagaaaccaccaagaagaccccuggucacuuuuuauccuuccagucagaacaaacgucacuugguuagucaugguucaaaaugaagcuuuggaucuaccaucuuuugugucaaaucuauucuuauugcuuaugcagaucaagauagucaucggaagguagucaucgcaaguaguguccuuugguugggaggggucucagagauaaccagcauaucgcuuugguugggacagaaacugagcuuggguagauguugccugugaaccagacauucccacuccuucagucagcuuugcaaauagcugagcaggcaggcccuugugccuuggcuugccuuucugucuucaugggguuaggaggggagcaguuuggagucugauucagguuucguggaguuggugccucugccaccuccacaccaggccugggguggggcuccugucacuggcacuucugcccagguccaguucuuccuagaagccucaagugcugugaguuuguuaagaauacuuuuaaguuaugguuaauaggaaauuuuguuuaaguuauaaagaugcuucaagcuaccaagaauguguugaaagaagagaacauugugcacagcuaucccugugacuggagaacuaagacacccgugcugauucgagccagcaagcagugguuuguaaauaucacggacaucaaggcugcagcuaagguaggaaagaacuccugcucuaaggguugggcuggucauuaccaccauaaaaaguaugugucugugugugugucuguguguguguguggggggggggggaggggggcuggcgguaauggggcugaaggagagaagauuuauaauuuuuuauuaugauuuauuuuccuaaaauuguaugcgcuuaggccuaaaaagaucucauacuugauucuuccauguaugcacguguagaaacaaggcugaaggaggcugaguggguccucgggucacuuguguguccaggguuguagacacagcccaggcuaagggcaucugcaguaacagcuguaugaccuccuaggaccucagcucuauaacuuguccuccaguccaaggcaguaaugucugccaaaggagcaagucgguuuccacagcagugacugccaccacaugauacacauuuagugcaguguuuuguauccccuguugccuugaaauuaagacugcuaaaaggaagggagcaaaacagaauucugguccauuuaaaaaauuguuuuggggcuggagaaauggcuauggguuuagagcuacucuugcagaggaucugaguuugauuccuggcacccgcuucaggcuucucauauauguauauguaugugccuauauaugccuauauauauauauauauauauauacauaccuguguaugccuauaacccuagcugcaugggguucggaucccuucuguccucuucaggcacuguauguacaugcacaauugugugugugugcgcgcgcgcacacacacacacacacacacaucauuuuuuaaaaauuuuaugaauuuuuuaaaaaauguuaugaauuaacuaacuuuauaguugguguugcaaacauuuagcguguuuucaagcucuuucauuuaauucgcuugacuauguauguauuuuuacauguaucacugguuauuuugaaaauagcuuuaugggcuggugagauggcucagcggguaagagcucugacugcucuuccgaaggucugcaguucaaaucccagcaaccacaugguggcucacaaccauccguaaugagaucagaugcccucuucuggggugucugaagacagcuacaguauacuuauguauaaagauaaauaaaucuuaaaaaaaaaaaaagaaaaagaaaggaaauggcuuuauucuauugacuacaggaguugaaaccuauuuauucgccaggcugaacacacagaugcuuugcucacagcuaauguaacuagggugccugcuuugucacuggcuugauaauuaggauccuugucaguagcuuggguuucugcacauaugugaagugggcgugagacauguuguauuuuuuuuuucauuccaauaugagauacaucuuauuuuuugauguaugcuuauuugcaugauguugggggauaagaccucauguaccuccugcuggugggaacucacuuuguagggcaggcuugccucaaaaucguggcaggccucgugucucagccuccuguccuagcuaacguaaccaguguguuagugcauaugcccaucuguccgcucacgacagaggggaagucugcuuuuguugccacacuuggaugucuuugcuuuccucguguuugccuguggugggagggggagcuaugaguggucagacacucagaacggagaacaggaguagggaaaaucagcacagcucuucacaauguguccugcuccucccccuugaccugcugguaaaugaauugcaggagucguugaagacggugaaguucauucccggagccgcacugaacagcaugacggacaugcuggacagacggccguacuggugcauaucccggcagagagucugggggguucccauuccuguguuucaucauaagacaaaagaugaauauuugaucaacagguaauucuuuucugauuuuuauuguuuaaaaugaguuauguuuccauggaagaacgguguuuaccauuaagaauccguuguuacuguccguugcucuggggcuuugagauggccuuucaugaugaaguccaggcugcccucagagccuggguccaaguuguuugccuuccucagcgggauuacagguuugucccgauguccuccucgcucucagcucugucugucucaccagugagcacuggcugcucuggcacagucucacauucacggcaguccuccugccucagccuccccagugcugggaguagaaagucacacuguugcugggcuggaugagccagcagugagcaagccugagacaggagcacgggguuaaggcuaaguccgcagugugacagcgagcgagugaggcauucagagggcugauguucccucaaccccaugaccaugaggaugcuguuggaguuugcaguuucuacguuguugcuguuaagguuuuguuguuuguguucccucccuuccucucucucucuuucucucucucucuuucuugugcacccccugggauuaaagccugugccaccauacccagcuccuaguugcuguuuugauagauguggaaaggggacagcuaaucauuucuguaagaauucauuguaaguuuucauuuccuaagacugcuuugacuuuauuuugguuaaugagauuuuacucaacuaugcuauagcaucagcgacauuggcugagugugauuuuguuaguucaggaucuagucagcaguuucgaggggcagaggcaauaagugauggguuguuuguugguugagagacuguaggcccagacuggcggcccuuccuggggauuccuuggcguuguugagaugauuugguuuucacuguugcugugauuguauguguuaauaguaucauucugaguguauggauuuuagaaguuuuaaaaaauguuaauuuaaguuguuguuuuuuuaaaaagucacguaugaccacacaaaggauagguuuguuguuaucuuuaauaauuuugugcuaggaauuauaucaaggcccugugcauuccugaccacugacuuguauucuaagcugagggcagggaagagugcucugcgggaggcaggguggcagugugugcugugcguaggagccaugggauuccagggcugugagagggauagaaaggcagucacuaagaacuggccgggggcuggagagauggcucagcaguuaagagcacugacugcucuucugaagguucugaguucaaaccccagcaaccaugugauggcucacaaccaucuguggugagaucugaggcccucuucugguuugucugaagacagcuacaguguacuuaaauauauauaauaauaaauaaauuaaaaaaaauaacuggcugggacaggcugaaggagucuugagcaccacacuagggauuuuaagaagucuuuuucaggcuaagcauguacaggcuagauuuguaagaccauuugaguauuguuauaguuuagaguugacucugcuccaggauugucccuguguggcucuuacagaacucaagaguuuuuucaguuauauuucacuacuaucuuaauacaucuguugaaaaugaaaugauuauaguugagauaaauucacacaaguaaacuuaaagccaguuguuucuuaguccucagcuaucagaaugcaagacuuugagggcauugccuugaagugagugcgguaggaugaguauauguuauuaaaauuaagaaguaaaacagauuuggcuuuuauuuguuuugugugcaggggauugauugaacucaggcccucucagacgugaauacacacuguaucacugagucguaucccagacuucagcaacucacauuccaccacugagcuguauccccacacuucaccaacacaaacucgaccacugugacauaccccaaauuuucagcaacacacacucuaccacugagcuacacccucagacuucagcagacugguggaacugacaauuguuuucaaagugaaaauguacacagauugagcagucggugagugagaugaaauagacgucagcuuucucagguacacagaagcacucauuuuauuuugucagcacauucuccugccaugcuacagacucucccgugaucugcugcacagcgcucagaggguguuugccgauguccggauuuuaaguagcagugacauacagaauauuggccuacagaaugacagacauacacagcugcacggucugucaaaucauaggucauucuccuguacaccguugaugcugagagcuccgugcuccguagucuccauggcuggguccucugcugaccuagcacuugaacuugagaacauuuacauucuuaaguauuuguuaguuaggaaacagaaugaagaucaucauucuuuuucugaaucaaaugauaaccaagagcccacccagaaaugucugcccuuccuuuuccauguuuguagccgguuggaggccaucagaaguaacagcagcuccacuggaauccgagcacaguccacauggaguugcuguuacacccgaugacuccaucaguuugccggauggguccuuagcuuuaaaacacuacucccucgguguggaggagucuugaggauugaaccuggagccuggugcaucccaggcaaguacucuacaggagacuggagcuagccccagcccucuaccucuuccugguguguggugggagugguggcaguuugggacaagaccuagccuguaccuugcaguccugccucagcuuccagggagcugagauucccggugagcucugccgcgccuggauuuucugcuuccuggacgagagucugcgaguugccucuaaauauacuuacuuguuucccaaagagaaccugggauuccucgugucccaaaugaguuuaaagacugacagaauuaaacucuggacucaaacucugacaugucaauuucauuuauagcuuauguucgcuucuuuuccucaagaacuuuuaauguuaauaucauuggccauuuccugaaucuguaauauaauccccguauaauuuagguggcaaucuagucccugguuaaugaaaacaaguuuuguuuuguuuuuuuuuucggagacaggguuucucuguauagcucuggcuguccuggaacucacucuguagaccaggcgggucucaaacucagaaauccaccuaccucugccucccaagugcugggauuaaaggcgugaaccaccacuuccuggcaacaaguauuuuuuaacauaaaauggauaaaauuuagaaacauuggccaccuagagaagacaggaagcuguugauggcguuucuuuccuuauuuuagacguauguugucaccagcacuguugacuuacgcgcuaagguagcuuagagccagccucuggaaaccuguggacuuuauguucaguaaguaaagaaagcauccuaaaucguugccugcugccucuacagccugcgcauuggacuuggugggaacaggcucuuccuucugaagcuccaccguguucuuugucacauuuagacaacagacaggaacucuuagccucuuaccucguucuuuccacggucacuuccagcagagauccuguccugugccuuuugcuuauaaagagagaacagaggaccaagaggacagcagcggcuccuuaccuggaaguccugagugcuuccugcuucucggcuaaauagcacaugcugcugauagcagagcccgggugauuggcugccgucagagcugccccacugccuggguuuucccugauggaaaccgaagcaggaacacggaaugcgugacagauaaggccucugaguacaaaguucuaguauggucugacuuauugcucugugaaauacagcauuaaaauggaaacagacuacagagugauaagugguuucacccacuuuuaucaacaguaauuuauacuggucuuuaggucauaagucaacugugugcugaaguauagaauauuguuaauaaaauaaagagaauucuugaguuugcaaggacaaaccuuaagaaauucuuuuacacuauuugaaagcaugaccucaguuucauuauaaagaauucuacuuguaaguauuuaucggaagggaaaacacuaaugaauucuguacagagcuaugcauauaagauguccaguuuagcuguguguccgggaacuuaaugacauccaaaggagaaagagcuaggaagacagcucggugggaagcacuuguuuggcaugcaugaauccauagguucaaagccagccucagacaugugcacacagcuaguguuuaaauuauguaagaggaggucacgcagacauuuaaggccauagcuuugcucuuauuggcugccuagguuccacacugaaaauccagugaccagagcauguccagcauuuggcuguuucgaggugguugcuuuuugucguuuaguucuguuuuggugggaagucagucccuacuacugagcugugcuccugccccugaguuuuccugagucacagacuguggcaggcagcuccacuguccacaagguugguggcccuccaguuugucuccugagugugggauucugguccacacaaagggcaggcggcaagaggaaucggcucuuucaugacagcagugcugugcaugugagcuucagugagaaggcuuguguuaaucagccuuuaaaaaguaaauuucaguuuuaaaguuaagcuaaucaacuuuuuacugacaaauuugcauacauuugguaauacaacauggccucucacgacacaggcauguugcauuggggugugcuuguuugguuuccuuaauucucuaacucuagagcugauuggguuuccucuaaaaggugaguauuuugucugucuagaaugucugacugcagagcaagaggcuuagcaaggaacagcaggguccuucacagguggugggaggcgaggcuggaaggccugacucagccagugcagcuccuuggggggcacugaagacaaaaagaucuuuuuuuuucuuucuuucucucucuuuuuuauuuuuggaaaacauuuuuuuuuucuuuagaguccuaagaacaaaacuggguuauuuucuugguauuauguauauaguuuaauuugccaauuuuuuuuggaaacaaguaugucauauauguguauguauguauauguguguaugcaugcuugugguugagguccuaggcccugcucaugcuaugccaauguucucccacugaucuccaugcacacacaccugcugaucagccuuuguagcucauauugacuuugcacucaguccugcugcuaccucuucuugaguugcugaggugacagaguguacuggcuaguuuugugucaacuugacacagcugggguuaucacagagaaaggagcuucaguugaggaaaugccuucaugagauccaacucuaaggcauuuucucaauuagugaucaagggggaaaggccccuugugggugggaccaucucugggcugguagucuuggguucuauaagagagcaggcugagcaagccagaggaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaacucugacuaagacacagaggcacacuguuugaggcaggcuuuguuguuuguuggucuuguuuuuugagacaggguuucuccuucccuggcugaccuggaacuuauucuguaggccaggcuggccucaaaggugugcaccccaucccucucccucccaucccccacuccauccccacuccagcuuugaggcugaauuuuuaagaacuacugcacauugguuuucauugguugagauuauauuuguaguucuaagauucauagaaauauuacuaaaguaaaagaaaaauaaaaccaaacaagcucucuuucucacugauugccagaccucagacaucuaaaauaaggauuucaugaucuuaaaacgaagugcuguaaaauauacaauuacuuagcauugagguggcggaggcaggaggaggcaagacaaaccuacucuauauagugacauugcaaaaaaagaagggaacacuggaaaaaauuaaagcaugauuauauuucuucuguuaagacauuguugucuuuuuaagugaauuauuaacauuuuuauaagggaauauugcaguuaaagggaacuuuauucagaggcuaagguguuuaaccucaggguuucauaguugacuuaauagcauauagauauuuaaaaccaagcauguuucugugauuuauagacuuagcuuacugucauguagcuaaauaaacaccuaaguuaucauuuuaaaguauuguugacuuaucugauauuuauuuaaagauaaggaaauaauugaaguugaacuuguuaugggauggguguggaauacgucaugugagacuucucacuuuucuuuaguuauuaagacuuaaaaauguaaaaauguucauaaucuuuuuauaccuuuucuaaaauaccauaucuuccucuugcuauuagccaguaagccagcuagaguguguucuuugagcccugggccugcucugucaacacacuaaucuccugagacgcccuucucccccgccuccaaccuugguucccagccuguccuuugccuguacagucagagcuuguugccaggcucagcagcucucgagaagaggguguaaguucacccaggguguaugugacagagaaggcacacagcagugaaaacagcucuugccugagaggguggccucuaagaccugguucuagacuggucauuuauuuagacucagccaggugcugagagucccugucccagaacuucugagugugccgugcuggucacuuauugaugaugcuacugugaaaugcaaacagcuuacuuucacuucugcaugauguacgccuguuuauuccaaucacauugaaaacuuuucacugcuugccugaauuugucaggcuaucgggaacaugaaaggcuggugauguuuaucuccugagaguucuuuuuuuaagggaaagugcauaacuggugugaacagcauaucugcugucuauaauguguacauuugaauguacucugcugguauuucuguuuuuguucuuugggacauuagguuucuucagauuuuucuauuaccucauguucauauuuucuuaacugauaaaguguucugugcacacuauauaaaaacuaauguauaaccaagaauuauugucuuacaacugguuaccuauugcguaaaguuuuuauggucaccuagggaaagcuuaucuucaccguuaaaguccaccuaaagugaauguccuagcaguuggaacuugggccaauuuuauauuuuuauaaucaugauauauguaaauucuuggacauuuugguagcauuauauguuuagucaaucuuuuauaaaguaucacuuuaauauauauauuuuuggagccagccucacuguguagaccaggcuguccuugaauucacagagcucugccuccauuugccuccuuaguccuggaauaaaggugugugccauuaugccuucgcuucucccucccuuuguaagguuuacuuugcuuuaugugugugcauguauccaugugugucacaggcagaccuggcgcccacagaagagggcauugcaucuccuagaacuggaauuugguugugaaccaacugccuuguacucagaacugagccuggcuccucugcacucuuaaucacugaaccaucucuccaauccccaccuuagucuuuagugaggcgucucccguuucaggucacagagucaucauaauuuauaucaccuacuugauuugcaucccuuugcagauuuuacaaacagcuuuauugacccguggccuaccagagcuggaagacugagauaacagugugguuaauauaauaucugcuggugcagaucuggaccucggcuuugccauggucacuguccuguccguucccaguaacgcugguggaucugcacuggcuugcacugguuauggaguggagacaggcagcuguuucagagauagggcucacuguguauuuucaucuuuaaguaauaaucauggaagcugaucagagcucgcucacugagagugcugcucuuucaaaggauuagaguuugauucacagcaccuacaucaggcagcucucaacugcuugcaacuccacuuccaggggccccaguggcagccagccuccaagaauaaacacaaauguaguagaagacaaacauacacaaacucaugaauauauaaguagaaauaaauccuaaacccuaauguagguguaugacuuaguaaucaacacagaaccauuaucucaaaguuaucucaaagacucagucggcauucuuuugguuuucagagucaggguuucucuguguagaccaggcuggucuggaacucacaaagauccaccugccucugccucccuaggguuggauuaauguaccauuaguguccagcgugaguucucacguauauaauuauuauauguuaaaaugucaagugcugcuguggggacuuuguuuacuaggucucuuggugacgugcugcugcggcugcggcugcggcugcugguggcgguuuacacaugagaauccagaagugcagaggcccagggccuugccugggucccuugcugagucaguaacuagguuaucgcuugucacacccaaagcuguggggucugagcugcugccuguugugugcgcuaaacagaaaacaacuccaagaggcccuggugugagcgguaggacgaguguugcuacugcgcagcacuggacaggagggcggugaucuccaggcugcuugugccaggggauggacgaagucaugggcagaggccauggggccuugaaagguucugagagggauguugaaggacagcaguuacaggaaugcuucugcuggagugguggucagcuucucugugagagagggaggggguggugguggucagcuucucugugagagagcgagggggcgggucuucucagugagagcgaggggccgggguguuggcucuguagcuggugcugaggcagugagguagacugagauagucagguagaacugacaggaugugucagcuugaucuggcaggaaaugaggacagaguuccuggauaggaaccguauggacgacaugggaggugaggagagcgcuguuuuccuguuuagggacaugcaugaucacaauggucuugcuuguacccaaauuacaaaugaugggaccaguccaguucuuacccgcguucacgcgaccggccaggaagaacgcaacaaaccggaaucuucugcggcaaaagcuuuauugcuuacaucuucaggagccagagagccagagagagccagaggaagagagagaaagaaaaagaacaagaaagcaagagagagaaaaagcaagaacaagagagagaaaaaacacaagaacaagagagagaaaaagcaagaacaagagagagaaaaagcacaagaacaagaacaagaaagcaagagagagaaaaagaauggcaaaaccccgucccuuuuaaggagaauuauccuccgccuaggacguauuacucccugauuggcugcagcccaucggcccaguugucaucacgggaaaggcagaacacauggcgggaaaacugccccugcacgugugcagauuauguuuaccacuuagaacacagcugucagcgccaucuuauaauggcaaaugugagggcggcucccaacaucucccccuuuucuuuuaauaagaaaauaagagcaauaggccacccauauuaaugaaaguggagauagaggucaaauccccagugugcagguaaaggagccauguacaggauuagcucuuaggcucacaggcuuuuacccagagcaacccugaccugcucccgugucguuuuuccugggggaagggaacuaggacacugaaccuucaugaaagaugacaugucucccuagaauaggcucauaugugccgcagagcccuucuacugcagugcuuagccgugcaacucucucggucugcugaagcacacucacucuaucccgugcaaugagacuagccucguggggugcaagagcugaauggccagcgaccuauugcuuaagcauagauauaucaggggaagcaccauguucuagagcugcaagugccugggcaauaaccaccuugucucuccuaguuuuggcccuuaagcuuacagaccaaccagagaagcaacacuaauccacagcaaaguguaucuccaaauaaucccacccauacccauucuuuaaagaaggaaaaugcugaggagauccaauugaguaauccuuugaucagggacagguccaagcgcguggaguugaccugaaugauggcaagucucaauucccgaagggucuguucaaauucagcuguccaauucuguaacauauacugagaaagacuuuuuaacaaauuagcugcccuaguaaauuucucauacugaauggaaguaacgcauaaugagaguucccccaagcuccugacaaaccuugagccagucuuguaaaccuuuguucuuucuuggggcuauggccgcucugcauuccugcguggcuugcucauaaauaagcuauucuaccagaggugcggcuugcuccgaaucuccaaaaauacgcucugcugccucugucauucuggccacaaaaucugagaaggacuccugaggucccuggacgaucuuuguuaguuguccaguggcuucaccugcucgggagagcgccuuccaggcccuaauagccuuuucaucugauucagaacuauuaagaacuggcuccuugagcucaccuagugaugaguauaggcuccuucuccuagaaaccuccgcugauugaucuuuuuucuuuucuuuuuccuucuccuuccuucuaaucucuccccagguauucuuaccugaccuaaacuuuuccucagguucaagacccguggaaaggccuguauacuuauuuugugcgccauauuuccucuuugcuccuacucucucuccccgcuuuacuucugauagauugcccugaauuucauccagaauuuucagcccugccuuaaccgcuugauaacaugugaaaaggaacaaaaaggcuccuaacacuagagaaaguucaaggccaaacauaccuuguaaagcuauuucccacuuuacuucugauagacugucuugaauuucuuuagaaaguucaagaccagacuuaccuuguaaagcuauuucccacuuuacuucugauagacugucuugaauuucguuagaaaguucaaggccagacuuaccuuguaaagcuauacuuacggguacccuguuccccagcugaagaguucugaauucacgcaguugaauccuucucaacagucuguguuacaggaacacuuuauuaccaccauuccccagcugaagaguucugaauucacgcaguugaauccuucucaacagucuguuuuacgggaacacuucauuaccaccguuccccagcugaagaguucugaauucacgcaguugaauccuucucaacagucuguuuuacgggaacacuucauuaccaccauuccccagcugaagaguucugaauucacgcaguugaauccuucucaacagucuguuuuacgggaacaauucauuaccaugacccgcaguucugguuccggaaugagggaucuuccuugcgccagugaugguaaccgucccggguuuuucuugucccggguuuucucgucccaggucuucucgucccggguuuucuugucccggguuucggcaucaacucuuacgcgcguucgcgugaccggccaggaagaacgcaacaaaccggaaucuucugcggcaaaagcuuuauugcucacaucuucaggagccagagagcuagagagagccagaggaagagagagaaagaaaaagaacaagaaagcaagagagagaaaaagcaagaacaagagagagaaaaaacacaagaacaagagagagaaaaagcaagaacaagagagagaaaaagcacaagaacaagaacaagaaagcaagagagagaaaaagaauggcaaaaccccgucccuuuuaaggagaauuauccuccgccuaggacguauuacucccugauuggcugcagcccaucggcccaguugucaucacgggaaaggcagaacacauggcgggaaaacugccccugcacgugugcagauuauguuuaccacuuagaacacagcugucagcgccaucuuauaauggcaaaugugagggcggcucccaacauccaguaagccauuuaagguuugagaaguuggagaaacaauaacugacgaauguuugucacagggaugcauugcugauccugccuguuuccccacagccaaaccacugagcauauuauuaaacucgucgagcagcacggcagugaugugugguggacccucccugcugagcagcuucucccggcagaaguccuagcucaggucagugugggccacucugggagguaaaggugacuuuuugaagcaauggaacugggagaauuagaggcagaugcaguuuggaagugaacauuuuuucuugcagucaaaacauccucuguagcauagcaguggaagguggggcauuuguaaccccacccaccagcgcuauuccggcuguccuaggggacuaagcagaugguaccacgagaaaagucccucuuguuggcacaacagggcugugugggucugacacagcgaucccugaugguguucucugccgccaucuuacugaagaggaaaaugugauuguugcuacaccaguggccaugucuacacaugcugccgggggcugggcucaacugugaagugcauuuuaguguuuauuuuuuaaauguggauguaaugacuguauuucacuuccuuuaaacuuguggaacauuuacugugugugguaugcacagccucuguaggucagcucucuucugccuucuucucaggcugguggcccuggggcuuuggaauacgcgccagggcaggacauuuuggacaucugguuugacaguggaacuucauggucuuguguucuucaagguaauuauuuuuucuuucucuuuucuuuucauuuuguuuguuuuucaaguuagggucccuguguaacagcccugacuacccuggaacucacuuuguaggccaggcuggcuuugaauucagagaucugccugccuccugccuccugacugcugggugcagggauuaaaugcaugcaccaccaaacccagcucaauuuccuuuuuuuauuuuuauuuuuuaaagauacauuuuaauuguuuuucuguguguuuguauguaucuaucuguauguugguaugugcaugugaguguaagugcccauggcaggugagaggguauugaguccccuggagcuggaaugacaggcauuucuuagcuaucuguuauagguguugggaacuggguccuggucaacagggaaaguagcaagagugcuaaccauugagucauguagcuagcugcucuuucagcuaaccucuggcauuagauuauaagccaguuacguccugagggcuggcaagauggcuuaguggguagaggugcuugccacacaagccugguugccuuagcuggauuuccuggagcucagacagaggcaggagugcuaucuugggagacuuguccuaugaggggcacaugcacaauaacaguaauaguucugaaaauacagagcuguuaacguagaucuucagccagaaccugugugggacuaugguuugguuaugggguccacuuagacccaacacaaugcaaacaccaggacaaugcagaugacagaacuuuauuauaaucaagccaguacugaucagucagguccagaacaagcuuggaagccgcacugcagccuugagccacaauguucggagcuuuaaacuugaaaaccacaagcauuuguaccagauuacacuuacauuuuuuuuaccaaucaggauuuagggacaggggcuuuucucaugaggcugauguacaucaauugguauggaauguagauuuaccauccagucggaaaccauuuguucuuuugugguugggaguagucauuguguuuuggggaguaaaagauggcuaucagaagcuggugcuagggccugggaucuagaacuuaguucccccaugauuaaaacggagucuggaaacaaaauggcagcacuuaggacaaguuucuuuugcuuguuccccacagguuguuuuuugguuuuuuuggaacaaacagucugugucuuaguuaggguuucuguugugaagaaaugcuaugaccauggcagccauagaaaagaaagcauuuggaggaugguuccucucucuccacaucuucccaagcauccugcugucaccugagguuuugaucuuagccauucugacuggucugagguggaaugucaggguuguuuugauuugcauuucccugaugacuaaggauguugaacauuuccucaggugcuucucagccauuugauauuccucuguugagaauucucuguuuagcucucuuccccauuuuuuaauaggguuauuugguucucuggagucuaacuucuugaguucuuuguaaauaucagauauuagcccucuaucggauguagguaaagauacuuucccaaucuguuuguuguuuuguccuauuggcaguguccuuugccuuacagaagcuuugcaauuuuaugaggucccauuugucaauucuugaucuuagagcauaagcuauugguguccuguucaggaaacuuuuccccugugcccauguccuggagacucuucugcacuuucuuuucuguuaguuucaguguaucugguuuuauguggaaguccuugaucuacuuggacuugagcuuuguacaaggagauaagaauggauuaauuugcauucuucuacacaauaacugccaguuguaccagcaccugauuuguugaaauugcugucuuuuuuuccacuggguuuuagcuccuuugucaaagaucaagugaccauagguguguggguucauuucuguguucuugaauucuauuccauugcucuaccugccugucacuguaccaguaucaugcauacaaucacucuggaaaucagucugacgguuccucagaaaaucggaguacuaccugaggacccagcuauacaucugcugggcauauacccagaagaugcuccaacauauaauaaggacacaugcuccacuauguucauagcagccuuauuuauaauagccagaagcuggaaagaacccagaugucccucaacagaggaauggauucagaaaaugugguacauuuauacgauggaguacuacucagcuauuaaaaacaauucaugaaagucuuaaacaaauggauagaacuagaaaauaucauacugagugagguaacccaaucacaaaaggucacacaugguaugcacucacugauaaguggauauuagcccagaaguuuggaaaacccaagauacaauucauagaccacaugaagcucaagaagaaggaagaccaaaguguggaugcuuugguccuucuuagaagggggaacaaaauacccaugggaggaguuacagagacaaaguguggagcagagacugaaggaaaugccauccaaugacugucccaccuggggauccaucccauauacaaccaucaaacucagacacuauuguagauaccaacaagagcuugcugacagaagccugauauagcugucuccugagagguucuuccagugccugacaaauauagaaguggaugcucacaggcauccauuggacugagcacaggguccccaaugaaggagcuagagaaaggacccaaggaacugaagggguuugcagccccaaaggaggaacaacaauacgaaccacccaauaucucagagcucccagggacuaaaccaccaaccaaagaguacacguggcgggacucauggguccagccacauauguagcagaggauggccuugugggacaucaauaagagcagaggcccuuuguccugugaaggaucaaugccccaguauaggggaaugccaggacaaggaaguaggaguggguggguuuagugagccgggggaggggagaggggauaggaggguuuuuggagggaaaaugaggaaaggggauaacauuugaaauguaaauaaauaucuaauaaaaagaagcacuacugcacaaaguggaaaaaagaaaaaagaaagaggggggcuggugagauggcucaguggguaagagcacccgacugcucuuccgaagguccagaguucaaaucccagcaaccacaugguggcucacaaccaucuguaaugagaucugacucccucuucuggagugugugaagacagcuacaguguauuuacauaaaauaauaaaauaaaccuuuaaaaaaaaaagaaaaaagaaagagaagaaagcauuuaacugggcugucuuauaguuugguccauuaucagcacgcaggcagccaugguacuggagaaguagcugagaacugcauccucauuauugacugagagaaucugugccuggccugugcuuuugacccuuaacaucccucccccccccagcuauacacuuucuccaauauggccacaccuucuaauccuaucagacuuccacuggugacauucaaaucuaugagccuguggaggccgaucuuacucagaccaccacaggcugcuacaguucaggucuagaaaggccugggagaucauuuaguccuggaauuucucaacauacucuuuuuuuugaggugaaaauuuuuuuaaauuuuauuuuauuuucuaaauucuauuuagaacuacacuacuuaagauuagagugggaaccuuuagccagcuugguggugugugccuguaaucccagcaccugguaggccgaggcaggaggaccaugacuuugaggauugccugggcugcauaggacaaaauuccaccacaaauguaguuuguuucuguucuuguauuucccucuuugccagcagggccuucucuuuggccugcuuggcagcccugcgcuacccaguuuggaaaccauggacuuaaccugaccccaucagugcucacaagaggccaagcuagagccaggacgguggucacgagguuagcggugucagagcacacacgugacccucugcuuuccugugcccaaacuucugcacagauguaccuuccuaccucccugcucugcagacauuucuugcuuccaguuagcuaaguuuuugacucauugccgaagggacagcgagagucagaagggaacaggagagggggcugcacaggagcugugugcagacagacaugugcacaggaagccaaggaaagaaagaacgcaggagaugagggagucgggaggaaucaggagcacgccgccacacagcccucacaucccaccacgggccagcugcgagcucugaggagagcugggggcagcagcuccucugcagccggcuaucuaugcacuggaaggacuucaggcuuuauguggaauaagggugugauccaaggccuuacuuggggguuguggcgggaggguccuagcagguaaauagauuccucauuuggaccuuucaguuuaggcaguuugaaagucaaauguauauauucaugcuuacagacuaagauguauaauuuaaauaaacuuuuguaaugaauuuuuuucuaauucuguuuccuggcacuauuacguuuuagucauuuuguucucauacauucacacaguauaggugagcagcauugcuuguuggaaaagcaggaggaagcauuuucggcuggcacauugugguguggcacagagucaguccucagucucagaaggagugugcugugugggaaguaguaccucagugugggacagagccaucacagccagccacacauggcuauggugaccgugcacaguaaagacgagagucaugcugggccuuggguggaugaaacugcacagacuguugcucauaccugccugucacaugacuuccacgcaugcuaaccagcuucccaccacaccuugcuagcucucagugccaccugacaauugugaucagauggguuugaaggcagcagaacauggucgcacuagaacccggucacauugguuacccuaacacuguggcacacacuggcuuuuauuuucuguucuagugaacuucauuuguguuaauauauuucagacacgcagcagagggcagacuuguaccuggagggaaaggaccagcucgggggcugguuccagucuuccuuacuaacaaguguggccaccaggucaaaagcaccuuucagguaaguacucugcgcaaagugagcccgcucugaugauccucugagugccuaccgugugugccacacacgcuuguggacauaaguguguaagccagcugugggcaagcuggagcacuguucuuccugucucugggaggagagacccacagagucaauguguccagaagaggugcguuuugugggugcggcaaggcugagugacacugguuugccuuuuguguaguugugguggcauauccugcaaauccaagcgcucuggaggcagagauagaaggagcucaggaccuggguccgccugggccaugugcagacccuguccccaaaagaccagcaaaaagcaaauaaaaucaacacaagaacaaggggagagacacagcaguguguggcgccugucacuuggcagauugcaccuccuggaagauagguggcacucauggaguucgcuggcaaacuuugugaggcagcaucuucagcuguguggcgauccaccaggagugcaaggaaggacagugucuccugcuggggggacccacagggacugcgggacugaaacccugcugggguagaguacaggcagccuguggaguacaggaagauggugagcgguagccugaggguuugcucugcugcacucggcuccacccgagacaguucacugcccagugcugugucacuuuuaaaagccacccacgguagaaagugcuuuuucccuaaguugucuuugaaguuaguuuuagaaggcagucugugcuacucuuuauuuuguugguuuuaguaaucagggggcaugaagugcucugauauacagagaagagaaccccugcuuugcuguguuuaaggggaggacucccugcuuaacaccuugauaugugaaugcugagaaaaagaaguguucacccauugucaagacaucccccgugauuacaaugguaucucacgcugguccucaucuuucuuaggacagugaugguucauggauuuacacuuggagaaaaaggagaaaagauguccaagucccucgggaaugucauuaauccugacacuaucaucaguggaggaaaaguagguguuugacuaaaacucauuuucauuuuguugucagguccuaaaauuggcagcuaagucuuuaguaguuaccugagugaauaaacacaagauuaacaagauuagaaccaucucugacaggauaugcuagggauggcggccgcugggagguggagacaugaggguugcuugagcccaggaauugagggccaagaauaguggauggguuacuauaauguuuuaaacauaaacuuguguguacacauguguguggaggucucaagguauccgguuuuauuauguuaaacuacagauuuauaauuaaauggaaacaggagaaaaaaaugagauuaugaauucugaguguauauaauugcacucuuaggacauacucacuuuaaauucagaauggccaucagaucuggggugacuggaaauuggggacagauuggaggugcuucaggagaggucguccauaauguguguuaccuugcuccuguggcuuucccaucuuacagucaccgggccacgccugggcucucccgucugucucagacaggacugucuugcuagccuaccuguuuucagauguagccuacuuugcaguggguguugcaguguugcguaucacacagccugcguucacagacuccaguuucugaaggggaacuuuaguaaagccuuuguuccucucuaauugaaauaaauugaaagcuauucuauucacauguuguuuuucuaugaaaaggaccacagcaaagaaccucccuacggagcugacauccugcgcugguggauagcugaguccaaugucuucacggaggugaccauuggccccucuguacucucugcugccagagaugacaucagcaaggucagaccugcucagggaacuuuaugagcaugcgugaaaacgagcuacauguggcugucuuuaaauguccauguuaauuuguucaaaacaguaacacuaagaaauguacaugucagccagacaguagugcacgccuuuaaucucagcacuagggagguagaaguaggcagaucucugggaguuugaggccagccuggucuacaaagagaguaccaggacagccauggcacacaaagaaacccugucuugaaaaacaaaauaagcaaacaaaaaaaguucauaucuuuuuauauuugauuaguguauagauuacaccauaagcugguauaauauugugcuauacauauacuuuccguguacucagugacuuugcaagcuagauucguuucuuuuuuuucauaugugaaucagaugaaauagcauauagccaucucuguaugaauaaacacaugagcaaaacaggcuagggaagggaguuagugguuguuucuuuauaaaacuggguauuagaaugagaguuucuuugugccuuugcagucuuauuuaggaauaauaggauuuuaaaaucuuaccaaaaaauagcagaacuuaaaaauaauuaauaguuaugaaguaagugguggaauggagaagccuugugaucugucuuuaacugugugcuuccucucgcgcugaacagcucagaaacacacuccgcuuucucuugggaaauuugaccgguuuuaaccccgagacagauucuguucccgugaagaauauguaugucauagaccaguauaugcugcacuuaauucaggauuuugcgacaaaggucagugcacaguagcaggcuuuggcaaacagcaacaucagcaccucucccauaacuuccagugaacagaccucgcucacuagaaaucaucccuauuguaccccagaaagugcaccacuacguucacacaguuuacgaugaccaugacaugaaguguuuugaugucuuugcuggauuuuugcuuuuuuuucaacauuuaauguguguguuuguguguguguguguguguguguguguuugccacuggaauucauaugugaaggucagaggacuacugaugggccuugggucuccuuccacccugugagucgcagggaucuaacuuagguugcugggcuugagagcaggcaugccuaccuucugagccacuccaucaucucuucccuuccucuaaggcugucuucuggugagcaccacagcaagcagcuucccucccucacagcaggcuccucucucaaggucagaguggaacuguacuguucaggcagcugugccccucgagcuccuggagggcaucugauccugccauacauugccuggccucugucuggugggcaucugguccugucauacauugccuggccucugucuggugggcaucugauccugucauacauugccuggccucugucuggagccuccguggcucuguaacucuugugguuuuuaugccuaagaaaccagcaccaugaagaaguugccaaguucugcugucgauucaaagugucaucugaccucaucugccacaacuguagcugcuuuugugugauuuguuagugggaucuaagaaacaguugccuuugagcagggaaccuuucagcaggauucuacguucagcuuuucuccuuucaaaugacauugcacauucacgcuggagccuucuucaguggcuagguugugaucucggacaccucucuuauugauccugucuucccuucauggcucugaucuaacaguuccagccuguaucguggagcuugcucaggugucuccccucgacaacugcacgucuguauaccugugcacucugucguaaggugacugacaacagcaaacaguaacugugcacagcacagcacagauacuaugcugucuugaagcuuucuuuggcagacaacuuauuucauuacuuuugaguuuagccucacucaaguuaccaggaugggcuggagagauggcucagcaguuaggggcacuggcugcuuuccagagaaccuggauuugauucccagcacccauguguuagcucauaaccaucuguagcuccauuuccaggggucccacucccuuuucuggccucugcagccuccaggcacacaagugguacacagacauacaugcaggcaaaacaccgauauagacaauaaaacaaguuugaaaaagucacuaaaacaagagcaaugcgcagcuggguucucugccagaacacggcgugagugaccucuagccagugcccaggcguccuucucuuuguccucagguuucuggccauucugcccuuccagacucccacccaaggccccugaguacuccugaagcuucccacacucucaacucugugcucuucugcauuccucucacacccuuccacaggccagugagccagaacagcucugucacagcagcugcccauccuggggacaguugcugggaucacauacgucuccuuucugacaaguacuaggcaaccccaacuuaaggaagaguucauuuugcaucuguuuauuugguauagcgggggcugugccacauuguacaugcagcuguccaagaucaugauagucccagggagcagauuuggguugucaggccuguuggcagguaucuuuaacugcuuugccaccucagcaggcugagaagacagguuggcagggacuugagguggucagucacgugccaccugucuacagccaggaagccugggaauaaugugauugcucauuucuccuguucauucagcccagggcuccgcccaccacgcugccacccauauucagagugaguuuucccuccaguuaaaccugucuggaaacacagccacagacaugcccacauguguguuagguggcucuaauucccguucacagucaaggucaaccauccccugaguacuaggauuaaaaacauggccuaaaaaccuuaaaaaguuaaaaguggugugaguccaucacuuaggacucaggcaggagagcagcucguggaagagagcuugccuagcgugcacgaagggccugagcuucucuucagcacugcagauuuacaaacugaagcacacggggggcugggagaacagaugccggagcaccugagugugauuucuagacaacaucacguugagaaggucaaugugaagguguggcaugagcuugugauuccaguguugggggguucaagacagcaagcagccagcggagcauacuugagguccagaccagggagaaagccuauuuuaaaagcaagguacaugguuccuggcuugagcuugaccucuggcacccacacacgugcaccuacacauacacgagcauguguguucuuacacaaaacaagcagguaaauaaacaugggccuuuccuuggagcaugcucugcuggcauucccagaggagaggagugaucauugaguaguugugccucuacgaugauguucucugacauucgugcauacuugccuucugucuuugaaacauuuuuuucuuuuucauguauguguacgugguaugcgugugagugugugugcuugugcaagugugugugugcaccggcacguguaugcggaagcacaaggcugacauuauucuuccgccuuauccuuugaggcaggcucugacaaugaaacaggcagguaggauggcccauggggugcgggugccugcugccuggugaccugagcugaguccccaggacucaggacacugaucgucccugugaccuccacaugugaucugugguacaugccuucuccccgugccccaaauaaauguaauagcacagguguaaaaguaacaagaaaagcgaggcaauaaacagcccucaggacuccaggggaagcuuuauuaaaggggaggaaacccagagcucagcccuaggauggccugugcagccagccugccucagagauaacugcuccacaguggccuaugcuacccaggacuuaugcgaguucuggggguccacacugguucuugugccugugcagcaaguguggcaucugagccaacuccucugagcugcuggugggaggagcuugcuuugccaugauguccugcugugcuuguugcucgcugcagccuucacguucacugucuuugcucucuagauuacugacucauacaaacaguaugacuuugggaaaguugucaggcuguugaaagccuucuacaccagagaacuguccagcuuuuacuucagcauagucaaggauagguaagugugacugugcacagcccucaacagggaugucugaguauccgucugcaguguccacggugagcagcugggcagaauuauagcuggggucuggagucaagccugacaucaguuaugccugccacauacuagcuucguguucgggguaacuuagcugguaaucucaguuugucugaaaaaugaagaugauaauacccauccuucuaaucccagcacuuaugaggcagaggcagggggaucuuuaaguuuaaagccagccuagucuacaaagaauucuaugcuaggccagcuagggcugcacagugagacuuuguaucaaaacugagcugcucgugugccuggugccucuuuacaaugagcuagagcugcugguagaugaccaccaugcuguccugagggcagaccaggacuagcugggcagaucuguaaugacacuggccuucacagugcgcccauggcaccagugggaauggcagucacucagauguggucaguuaccuuacuauaugcaaagucagugaucuagacugucauccaccuuaaacauccacaguugggcaaaauaugagaaaccagauacauccugagagaguaaaauaggauagacgauaaaguguccaaaggcagcauggaugugcgaaggccagagcggcaugucaacugcugagcaagcucuucuuccaggcucuacugcgaaaacgagaaggaucccaagcgccgcucgugucagacagcauuggcagaaauuuuggauguguugguccgugcuuuugcccccauucuuccucacuuggcagaagagguguuucagcacauucccuauguuacagguaaggagaacugcucucugcaugggagggaucacgcgagggguugaccgagcuguuacaaguucacacauggacacuggcagugucugugaugaggcucugugccuucauacagaguuaggacugcaucuggugccuucugaaauguauggagccuugacaauauugagaaaucacuuuugcuuaaauuguuuauaagagucuggagagaugacucuuuaguuaagucacuggcugcucguccagaggacccagguucaauuccgagcacccacauagcaacucauaccugccuguagcuccaguucuaggggucagacacagacaucuaugaaugcaaaacacuaauaaacauaaaauaaaaauuagcuaaaaaaaaaaucuuugggcuggagagauggcucagcaguuaaggucacugacugcuuuccagagguccugaguucaauuccccacaaccacaugguugcucacagccaucuguaaugggauccgaugcacucuuguacuguacugaagacagauacaguguacucacauacauaaaauaaaucuuaaaauguguuuauaauguuucauaauguauuuuaagcuuuauucaaauaaaauacagugcuuuauaguaaaugcuuuuauguuaguuuuuuuccucuccugauuuuauuuucauagaaaacuagaaacucgggcauggggaacuguuguguccucauggaacacaucccauguuuauaguucugcuuugcuuugagauuuuuauguuuauguguuuauaaugugugauggaaagggagccuuggaucugcagcucgggagaacauuagaaguucugguucacugaaccucacauccuagaugacagcccugucucuccuuagugguugguuagagcuuauacauugccuaagcuguaucuaacucaguccccacuuauuguuuaagaacccaagaguguuuuucgcacuggcuggauuaauacaagcucuauuuggaagaagccaggacuggaggaggcaguggaaagugcgugcgccaugagggacuccuuucuuggcagcaucccuggcaaaaaugcugcugaguacgaggucaucauagugaucgagccagggcugcuguuugagaucauggagguauguggaguggguggaggcuguguguaguaaguuuagugguggauuuaagaucuuggauuaauuuagaaacuaggauuucagucuugcaguacugauccucuugcuaauuguuugaauuugugacauaugcagggccuguuuaggucaguguagaagugugagccuacauuaaaaaaaaaaaaauaauggaaguuuuauuuauugaaggccuggauuuugaaaauuuauucaucuggaucauguuccaaaaaugaguucucuuucauuucaugagaaccagcaacagaaaaccaacacuuuuccuaaaauuuucauauuuuaauucuacauauacacauauacacauauagauauguguguauauguguauguauauauauguguguguguguguguguguguacuaugugugccaucauaaaugugacuuccuuaggaauccuaacuagaugucagaugggagacuuguuacuaccuauuacuaagugagugaacuugucgaaaccaaauugaucuuagucucauaaauuuuuugaaggaauauguauauaaauucacaaacuuaucuggaagauuaaaauuaugaugggaaaaucucaaagggcuuaucagauagccuggcucauuguacacuguggaaaaauuguacuacugauugcuaccugugugcuacacuaaaagcaggucuuuauuuaacagaaucuuuuaaaaaaaagauuuauuuauugauuauuacauauaaguacacuguagcugucuucagacacaccagaagagggcaucggaucccauuaaaggugguugugagccaccaugugguuacugggauuugaacucaggaucucuggaagagcagucagugcucuuaacugccaagcaaucucuccagccgccuauuuaacaguaucuuaacuccuaauagaggaaucaugauuggaaaggaggcucuaaaaaguuggcaguuuuagcuuaacagacaaggguaacugaaccucuuuuuucuuuucucauugcaaaauaaguauaauaaacacgauauagacugggguuuugggggggugggagggacauaguuuucagagugaagcaaaauguauacuccagucaacagcuaaaagugacugucaauuuuuaauuggaacaguaacuuucacaugcauuccagaugcuccaagcugaggagaccucuagcacgucucagcugaaugagcugaugauggcuucccagacgacauugcuggcucaggagccacgggaaagaacugcaggugacauugagcucacggggacauucgucaucaaucuagaaggugagaagagugagcagggacugaauaguugaugucacccccagcuuuccaugggacuaggcuaccucaagacuggcugagccaggucucagggcucugggaacggaagcugaggccgggacaguuccuucucacccaugagugacugucacagagucuuuccccccucguguucugauacagugccuaauguggcccagccccgcugacccauccuguguaaauucuaaaauuuccuuuuaugcauauccuaauuaaaauaccauuagccauucuuauaaagggcugggcagacuuuuuaucacaggauuucugugcacuguucaaagggcugucaccuugauucaucuucauuaacaggaacaguggagaaaguuguggcuccuuuuguguaacugaaguuuugaguaguggcauugccacugucucuagaacuugucguuuugaacucuugaguuaagagcugggcaugguggugcauaccuuuagucccagcacugaggaggcagucagauggaucucugugagggcgacauagaagagacucugucuuuaaaaaacccaaaucaacugucuagcagggucaagaaugagagccaguuccaagcauggcagagaagcgguuggucugagucgacugcucuucaguccuggcccauguuagacacgugggaggcagaagcgcgcgccuugggaggagcguccacgugggaggcagaagcgcgcgccuugggaggagcguccacgugggaggcagaagugcgcgccuugggaggaguguccagugaagcacugaggacuggugguacaagcucagugacuggacaugcucuguguguucuuucaagguggugacauucgugaggagucuucauauaaagucauugugguaccgacugccagagagaagugcccucgauguuggaagcauaccucugagacugcagacgcucucuguccucggugugcagaggucauuggugcaaaguagcaaccugaugucaacagacgacgacacuccccacaguacugacuggcugaggagaugagcuguuagacaguucccuagaaagaaauccaaggcuuacacagaaaguagaggggcagauagaugguagcagaugggguaagaaucagaagauuaaaagaauauuucuuguaacuauagaaagaauaauguauguauauauauauauauggagauauauaugcagauauacauauauacagggcacacacacacacacacucaugacuucuucagagacagacacugaauaugguuacuuucaauguggcagaauguuuuauauuuuauuaaaacuuuuuugacucaguauuuaagcucuaugauaucugaaaauaaaggcauucugggaaacucccagcauaugauggugaagaagcuguggaugacgaagcgugggauucugcagggaguggcaguugugugccucuacaaggugaggggggucaguuccuucugcccacuagcaaacaccaaguuucuaaagcagcaggacucugaguguacuacaaagagcaucaccaaauuguuauucaagaggagaaaucucuguguuccuacggguaugaacaguggaggaaauaacacgaagcguuaauuuauuucacuaauauacauaaguucacaauaaugaauagacaggaauaacaguauauacagaauucacuacuuaacaauacauugacauuagauaaauagagcauuucuuaaacaacccaauacuggauugauuuccaaggaugucuaaucuacuaaguagaagcuaguugcccagcacuccaccccgugagguggaagggcgugcucugcugcugcugugugugcacuguaagauauuguuuccuaaugaaguggauuauagcaacuucuaagugaaugcuauaaucgguguaagcuuacugguacuaaguuuaguuuuccaugauuuuaaaucacaaggaaucauauauuacgaagcuauuucaauguagcaggcuuuacacuggccuuagaugaacuuuucuaacaggucaaucuuugcaaaagugugaaugaagcauugggaagccuggugcuguguacugcugacuacauuucucccggccccuccauuuguacaucuaacauaaccuggaauagagaaguuaggauuauuuaaacaccuucauuaauaagguaaacauauguaaucguaagaagaggggcagugucuagggaaauacuaagguuuccagcacaugccacgcccuuguugcaggacaccaccguguguuagaaccuaauuauuuugugacacuuuguuguuagagaauggauacauacauguuaauuuuccuuucuuaccagaauuauuuuaaaagcccuuagugaaguaguagacuguuaauugcuuuuguuaaacucaggacuuaguuuuaaaauucuaugcauuuuauaaacuuuuuagaugauauaucuaaagacuuaauaaucuguguucugguucauuuagucaguuuuauuccccccaaaaaugcaagcuaccccccucccaaaagacuuaaugggauuagaggaaaaagaccaacaucauuagcaauuagcagugcuugcagcaggaggcuuuccuggcaagcugcccacauccugugccuuccagagugcugcagaagguccuggggcaaguggaccuacucaggacugugucaaggaugguauguaugucagucaagcugugauugcagggauucccgcacaagcuggcugcuccucagagccacccgagcaacaucggaaacauuuuucucugaagauuugaaaccugacagucagcggaguuaguuuuagccagucacaaucuuauuuagaucuaacuuucuaaugacaaagaauugauauuugugugcgccugggugucugucacuuuguuguggagucccugaagaguauucucagccuucuaauggaguuggcuucuucccuugauuagaaugaguaugguacacguacugugagcaaccaugaccauggcagacagcaauaauugcacuauauggcuacauuccagauacacuugaacugcagccagggcuugcugaucugcagagcgcagugcauuuccucacacuugucagcacuuggacugcucuaggcacuacaggguccaacacuagccgaggcucaucuucuccaccuagcugagguagguaugcuaaggcugugacagcacaaagugccccauccuguucccggacaggcaacaugaccaagucccagaaacagacaguuuugaacacuuggaagaaaaauaaaguugaauuuuuaaauauuguuucuuugcuuuguucuuuuuuuuuaaacaugucuuacaagauaauacauuuuuacaauuaccugauguggauacaauuuuggaacuugacaaaauagaguaaauuuuaauuuacauaauaacugaucuugcugcuuuguucacaccucugauuccuaagucuggcaaggacaacagacuugagguccuuccccaaguuccccgguccccugcugaucucaagccauuucuccucugacagcaguagcacccuggacaggaagugguuagcacccagagcucccugccagguggcaucccgguacacgaccaaccaugaggacaucucuguguguuugaaagggacaugggcuguaucucuagugugcucauggaagcagugugaacacacuuaauccccacggaaucauuuggauaggaacuagacuacuacacuaagaacaaaaucugcaaauuauaaccaguaacaauaccaaaguuuaacaauaaaacugcuuauuugaaugaaaaaauaaagaauaaagcaucugcauuagucacaggauaguuaauguguuuauaguuuaucuucagucuuugcugaagauggggaauuuagacaggauugcacauuuuaaaguaauauauuuauuuauuauacaaaaaaaaaaaccuuccgaaguuccagaucuuacuaugaaaaaugacaugcagugguucauguagucacaggacuguaggcuacugucauaaagucgccauggcuuccacggcaucgaugagguguaaggcgaggcuguacugcccgugcuucucuggcaggagcuccaucacuuuaugcacgaguuuagcuguugcugcaauaggcacgccaguguucugaagauccugaggguucu

SEQ ID NO: 580 - RNA, 25699 nt, Mus musculus
cgcgcacgcgcagccgcuguccuucucacagcauuggaccaguggacuuggaggcagccgguucccggacagcgagccaccaggccggacagcgcuuaggggacaccaggcugaguguaaguuucucccgcugcaacgcagaggcucaggcggcccugguuucuuguuguucagguaacugcccaccccuggcacagauuagaggagugccagggguuguaaucccaaacacuacacugcuacacugcucgucguucagacgcuucuagaagcuugaguggccacaugugguugucuaucuggaccuucucuuucauaguggaauaaacuacagaguuaaacuugacuuucgcauccguauuuagaaacuucagaauagcaaagauccuuucagucgucauuucuuugcaucaguaggcugcugugauuuauuuaaccaggaauagaagagcugcgucgaacccauguauacauuuuguuuuuguuggagggcuccaguagggacacguuuccucgaucccugcagacugggcaaacgauuucguguggcaaccuuaaucacuucucaggcuggagguuugcauuucguuuaaauucaguagacugagcauuucguguauuuagugauaagcaccuuucucuuucuggaaauggcuugucaacuguucuugccccaaacaaaacagcccaguuguuacuggggauacaggacuuuccucuccuguuauaugguaugaacuggcuuugcuuguggcauuuuggacauguagaaguuuuaauuucuguguaaauguguuaauacacuuaguuuuauguuuuaauggcccuuuucaaguuuauaaagccauuccuauacuucuuguaguuucuaccuuaauuuaaaucuacuagacugagagagaaaacuguuagacuggcuucaaauccaagguacaugugcuuccagccaggacuuccuggaacauuaaacaacaacaacaaaacccagcauuggcuguguguguguguguguguguguguguguguguguguacaggugccacagguguuuggguggaggauggagggcugcuugcaggagucaguucucuccuuucacuguauuugaauucaaguucucaggcuuagcggcaagcaccuuuaccagcggaaccauuuuaccuggaacguauuuuaauaagaauguaagaaagauccaacuguuuuugaagcucuaccaguugcuauuugugugcgaguggcuuuccuccuuuuccuuucuuuucuuuuuccucucuccuuuuuucuuuugagacaggaucuugcgguguagcccaccucaaauccaggaucuuccugugucucgucccaagggcuaggcagugucauacauucaucugcuucuuucuuggauuuaaaauaccacccuuaguaguauguuuggauucauuucuggaauuuuacugagagauauuguuaaguugguaguguuugccuagcaugcaugagguccaggguuguucuaucuccauauauguauguauauacauauacacacacacauauauauauucggcauauuuauaugaguuuuuggaauugaggauauauguguacaugcaugaguguuuggagaaaguaccacacucgguagcaaagcuagccugaauuuacuguguaacuaaaguuaauguguuauucccaauccuccugacucagcuacccaggugcagggaccagaagcaaggucaccacgcccagcugauuagcugaugauugcguuugauagcugguaauaaggggaucucuauuaauuguucagaauuugcaccaucgugcucauuucuaucuuuccuaauaccuugaacuucagcacuacugauccagguuccaaagauaaguuauuuuaaugcuuuugcugggaacacguuggacacgucugaauccuaaucugcaugcucaccauccuuauaugaauuaaagauaaaggacaaaaacaggugguggugguggugcugcugcugcugguggcggucuccuccuucuccucaccccucuucuuccucuuccuccuucuacugugagaaauucuggucacuugagcuuugcugcuauucuuuguuuuuguuugcuugcuuguuuuuauuuuuuauuuugacacagggucuuacugugugcaccuggcuggccugcucuuggcuucuggcccaggcuguucucaguccuuugcaguccuccgcagccuccuguauggucagauuacaggcacacaucaccauuuuagacuugugcuauuuucucuccuugagagugguuggcagguauuauaaagauuucucgggagcauguaaauuaaguuaauugccuuuuuauuucguauuuuucauauuuccucuuacagugcuaaccuagaauacaaugcagaagaugcucuuucccaucagucacugugucccuccuagggugggaacagccuuugugucaguugcuuuccucaccaaggaguaaaaaauccucagggugcggguguuuauuauuuuggcucaugguuuacuggcauacaggccaucauggugggaaagacaccgugucugggacuccauucuuggugguggaagcuugcaugugacuuuuuacaccuuggugaaucuggaagcagaaagccugaacagaaugcagagaaauggggcaggugucagugcuggaccauaaagaaaccuuaaggcccacuguccagcucuccacuuccucuaacuaggcccacccuccuaaggguucuaccccaguguccuaaaacagcaccagcacuuggugagcaaguauuuauucagacccaugaggccgugggagauaguuacaugcaaaccaugauacucuucuaaaagauacaaagccuuuuuuuuuguuuguuuuuuuugagacaggauuucucuguauagcccuggcuggccuggaacucacucuguagacgaggcuggccuggaacacagaaaucugccuaccucugccuccccagugcugggauuaaaggcgugcgccaccacugcccgacacaguagccuuuuaaaaaauuauuuuaaguuauauguuuuagauucuguguaugugucugugugucuguauguggcaaugugccugagucuuaauucuggacggcuagcuauuggucacaagaugauuuucaguacugcacauuaguuucaguuaaauuguuucucuuccuuuuaaaacgauuuaugagccaggcagugguggcacaugacuuuaaucccagcacccuggaggcaggagcaggcaaaucucugugucuguauuuagauauguacucaugagugcaguagcccauggaggucagaagaggacaucuggucccuuggagcuggagguucgaguauuugugagcagccccauguggguucugggauaugaccucuagucuccugcaaggacaucuuaacccuugagccgucucuccagccccucuccuuuuguuuuuaacacuccuguguauucauacugaauagucagaacaaaggaaacauuaaaaucugcuuagccaguguuguuggaugcuuuuaucuguagucaguaacucccgugcaguacuuacuuaguagucgcagcaacccuguacaaauacgugguuuuuccaauuuauaaguucaaggaugggaguugaagauguggcucuccuaaaagacuacagcuaauguauggcaggguguggacauagagaguugauuccagagucugugucuuuaaugucuaagcuuugaaaggucaugaagaaggagugcuucagguaagacucacagagacagggaaggcagacagguggaggacguguguuaugugagcugcuguaagggaguuaacucagugccuuggucuuuuguuuuuuguuuuguuuuguuuuucaagacaggguuccucuguguagcccuggcuguccuagaacucacuuuguagaccaagcuggccucacucagaaauccaccugccucuuccuccugagugccgggauuaaagugugacaccaugcccggcuuaguuucuuguucuuaagccaccugucgccuggcuuagugccuuguucuuaagccacuugucacaucaaaagguaauuuccacuuggguuccuggggaagacugggauagaaguagaaaggcuaguaagaaucucuuuuauauguuuuaugucauuuuuuucuuuuucuuuauaccaagaaucaaaauuuuauauauauauuucuuugaaaacuaugguaagaaaacuauuagagcuggggguggggggugguaauauuuuucuucuuaugucuuacaaacugauguucuguuuaaauuguaguucauaaacagagugcauuuauuaaggaaaguagugagcaggcaaccugggaauuuucuguuagaagaagaaagcacugcauauaucuggcaagcuuagaggaagugaauuaauccugccugcagcccgcccgcccgacaaggcucagaugauugcugaauaggcuccagggugaaugauaugaaugggaagcuguagcuagagaauuacuccucugucaccacucccacaaguuaaacucucagcaguuaggcauucacugaauguagcuuagugagaaagaacuugauugggaaggccucuggugggauuucccagcauuccuccugcccccccccccccaaaggugcuggguggaguuaguaacccagaacaacuuuaccaguacaaaguucauuagauagauggcuguucacagauagaaaaguugggguaaggccaaugaaauauauauuuuuuuaauugauucuaccugcaauaccaaguauguaaagaaaaucaguguagcuugauuacaguauaagaaaauacccuagauacccauuuuauuuucaucuuaauucugaacagcuagcuguuggucacaagaugguuuucaguccuacacauuaguuucaguuacauuguuucucucccuuuuuaaaaaagauuuaugagccaggagguggucgcacaugaauuuaaucccagcacucuugaggcaggagcaggcaaaucucugaguuugaggccagcuuggucuacagagugaguuccaggacacccagggcuacacagaggaacccugucuugaaaacucggagaggagaggagaggagaggagaggagaggagaggagaggagaggagaggagggggagggaggacgaggacagaggacagaggagagaggagagaugcuggcuaagaccucagccagccccacuggacccuucagagcauccuuuacauuuucuguugaagccaggcuuggugacacauacuugucauaccagugcucaggaggccagccugggcuaaauagugagacugacacauaaccagagaguggagaggcccagcacucaggaagcagaggcaguugggucucugaauucaaagccaccuggucuauacagggagcucucagccugccagggcuacguaguggcaaucacaugcgguugggguuuuucuuggcugguuugguuuguuuuaaacaguuugcacacaggaccuugaguaugcgggaccaaaagugaggccauucccuggcucaccccucuuguguacuuaucagcccuaguguucaaaauagcagcucagcaaggccagauauauuuuagguuuagcuccuaagacuuccacguugcgugauacacgccucacacuuaaaacuuuuucaccugcugaguucauuucucugggcuuugaaaggcuuuguugacuaugaaagagugugacaggguuuaaggauuaauucugaaacugugccuuucccaagucguuuuaguguguauuuauuaaagaacccgugcaguucauugaggcagcccuaagcauucaguuaguacguguuagcuugaauucaguuaaugggacuaguagcuggucucuaaaguaacaaaacauuuccuuuuuucauucaagguuuaucauggcuuccagccacaccguguugaugcggcugguagcuucagcauauucuaucgcucaaaaggcaggaaccauagucaggugugucauugcugaaggagaccugggcaucgugcagaagguacuacaaauccugucuguuucugcagucauaauguuuguucuucauaguagguaaagauugucauauucuagaccaacuaacaauuagaguaauggagaucacaagaucuuaguuuggcugucuguuuugaaaauaacuccagacuuuaucgaagaucuuuguauauauggcuggaucuuuugacugaaguuuaccuccagaacaaacccuaaucuauuucauacaaaaccgugcaaccuuagaacauaugacaugucugugaaaauccaugccuagauaaguauuucuuauuucaucccagcacuugggagaugaaagcaagagguucauaaguucaaggccagccuuggcuauauagcgaguucaaggccaaccugaacuaugugacacccugcuucaagcccaccuccauucucacuccccccacccccaaaaucaggaugucaaagaucgacuucaguacccaggguaaacugaauggggcguagagucagccauugaucacucaacagacuuaucucucagggagcaaagcuugauuuucuggggcggucacgcccugggaccagugagagacucuuugacucuuaaggggcuggggaguaggaaaaaaggcaaaagacgggaaagaauuacacacacacacacauacacacacacacacuugguacaugaagcaagacaagcuccaacaacuucacacauacauacguacacguucacacauuggguugacagagcaaagcucuaaccaauuuuacauauaugcauacaugcaugcaagcauauauguguuugguggauggagcaaagcuccagcgagaagcucuuaacaacuuuuuuuuuucucccacagcuuauauaucccagcaaaaucucuccagcagcauaaaauuuacaaugugauuuacauucugucuuuuuuucuagugaaugauuacagugggaaugcauaaguaaaacauguuccccugcacccucaccugaccaaaugcucuaugaaauauggauuuacaaaacaauuuauucccaagaaccugcauacauuuguaacuaaguaacuuguuauagauuaacaaaguauaagcaagcaagguaguuuucucagccaguuucuuuuuauuggcaggcugcaauuugcaguuacaaagaaaggaucaguuauuuuauuauucaucuuaaaaaguaaucuuacauaaaucuuaaaagaaucacaaagcuaaacuuuuauauaaaaacaaucacucauuucuacuuuaaauccuuaggcugcauuaauaucuacucauuaucaguuuuuuauuaaauuauaucaggaagcugagggcaaaaauggauauaagguuuggcaagagggucaugucaguuagcgucagucaggccgcuauuguucuuauucucugaccaaacaaacaaacaaacaaaaaaagccucguucaacuauuaagagugcgccuuucuaaacuugaaauuguuuucuaagauuuucuaaaucagagccacuggcaaaaacaucuuaaccucacucuacuaacaaucuacuucuccaagugcuuucugagggugguggccauugcuuacugucugcaucucuaccuucuuuccaaggauggugaucgaggcauuugucugcuccagcagcaaugcuugaaaacgaugaagcacucuaguugugagugccaaugauguuucccaguaaggggcuuggggccccuuagcuucacacaacaguagauuaggaaggacaugaagacugaaaaggcagcaagcagagagaucguggcagcaugaaguccucgggacgugaaguccucagcucuguucugggggcucuaccucuccaaggcucacccaucccggcuggacuaauuccauaaguuagaaucccacgaguucuaaagcugcuuugcugcuccucuugcacggcccucagcaacagggguucuuucuaauacauuggagaaucaucuucaggaugucuugagauacaaggaugauugagaggaaguuagaggauucucauugauaauagaguuuuagcuucacuuugaaacaguauaaaaucuauuucuuugagacagagauuugucgugcugcauuggcuggccugggacucacuguagaccaggcuggccuaggacuucuggcgagcuugcuuauucugcuuuccgaguaugggguuguaaaaagcauguggcaccacacugggguuucccgacuuuuagcccauuuaaagcagguuggaaucuagaaccuuaugaaagaguuucucaauuagagaagagaauauuccaaauaauuuaaaagcaccuuugcaaacuugaacuguuguggagcugggaaugcaguucagugguagugccugcuuggugugugucaggggcgugugugaucucuaucagcacacacacacacacacacacgcacgcacgcacgcacacacacacgcacgcacacacacacgcacacacgcacgcacacacgcgcgcacacacacacacacacacacacacacacacacgcuguuuuaaacuaugauuguuuauugguauacaguuucacacgguaguacaagcugaucucagauucauggcuguccuucuauguccugauauuagagccgugcagugcuauccagccucacuucucagucuuuuuuguuuuuuguuuuguuuuguuuuguuuuguuuuauuuuuuugagacaggguuucucugugaagcccuggcuguccuggaacucacucuguagaccaggcuggccucgaacucagaaauccgccugccucugccucccgagugcugggauuaaaggcgugcgccgccacgcccggcgucacuucucagucuuagcugcuguuacuucucugagaagcagcgagggcccucacuaguugaucccugggcucgggucugcguuauacuggggagucggaagacugguuaccccgauuuguacugauacggagauuugcauucuugguuacagaccucggccaccgaccugcagaccaaagccgaccgcuuggugcagaugagcauaugcucuucccuggcccggaaguucccgaagcugaccaucauaggggaagaggugagaggcgcgcgccacuuggauucauacccuaccugccauugagccguagguuauggucagucuuagcguuggcacuaacguuccaacacaaagcgaucguuuuccuuaggggaaaaaucugacuuaaugauauuuugguccacuuaaugggcuaagucuccauuucuagugaugggagcuauggucaccauuguaauaccauacgauggacucaguggcagaaagucgccuacuguaugugaggcucuaaggugggagacaucucagucauaagaccauguggcucacauaugugagguccuggguuggagccccugcaucagcaguuauaugugaagagucggcaagguucuggaacucugagaugacugggcuugguuugcuugucugcuuguccgucauuucagauuggacuuguguacuuacaacugaaacaauagacuauguuuuaguuuuguuuuuuauuaaguuaguucguugacaauuuagugcauacauguaauacauucugauuucccucauacuucggauucuccuccccuccccuucuuccuugcccgcccccucuucccacuuaguuuauucaggaucauccaugugaccauuucauugggaccauccauuggucaucaguggugcacagcugaaagcaauggcuuccccuuucccugaaucagucuguaggaaauaguucugcagugaaggagagagagugcuggucugcaucucuccuccaccucugcuuaacuguugggacucauucuuucucagacccagcacagucaucugguuguugagaguucaugcuugcacuggcucgcaccccaguaaugacguuuggcagcccuucuccccguuuuucagcucuuaccaucuuucugccccucuccuacaaagccugguaaaccuuagaggggauaaaugucuaaauaucuuauucagagcugagcaaucagcuguaaguuugucuuauuaggccuucauauaucucucccuucauuauaguccucuagaaagagaaucuucucugacuaaggcugagugguaauucgcuaugugaauaaacaucuauauuuaggaagcuguuugacacugugugacuuuaguaaagcuguagaguuuaacucccuaagaggacucauggccucccuuuuuauacacugagugggucuccagacauggaguguguuuaacguacuaagcguggauucccaugcuggaguagcccucacauucgaucaagagcagguaguuaccccccaacagugccgacacuguuguuguaccagugagcacagcuugccugacagauggugcuguaguuugucaggugcacagaugggcaauacuuucuuccccagcagccugcagagaaaauguguucaggucugacuucuuugucucaugcaaccaaaguguguggugucauuagcaguaaggucuuagcaucuaaugcuagugggcaaccaagaaaaaugacaaugccuauauugucuuagggcagugggaccuccgugaccaacuuaucaggaggcaccacacacacagcaggugggguuuuaaugaaggauaauuucacaggggagcaguuucuaggucucucucuuccaacuuaaaaaaaugcauccuaguuauugugaguaaauugaaaaucaacagauaaguuaguuuccaacagugcgaugucaggccucuggacguguggaagacagcaguauuccauguacugggauagcuggccaugugccggaacagcugggcuacggaugcuguucuuaguguuguaaggaauugccacaccaguuuccauauggcugcacugguuucccaccagcaaugaaggagucccucuuuuccacccucaccagcacugccugucuugagguuucuuacggauugccauucugacaggacaagaugaaaucuuagagcagcuuuaauuuguacuuccuuuugugcuaaugaugucaaauacuuuuuaaaauguuuauuuuucaauccuauuacuuuugagaauucucuguucaguuccauagcccauuuuugcuguuguuuguugacacagggucuuucucuauguaucccuggcuauguagaacagaguuaccucaaagcugacagagauccaucuacuuuuaccucccaggugcugggauuagaggcaugcagauuuuuaaaguuauuaauauuuauuuguguaccugugucugaucuguguauguggauggauguuuugcuugccuggauagcucugcuccacaugugagccaguuaccugcgguggccagaagagggcaucggaugcccuggaacuggaguuaggaugguugugagcugccugugggugcucgagaacaagccuggguccucgggagagcagcguuguucuuaccuccuagcccacucuccagcuccggggguugauucuuguucaagacagcagagaaggcucgagcuucccucuucuccguguagacauccagucuucccagcgccaguuugagaugcucccucucccuucguguauuuuugguguguuuuucaagaaucagguggcuguaauuguauggcauuaguccgggguuuccauucuguugcacugaucuacacaucgguuuuugugccagcaccgugcccuuuguuacccugauucuguaguguuauuuuggcucagaauuuuuuuggcugccugggccuuuuguguuuugcaucacucauucuaccgauccaugagcagggagaccuuucaucuacuagucucugccuugauuucuuucuuuagaguuuuuugagacagggucucacauauaaucuuggcugaccaggaacucaguguguagaccaggcuggccucaaacucacagaguucugccugccucugcccccugagugcugggguuuaaggcuuaugccacugggccugggauuuucucugauuuuaaaguuuucauuguagagguucuucacuucuuugcuuggguuuccucugagguacuuuguuuauuaaggcugcuauaaaugggauuguuuuucugauuucuucuucaccuuguuugccauugguauaaaaaagcaugccauguguguauccugacacugcagaaguguuaguaauucuaggagcuuucugguggagacuguagggucucccauguacagcauuauauucucuguagacaggaacacgcugucuucuuuauuuccuaccuauauuccuuucccaucuuguuuuuauuguuuuagcuaagacuaaaacaccaaaucgauggcccugucucgcuucuaguuuuaauguugauguuuguuuggcagggucucguuacuuagcccaggcuggccuugaauucuuccugcuucauccaacccagugcugggauuaccaguacacaggacucuauaaaaagguuuuuguuuuuguuauuguuuuuauuucucucuucucugcacucacauugccccucuggugcuggagaucaugccagagucucgugugugcugggcaauuacugaccacugagcuggaucccaggucccuuguguaacucaaugccaaguucauucccacugucucagccucccagcauuccaaaggaaauuggggaaacagaaauauguaaaggaaacuggauguauuuacaauuuuagguaaacagauaugaggaaaagguuuuggguuccuucuagacguuccugagucaggguuuacauguggcuaggacccagccgugaggcuuucugugaggaugcuguuccucgugcucauacuucaaacuaggauggaagcuccugggccaauccuagcugcucacuuccucucuuucggcuccugccagucuuaugcuagguuugcuauaaaagcucuaaauauuagagaaauuaaacagaaguggcuaggcgucccauugcugcguauccuguuagacagccacacgaugcauugugggaaccaacagcuuuaggagugucaccuugccuuugcucuaggaccugccuccuggggaaguggaucaagagcugauugaagacgggcagugggaggagauccugaagcagccgugccccucgcaguacagugcuaucaaggaggaagacguaagguccaucugcgugcuuugugcucucuuaguccggggcugcugccacugggaagcaaaaacaguuuguccauaagauggaaaguuuguggugacaaaauaggagcagccagucauggagucugccagaaccagcagaaguagcagggaacacauggaugugugaccaacccucagcucucugcccucugcagaucuccugucuucugaaaccauuauuaaaaguagguuucaugagagucuucgcucuuagguagauuugguaagaaagcauuaugugggcagugggacuggucauuucugaaaaccauagacaucuugucaguugggcugaagggguggguugguaguuaagagcugguggugaggacccagguucgacucucagcaaccacacuggguggcuaacacugccuguuccuccagcuccagggauccugguuuuaaaucacucaacaucgcacuuacagaaacauuacuaugagggauaaauucuguucugugggaagaaggauaaaaggauaagaagacaugauaucagaagccacccacugugcugagaguauaugggaagaaauucuggcucauguuaaguccuaagccagagggauuucucuagucuagcacccaguuuacaagccauuccauuuuccuauguuacugugauuuguguccuuaguguguacaggccaagcaugguggcacguaccuauaguccuagcacuugagaggcagaggcaggugggucugugaguuuauuaaggccagcguggucuguguagugaguuccaggacagucagggcuauguagagagauccugucuuaaaaacaccaaaaaaaaaaaaagaaagaaagaaagagaaaaaaaacuccgcaggaacauguuucuauguaaaugaguaacgacuuuacacuguccacgcuguucucagcgccuugugggaacgucucccuguagcgccaucuagagagaaguuagagcaugacuuugugcuuaguggucgagguacugcuuacaguggacauuuaucagcuaagaacuguaaacucgccagggcuccuaagucaggcuuuguuuacuuuaaaggacucacuccaugacugugacagagcugacgaugguggcuuaagccacccauaauaauguguucaaacaucuucaaagggguagucuuagucuauuuaauucucugaauguuacauacuuaauauggacauugccucuuuuuuccccauuuuuauuuugcagcuugugguuuggguugaccccuuagauggcaccaaggaguacacugaagguaagugucucuccuccacacguccuacacucgggcugugacacacacggugccauuccugggucagaugauaguugcuguuguguucugucuguugucauacacuagaagagcucaucuccagguagcaccucacauacucucccagcuccagagcugaggccccuccuggggaaucacuguuguacacuuccuuuccugagggacugugcugacaugucugacugggcuagagaaaugcuccaccaccccuggucccauagcauccccucaccugagguugucacggguaagaaaaccagaaggccucgaauuaaauccagagguguaaaagucaggaggaguugugugagagcucacaccuguaaucucagcacacuggggcagagggacugcuuugaguuugaggccaucuugagugcuauacaugccaaguccugggucagccuggguuagagcaagaccuuuucuaggcaaagcaagacauuagucagaagaacccagucucagagcuggacuucggguuuuauuuguuuguuuguuuguuuuuauuuuuugagacaggguuucucuguguagcccugguuguccuggaacucacuuuguagaccagacuggccucgaacucagaaaucugccugccucugucucccgagugcugggauuaaaggugugcaccaccacugccuggcuuagacuucaaguuuuaaaagccuagaguuguaguuuugaaauaaagaucugcauugagaacuugugaggcugaggcaggaagacugugaggucagccuggccuucacagugaguuucaggucagccugagauagaggagcagugugaggccagaaggaccccacaaagaaagaccuccacagcgcugcuucuaacggguccagcuucgaggggcuuucucacagcugccagagagaauuuuguuggccccuggaggagauagagugauagugacucuguguguguguguguguguguguaaauauauacuguauauacugugagggugcaugugugcaacaugcauauguacugugaagaugugugagagccauuguguucgcaugugugucugugaguauaacccaugcguauguaaucuaggggguguacauauauacugugugugugugcguaugagagagagagagagagagagagagagaggugcauguacucugugugugcugaaaacaucucugagcccauugggaagcaggaaaucuacccuagagcuuugauuaaccccuggcuuggggaaggggaguccuacauguuacagaucacuagugucacaugucacagaucaccacugucacacgcuacagaucaccacugucacacgcuacagaucaccacugucacacgcuacagaucaccacugucacacgcuacagaucacuacugggugauccagugccaugugcugaucucuugucccaaggcuggaaaguaaguggggaagaacuagguaguuaguagccugguccugcaggucagagcgcacuggaugggacagaaggagcaagaggagucuagucacggcuuuggcacuguggcuuuaaugggucugcaaacuaaggagaguguggucgugguugucucuucaguuuaguggccauaauccccacuucugucccuguccaguuuucuuagagcuggugcauucgccucaaguagaguugcccauggguaaaucauugcaaaucccuuacccugacugcaaaaaugacuagcagugagguggggugcacacaccuuucaucucuacacuagggaggcagaggcagauggaucucugaguuugaggucagccugguuuacagagcaaguuacaggacaaccagggccacacagggaaacugccuggaaaaaccaaaagcaacgaucgugaucauaaugaugaugacauggaggaggaggagggggagggagacuaccagcuguuguuugauguucuggugguaaacaagaaccugggagagugauugacuucugcccuucauaggucuucuugacaauguaacaguucucauugggauugcuuaugaaggaaaggccaucgcaggcaucaucaaccagccguauuacaacuaccagguacugcuaccaacgacacgaguguuagauacauaacuauagggucuaaugaggccaucgccauccaguccaauugccaucucgcccauuugcacaagcagccacauggggacaggcuuccugggguauagauucccagacugcuguuccuguuccccuauauaaacuagagcuuccggaagguuuuggggccaggaacacagaugggguaaauagacuguguguacugaacugucacauauuuauaauucgguugcaguaguucugagauuacccauuugguucuugauuagcauggucaucggggucacagguaguucuugaagcacauuugaagaagcaaaccacaucagcaaagaggagcugcuagccauguugccucccaaguaagagcaugcagugccugaagccgucaguccagucagccagccagcggugcuuguugccucuucuucuuccuguuucuuccagccugcuuugacuuucugcugugcuucagagacacugucuccuuuagaaacaagagaggaguaaacuuucagagcaagaauauaucauugaauucuaaagaaaucauugaauaaaauauuuagaguuuucauauuaguguggaaguugaugaacuuuggaaaacuaaacagaguggggaauaucugauucauagucauuuagguguaacuaacuuuauuuaguuaccugcugcuuauauggcuaggaauuugauuuauuucaugggguuucccagagugguuuugcauuguuaggcgagucagacugaagugcucagguguuaauccuuauaguguucucugcugucugcacaauaguacacuugggugcagguuuguaauuuuaacaguccuuaaauaaaggguauuuaauucauagggaaagguacgcauggucccuuccaucuauacuagagacguaaguacuuaggaauuguuaauguuuucaucccuuauguccgagacuagaaaaucuguauucguuuuccacagaacaaugaaaaggagaagcucagagagcacgggaaugaagcccaggugaggcccagauagcgcgggcgccagguccagggaaggaagaggcaggcgcugcggcacccgggcuguccugggagccagcucauuuccuccugcucugggcaucuucuuccuucuuccaguauucgcucacccucuuugcccucugugugccuuaucguguguugcaacaaguagaaggggaacgcuggcugcugcugguuucuaaggcuggugaugcauagucaucagcuuagcuguaguuuaucaggcccucgcugugauuggcaugugucagcuccugcaauacucacuacauagcuguacauauuaaagaaaaggauacuaguggggccagagcauuguaaguucaggggaguccugggcaacagaaugagcucaagaccagccaucaacuaagugagaccaucacaaaguaaauguaaaagaaggcuggggguguggcucagcacagucgagugcugccugcccagacuggcuucaucucagaauucuccugcuucuaccuccuacauguugauuaaagccucaugagugucuagaacuaccaugcagccugugggaacuuuccagacuccagguuuccuggaggaaagagaggaagcacacugacauuccgagcagcuaaucguugguuuugguuccucuguugccccaaugcaggaggcacagucaguagucagccuucucagagauugccuccccgugaggagucuucccauuccagucugcuucccauaacuagaagugcagauguguaaaagccuggcguguccucauggucacagcaggagcugucaccuagcucacugcagcccauguccccucugcccacacuguugccuucuguaggugcugaucccacaugcauuccuugccagccauccuccugccccagacucuguuucccagggcacacagccuguagcauaaaccugcuucacccugcaagcauccguguacuucccuaggacaaaggagcaaugacuuugaaaacauuuggacaagucggcucugggugccccgugucugcuuugaucagcacaguggcacuaaccugugguccuaccuacuugggagguggaggcaggagaaucauuucaaggccauccagggcaauguagugagacccucaucucgcaaacaaugcagggcaaaagcagaagagcuuuacagagcugcagagauggcucagcaguugggagcacuugcuguucuugcaaaggacucagguugaguuaccagcacccacauggcugcucacagccaucuggaacuugaguucgaggcacauauggugcacaaaaguacauguaguccaacacucauacacauaaauuaaagauaagucuugucuuuauguguaugaguguuggacucugguuccaggucagccauggcugcauagugagaccaugacuccagaaauaaaauggaacaaaugagcuggauguugacaggggcuuccuaggcuccucagucaguuuauuaacugacucuaagucucauuguuagggauaauggcaucuacuucugggguugcuuugaggaucagaugaacuaauguaugcauaaagagcuuagaacuuagugugguucuaacacauucaugucaggugagccccaagccuguccucgcugugcaaaacccaggcuaagaugauucuggguugaguuuguuguguuagcaucaauuuuacaaaacaguagacuauguuuucuaaaugaaauauuuauuuagcggugugguugagaggucuuugagcugcacaguggagaacacagguucuaagauuguauugucacugucguucuaugagagcagucaucauuaaagcuuuagccccgucaccacuguccaaggccuugagcaaagugcagccuuccuuagguaacacagguccuaguguuccuugaauaaugaaaguagggaccaguacauaguuccauuuccuggaacuuugguauuuuuuagaaauggccauguucaguucaacagacagaucagugggugacuccaaaacaaacagcaaccgaauuaugaaggucacuuccugaggaguucuuuaaaacuguugaccaaaguaguaaugaggaaaaucagaguauugccaggacaaauuacuuugucuaucuauugcccuuauauuuuauacaguuguguguuuuuaacuauugaaacuaaaaaaauaaguccuauauuucaaacuugguaacuucagcuaagucuagcuggcugacuguuccuuuguggcugacgucuuuccccagugacugagccuuguugucaucucacacaggcaggacccgacgcggcgcugggcaggaccaucuggggaguucuggguuugggugcuuuuggguuucagcugaaggaagccccugccgggaagcacauuaucacaaccaccagaucccauagcaaccagcuggucacagacugcauuuccgccaugaaccccgacaccgugcugcgagugggaggagcaggaaacaagguacagagaagugccauuggcucugaaguaugcugucauugaaugaaaugcugagcuuauaaaaaguugaaguacacggagccugguggcacaggccugucaccgcagcuccucagaaagccaaagcaggaggaccaaagguucgagccugccugggcaacuuagugacacugucucaaagaagagcuacaaaaagagcugugaacaaagcuuuguggcagguuugagucccugaguuuaagcuccagcacacacagaggaaguaaaguaaaagugggaaagaggcuacauauuacagaguuugcuacuggcaucucauucaaaauuacagaaauguaagguaaaggguugaaguuaugucucaguuguacaacacgaauguagcaugaacaagacacuggguuggaacccaacauaaaaaagaaaaagaaagaguuuaaggcucagucucguucagaugagaacagcacguugcuugccaaggagcugagugcccgagagcccuccuggauucucuguagaccguccuucuauagacucugagcaugggccugccucugccuuuucugcuucucccccauucuucagccaggcuuccagccugaucagaguaucaugaaauggaacacaguucaaccuacuacacccuugaucuccuucucucauuguacccuggugucaugaugucauccuggggacaucacucagcccuucaaacucaucacguccagauggagcugucacccuucuuccacuggcaccccacaugcugcuugagugacaccuccauuuccauaauuguaccggccagauaccgaguccccuuccuucuguacaccccaccacccuggcccgguaccucuccuauugccuaccuaaguggacaguugagacuuaucaucccagaguacuaguauagccuccuccaaaaugguccagcucuucacagauaccaguaggcaguuagaugcaaacaacagccaaguguggugcugcgugccuacagcccuaacgcuggggagauggggacaggagaaacaggaacucuaggucauccuuggcuagaaaucauuugagacccagcaugggcuacaggagccucugucucaaagaaaccaaauaauagcagucaguaguaaugacucauaagugagugagggaagagcaguggaucgggguccaaagccccuggaggggcgcguuggacuugcccacuguggcgcuguugaagguuucucuauuacuaagcauuggucaguugcuuuuagaaauuuaagagaaguacuuguccaauagcgaguauuuguguccuuaagaaaacccacgugagugagaaaacuugaucuuccuugggcuauggauuguggcuuauuugauuguguuuccuccccuguagauaccguguacuacuaugcaccuguuuuauuucuuuguauuacugguaucauuuaaccuguucaggacuuugaucuaagucuaacagggauugaugaaaugucuuuaagaggcacgagcaguuuuucuuucgggccacucacccguuacauggugggguaacugauauuuuuaccuuacagauuauccagcugaucgaaggcaaagcuucugcuuauguguuugcaaguccuggguguaagaagugggacacuugugccccggaaguuaucuugcaugcugugggaggucaguccgugugaucuaggagaagguggcuuuuguuuguacucaggcacuguuuccgcacugguuuuugucauuuuauguguauggguguuuucucugcauguauguguaccacaugccugccuggugcucuuggcuagaagaggguguuagaucaccuagaacuugagucaccaacaguuguaagcccaugugguuauugagaaucaagcccacuugcucugagagaauagcccaugagcgucauuuucaacuaacauaauuuccuuuacuuuauauuguuugggaagagcggauuuucauauucacacgguuauuuuaauuuuuuuuuaaagauuuuguuuauuauauguaaguacacuguagcugucuucagaucugauuacgggugguuaugagccaugugguugcugggauuugaacucaggacuucuggaagagcagucaguacucuuuuuuuguuuuuguuuuuguuuguuuguuuguuuguuuguuuuuucgagacaggguuucucuguauagcccuggcuguccuggagcucacuuuguagaccaggcuggccucgaacucagaaauccgccugccucugccucccgagugcugggauuaaaggcgugcgccaccaagcccggcuagcagucaguacucuuaaccgcugagccaucucaccagcccgguuauuuuaauucuuauuuuguuguuuuugcuguuuguuuuauuaagacaauauuucacuuuaucccuggcuacccuggagcucauugugaaauccaggcucagaaauucagagcacuuuccaaagaacaugaauucaguucccagcugucuccugucgagugauuuacaauaaccuguaacucuagcuuugagaugcccucgucuaacuuuugcuggcacagauguguguacaugcaaaggaggcggggggagaaagggagggagagagagauauagagagagauugauuuaaaaaagacaacuuuaaaaauuagaaaacagaugaugggcuaggguuacagcucagaggucaguuccuggccagcaugugugaggcccaaggucuguguuaccuucacacaagcuggagucaucugagagaagggaaucuccguggagaacaugccuccauaagguugggcuauaagcaagccuguagggcauuuucuuauuuagugaugggagagggcccaguccaagguggguagcuccacccuugcuggugguccuggguucuauacguaggcugagcaagcuaacaagcagcauccuccauugccucugcaucagcuccugccuccagagcuuccugcucuguuugaauucccaccuugucuuuugucagugaacuguggcugaggauaaauaagccgaacaaacccuuuccuccccaacuugcacuugguuuucuuuuuuugucauaaacaguaguaacccugacuaggacagacagacagacaacagauauacagaaaacguucuuuauaauaagagaagcugauaccaagaaauuuaacuguguggcuggagagauggcucaguaguuaagagaguaacuguucuuacagaggacucagguugagacccuagcauccacauaguggcucacagccaucuguaaccccagucccaguggaucuggugcucucgucugacuucuaagggcccucggcacucauguguuccacaauacacacgugcagggaaaacccuaaauacauaagauaaaucuucaauuuuuccuaacucuaacucuaagaaagaaaucuguuuuguuuguuuguuuguuuuggggguuuuguugguugguuggcuuauuuuguuuuuuuaagacaggauuucucuguguagcccuggcuguccuggaacucacucuguagaccagccaggccucaaacucagaguuccuccugccucugccuuccaugugcugggguuaaaagccuguaccaccaucacuaguaauaaauuaauuuaaaauaaaauaagaaagacauacagacuugagagcaccaggcucagugguagggcucacauuugguguaccacaggcacuggcuucaaucucuaguuccagagaccggggaaaucacgaggauauugagguggaauaggccugugaucuagaauuccugagguacaagcaagaucacugcaaguucaggaguaaccucccuaguaaguuccaagucagccagggcguuagaaugagcguacagugagaucuuacgucaagccugcacaacuuagacuuuuucucagaaauaaaaacaaaagaagaaggcugacauaguucaguaguaaaaccugugcuuagugugagcccugggguuuaguucucuccauccugucccccaaagaaugacccucgaaacauccugauccagcuguccacugacugugauguucuucugcagggaaguugacagacauccaugggaaugcccugcaguacaacaaggaggugaaacauaugaacucugccgguguccuggcugcacugaggaacuacgaguacuaugcaagccauguuccagagucggucaaaaaugcgcucauuccaugaaggggucucacuuacccagaggccuugguucaaaggaacacaucuuaauacugauuacuaauugaacaauuggagcucugccugcauuuaucauugaucagcgauuuauuaguaguuagggauagaagauggaauuaaagaauuuucuucacaucaucuaauacgcuuaagacuuaaguauaugauacgauugucauuucuccugccuaaaaacaaauuagccaggugugguggcacuuacaauagucauagcuacuccagugguugaaucagaggauugcuugagccuagccuccauuacauagcaagauaugccuaaacacagagaaggaaaacaaaaaaggaauuuaauuuuacuaauuagcuaacaggaccaguuguuuuuuuuuguuuuuuuguuuuuuuuuuuuuccuuucucuuguuguuugggcuuuuuguuuguuugcuuguuuguggguuuuguuuuguuuguuuauuuuuuuguuuuuuguuuuuguuuucaagacaggguuucucuguguagcccuggcuguccuggaacucacuuuguagaccaggcuggccuugaacucagaaauccgccugccucugccucccgagugcugggauuaaaggcgugugccaccaccggccggcauuguuuuuguuuuuuugagacaggguuucucugugcagccccagcuguccuggaacucacucuguagacaaaguuggccuugcacucagagauuccccugccucugccuccuuagugcagggauuaagggcuugccccaccacaccuggcucaaauguuacuauuucuaagugaagaaaugaaaaaggguuaguuucaaaugacuguccaagucauuugugcagucaacauuccugcugauaaaccagauuucuucagggcacagagucuuaaguuacuccagaauuucaguuguuuuguuuuuucacaguaauuuuuaaaauuucugauuccaaauaagaaugcauauaaugauauuauuuauguugauuuaugggggaaaguuucucuaaaauacauaguccuaucuuuucauauuauauaucagauuuuuuucaaaaguauuugaaaauuauaaauaaugugaggauuaauuuauucucuuguuauuaaaaucuauaauuggaaagcuggguaauugccuuuauuccuuccccugagagaauguacaaucaguuugauugucaccuucaguagacugag

SEQ ID NO: 581 - RNA, 65319 nt, Mus musculus
cguagcgugcgcaccgacuccggcgguggcggcccguggggaggagucagggcugcggugccuucggucgcgcgcacacguugcaucuccuugcuuccaccugaacccucgccgccaggaaggcagcccgacgaguagaccgcagcuccugggagauggcggcgcugugccucacggugaacgccggaaacccuccgcuggguaagggcgccgccgacccgcgcggguugcaucagcgcgugggugcggggcuggugccgcggcggucacgccgaacgagccucccgccccgggacggacgggccuguucugcucugcggggaacccagccccgcguggccccggccucuguccgcucggggcgccgucucccgaggcccgcugucccgggaguggggggacaggaccagagccccgcggggagacacgagacuauggcugcgacucugccagggucccaaguggcuuuugaaguggaauuaaaaccccaacugucuguccggcccguccuuuuaaugcgaucuaggaaccucccgccccuuccccaccucucaggagaucugaauucacuugccccacuuucccuucgguugucgaguuaaagggagcaagguagacuuuucugucagcacuuggaauuuuuacugaggcugcguuggcuuguggucgaaggcuguaauuacggaaagccguaggaacgcugcggacuaaugcuacuggcuguuuuacuacacaccccguggacguaguccaggcucgaguaaacgucauccuacguuccauucgaaauugauuuuucaaaguggcuaacgcuauugcuagcuaguuuaaaauuucugucuuuucauuacuuugggaaacaacccaaaaauuuuaucauguagacuuggaaguacuuuuucuaauacucaaaaagucagccccuugaauacaauuggccauguggggcugaugaaauuucuugcaaccucaacuuugacagcagucugcgccuauuggagugaaaagacauuuauuuauguauuaaugcgcugggaaacagcucagggagcuuugcauuguaggcaagcacuugacuguugagccacacucaccagcccuaaaaauagacuguagcaaucgcuugaaauguucuaaaaugauaacauuuuagcauguuaguuccagucucuguaugcuaaccucacaacaaauccaugagcccugaaagaaguagaugugauucuugguuugaaacggcacuagguagaugaugcugaccucguggcuaauccuggaggccugaguucugcccgcugcggagugcaguugagauuccuugauuuguucuguaaggaagaaggaaaccuuuccagcgcugguugccagaauuuagugagacuacaggaagaguuuuuucacauuuuagcuguucagugcauagcuaaacuauagguuugguuuuuuuuuguuuuuguuccccccccccccccccggagggguggggugugugugugagguuuuuuguguuuguaaaaacugccuugaaaaaucacugcaggggaccaugaagucuguauccuuaaaacucagaaucaaauucugcugguauucuggaaaacacucuuaaauuugguuugcauuuugaacucuaagccaguuagagaauguauauuauuuuucugcuugcaccucuuucucuuauuuuaauuuuuuauugccuauagaucagauauauauucucuuuuaaguaauaaaauuggauuaaauauuuagaaaaaacccaucacauugugaggauuuuauggcuuuaacaugucauuuugugagagugugugugugcuaaaacacuuucaaacucacacauagaacuuuccccauccuacuuaagaacacagagcuuauuugaugcuucugccuccagaauacuucuucggugucuccuacaggcaaggaaucucucccugacuucauccaggaaguauaggcugauagaauucugccuaaugcucagucgucuuuguuguucuggggcugauuguucuaaguaguugccaggaucuaggaggaccaugcuuuauuugcccuuuacuguccuuuuucacgucuucuuucaauguggaaugauuuauuagcuugguuuuaauagcguugucuccugaagaugccaaaccucuuacuuauguaucccuuaauuggguuguuaaauguuucccagugguuggcgucaagcuguccguccugggcagggaugguggaaucauuccugcuguacauugccagcccagcagucggugugugaauuugauuuguccguucuggucuugaacacuuauugaagugccaccugccugucauugugcuguccaccugccacuaccccggauguaaagcuuucucuuucaaccaaaggcauuuuuaguuuauuuuuucauugauuuauuuauuuguucacuuuacaguccaaucgaagucccccucccuccucuccuucuagucccacccuuacacugccuuccccaguccucucuucccuuuucagagaauggaaagcccccuguggaucuaggccacugaggccagacaagacuccacgcuaggguaaaaggaggcaauagagucagagacagcccugcuccaguuguuaggagauccauauggagaccaagcugcacaucugcugugugcauguugaggacaaccaaaggcauuuuaacugaaagaacuuggggccgugcaaacauuucucucuucauugguuucggcuuccauuguuguauccugccuaucuggguuauuaaagagugugacuuugcaauuugacauuuccuuucauguguaucagcaauuuucucauguuacauucauaacaaaauguaugugaaauacuucauuuccuauuuaaaacuaauuuugagaauuaguugacuuggaauuugcauauaucuaaguucaccaaugguaauuguaugcuuuaauauccaauggcaaauauguauggacauaugugauauauaaaccuccauaacaauaaugccaaauauucccauuacagaaaauucucucucugucccuggcaucugguagccaguuaccugauuuuuguuguuuuguuuuugcuuuuaggauuuuguguacauugauucauaccauauaugucuuuauauacacaagauagugcuuugugauacaucuuguugccuauaacaauaguucguucuuuuuauaugcgagacagggcucccauuuuggauaugccaaaauguaucucauuuacuuggauuguccuaguuugucccuccaaauuuuugucugcuuuuuaaaaacauguuaccuuugagaaauccauuguugucuuagucugguuugugcugcuuuaagacaguaccacagacagggugauuuguaauggacagaaguuuucuggcucacagcucuggaggcugaaaagucuuaagaucaacaagccaguuguagugguagucuugcugugucauagaugcuugaggaaggggaagacagaacagccccucccccucacuguaucaguucuuuccugaagguucagcuccccuucacccuuccaucguuauugagccuagggccucaagcauuccaggcuucccuugaauuccugauguuccugccccagcuuccagggugcugggaauacaggcaucacgcuugacucuauaggacccuuucuuagacugugaccaggguaacuaaaucucaacauacaguuuaacaggggacagaccuacaaaccauagucaacauaacuuagauagugacagaaacacucaaaucagcacacuuguuuucuauuauaauaagcugugcaagauuauuguacuuucuuugauagggccuuauucccaguagagcauaguauuuacauagaauacuaugugcagaauaugugucugcuaguuuuccaucuuaaccaaaaaaaaaaaggggggggggacacacaggaugggugaauuuacucacuguuaggugcgggaagacagcguuacagcguguuuuagaauuugagaucugaaccguuugacuugcauucacgugcugacugcugaauuagccaaggggacugagccugcuguuuacccucuguaagccucagcuuccucuugagguugcuagaggauuaaaaguugugugaccaucaugcauccagcagaguacauaacauguuguauugaaauauaaaagccaccauucuaauuucuuacccucuucuagcggaggaaaggaauuucaugccacuaacuggaagcuggacacgguuacgagcaaguuagcuguauuacaacagguucugacuuguuacuucucuaagacccaaauuagacuuuauggugggcaggagucgggggcauggagggcugucacaucuuaacaggacuuaacauuggauuguugauucauccuuacugcucugugacucagguuauaaauacuaucuuuugaagagaaauaaaucuuucgugcugucauuuuuagaagcucugcuggcgguggaacaugugaaaggugaugucagcauuucuguggaagaagggaaagagaaucuucuucggguuucugaguaagugcuuauuuauauacaccuuuuccguucugaacagcauuuaaaaauacauagcacugaauuuucuggguguauuauacuugccaauuagguggaguguaccuagaaagauguuucaucucguguguguguguguguguguguguguguguguguguaugauugugcauguguagaggcuagagaucuuucuaccucagcauccugaguauuagaauuacaggucugcacuaccaugccaggcugauaacuguccugauaacuguuaaaggggaaaauuggggcugggauauagcuaaggcugguaagaauauuuucauauuuugcuugagccauaguggcccaccaccacgaaugaaugaaugaaugaaugaauggcuuuuuuuuuuuuuaaauagaccuucacaaguuauugagucugaaugagagacugaaagucuccagguugguccugucaacugucagcuguucauuuggugaauguggcauuggaauauauaguucuucuuuggguugaugagacuguccaaagaagacuuuagauuuuacugauuagagaagaaauuuccauuuauuugggaaugugguagggugggcagggauaagacagagucucccucaguaucccaggcuggccuuguaccuucagcagucacugccacagccugcuggaugcugcaugaugagcuugagccuccaccuaagguuuuagugcaguagguaacggggggccuagcaggggaagcuguaugguagcuguguuucuaagugaguccuaagccugauuucagccaaauuuucucuugauguuuaaaaguuuaaaucuauguccuauucaauuuugucuaaagauucuguuuuuccuggccuuguaaaguuuuuugauuucuaccuucugaaauugucuugcuauugcauucuguuucaugguuuuguaucuuguaaauaacuauuucugccaaacaguugugugguaaggcuuuuucacuugcuuacucucucacuuguuuuaugcuagucauuggcucccucccucccucuccuuccuuccuuccuucuuucuuucuuucuuucuuucuuucuuucuuucuuucuuucuuucuuucuuucuaacuguuggauuuggcuguguuguccaggcuggccuugaacuccugaauucaagcaguccuccugccuuagcucucugagucugcggggacuggguuuguucucauuuuguuaggauuugacaugcuuucuucccuugaaaguugcauuuguuuuuaauuauuaaauuuaauaacuuaguuaauuuaauuuaaaauuauucuaaaucccaguuacauuuuugucaccauugagacauagaaacugaacguuaggagagcaggguggugugcaaguuuauaggcucaguacucacuagacugaggcaggaggaucuugaguucaaggcuaguccaggauaugugagacccuaucucaaaaaaccaaaauagcccgugaguuagcucagcggcuaaaaguuuguuuccaagccucuguacugaguucaagucucaguauccacguguuagaaggagagacucagcuuuguccuuugucaaguuguccucugacuccacaugcaagcuguggugugcuuguacucaaaauaaguauauauaauuuaaaaaaaauuuguacucaauauaaacauguaaaauacaagauaaauauaauuaaaaaugcuaaagaaacaaaaaccuaaaggaugaaguaucauauagaaaaucuacuccgaaguaaauuaaauuuagguggauauuuuagaacauaauggaauuugauagaaacacuacgaucaaauuaacacccccccuuuuuuuuauaacuaugguagaaaaaugguaaauguuaagguuucuguuugugccauugugacucuuaagacuuuugcagaagcaacuauaguuuacauaaugcuucaauucuaggacuguggcauucacugacgugaauucaauccugcgcuaccuggcuagaauugcaacuacgucugggcuguaugggacuaaccugauggagcacacugagguaagcgaggaguauuucuuuuccugugugucuugugcuuucucuguuugggaacacuguuguccuacugugcguugacaugugauauuagucuuuagaaggaugugaacagaguuuaaccauaggcccagggaaggaauguuugugcuugguuugcuuuguaaagcagagaccucucuuuucuguauggcccagguuagucugucagcuuguguccugugcugcugcuucacugcaugcuucuuuucagaaagauaaacuggaaggguagcuaaaguagauguuuuauguuggcaugcgugggauccccagcacugcaaaggaacagacuucagcucuuaggguucacggucuccguccagccgagucagucagugcugucuucaccuuccugguuugugagcaucucauagacggauugugcuguccagcucaugccgcucaccuuucccaguuacagagaggacagcaggcccacacaaugaagagauuggugcaggcuugcacacaaguuugggaguucauuuucuuucuuaaguuaaugauuaaugacaacaguucaggucagcuuucagugcuacucuguagaugcagguuuucuccuguuuuaccuaauuauauucuacucuaauuuuuguaaaucucacacaguucaaaaaauaaugucuuuucuuuuccguuguugguuuuuuuuuuuuguuuuuguuuuuuggggacuggggguaggucucacuguauagcccaggcuggugucuacacuucaucuucuugcccugccagguuacagcuaugugccaacacauugggcauaaaauggauuuuaauuauugacuuuuaaauaucuuccaguugauuaaucugucugucuaggcagcuuaguuaguccuuuccacuguuaguuaucaagcaguuuuccugucuuacccccuccccccauugugaccuuucauguaccuggcuuaaaaagacaaaaaaagaaagaaaucauagggaaauaaacuguagagacagcauuuauuuaaguggcauauuagauccagaguagcagaauuaaacccauguaauaguaaauuguauaauuucaaguaagaacacuuuuguucuagcugaggaagccaagaguacuuuguggcuuuauuaacuuuuugugugaccauuuuguuuggaagccugagcuuuggaguucauucuuugucuaucuuuuguucacagauugaucauugguuggaguuuagugcuacaaaguugucuucgugugauaggcugacuucugcaaucaacgagcuuaaucauugccugucucugagaacauaccuaguugggaacuccuugaccuuagcagaucuauguguuugggccacccuaaaagguauuaacagcuccucuuauaguacugguguuuuaguguuuagaguaguuguuguuugggguggguuauuaucucuugagauggggcuggucucaaacccuuaagcuccagcagcccuucugccucagccucccagguggcugguacuauccuggugcauuguggggcccauucuuuuuuuuuuuuuuuuuuuuuuuuaaauuauuuuuuuuuuaagauuuauuuauuuauuuauuauauguaaguacacuguagcuguccucagacacuccagaagagggagucagaucuuguuauggaugguugugagccaccaugugguugcugggauuugaacuccugaccuucagaagagcagucgggugcucuuacccacugagccaucucaccagcccggggcccauucuuuuuuggucauauacuacugugcugaaugaaaagugccuuuauguaugugugcauaggcaguguggaaaugaggacuuuccuacugggcaugcucagucuggcuuucuuauugguggucacaggcauucuguguucucugauggcccuggaggucgucucucccugacuccucuugccuuugguguugucauuccugcuaaagagauccucauccuacuuagcacuucuaccuaugugacugccuaaucacaaccuuuguguccagccugggaaugugaggggcagauuagugaggcgcuuggaguguuguuuuggcgggucccuuuucuccuccugugcaauuaauuuacaacagaugugauaauguucuuaacaacauggggaacaguuaacuugaaaaacaaaacaagaaaaacuucaugagauacugauauguaaaaucuguauuuaaaauuuaucauuugaaauguuuugacauaauuuauaguuguaguauuuucaccacagacaagcuuuugaauauacacaacacacucaaaaugugcagaaaucuacagauucugggagucuaaccauuugauggugaggcaagaguuugcaggaaaggcgcacuuucggaagaggugggagccucagucagcaguguacuuuagaguuuauggaggcaaauauacaagucaguaacugaaggaguuaccuagguuauuaugacaugaggucacugaagccacaaggccagaagagaggcagccuuuaaaaauguaauuuugacuuuguagcuucuaucugguuggugguuauaugaagaguacaaucuauggaagagcauaggucacugaagacuacuuaagaugguuuagucagacagccggguuuauggaaacuuuggaccugucagaagcuuaaguugcaugagcuggcuggcagaauuagaagucuaugacauccuaugaacaucaucaguguuuaguugaaauggagcuaaacagugucucuucuguguacuagaaaaguuauaaaguggggagggaauggagucggugaccccauaauuaacugcuucuugguuaccuuagcuuuuguaguuuucucuaguugaucuacugaaaugaagcacuggucuuacccugguguguggugggaggaggggauccacuauugagcuugacugaguucagcuggagaguguuuuagcugcuuuguucuguuauguuuuagagacaaaacuagguaccccaggcuuguccagccucugggugcugggcagauagccgagcacugccacaccuggccuccaauuaaaagcacgucuuuugugaccucacaaaauagaccaaacuauuaggguuucauugcagaggcccaacuauaagcuaauuucauucacauaaauuaacugugccuggaacuuugcuuuagauuugcugauuugguaaagauuuaaaaaauuacguucacuuacaggaagugcugcauggcaggaacacuugaaacagaacaaaacucuaguccacguuaaacgcugguuuggcuuucuugaggcccagcaggccuuccgcucaguuggcaccaagugggauguuucaggaaacagagcuacagugguaagccuucugcauugcauuguucugcauugcaacuucauguguuuguagguacaugcaagcuauggagguguccaugucgaggucagcuuagugggagucaagucucuccuucccacugugggccccgggcuuccugauggcuucaggcuucauaauaagugcuuucacugagccaucucacugucccugggguuuggguuauuguuguuguuguugcuuuuguuuuuaaugcugauauuuuauuugauguugagauucuagaucugaaagauuauuauuauuauuuucugggggaugaaauauagcccagcaucaggguguuugcuuggcaugaucagggccugguauuggaccuguggcauugcuuuccaaaaaaaaaaaaaucaaaaaguuauuuccauuauaaaaaaaaaaaaucuuagaucuuauuuuuguuaaguuuuaggaucccguuagcuguucaacuacauaaaaagcccugaacuuuuggcuacaagauuauguucccaaugcguguucuucauucaaacuccauauaaugaaaauuacauuuuauauauuguuuuuguuguuuuuuggugcuggggauauguccugcucucaggugaugcccucagucagcuguuuuaugaccacacuuccgucuuuauccugaaucuucacugauuuugagccauugaguuguucuguagaaggaugccacauacacuuuccucuugcucaccuuugugucucucucuuaaguggccccuucuccuucuagucugguacauuucgacuuauuuucaaaauucaucuugggucuugcauucuguuaugauuuuuccuggugacauagauccugcuucuuaacuuuaacugaacacccuuauagugcugccuuuaaaugucuuuacuaacugagguuuggcuuucuucacauuccuccguauauuuggaggcuuuagagagugugcaugauggagucgucauucugcuugugaccaguauuugguaaaugaguguacccauaaacauucagccauguauguuuuuccugugucugcuuuguuuuuaggcaccugacaaaaaacaagauguugggaaauucguggagcuuccaggugcagagaugggaaaggugacagucagauuccccccagaggcuaguggguaaggaacgcugccugcuuagagcccaucacacucagugaauaagcccugcaguccugauuacuacuguugcuaaguccaucuagaagggugugguuuaaggauagaaguaaaucuaaaagccuccgucuaauuacuuacaguuuauguuaauuuguagcuuuaguucauuaaggcaauagagacaacaucugaauuuuauuauagaauuuuaaaaacaaauaaaguguccauauauagaaaagcuugguuuugcuuauacuuugagauuucugcagccuuuuuucaguaggaauuuguauuuauaccuacucccuuauaguagacauuacaguagcauuuauuuuucuaaaauaaaugaaaggaaaauuugaaaaacuuauuuagaucuuuccauuaauuuucaggucuuccaaaccuuuuaacucuugacacauaagaaaauagcgucugacuagcuccugagagcccacauggccugcccagcacuuccucagccugaggggagccucugccugugcaugucagucauuccauucucucugaaacacccuagugaagucuaauagaagccuucccaaggugcuaacagagaagcgaaucucucuguagcagccuuccucaggagauuuagccguaggagaccaucacacugucugccgugagaugauaaugcuuccuacauuuaauugagauccggcuuuaauggcagauaauaaauccucaucuuccauuuaauaguucuuuauucacaauuuuguuacuaauggcauuuugaaauucuucauuuugagaugguggggugaagaugagaccaaguuugauacagcugaaguuugccuugaacucauuauguagcaaggcuggcuuugaaucuuccuuccaccuccugagugcuggaauaacagaucacuccagccagaacuccacauuuuguuuugacauuucuaaguuugucaauucagauuuugaacuaaaugccagauagaagaaaaugaaaggacccggagagaggguuguuccagaggacucagguucaguucccagcaccuacgugacagcucacagcugacuguagcuccagcuccagaucuaauguccucaucuggccucugcaggccccaggcacacaggcauacauacuagcaaaacaccuauauacauacauuuuauuucacuaauuuuuuuuuuauuauauguguguauaaguguguguuugucuuuauguuuacauucugcaggcaggaucccaaggcauugugggugcugggaauugaacuuggaucaucuguaagagcagcaaguguucuuaaccauggauccaucucuguuuccuaaaaauaauuuuuuuagagaaagaaauaaaagagaaacuaaauagcuacagacuugaucaaugagggauuaauaguuggcaaaguaagauuugccaugaaaaacaccuuacaugguucacuuugcacuacauuuuacauuuuacauccuugguauuuuguuacugucuacugugacaggucaguuguccuuuugaguagugaccuuaaugacuugacaaaagguacuuuuauuuauuuauuuuaagauuuauuuacuuauuuuauauaugugaguucacuauagcccccucugcaaagguugcaaaagguauuuuuaaaauagaauguguagugaugcaauucaucuuuuuuuaaucacugucauucauuaauguagucucuuacaacugaauuuuagaauaauggacuuugaguggugcucugaugcccugugggaauuggagcaugacccagcgucccgucuuccugaaccuucuuucuuuguucucauccucagauguuguugagucucuucugugagcaugaagucagaggcuugaugcugccucuuugcuucuugcuuauucuucugauguuuuauuuuguuuuugagacaagguccaugugucugaggccacccucagacugcucuugaauagacugcggcgcugcugagggugaccucagacuccugguuuuccugccuguacuuauauagaaguaggguauagacgugaguccuguauucauucugugcaguguuggaauugaacuuggggcuuccugcgugcuaggcauguucuguaccagcugagcuauaccguagccccuuccucuggacuccuggcugaguugguacucacuauauagacagagcuagucuugaacucagagcagcccuccugcuucagccucucaacuguugugauuuugugugugacacuuauguguuagcuguuaugugcagacacuaucugaugugucauguacaguagcccaugagucugcaacucugugagcaaaagcaguuacuauuuguuuuacuugugguuucagaaacugacucacaccaugugcuaauaauauaccaggcuuagauuucugccaucuguuucuggaguccuaguauuuccugugugugggcuugugacagaaagaaagggagaaggagagggagguguggcacagucuaaugcagaucacuacaaaauaugcacuguucaucuuuuagagcugauuugauauagguugucucuugaaggcuaauguugugacuguuuuaaagaguccugguuguuuuccugagauuuguauucuuagggcuguauccacuguuucagauucagacaugucuucaaagcauaagagguuuuuuuucugucuacccccuuaagcugaagauggauaugaacauuaugaauaaagcugagcacauuaacuaauaauaggugaucaaugaucacuggugaaaauuuuuuaaauauuucauuuauuugguuugucauguauguacauauauguagacacacaugugccacauguggaggagucauuucucuccuaccaugggaagcacagaaauugcgcugagcuugucagacuugguagcaggugcuuacccacugagccaucuugcagcccugugcuucacuucugacaguaguuacagugguguuacuaaaugcagcacacauaauaucuucuuagugucucagguucuuucugggaacucacaucccuuuauuuuauuuaaaaauuuuuuuuuaauuuuauauguauggguacuuugcuugcauguauaucugugcaccacauguauuuuccaggugccuguggaugcuacaagagagugucagauccuccagaaccggagauagagacaguuguaagcugccaugugggugcugggaacaagucugggcccucuggaagagcaaacagugcucuuaaccacggagccaucucuuuaaacaaacuuauuuuuaauaguaguuucagauuuguagaauagaagcuugugugcauuugugugacuguauacaccugcacaggcuuuugguuuaugcaggagggugacucaucaacuggacugcugugugaguguuugaagaaugcugacuuagaccuggauacaguucagugagagggcaucccuuuaacacaggcagagcacugaguucagucucucgcaccacagaaaggcuugauguuugguuuugauguaaaaagcaaagacaugcuaagggucugcauuuuuucccucccauguuaguauauuaguugagaucaaagaugugcuuuccagcuagguaacuauuuuaaaacauuuaccacagcuaccacagaaacuaauaacauuggugagugcgauuuaaacuugcuucauaaguguuuaaccuugccuuaugccuauuuuacugccuaggugacaauaucuuuagcacuaagaucucagaugcacauucuuagguuaggguucuauagcucagguugucuuggaacaugugauccucgugacugugccugccaggccucaccaccucaccacacuuggcuuuguauguugcuuuuuaccacugcuuugauggaggaggucauugcuauucaguacuguuauucuuuuauuuucaauauuaucagcugcccauaggaacaaacaguauuuucuuagauucuguuuguggaguuuggugcuagaucggaccuuugagaucauuuaguuuaaauauuuucauuagcaucugagacaacugaaaccaaggaaaguggucaaaacuccuagcuuuuuucugucacguuagcuuucauggucucugacuuagccaucauagugacagcgccgucuugggagcuucucuccuagugggagacgguugucccagcagcagcagcagcagcagagcugagggguacccugcucggcuacauggguaaugguugcagaaguuuuccuuucagugaccauuccucuuggaagaacaaaaaagauuguucuuaggauuguaguauuuauaauaccuugcccucugagaguuuauguaagggguuguagucaugguuacauuguccauguucuagucucuugucucugucagucacauuuccuauuacagcaccuguggguagacaguaaaaugaccggggaguauggacguucuguuuaguucuuagcuccucagagaguuaaggguaagaaucccguugaagcauguuaaugaguuucucugugaaauguuuuuguuuuaguuacuuacacauugggcaugcgaaagcugcucuucugaaccagcacuaccagguuaacuuuaaagggaaacugaucaugagauuugaugacacaaacccagaaaaggaaaaggaagauuuugagaagguaauuaaaaguguagugaugaccuuuucucagaaaaauggguuaaaaucagagcucagucugacgccuucaugguacgagaauaaguuugguuucauugcugccuuuccccucuucaucugcauauuucaugccugagaccuaagccaaaaugcaauugagcucccauuccaaaaacuuaguuauuguugaauuuacuuaaauaccucauuuuuauuugaauaccaguuuaacuggaagcaagauuucuuauugccauagucuuaaguuuaugaaugaaauaaagcugcacagguauuguaaggugugguuuucuagccucauaguaucuguacuugagggacuguaauacagucacugaggggcugguggcguuggugucacaguacagcggcucucgguaaacagcuccaccuugagauccaguuucccagcugggcgucuggaagcacugagugcacugagcgcuuucuccuccucuguccugcacugugcaucaucugcagucuucucaggcugcuuaaggcugauggugcucauuacaugugcccaaaauaaguaucauugguugaauguguauaagaaaaugacagacacaaugcugcuuacagugaauuugguuguuuuguuuuuuuuacugcaggucaucuuggaagauguugcaaugcugcauauuaaaccagaucaguuuacuuacacuucagaucauuuugaaacuauaaugaaguaugcagagaaauuaauucaagaagggaaggcuuauguggaugacacuccugcagaacagaugaaggcggaacgugaacagaggacagaauccaaacacaggaagaacuguacggcacaguuuguaucagagucuaauggauacgcuugcuuucuuuuuuuaaugagagauauagcuuaagacacauugaaggcuguuucuuuuucuaauucuuaugccuuucuguuugucugagacggucuugcugcguguagccuaguuggguucaaacuugcuauuuuccugccucagccucguaaguguuaggauuacaggcugugucguuggccccgcuugcauuccuccuuuucuugccugggaucuaacccaggccugcacauguuagaccacugagcuaccaaacccagauccuggugcagcuucucagagcuguaucugcacugcaccuguguucaguguccugucuccagcaccucacugcuuguauacaguuucuugcauuuauuucauuugagguauucuuucuguaacauuuaaaguuauuuuaauuuaaaugcuuaccaauccugaaguguuugaaaaugcugugagcacuagcauauacaugugugugugauuucuauaaugugaaaguucauuauccucccauauuggugcagugucacgugaauaaaaucucuacgucuuucaguuacuucuacacugcugugacagaagcaucuuagguccaugagggacaagaggcauaagagagugcaguccacuguuagagaucagcaggucugucauuauugcugggauaugacaauauggcuuauuuaugugcuacugacuuuggaagcauggagugggaucagaauugaugcugagcuauuagacucaaaggccuaaccccaguugugcaccaaaggucucaaccuuccaaaacugccaucagccagggaccagguacuuaccugugggaggcauuucauaucucaacagucaaaaauuauuuuuuccagacaacaaauagaagaagagguagcccagucugauauuaaauguccuuuagcuucccugugcugaggcuuuauagauuauauacaucacuauauccagucuaauucaugacuugucccugagcuuacgaaucaagcucucucucucucucucuuuuuaauuuauuuuaaagacagggcuuuucuguguaucccuggcuguccuggaacucacuuuguauaccauagaccaugcuggcuuagagaauagagaugugccugucucuguuucccgaguggugggacuaaaguugugcuccaccaaguacaaaaucaagcaauuuuuauucauugcaauucguugccagaacuuccucacuauauuuaaaucuaaaacaucucauuuggggagcacaguaaauuuaaauuacagcaaacuuuuuuuuucuaaaaauuauauucucaaagggaguuagcuggacuuugagacuguuuauugauuugaguguaggugaaacaugcauuauaacuucagaaguuuccacgggaagguacuguugagcaguuccuucuuauccugguggaacaagcuuuugguacucugacauagguagagcuggggccacucagugugucuccuuuuugcagccaaaucccuuuaugucuuguaccacuguuuucugugaucuuucauuuucuuggagccaagcauuuccuaugccacaguggggugcuugaagggacauucagagaacccaaaggucagaacaaauugcucuguccccuggcaaugauacagcaaagaaaagaaugauucuacuuuaaacacacacugucuaccuugguggaguagaggggcugacugguuaguugugccuugaugggaaguggggcauagcagaugagaaggcuuccccuuaccguccauggaauguauugucuuuaccuuuucugcaccauucagagaguguauuucucaaauauguugagguuugcccucuguuucucagcguuucacugaguagcccuuccuggccucauguuccuucuuccuuucucagccucugggaauugccacuaucaaguucuaacauaccaucuauuaguauaguuuuagauuaaugggaugugucugcaauacaaaaaauuuauaucagucagauaaagaagaguauaccugucacauuacagcuguugagaagaaucuacagaugugggaagaaaugaaaaaaggaagccaguuuggucaguccuguugccugcgagcaaaaauugacaugaguaguaacaauggguguaugagagacccgacccuuuaccgaugcaaaauccagccccacccaaggacugggaauaaauacaaguaagugcacccuuuugccauguugggcagccuuguuuugccccagugugagaauguguguguggggggguggggggggugcagcacaguugggaagccagugccucguucuucauggugaguuguccaaguagccucuucugagggugugcagcguggccuuucagggauggcuuucugacucagcuguccaagaacaauuccaucuauaaaaguccuugguacacgggggcuggagagacggcucagcaguuaagagcaaugacugcucuuccagagauaaugaguucaauucccugcgcccacaugguggcucacaaccaucuguaaugggaucggaugcccucuucuggugugucugaucauagcuacaguguacuaaaauauauaggauaaguaauucuuaaaaaaaaaaguccuuggcacuugucaguuuucccaucuaucuugacuaaguguguaaguguguaccuuuagauaaagauauuucucuuaggguaaaauuuuuuuucagagcauaaauggacacaaaaguuaagaguaucaaaauuugcagaaaugugaacaaaccaggagaagaacauguacacuuaaaauuuuguuuauuuuuuggggaagguauuuacaaauuaccagguuuguuuuguuuuguuuuaaaguucuuguucuagggccugagcccagagccucaugcuugccacuaacacacaccccaaauuuuagauauuucucuuuaggacuuuucuacagaaguccuucuuuguuguguaaaauaagcuguaaaauauguuuucuuucuuuucuuuuaaacaaacauuauuauaaaaaaacuugcacuagacccaaauccuauucaugucaaugaaccucuguaguuagaauggccauucugaagcucugggguuucacauuggauuuuauuacacuuccacuauuaaauacauuuuuacguaccuagcuaccaccaaaaccaaaaaaucugugacagagaacuagaaaaccagcuuccugcccuuuuguguggcuugugugcauucccugcuuugguucuucuucaucccccaguagauacucauucuuguucuuuuccacgugaacccaugugcacaugugcuuucugauguacauauauuauugguuagguucuuccuaugagaaagaauguauaguucuuuuauuucugauaauaugacaccccccuuaauauuauacauuuuuuuuaaagauuuauuuauucauuauauguaaguacacuguagcugucuucagacacuccagaagagggcgucagaucccuuuacggaugguugugagccaccaugugguugcugggauuugaacuccugaccuuuggaagagcagucgggugcucuuacccacugagccaucucaccagcccaauauuauacauuuuaacuuuccauuuuccugaaauuuuuauuauuguuuucuuuagagcugaauuguauuucguuuuuacuuuuuuuaaagauguauuuauuuuauguaaacgagaacaaugccccugccuucagacacacagaagacacuguguucacugauacuucaucuuaggcagaaaucaccuuuuaaugguuguuguguugguuugguuuuuuuguuuuuugggguuuuuuggauggugcugccauaagcucaggaccuugcaugugcugggcaggugcuguccagcugcugucggaaugcugcccugcuggagcguggccuggcaggucagguccacagcuuaccuagcauuccggagaccuggguaaaucagagguuccucuuaaauggaaugguuuguugcuuaccugccccucccucccucccucucucccucccuugcuucuuuugagagugccacccucuguucuugaguagguuucuuuucuuuuucauguuuaacauuuagacagugacuucaugugccacagcacacauguggcaaccagaagacaacuugauaagagucaguucucaccugcuauguggguuucagggauuaaauucagguccucagguaaagaugccuuuauaccgugagccagcucguaguccuccggugcucuuaacuauagagcuacaagacuuuuagggauuacuaaggauauuuaaaggcuagauuucauguacauucuauauauagugaguugccugcugauacaguauauauuaaugauuacagaaauacuauagaauuugccaaacuaauacugaacuguauauuaaauugcaacuuuugugacuuagugggcaccaugguauaugccuauaauguccaguacucaggauguagaggauugccauuaccucaaggcuagccuggacuauauagugaguaccaggccagccagggcuauguauugagacucugugugucucagaaaauaaaaccaguggggcuggagagguaguucauugguuaaggacaaugaaagcuuuucuagagaaauugaauucccagcagcucagagcagcuuaacaacauaccauucccuucuuuccucagcaggcacugcacauauacaaugaagagaccuauacaugcaggcaaaacccugaaaacaauaaaauaaaaauaauacuuaaaaaaaccaauaaauuguuuauuuucuacaugaaaauacucaaaguguuuaaaacauuuucaacuuuuuuuuuucuguuggguggugugugugugugugugugguuagauagucaagguuggccaggaguuuguagugaucuuucugcuucuauccucccaaauuuugguuuugguauuacaaguuugaaauacuauauccagcaaaaaauaaauaaauaaauaaaaauaaaugaguaggcugcuaauguuuaagauggggaagauaaaauagucuaauuuauuuagaaagccauucucuuuuuuuccucuuaguguuuauccaacauaugacuuugccugcccuauaguggacagcauugaagguguuacucaugccuugaggacaacagaguaccacgaccgagaugaacaauuuuauuggaucauugaagcuuuaggcauaaggaaaccauacaucugggaguacagucgcuuaaaucucaacaacaccgugcuguccaaaagaaagcucacgugguuugucaaugaaggacugguagauggaugguaugucugaugucccauggcguugucagguuugacuagggaguggugcgguggauaggcccagaggcuuguaagauccuuaguucagcucugucucagcugugccuuaggggccccucucccuugacuuaaaugcuguaaacacguguuccugccagagcguggcguagggaaguaagaacugugcuugccacauccucuggguguggaucuuagcauuaauauggagggguuguaacuacucuuccacaggucugacuccaucacucuacacacaccauucugguguggcugugagauuucucucugcucugcuuuauagguccgaauggcccugaacugacucgagggugaagugggcucaggcucagaguucagggcccaccuuauuuguaggcauuuccucagaagagucagaaaauugcuguggauacaaguaacguccacaggauuuuuguaauuuuaguguaaagcuugaaaucaccauuuuaguccuguguguauauauuuauauaaauuaugcccaucuaucuggauuuacaugauuauaaaucuaaaaacacuauuuugccugaauuaagaacuuguguuuugauaaaagguagguuuaucuuggggcacuaucuuuguauaaagguuauaauugcagcuguacugaaauuuuuaaauccaagccaaauaucaauaacuuucauauauauucuuguguauacauacauucauaaacaauugacauaauuccauaucuugcccaguuuguuauuugagacaguccacagcccuuacugaccuggaucuugauaaacaccaggcuagcuuugaacuagagauaugccugccucugcuucccaagugcagcaauuaaaggcauguuaccaucacauucugccaagggaauaucauuuauuuaauuuggaauaggauuucuauagcuaagguugaccuugaacucaguauguaucucaggcugaccuuaaacuuuagaugccuccugccucaaccucguaggugcugggauuacaggccuguacuaccgcauuuuguucugaauauaguuuauuauucagacacugaggacucgucugucuauaucuaagugaauaaaaaucuguuugacgaugugcguguuucccagggaugacccacgguuuccuacaguucguggaguucugagaagagggaugacaguugaggggcugaagcaguucauugcugcucaggcaagugauuguuuuucccccagcuccucugaauuuccaagcaauccuauuauugccccuuuuguugcuauccauguucuuccuauuccauauuuguguggguuauguugugguucaccguuggauuuguucuuuuuuaaauaaaguuucacucuuuagcucaugugccccuugaauucugggugaccuuccugccuuaggcucccgagagcugggacugcaggucuguaacucugugccgugcacaggcagcuuguuucccccgggcucacuuggaaauugcuguggagacuggguugaccugucgagguuuuccugccuguuucccaagugugcauaauacugugccugacgaagaauagauuucugaagggaguaaauuaacguuuuauaauaauaaaagauugggacaaaaacaguggccuauguucaugugguggguagucaggugucuacucugagcagcccacagaugauuuccagcaaggaaaacggucaaggcugcauaccaaggucucaguuucagugaagcgcaucugcaagcauuuguuuuguuauucuaaguaugcuuaacugaagcaaaaucuuccucuugguauuuauauuuuuaguuuauaguuagcauucacauggaggucagagggcacacaccuuuacucacugaaccaucuugccagccccucuacguggcguuucuuauccuuaaacuauucuuauugcuuuucuagggcuccucaaggucuguugugaacauggaaugggacaaaaucugggcguucaacaaaaagguacaugaccuccguuggcucccuggugugcuuuugcagucguccucugcacacugugaccacugugcaggcuguggcgaagggaaggagcuccuccuuuaauggcuaaggguaguaaacaugguaaucacccggcaaagagcaauuacugaagcaacaaacucagacuuacgggaaaugguaauaguuuuuccuuaucuuuuacgaacacucugcguuucauuuuucugcuuucaagcugcgagcucucuguaagaagguaucacuucauacuuguauugccuuaaacauagcuuuuagcauaguacauguuacaaacugaggaguuauacagcuuugaagcacaaucacauuucuguaaagacuugcacaaucaaaccuguugacagugcaucaucccuaguuugccaaauauguccucuguuuuuuguggcaaagggagacuuggcuaacuucauuccacuguucccuugugugcugagaggacauagaaguuuaaaaaauugcauauuguauuguguuguaaugaagguuugcuaacuauaauugcugugcuuucagcuugaaaaaaaaaagcuuucuuaauuggacaaucaaaccaggaaucaugcauauugacauuguuaccccgauggggagcagaugcuuggacacuauaauaaggcgggucguuagaaugcacguucugccgugcggcuccugugauugugaccuguagauccuuccuugguguugcugcuugguugugcugaugucuugccucacguaguugcuugucucgcaugcgucuugaauuuaguuuuuuacuuuuagugaccuuucuauauauuaaggaaucauuaauugguucuuucuguugcugcaguuacuacuaacaaacacaaguagaauuuacaaggaaguuaacuuuuguguacuucuuuuucuuuccagaugaauuuuuuucaauaguuuauuuuuuuauucacuuuauauccuuaacacagucccucccagacccuuccuuaaaaucuuacaagucccuucccccauuacacccucccuuuuuccucagagaaggggagcccccuuggguaccagcccacccugggacaucuagucccagcaggacugggcacauccucucccacugaggcccaaccaggcaguccaguggggaaggggauccaguggcagggaaccaagacugagacagccccagcuccauuuguuaggagaccuacaugaauacgaaucuauacauuugcuacaaauguguaggggguauguccagcuccuauauacacccugguuuguggcccaggcugugagccaccaucgucccaguuuaguugaugcuauaggucuuucuuuucuuuucuuuucuuuucuuuucuuuucuuuucuuuuugguuuuuuuuuguuguuguuguuuuuuuuuuugguguccuugaccccuucuggcuagcucacuuauauccccaacucuucuacaagacuccccaagcuccacccgauguguggcugugggugucuacaucugcuuccauccacuguuggaugaagccucucaggagacaguuaugcuagccucuugucugcaagcauagcagaguauccuuaagagugucagggguuggcuuucaagugucagguggaaugggccucaaguuggggacagucauugcuuggcuguucccucagucucugcuuuaucuuuaucccuguacaucucguaggcaagacaaauuuuggguugaaggauuuguguguggauugaugucccccucccuccucuggaaguccugccuggcuacaggagguggccaguucagucucuguauccccuacugguaggaaugucagguagggucacccccauagucuccccacauccucccuccuccuaggccuccacuagucaccagagauggucccuaccaauuuucauucucacuuccagcccuuuccucucucuaccuccucucuuguccaguuuccucucuccauccaccugugaugacgaguuuucccuucugagagagaguugugcauucucccuugggaacuacuuauuacccaguuucuuuugggucuguggauuguggcaugguuauugucuuaggguuucuauuccugcacaaacaucaugaccaagaagcaaguuggggaggaaaggguuuauucagcuuacauuuuccacauugcuguuaaucaccaaaggaagucagaacuggaacucaagcaggucaggaagcaggagcugaugcagaggccauggagggauguuccuuacuggcuugcuuccccuggcuugcucagucugcucucuuacagaaccaagacuaccagcccagagauggcaccacccacaaggggaccuccccccuugaucacuaauugagaaaaugccuuacagcuggaucucugggaggcauuuccccaacugaagcuccuuucucugugauaacuccagcugugucaagcugacacaaaaauagcuaguacaguuacccuguacuuuauggcuaauauccacuuauuucuuuuuuaaagauguauuuauuuauuuuauguauaugaguacacuguagcugucuucagacacaccagaagaagacaucagauuccauuacagaugguugugagccaccaugugguugcugggaauugaacucaggaccucuggaagagcagucggugcucuuaaccacugagccaucucucccuaauacacacuuauaagugaguacauaccauauguguccuucuggcucuggguuaccucaggcaggaugauauucuuccauccauauugccugcaaaaaucauggugucuguuuuuaauagaagauuuauuuguguacuuuuuuagauauacaacuuucauaggucuaagucuuagucaagcuauauguguuuguuuauuucaaauauauggacucuucccuuuacauuccuccuggcagagauacugcuggguuuuuguaugacccuauggaucuugcuguccauacucuaggcaugcaggaugguacucggguuuucuucacuugucuuccugugauuggacaggaggcuuuggucuguuuuuuuucuuauaagaauuugauuucuuccugucauuuguuuuauuuugucugcucccccuccuacauguauugaccccugguucucagagguucuauggggucaccgaaucccuuccaguguucaggcacuacacauguucuuuaguuugcucuuggagaaaucuuugucagaaccuaugaaccucuggugguguccguuguuuugugcuuuaggguagagcuguacacccagaucuccuccugucucccaggggguugucuuuccuuucuuucuaugauagguuaccuguuuccuggacagcuuugguuaguuuuuuuguagugggucuuugugguauccagcugaucaccagcaccuggguuuaagugguccuggcuuaggcgcccugggagcugggucuguaggcauaugugcguuaccauguuagcuuauaggcaugugugcauuaccauguuagcugcccuucuuucuuaacauccuuucuugugugcuccaccacucugaaugggauaaagagauccuacugagaccuuuuuuuuuuuuuuuuuuuuuuuuuuuaaaugaaaguaaguuuuuuuuuuuuuuuuuuuuuuuuuuauaauuuuuuuuuuuuuuuuuugauuuauuuauuuauuauauguaaguacacuguagcugucuucagacgcaccagaagagggcaucagaucucauuacgggugguugugagccaccaugugguugcugggauuugaacuucggaccuuuggaagagcagucgggugcucuuacccacugagccaucucaccagcccaagagaccuuuuuuauauggcauuuuaaaaguaacgggcuuguuuguuuuuguuuuuguuuuuuuagaggaaggcuucauuguguugccuagaccaaucuugaacuugcagauucaaaguaccacccacuucggucuccugaguagcaaacagggucuuggugcuuaccgcagcguuaaacuuuggaccugcuaagugugaugguuuauuucuggggcuuuucugucgcccagaaucuuacugccucagucuaugggccaccaugccugucuaugaccuguucuuuuacuuggaaauuguaguauaccuuagugugguucuguuuucaucuguauccauugaaaugacaugugguucuagccuaaaaucauuccuucaguucugaaguucaacacacacuucccuuugguucuuuuuagacaguucuacuguguagcccugccugacccucaaacuuacagugauuguccggugucugucuuucccucucagguacugcaguugcaggcguggguaaauccugcuuccuucuuugcuucccugccugucuucccccccccccccccccacuggcacacagugcaugugguuaccaccccaccacucaguuucgugccagcccuuccucucucuggacgcgugcaaaugucaccuccaauuuuauuuucucucuugauugauggcucuacuuuuugguaucuauguaacuuucuguuaaauuucucauuuuuacucacauuucaaagaucuucaaaguagccuucuaugcauguuccaugguuucagcauuaguaugccaugucaucucuguuuuaccuguucauguuuaauaugggagaaugcaggagugaugggaaauguuaagagcaggggcugagcuuuucuguaggaugaacugacugggccagugagaagaccccauguuguaacuucaaaaaagagaaagguuuucacuuuuaaaaguuuguuuuacuuuauggguacagauauuugguuuguauguauaucugccccauaugugugccuaguguucauagagguaccagauccucugggacugaauuuacagccaguugaguuacccugagugugcuggaaaucaaauccagguccucuguaaggguaauuagugcuuuuaagccuugagcaccccucagauccccauguaguaaguucagaccuuucuuuuagccagcaguuuucccagaggagcuuuuugucagcccuugaaugaaggucauggcugucggagaagucuggaaagggugggcacaccauucucauccucuccuuguucccucuguucuuguguugucuguguggugcuauccacgggcucgugugugacaugcaguucccagcugcuagcugucuacucuugggugguuguagguguuaccuucuuagagaaggugugguacagccaggccccucucuuaaaugcucuacagccaugauaacagugcuuaagcauaaaccuggagaccuuucagagucacccugcaacauccuucugccauucuuuuaggccccucuuggaguuauuugaaaacuacugguccacacuguuagaauuauauagcuuuagagcuaaaagggaucccucccucuuucuuucuuucuuucuuucuuucuuucuuucuuccuuccuuccuuccuuuuccuuucccuuuuucccuuuuucucuuuuucccccuuucccccuucccccuuccccccuuccccccuuucccccuuccccccuuuccccuuucccaccuucccccuuuuccccuuucccccuuucccuuucccuuuccucugaggcccuguuuagguugcccagacugcucucaacuucuggguugaagugauauuucagccucagcuucuagagucguuaaaauugacaguugugaucuaccauuucuggcugugaauuccaauuuuucaaauaauucaugguuuuucacauuugcuuaauacauuuugaagaaugauuuuuaaaaacaaauuuccaaauuuugcuuagaccauuugaaucauacuucucuaagguagccugagacucuguacagacagcuacucugggugauuagcuaucuauggaaaugccccccacccccauuuuuuuguugugagacagucuuuccauaacccugacuguucuugaacuugcuaaguagaccaggccagccuuaaaauaacagagacccuccuguuucuguguccugagcacuggaauuaaauucuuaagucaccauacccugcuaggaaacacuugacaguuuugcagguaaggaaguuaguugcagcgaauuggaauuaagcuucuuugaguuguauuguuuuuuucaaagacauuuuagaggcuuaaauauuaccugaaugcauuuauuauucaucuguuugucugucuaucuauugauugaucgagccauccaucuaucuauugggucuuccccuuaacccagccagccucccugguacaaggaccaccaguaugagauaccaggccuagcucuucauuugcuuuugugaucauuuuuuccccaguuuuuaguaucuaagcacuucuauuguccuugcucaguggauacuuuuuacuggcuccagaagaagaggcuacuacuguuuuggagcuagaauggguuguaguacaguuaaaggauuauuauucaguucaucuacaaauacuuagugagagccuguccaugccaggcucaugcuagguuugggaauauagugguuuuucuguauauacauugaguguucuuuucccaaaaugcuugagcccagauguguuucagauuucuuacuuuuccagcauagagcuccaccuuguguguggccuguagcgcaaaaggauuccuuguuuguccuuggacaccacagaguugccuuauuauagugaucugauggcauucugcuuuacauggcgcuuagucucuuacagaaaugacacuggaaacucguaaugucucuuguccuucaauggaucucuccagaagcgcagaacuaacuaccaaguuaccuuuagaucuuuauuuauaagccuuccaggauuuucccucauuucuaauacugcuagguuuaaagauuaccuucaaaauaugucucacuuguuuucuucaguuucuuuuacuugccagucauuauuuuggggaaggaaaucuuaaaucuucugugucuguggguuuguaauuuguuuuuucauuuuucuuuaaacuucacaugauaguuacauaguaaagaagugaagagauaagaaagacuuaaccgaugaaacacgaguaaaugcaguaacaaagaaagccacuuaguguuccugugcuguuacuuauuuuauuuaugaggccacuauacaucucaguaugcacaugaagauguuuguugcagguuauugacccaguggcuccacgguacguugcauugcugaagaaggaagucgucccagugaauguccuggaugcgcaggaggagaugaaggaaguagccagacaccccaagguuaccuugcauuguaaucacuguaauaccuucagagaggagcauggcuuugagauauuuucuauuuucaaguacaagaacaaacauuuagaauguacguggggaauaugcuagguuagcaguguaucgguuguagguucuccagguaguuggcuaaguuccuaguaucagaaugaguucccucuuguugagugguccuuaaguccaauuagagagagcuguugguuacugccgagguaugugugccacuaaugcaccccaggguagcauaccauucugcuuacuguugugguucauuagcauuguagguggguagacuguugguuguuugcucccucugaaagcuuagauggcaccuucuggugccuugaaaccuguccacagggagcuggccuuccaggucaguucuaacggggcucuauaucucaaauauauauggugucugcagcaauaggaaucuaccucuaggcgcuggcagugagggcaguggucaguaacauaggaugcuaggagucucuuggacagcucugucccacaacucaaaaggcagcuucccacgccugcucuuggguuuuuguuagguggacaguuacaguguaugauuccuuaggaucuuuuccgaugucuuuacucccuccuccuccccagagcccuccccauuuuucccauuucuacuuucuuuucuuugggggugugugggggauucgagacaggguuucucuguguaguccuggcuguccuggaacucacuuuguagaccaggcuggccucaaacucagaaauccgccugccucugccucacaagugcugggauuaaagguaugugccaccacugccuggucauuucuacuuucuuuagccuguuuuuauccugcagugggccuuuguucuuucccuggucucugcagaucacuucagauuaugcacucaugucuggagggagagauggagcuaggacccucagaugagagagguaucuuuuuagucuuucucucucuaucaugagagccacguggugaagcaggauuguuugacugccugcacgcacaugguauuugcucagaauuugucuuuaaaacacagagcuucauacuuuucugccaaauugucaucugcugucugagaguguuccgugagaacagcuguuccuccuuguauagaaaagcagugagacugaagauuguggggcacauucugguuguggggucagugcugugccuuuagcccugaaaucagugguggcuuuagacuaaggcuuuuuagacaggcugccagguguaacuguuguagugauggaguccuguaccagagauaggcuucagaguguggguuuucuacuuugagugugggccaguguaacgaguguguauugcuuaaguucaaaggauagaauugggaacucagguaaaacuuaccugccuuuccuaguuuggcacaaacacauagaaucuuuguuuguuuaaagagcacagugcgggguggaaggacuuacaugcugcagucagggugccuuagugugucgcuuaacucgcaucuuguuuucuuugaucauucagaauccugauguugguuugaagccugugugguacagucccaagguuuucauagaaggggccgaugcagagacuuucucagagggugagauggucacauuuauaaacuggggcaacaucaacauuacuaaaauacacaaguaagaguuuuauuuuucaacuauguggggaaaucuuucauuuuuauucauguauuaaacauuaucuaauucagacccugauugaaguccuugacacuggugcuccugacuaauaguaaauuugcccaaguggagacaaugacaauuugguuuuuuagauucaugcauuuuuauuuuacacaugugaguauuuugcuugcaugaauguguaugugugcugugugugugcuuaguagccccggaaaucagaagagggcaucagaugaucuauaacuaaaguuauagcuaguucugagcugcucaucaguuuagacauuagaaaaauaguuuguuguuuuguuuguugauagcaucuuaucuaauaauugcucaaggaucuuugggauaggauauuuuguauauguaauauuuauauauuuuauucuuagucaaacauuuaaaguagaucggccaguguuaauaaugauuuuuacuuucuaguuauuauuguguguaacagauuucacagcauuuaaauuuacuauguuuaagauucauauaaguucugaaaucuuaauuauguagucaauaacguauacuugugaguaauuguuaaccuaagcauugaaggcuuauaaugguuuaauagcccaggugacauuaaauuccugaguguguuuauuuucuucaacagauguguauagaucugucguccagugaauuauuaguauucccaauguaguuuguggcauucauauaauuaaugucuaucauauauauguuaaaaauuaaaauagauguuugauuggaauuuuuuuccaaagagaauucuuuauucacuuacuacagaauaauauuacauuucuagcaguuuacuuucuuuucucguuuuaauacuuuucaaucuuuuguagaaaugcagauggaaaaauuacaucucuagaugcaaaauugaauuuggaaaacaaagacuacaagaaaaccaccaagaucacuuggcuugcugagagcacacacgcucucucgaucccagccgucugugucacuuaugagcacuugaucacaaagccagugcugggaaaagaugaggacuucaagcaguacaucaacaaagacaguaagguaacuggaagagaccaggucuccuuucuuacacagauguuagcauucugaaagcuaauuuuaaauguuuuaguuucuuagguaaaauagaaagggcuuguagaauuuauuaaacuauaaagauguaccugggccugguggcucaugccaguaaucccaacauuugggagggugaggcaggaagaucgugaguucauggccagcgugggcuacauaguaaaauuguccugaaaagcagauagccuagcauguacaagacccuggguugaacuucuguacugaaacaaaauaaauggaaacaaacaaacacaagauguaaagagcccagcagugauggugcacgccuuuaaucccagcacucaggaggcagagacaggcagauuucugaguucgaggccagccuggucuacaaagugaguuccaggacagccaggacuacacagagaaacccugucucgaaaaaaccaauacacaaaacaaaacaaaacaaaaagauguaaagaguaauguucacacuuuauaaaugacuggugaaaugcagugaaguuaaguaacuugcuuaaagauaaagaguagagguggauucaaaccuuggauccugcuugcuuacagaaccuuccaacugcguuuccuauuuauuuuaagagaauacuuucacgagguugcgaguugaauuauacacaggcuuccuagagcuacaguucuucaauguuacuuuaaaacugugcugaaugccauugccuguaauccuagcauuccugaggcgagacggaagaucgcuagauccagguuagccuuggcuucauggugagaugucucaaagcaaagcaaaaaccagcucacugauauacacacugugcucaggaauccucugguuucugcccccuccgcacugaauuacaaguguccauucccacagcgagcaucuucauguggguuauggcgaucccacucggguucugugcuuucagggcaaaggguuucccgagugagccaguuacccagcccucgaguaguaaacuuguguuuucagugagcauauuccagcuguuggaauacugcuguguuuacaguucccuuaguguccugcagugagaaguacguuugguucugugucauuucacagcaugaagagcuaaugcuaggagauccuugccuuaaagaucugaaaaaaggagacaucauacaacugcagaggagaggguucuucauaugcgaccagccauacgaaccugucagguaaacacuggggaccuuuuuguguuuguuuuauggucuugaggauugauugcagucucauaagcaggcgcucuacccagcugccuguuagauaaaugaguauaacaaccagacaaaauguuugaaauucucacagugauuaauucaaaaguugagccugacuaaaauacuguaucugauaaauuucugauguucaauuuggugcucuauguuuaauauuucagaugaguaauuaauaaguagugcacacuggaugcuaauaagucauucauuucuaaagugaaacaacuuccauuucuccgugggauguaacuccuaagagcaaugcccccccagacccccuaaaugcuggaaguaacccguggguacagguugaugauagcugguguggcuuugcugcugugaaucagcagggccagaagcacccguuacucccuucucuaugcagaggaaggagcuugcucagaaccaguuagguuagacucucagauaagauagucucuuuagaucagacagcagacccccuuuuagauuaguacaggagggaccaaaacugaauaaaucauacccacucuuaguuaacuggcauuaccacaagaacgcacugugguuugaaaagcauuaacuguguagcauugaauuuaucuaguaauucaccuuuaauugcuauuuagauaauuuuguucaaauaaacuuuugacuguuuucuuuuuagcccauauaguugcagagaagcuccaugcauccugauauacauaccugaugggcacacaaaggaaaugccaacauccggaucaaaggaaaagaccaaaguggaaaucucaaaaaaggagguaaauguugacuuauacagagagcuuggaaucggaggguuuggaguguaucucuuuagacauggcugucuuugcuuuugagauucugagauugaagaagacaagaagugcuguuuugcuguuuuuuguuuugcuguuuuuuguuuugcuguuuuuuguuuugcuguuuuuuguuuugcuguuuguuucuaucauccauuccuauaagauuuuaaaacauuuuggagaauuuuuuuuuaagauuuauuuuuauaugaguacacuguagcuaucuucagacacacaccagaagaguccaucagauccuauuacagaugguugugagccaccauaugguugcugggaauugaacucaggaccucuggaagagcagucagugcucuuaaccgcugagccaucucuccagcccuacauuuuuuauuuuauuuuauuuuuuuuuaaagauuuauuuauuuauuauauguaaguacaguguagcugucuucagacacuccagaagagggcgucggaucuuguuacagaugguugugagccaccaugugguugcugggauuugaacuccggaccuucggaagagcagucgggugcucuuacccacugagccaucucaccagccccuuauuuuauuuuuuuaaccuacauuuuuuaaaaguaauuuuguuauaccaaaaacuaagauagccuagacucacagagcauuuaggggcucccccucccugcaguacauccucucucucucucacccuuucucucuuucuucuuuuacucuguuauuuuuuaacaggauucuuguuguuuguacuuuucuaucccaacuaccuuguauagaagagcucucuccugucauuaaaggucugaaaagcagaaaggaaaggaaguacuuagaguuagcaguggcaagagucccuuugccuuuagauggugggcgaucuuacuuacugucauuuagaccacggcugugaccaccaaaggcuaaacugagcugaacaucucaagugauucauucaccuggguaucaauugaugguggcucugugauagaugcggccuccaugaugcagccuccagaacauggaggccgcuuguguuaacagcucagaccuacagaagugauggucuggaagaaaagaagcaaaucaacaaaaaucagaagugugugcucaguaggcagaggaagggcagcaucgucuucauguuggccuggaagaucucagagucaaaucugcugcgucccagauucauggcaagagacucacuucuaggaagaaggaauuuuaaagaauguauauauggauaugguuagaaaccacaaacccuaaaacaaauucaaguacaguugaccaucaauauuguagugagauuucugcagucuuaaugguuucuuuuugauguauagauccuuggagauauuugccuccgguagaaacuguuaauaucaaaauugaaaucugaucuagggcuuuuugaugcauggagagagugugugugugugugugugucagaguucuuugcugaugaguaaauugaggcuuagcucaguguuuaaggaaugguaaugguaaagcaggucuguguuuuucaucaaccuaaauggguuaaauguacuuaaccuuuccaguagcauacaugauuauuacaugauuauuucauguugccucucugucaugugcuguaguggugauuuguucuugacugaauggauguguuauacuuuggucuccuaaagauaaagauacaggcuccuguggauccucuuaccuccuccgagguuuuugauggcgagacagucugcugucuucuuccuuugcugcugcugccauugcugugggauaaacauuuuaggugugagcugauucaucugcgcuuuugaaggaauugaaauuauuuaugaugaaguaguaaguuuuauauaagcuugugaagguguuuaacaugaauuaauauuuacuuuuggcuuucugcauugguagacaagcucugcuccuaaagaaagaccagcaccugcugugaguucuacuugugcuacagcugaggauuccuccguccucuacagcagaguggcggugcagggggaugugguucgugaauugaaagccaagaaagcgccaaaggaagauauagacgcagcugugaagcagcuuuugacuuugaaagcugaauauaaagagaaaacugggcaggaguauaaaccugggaaccccucugcugcagcaguacagacuguuucuacaaagucaucaucaaacacuguggaaaguacaucuuuauacaauaaagucgcugcccaaggggaggugguccgaaagcugaaagcggaaaaggcuccuaaggucagugugcuggauucacacgugcagcguaagcaagcccuucucucccaugaagcagauucuagacucccuguuuaaauacuuuugagcuagaaaucaucauuuauuacugccugaggcugcagaaugacucagugcauaaguaugcauacugcuuuugcagaagagcuaaauuugucuuccagaacccaugucaagccuuuuacaacucuucuucuauccagcuccaggcagauccaguguuacagucucagugugcagcuguacuugugcacauaccuguccauagauacauacauacauacauacauacauacauacauacauacauacauaccuguccauagauagauacauacauacauacucucacacauacaaacaaacaagagaaaaaucuuuuuaaaauggaaaaacauuuaaguguuuuuuaaaaaaaaaacaaacccucacaguucauaggggugagggacauugugaugugagugugaccugggugauacauuugagugguuauaagauggauuuauagcccagaguaaugcggaaggagaaggcaguucauaaggguauuuaaaauauuccuuguaggcuggaguauagcucaaaaacuuuuuuuuuuuuuuaaauaaggucucuguauguacccuggcuguccuagaacuuauuaaauaaauaggcuggccuugaacucgcagagauuuauccaccucugcuuccaaacugaugggacuaaagguauaagccaucacaccuagagguaucacucaguuuagagacuguuuaauaggcaugaagcuuggaaugacccccagcauaucucucucucccucucccucucccucucccucucccucuugaaguaagagaagccuuuuacagaugacagaguucaucuugacuguggaacugagauucuugcucuuugugcauuagaaguuuuagaugucuuguuaaaacacaaggaccauggccucucuucuuuaugcuaaaggaaacccaggauaugcaaagcgacauccugccuuuuguauuacuguguuucucaucucugaccaaauaaccugacaggcaguccaugggggaaaggcuguccucacucacaagucaggcaugcaguccgccauagaucaggacaggcaagagugucucacggaccugcugaugggauuuauucacuuucuucaugggcuugaagcaaagaaaggagacacaggcacuggccuggcauucuguccuucauuuauucuggacccccagccgcugggaugguggcacccaucucagcauucauauccuucaguuuauccucucugcaaacacccuacagauauccaaagcugugucuccuaggugauucuaaaugcaguuaaauuggcagugaagaguaacccucacaguauuuuaauugugcccaaauaauuguucagguguuguugcugcuggcccagggauugaagagagccaccaugucuggcucuggguuuggucuuguuuguuuguauggcagauauucuuaguuccucuagucaaaaguguuuugagacaugucaucagccacuaaagccagucacagaacagaaucaugggacucacccauccuuuaaguggcccugaagauagcacagguuuuuaaacuggccacuaaacuugccugugaggucucauccaccuggauguguguccuuggcaccagugauguggguuagggaggggugggauguaaggcccaggggauggaagagcaagggccaaaggggagucagcguuccagaggcagguacaggcccgugaacucuguuauucugcacggcccugcaaugccugagccuuccagguccaacagaggcagagagagcuauuuuuaauuuaaaaaaaaaauuacauucauucauuauguaguuucugaugauuuagacaguaaccauaaauggcaaaggcauuaugaagcacuaaacuuuagauucuacagcccaguuuagcagaguaugaaauguuaaugggacacugcuagccacagucaguagucuguguugucucugucuauuccaggcuguggaguuaggaaguugaaguggagacucacagagccugacuccugcccaggagcagaggguuuagcaaacuaauugggcucugcucugcuguacuaacugguggagucaugacuucuuuggagauauuucuuacagaguuuacuaauucaaauaaacagauuucuaauuagaagauacuauuuuuuuuuaaaaaauccugugaccuuuuaauuuguuaauuucaauaucuuguaaacacaggccacaggcuucacccuccccacucuuucaguggaaacauggcugguugugguuggcuuuagcuccuucccaccaaguugaagccucugcucuggggagguguuucuuauaaaugcgugugguuauugcuugcuuaugugugcuaaagagaaaaggugaaguuuuuuagaggaaaaaaaaugacguuuuagcuguuuugagaaguucucagcauuuaauagcuaaggaaacuagauuucucuuuuugauggucucaccauucuccauguuaaacugcuuccaccuaguggcugcugcagaaauagcacuucacauauuuaaauucuaaaugagcagagaugagggcuucuauuucuauuuucucccagucuugaauuaaaauuuuaagaucauuuuugaauagcuuagauucagccugaaacauucagagaaauuuuguguguguuauuuuugucaucauuuguccacaucaaugacuaucuaaaauuuuauuuguguaguuguguuucauaagcucaaaacaaucuuuguccauuaggaacguaacgucuaguagcucuggaaguaaguacgucauacagugucacucagcagcuucuucuuagucuagaaaaaaguuaaaaggcugcuuuccacauucuuuaguguauacuauauacugccagggacacucagauaauacauaauaugcauguucauauacaguguuugugugugugaagcugcuagauguugcuccuguaucucugucuaccucacuuuuugagauggggacuuagcaaagcuggagcuuacuguggcuggaaugugaguggugagcccugugcacacucacaccaguguugacacacugaccaugcugugaacucuguagucaggauagccaggcaugauuacugccugcguaucuagaugccguguaggugagaauuaaguaaaacaguuccuuguaggacacuuagcauggcaucuggcagagcccaaauaugacuugaagugaaaaagcuuuuuguuaguaauucuaguuuuccucagaaaccuuuacagcuguuuucuaagucaucagggaaauuuucauggugauaauuauacauauaaucuugguagaguaucucauucaauaaugugauagauuauuuaucuuaauuuucuuuucuauaauauuucuaauugucaaacagaaauuuuuccuuaagacacuguaccauuugacuucaaacucaagugaauguuuaaacuuuauuuuaaugcuauuauuaaagaguacuagagaaagagagcaugugugaguguguauguguaaguacgagugugugugauaagugaucagacacagcugugggagucaguucucucuugggucaacuuggguuauuggaacuucuuucaaaaaguauauuguagacauauuuacaaggguguccuuuuuuuucuuauucuucacauuuucauucuuuuuuugguuuuucgagacaggguuucucuguauagcccugacuguccuggaacucacucuguagaccaggcuggccuggaacucagaaauccgccugccucugccuuccgagugaugggauuaaaggugugcgccaccaugcccggcacacauuuucauucuuuuagcugacaguguaaccuugccuuccuuuucccugccuuuccuuccauuuccuucuucauuucuccaaccauggauuccccuccuguucucauuccuuaucuuuaacugugacauuuuucuaaagaaaggcauucuauugggaaauaacuauaauucugaaguaauggcaauaugggucagguugggaguacacguagccuucccugaucuucuuuguucacccacaccccuaacccuuuuuuccugggucaugguuacacuguguagcccaaggcuagccuuggacucaggauugcucugccucaguuuccacagacuggaauuacgaccgucagcaccagcucuccucgauucuuccugugcguuuacucuacuugguuguuccugggaucacagagugccaaguuuguagggagaaaaacagaguagcccgagaugugcgcugccaucuccuggaugcaggguccuugcggcugcugcagugcugcuccugcaggacugggcugugagccagucuuaucuguacucccuggcuccuguggcauuuauuauucuguuagccuaugcagugcugugcuguauccgugaaagccgagaggcguagcgcugaacagggaggcacuauuucuucacuguuugguuguugucuugagguucuccaucagauguuaguuuguggugguagcuugaagucggacauccagcuuguccuuccccugugcugcugucugucuucugucacagagugucaaguaucuccuugaugaggaugucauuucuucuauguugaauuaucagauauugaaauuugcagguaugcguguaaguuaagacuucaucauacuuucuuuuuaauuuuugaaaguggucuguaagagugauuucagaccuucaucagauaacaaaaccagagaguacacagagcucuuagcaugguauuuccauguugucugcucauauccuuccauguauuugugugcugaaaauccucucuggcuuacuuacaauaccuaacacgcuauacacaguuguccugcguaggaaggaauaaugaggcgucuguacauuuucagaauagagcagugcuuugccacaugugucuuuuaaaacagaagauagaguuugcucagcugaaccuuugaaaggcuuuuauaaagaacuuauuggucuaaauuauuuucuuucccuacccacuuuuuuugcuggggguuuguauuaugauacaauuguuuguuuucaaauaauuuucaucuuugaguacuugaucucuggauauauauggcuaaguauauuuugauaaugauuaaauucuuugaaaugacauugaaauauucauacauguucugagauguucucuuccucuucuuuuuucaggcuaaaguaacugaagcuguggaauguuugcugucccugaaagcugaguauaaagaaaagacugggaaggacuauguaccuggccagcccccagcaucgcagaacucacauucaaacccugucaguaaugcucagccugcuggagcggagaaaccagaagccaaagugcuauuugacagaguggcuugucaaggagaaguaguucgaaaacuuaaagcugaaaaggccucuaaggucagugugggguuuccucugugguccuguuuuccacauagccauguguaucuagugacugcugucaagacagugcauagaucaucuguuuucugguacucuaggcucauuuugucucuuuuauaaccucucacuuauuuucuuagugcauuuuaaccuauugugucuacaaacuguagccauuaauuaauuguucauugaccugguaaauauggguguggcauuuguuaacauccgauaggacuguaacuuguguugccugauguccuccuuugucccccuuuguuacacugaaggaucaaguggauucggcgguacaagaacuucuucagcugaaggcacaguacaagucgcugacaggaaucgaguauaagccugugucugcuacuggggcagaagacaaagauaaaaagaagaaagaaaaagaaaauaaaucugaaaagcagaacaagccucagaaacaaaaugauggccaagggaaagacucuuccaaaagccaaggcaguggccugucaucagguggagcaggagaagggcaggggccuaagaaacagaccaggugcugagacguguuucugaaugacuucaguucuaaagagauuuuuguuuuuaaaauuugcaaauguugguuuauuaucaucaagacagaaugcucguauuacauugucagcagauaacuuuuauuugauguuaaaaauaggcagcacaucaccugcucaccuuagacuuagaagucacuauagcuuuccaccuguuguuucccaccagggaaaugaaccgcucaccacugucacggguugagaaucugucugaguuguuccguuguuguggagagauagcaugaccagagcagcuaacagaagaaggaguuaguuagggcuuaugguuucagagcauucgaguucaugaccaucuuggcagggaacauggcggcaggugccaggcaggcacuggagcagagcagcaggagcugagcacuuaauucuugaucugcagacagaaggaaaaacagacugugccuaccaugggcuuuugaaaucucagagcccaaacccagugacacaauucuuccaacaaggacacacauccuaguccuuccuaaacaguuuaccaacuaagaaccaaacuuuaaaauaucugagucugcauggaaugcucagcuccugaagccuagacaaaccgugcagaguguagaaagcucugaagaaugaagcuauuauguucccagaaauacugggauaucuaaacuaguacuagugugucgugugucucuugaaagaauagcugcaaauaaacauaaauauuccuuucagcagcagcuuagagacacguugcuuuguguguuuuuucuucucaagcggauguuuuucauaagaaaugaauaagaguuuuguucccaagacgauuuugaaguuggcaguagcugguuuaaaaaccagacagugaaauguaugucccuuuucaguguuuuucugucugugugaacagugugacaggcuuccugucauggcuucuuagaaaauaguuuaaugcuauuacugaggugguuuggauuuuagauucuuuuuuagcuauagaucaaauuuagcuaccucccauguuccuguaccaucuccuuaauggacacagaaucuacuccugguuuuguguauugacucagcucaguaacaguauagaauaguuggcaagaguuagagccaagcuuucuauguagcucaggccugccuugaacucagucuuucugccucaucauugcuuuugcgauuauaaaugagcauaccccaugcccaacuaagguugaggcuuugcggaaagaaguacugucuggaacaggaauugagggguggguaggaaaucuaggaccaaagaaaaggucuuucacuucuaggcaauauucuacucccaaccccagcucuggugcuggauuaguuggguuuucuuagguuuguuuguuuguuuguuuaauuuaaaugucacuuguuuuuacagacauccaccucugcaucuucuguacaguauaguauaaaauauaagugcauauucacuuacaugugaauauuuauuugugcguguuuaguggguggcuacuguuguuauuacuuuuuacauuuaauuucagugagacacugaucuuuuuagcuguuaauaucaccucuguugauuuuggcaaaaguuuuuucauagcgaauauacgugaauagacuuugucuuuaccaaauauauuuuaacugaaaaagaauuugcuuaaaaaauaaauaaaagucuucuuuuaaaaucauaguucuaacagguuggccuuggcaguuuucauggacaaugucugcccaacuucugaagagcuguuuuaaugcucccacaugcccaugaucucaguacuucugagacgagcaggaagacugcuacaaguuuggggcaaucugaugugcacaucaaguuauagccaagcagggacuaagcagugaaacccucccuguguuaaaaaacaaagauuaaauuguuucuagauuuaaaacauuauuauggaaaugaauguaaaagaugcaaauaaagaaaugacugaaaauuaagaaaacuccccuauuuugagcuuaucgucuuauuuucaguuuagccugcuguggucugaauguauucccaaaguccauaugcuaggaacuuggucccccaguuccuagagagacuaucaucuaaugguggaaccuuucagagaggaauuaaguaaguugaaguugaaaaaaugugauuuugugaugguguuaaauggcuuuagagcagucaccgucagcagcuuucucaugucuuguuguguccugucgugcccaacccaagauaugccucuagagggcccucaccacucacagaugcuggcaccaggcaacaccaagaccaaauaaaauaaguucuggucuuuagauuacuuggucucaguauuuucagcauaagaacaguugccaaauaaaggauucuuguuuccuuuugcaugucugcagauugggucuugaagcaaaaaaagaagaaaaucuugccgaaugguacucucaagugaguaugccuucaguuggcuuuuauguuaguguuucucaauucucuaguuuggcuuuguguuuagauucuaaagucuagggagaaagguagucauaagcucugugaucccuccugagucugugcauguguguguucaagaaaaugcauuuauguguguaugugcacauguggaggccagaagacgacaucagguuaccuucagaaaagccguucacccccuuagagacagaucucucuuuggccugggcucaccaaucaggcuaggccaucuguaccccagagacccuuuugucucuucucuucuuccuuccccagcauugaaaguacaagcgcaccucucacuccaccaugccugacauuuuaggggucucaggaccagucuuccuguguguaaggcggacaccuuaccuauucccgugcaucucccaugaugcccauuauaguaucuaucguguaucagaugugguggcacacucauggcaccccaauacuuggaagaugacggcaagagaauuugaguuccagguuagcuggccuacauagugaaacugucuuaaaaaauaaaaauaaaaguaggcugaggauguauguagcucagugauaagucugcagacuuagaguccuguuaugcguugucuguccauguaagaaagucuggcuucccuccacauuaaggagaguguuuccaagcugagcauaaugguguaaccuguaagaaaguauccuagucuaagagugaguuccaggacaaccagggcuacccaguggagcccuguuuugaaagacacauacaaacaaacaaacaaacaaauaaacaaaugaggugugugccauuucuagacaggaacuuugauugccacaggcucuugccuuugcaguagauagugguucaguauccaagccuucucucuuuaaaaggucaucacaaaguccgagaugauugaauacuacgaugugaguggcugcuauauccuccgucccuggucguacuccaucugggaguccauuaaggacuucuuugacgcugagaucaagaagcucgguguugagaacugcuacuuccccauauuugugucucaggcugcguuagagaaagagaagaaucacaucgaagacuuugcuccugagguaaacugcaguucugucuuauaaacucaaaaguauaucuccaguagaguuuaguaaccaacuaagagaaaggaggggcuauuccuuuuuuucuuuuucuuuuuuccuuucuuucuuuuuuuuuuuuuuuaauaaaguccuauuucuucuacccuuauagcaaguuugguugcuauucauguccucugacuggaugguugcccauuuccuuauaguaacagcagcaagaauucgcacuuucuuuaguugaugagaaagccuaaaaguugauauguacuauguucuucaaaaacaacauuaaaacugugugucaccaaugguuuuuaacuuccuagguugcuuggguuacaagaucaggaaaaacagaguuggcagagccaauugccauucguccuacuagugaaacaggugagagugggccuggaacgcaggagaaagcucgcugcgcugugguuagauagaguugagucucaguguuucuggugcauagaucccuuucugaaggacggugaagacagaaugaagucuacaucauagacauguuauauguuaagccguguaaucacagaguucuuuaucaguaggauguaagucugucugucuucuucuuaaaggaaccuuacauuuuagguuuucuuuuuaugcguuaguucagcugugagugcauagggauuggacuccagcuucaaauguuuguuuccuaaagagagcacagccguuccucuccucuuucccuuggaguuugccauuuuggcaaguuacuggaagauggcugccaugacuaaaggggguuuuucuguuuuaaaccucaucaucugcuuuugcucaguguuacaacuuuucagagggaaauguauugaaauuauucuugggacugauuauaaaauugcaaauaauguuguuguucauuuagauuuauauuccuguagaguuuuuuguugcuuuguuuuugaguuguagaguuguaauuguagaguuuugauuuugaggcagggucuccauccaacucuagcugacugaaaccugguauuuuggucaggcuaaccuugaacucacagauaccccauccccaaguacugggauuaaagguguacgucagcagugcagcuucccugggguuuuuagagcgcucuccugugagucugcuacugugggacagcaucagcuggagcgucucuggggucaggcuucggaucugcuggcguggugagcugccuuugguagugcgcuucucugcucagacuggugcugguuuucuauuugcaucuuugaaauuauuuugacuccaguuuuuuuuuguugcuguuuucuuauaccaaauuagcaguuuuguuuuacugauggcacaagucauacauaguucauggcaagaguuugcuucauuggauggaucuaacuaaaauucugauucugauacauagcugaauucaguacuaacauuaacaucuuuaaauuugaugguauuugugagccaaagagaggcuuaaacaguaugaagagugaacaguuuuacauggaacacagcauuccuaguauuuacccaaguagaugguacggugagcaacucuuacagacagagaggugaggcacagagcauuagcucgcuagguagaccugugucucuucaggauucugugauuuaugaaguaagcaaugccauucagugagcugucacagauaaugaccagacacacucuaauccauauuaauuuauauugugaauuuaacucuugucagccuucaggaagaaaucaaaucauagaugucucuguuuucuuuacuuccagugauguauccggcauaugcuaaaugggugcagucccacagagaccugcccgucaggcucaaccaguggugcaauguggugguaggugcugcacacacgcauacuucauuugucacuguguucuucucaggauuuguggcuuuguagagcauacuuucuuugguugguccgaccaugaaaguaauuuuugaaguauuuuggaucacaauaauuauuuuugauuauucaucauguaaaguugcuaauaaaaaacacuauuuccugugcugacuggcuuuguccucucaucuugcagcgcugggaguucaaacacccacagccuuuccuccgaacucgggaguuccuguggcaggaggggcacagcgccuuugccaccuuugaggaagcagcugaugagguaggaacgguccucugcugugcuccugucuucaggcccugcuuuuuuauuauauggcuuaugcuguguaaaaccuguuugaaaagaaaguuuauucaagagcaaacaaauuuaaaaagcuguuuauugugccgggugugguggugcacuccuuuaaucccagcacucaggugguagaggcaggaggugcucuguggucuacaaaucaagucuaguacagucagggcuuguuacacugagaaacccugaccaagccagacacacaaaaauaccaacaaaacauugcuuauugaaauuuuacuaguaaauuuacuacuuuaguuuuuauagccgggcaugguggugcacgccuuuaaucccagcacucgggaggcagaggcaggcggauuucugaguucaaggccagccuggucuacaaagugaguuccaggacagccagggcuacacagagaaacccugucucaaaccaaaaaaaaaaaaaaaaaaauuaugcgauagguuagguuguagcaaaauuacagucauaugauuauuuucuaaggucuuuuuacucugauuacuguauaucgcucaggcauuuuuuuccugcauuccaaauuuauagacacuuaaauguuucucagcugauuacuuuuuuguugaauaucuuccuuaagucucacauuggcuucuuuagccuucccacaaggugguuguuugaaguacuuuuucacauacaaaugagauaguauagauugacaagccugcagugaauaagcaugcuguaaauguuguuacagguuuuacagauccuugaguuauaugcucgaguauaugaagagcucuuagccauuccuguugugagaggaaggaagacugaaaaggagaaguuugcaggaggagacuacacaaccacaauagaagccuucauaucugccagcggacgcgccauucagguauggaaguacugugacuacucggccacuguaagcacagcccaugacaguuccagcaguuuuugccacuuuuauuaguauuuggaaaaccaguauagaaaaugguauuaagguuuuaaaaauaaaaucaccagugugugcucuaguaauaccucuuccagugacgacaucacuugguaaaaaacaauccacaauccgcagaauauuuagccauaaaaggaaugaauucugucauuugcagaacuauagaugaaauuggaaauguguuuguuaagugaaauaaaccagauacuauugcaugaucuuaauuguaugugaacucuaagaaagugauuauauauaacuaacuugauaauagaauuguguuuauuuggaugucggagagaauaugaguugcucaguaggcauuacacuuuaguuccaugggaacaaaacguuaaacuguggcuaaugaugcuagcagacgccuauaauuccagcucucuggggaucuugggucuguggccagugugagcugcauaguaagacacugucuuuggggguugagggggaaucugcccuguugguguauacgaaggugacuaucaagaguaaugcagucuguguuuuuuaaaagcucaaagaaaggauuuugaaagguuuuuuuuuuuuuuuuuuuuuuuuuuuuaaacagaaagaaaugauggauuuuggagauaaguuaaccugauuuaaacauuauaaaauguauguguguugccucauuauguugacuuuaaaugugaauaaaaaaauaauuucuggggaugcaguacagugcuucucuaauguucauggagcccuagguuuaauuaccaaugcuccauuaaacugggcaucaugguggcacguguaacucaccuacagguggaggcaacaggaucaaguauuugaggcugcccucagcuccauagugaggugcuacacccaucugggcuauguaagacccuuccucaaacccaggggaaggagcaggagagagggcaacaguggaggagagcagguccaggcaugagaucugggaagucuagcacacaguuacuccugaaaggggcuucccggagcaggaccguggugguuuauaacucauccugcucucuugucaugccaauccuacuuguauuuucagcauuaaugucagaaaauuagcuaaacaguacauguagugacauucuacagugugugcucuuguaguaauugucgucaaaggcaaaauaguauaaaauuaagccucuguuuccuuauuuuagggagcaacaucacaccauuuaggccagaauuucuccaaaaugugugaaauaguuuuugaagaucccaagacaccaggagaaaagcaguuugcauaccagugcuccuggggccugacaacacgaaccaucggugugauggucaugguccauggggacaacaugggccuagugcuuccaccccgaguagcaucuguccaggugagggaagugucucugcuuaucauuucuuuuguaagauuauagaccacgcuuacaaaggaaguuugaaaggguagauuucucugcuacagaaauaauagaaaauucagccuaggccacuauauuguaaaaauauguguaaauuuguauuauuuauugucucaagaauuuuaaaaauuacuucauugaaaacuuuuaaauuugucaauacauuuaucauuuuauuuucuguaugaauguuuugucugccuguauguuuaaggaccacaugcauccuuggugcccaccaaggucagaagagggcaucgaaucccauggaacuggaguuagagauaguugugaacuaccaugaggauguucuuaauugcugagccaucucucuagcccuagaacuuucuuuagaaauaauuuuuggauacuauuuagaauuccuuaaaacauaguagguuaaaaguauuaauaagugcuauuuaacuauuuaguauauuuuagagacagauuagaaaucacauagauucaguugugauaagauucaguuauuagaaagcagacugaggauuauguuagcaacaaaccagcucgugcuggauccccacgaaaccuccaaaccagacuaggaagccauucgugccagcuuucugugggcauggcuaaaagaccugggacuggagaaauggcuuggugggugagauagcauacaacugcucuugcagaggacccagguaugguucucugugcccacaugcagcaguguacagccucugaugcuagcuucagggggauccagugccuuuagccacacuggguacaugguggcacacaucuuuaauuuaagagaggcaggaagaucucugaguucuaggccagccccgucuauaugcugaguuuagagaggccagucaaggcuucauagugagauucugucucagucagagagaccccagcaagcuauaggacaaaaugcccuuguucucaugauguagacuuaaaccccuaaacucuuuuuuuuguuuuguuuuguuuuuuuguuuuuuuuuuuucgagacaggguuucucuguguagcccuggcuguccuguaacucacuuuguagaccaggcuggccucgaacucagaaauccgccugccucugccucccaagugcugggauuaaaggcgugcgccaccacgccgccccuaaacucuuuuaccaagaaauauuuggaaagaugaaagaccauguuuucaaaggaagguggaaauuuggagauguagccaaaaugacagagaggaagaacuguagucucccaaaggaggugaaaaggagaggaaggaggucccagugcuucucagaugccacuggaggugcugcaaaaacaugaggucaggugaccucagcaguccucacaaacagacauaggaacagaaagcagcugcccuaaaggagagacacggaagcaaggguguugcuuucugcacacugggggaugaagaaggagccugguaggccacagccucagaagaggauggaauggagaggacguggcugucuuguaccgugugcucaggcaguugugcugcaaggacgacauucaugggcagcucagcgcugacaucacuauaaccugcagguuuccacacagcucaugaaagagucuuuguagaaaaagugcuuuuaaaacaauguagggugaaaaaaaaauguaggcucuagcauuucaagaagucacuauggauaguuagauuuuuuaagcccuuugguauuggauauuauuuaauauuuaauagcuuuuguugguauaguuuuguuuuuauauaguggcccagcaguacacuauuuaggaauuccucuaguauuaugcuuuggauguauuuaggaugcugccuguuguggaauuguuuuguucuguucuguguaaagauuuauuuauauaacuuacuaugugugcauacaugcaugccuaaguauaugucuaugcaucacauuguaugcuggaacacucaaaggucagaagagaaguugggcccccuggaguuacuuacauaggguugugagccacaguguggguccugggaaccaaaccagauacugcaagagcaauaaguguucuuaaccacugagccgucuccagcaccauguuuuuaauuguaguaaaaucacauauauuuaaaagaucauuggcagauuuuaacuucuguaugguucauuauuguaggaucuagaugauucguuauuguagauguaacuaugaguauguggugugucuuuggcuggacucuaggugguagucauucccuguggaaucacaaaugcccugucugaagaagacagagaggcacugauggcaaaaugcaacgaguacagaaggcggcugcuuggugcuaacauccgaguccgagucgaucuacgagacaacuacuccccaggcuggaaguucaaccacugggaacucaaggugcgcuggaguccuguuuggguggcucuagaucucugcaaacuucuguugccuucccuuguucacauuuauaaguucuucacuuaaacucagucucaguacagcucauacuguaauggggguuucuagagucuguguuuguuaaacuacucucuguggugguucaaggagaauagcuuggugggugaacacuuagugugugcuuggccugucuuugaauacacagcacugugccuugccucccuaaaaguguuguggaaacugguucuuauguuagaauacagcuaucuugcgguguuuguuuauacuaaggaagccucaugugggauguugcagugcuuauaucuggaauucagucgauggcggagugagguuuuggugaggauggaguccucacagguuucuaguccgccugggcgcacauccacuucuuguuuucaacucugugcagacaaagccuaucuaauucuggcuucauguuuuugauauauuuucauuuacugcauagcuucauuauuagguaauauaaacucuuaguuuuauuuuauaaacauuuagcauuuuaccuuuuuuuuuuuuuuuuaauagcuaugauagagauuuuuaccuuagacuggaaguuaggagucaaauaaauauauaccaacuuacauuauaggaguaguguggaacauguccucacaugguagcugagaucuuaaggguggaugcuucauuuguugggguuuuucacaaucaaccaucucacauuacaaagccgccaguguuuaucaucuuucuuuaaaauggcuccuaaggucacccugugcugggguuagucccaguguugacccugcuucucugugugucauacuucuucacauguuccccuaccuucagggaagauaccagcagcuacuucuuuaagccaguuuauguguggguacacgauguuaaaagagaaacuugcuguuagcuuaaucaaaauuaauuuaaaaugccaucuacuucugcaucccccacuucccucuccuccuucugugcugugagggucacggcuugcuggcauucgcuuacauuuccuuuggcuucgacuugaguacugcucaacauacacacacucucacacacacacacacacuaucuaucuaucuaucuaucuaucuaucuaucuaucuaucuaucuaucauucuaucuauaccugaagcaguuucaaaggaucuuucacucagguuuaauuuaagaccuacuguuuuucagauagaguucuagacccuacaaaugcaaggucuccuuaaaccugaagggcuucgguccccucagagauagaucacaaugcauaagacuugaauauguaaggagucuggcauguagcuccuucuucaguucccugauggaaaccucaaacuuuaucccaaagccagcaaucugagcagcccuuaaccuagaguaacaagaaucugaggugaggccugcaggggauucugauauauucucuaguugcaggcagaguacagguucacuaggaaugagucugggguguaccagugacuaaccccucaguguccgaggugugucugguuucaaggugucucugucauuccguguaccaugugccauuccaugugccauuccaugugucauuccguguaccaugugccauuggugaggaaaugggauucagaguagaugaagccaugauauagucugcaugcaacuugagauacacaugcacuuuuaacugccuguuuuguuuuacagggaguuccagucagacuugagguggggccacgugauaugaagagcugucaguuuguagcagucagacgagauacuggagagaaacugacaauugcugagaaggaggcugaggcuaagcuggaaaagguuuuggaagacauccagcugaaccuuuucacaagguagcucuauaggcucccugugucuccuuccucagugcucacuacugccggagucacaaacagugggcauuggugcaacgaaaagcagcuuucccuuccagucccaggcccacuuaaugucuuauucuuccuguacauuggacuuggaguaggcuuuccuaaaugccuguucccugagaagcugugcucugucuugaaccaacagguuuacuuaaaaaccaggcuuuuguaacaucaaugugaggguuuaagucauggguucuuaaucgcccgugcagacugauagaacccaggaggcuugaguaaauagcagcgcuuucccugagauacugcuuacaguggccuacagagaagccagcagccauagugcuaaaagcuccccuguggugguaggaaggcuggcucagugcugaagagaucaauggguacuguuccugcagaggaccuaaguuugguucccagcagccauagcaagcagcucacagcuuacuguaacuuccagcuccaagggaguccccaggugcgucuggaccucuuggggacggauggacacacacacacacacacacaccccacaaaaauaaaugggauugaugccucagcaguuaagagcacuuacuuuggaccuggguucaguucccagauccugugucagaggccacacagcugccugugacgccaguuccaggaaaucugauuuccucuuacagagauagcgcacacauacaaguaggcgcucacaagugcaccgaaguguuuaaaacaugaaaagcuccucaggggauuugaguagccaagacuaacaacuccucuugauugguuugggagaaugagauaguugaggcauugggcuggccuauccuauaagaggauuucuccccucugccuaccugaagcaguaagaggaaggcuacuaucacuagagauagaagcuugguccaagguuaggggagguagcccauguuauauucauucuguugccuuauaguacucuaugccuaauacauaguggguuuaguggguuuauuuauugagacagggucucacuauguagaccaggcuaaccucaaauucagagagauccaccuguugucuucacugucugagugcugggauuaaaggcaugcaccaccauuccuggccacauugcgucucaauaaaucugacugggagagaguagacuaauuuuagccuuaccuuuggugcuugauuggguguuucuaggcagcuaguuuauagcuuucucuggauuuauucauaaaaguaucuuuuuuuguuugguugguuuuuguuuuuuugagacaggguuucucuguguagcccuggcuguccuggaacucacucuauagaccaggcuggccucgaacucagaaaucugccugccucugccucccaagugcugggauuaaaggugugugccaccacgcccggccauaaaaguagcuugaauaguuauuuuaggauuuguuugguuucuggauaacaugauacguuuagugucucugcacugcgagcggguaguguugugggugaggcauugggaagcugccugcccucgcugcucucagugcuucucuguucucagucuccuggaacuugaggcacugagagugcugaacuucauaccuagaaauccugacuguguuguuuuaagauaaauuucugguugguuaggguuucucuccugugauucaugucgugucucaggauggaaaaccagcaucauuagugacagaagagcaauuuucucguuuuuuguuuuguuuucuuuauuuuucuucccuuccucugauuggucaucuguaguaauagaaucuuaggcauuauaggcauggaaguacuuuguaaacacuggauagaagacuuuauuaguaaaagaugacuuuugcaugugugugcacacgggugcauauuguucacauggagaccaggggucagccucccacuccuuucuucaggugcauccacauuauaguucguggagccgacgucucucacuggauuggagccuaccaaauacgagacucgccagucccaggccuccugggauacagcauauacauauaugaggcugguuuuguuguagguuuuaugagcugaggccuagacucccgggcccucgugcuuagaaaggaguuaagcugucucuccaggcucuacagggguaauuuuauuagagcaaauuauuguugguuuuuuguuguuguuguuguuguugaagauaaggucuguagcuuggauugccuucacacuuuaggcuggccuuggauuccugacucuccugcuucagccucccuagugcuaucacucuuggcuuagcaggaaaguucagcgacuuuuuauucacuuucuaucaauuuugcacauaagguuuauacugaauaguucauacuuaauuuauuucuguuuuuuguuuuguuucuauaauuucucacugaggugcaugcucauuauaaaaaaguugugacauaugagagcaaaauuucuuguggaagccacauccagguagaacuacuaggaauauucuguguggguuuuuuuuuccuacuuuucagaaugaaugugggacuacgacucguucugauugugugaguucagauuguaauagucaguaugcauauacucuacuuuuggguucauuuuuuaaucuuguacaauuuucagugugcguuacauuacuugcuuauaaauaucgggccuuugaauaagucucgguucuauauauaauaucauuacuaaggaaaagcuggauuaggauaacaacucauuguuaaagucagguaacaaugaacacugguucacaugauucuuuacuaacaagcauaaagaaaguggugcacugagcauuuuacugaauugaggacacagcaguguagacugaccacaaacuuguguucuugagcuuuucccuccauccacagcacagguucuccuguguauucuagaccgcaagacacgaauccuccuggucauuugcuagauucaguguuagggugcauggugugccuugcacugugcuacaucccagccuccuuccuaucagcugugguuaaagaagcccugcgugaaguagacagacaagacgcaggccuguggccagcuuuccuguucucccaugaaacagugugaagucggccuacaggcccagugcugcgcuucucaggaacuuagaucaauugauuuuauugguucugucgucaccuagaacuuagugacaaggacagacgaucacagccauaucaaggcagugcuggugggugagggugcaggagcaugcccugcccucaagcuuaggguaggacaugauuuuuccuacaaaaugugacagaaaggggaaaagaaaaaacagguagguuugacugacagcuagcaauggcuaagaguucacaaggucuuagaccugagauucagaaaagaacaacugucuuuuuuuccucauuacuacgugugugauuuuuuacuguagaugaaaauauuaccuaauaccugaggcucuuacauggagccaggcauggugauuuacauccaguaauauuagcugaagcaagaggaccaugucccaggccagccugggcuacauagugagaccugaggggacaggaguguugggugguguaaaaauaccuuugauuugugucugcuuuucuuuguugugauauauucauaccuucaugguucuauacuucugcuacaguguuacuuuuuuuccaguuuuguagaaaggaaaaguagaugagaaggguuugaaaaauaacagacuuccacaggugguguaagugagagucaggacuauucaacaggaauaacaaaauagccuauuguauauguggcaagcuucccacaccucuaggcucaagcgguacugcaaaagguagcuggcuuaucuguggccgccgcuaguaagggggugaauacucacagugaguucuucucauuuucacuuacuaguuaucuuguuuaucucgggacuuaaacugucacauuuauaagaaaagucucguauuuucugauguauuuuggcagggcuucugaagaccuuaaaacccacaugguugugucuaauacacuggaggacuuccagaaggugcuagaugcuggaaagguaagagacuuccaaaaaaguuuucuugguuuuugcuuguuuucuucaggguuagggguugacccccuagggucuuaccuggguuggcacuucuacuacuaaucaguaaauuguauuuuaaaacucuaugaacuuauacuuuguauuaaucucuuuuuaagccagccaaucaaaaugauggcacauuauucagcuucauauauuauuagagugaaucacuuauggacuuuaguauucugguauacguguuaaauaugcagccagucugugucuccagauuacagaugagaaagccaugggccagagucuaaacaaauuagcccauagaauuagaugccagaacuuagacgucucuaacacaguuuaauggacugccuccucagauuuuuaaagauuucauguugagaauaaaagacggaguuuuuuaugacggcagccuagugcugaggaaaugaccgcuccacucugcugauuuguaaaauaaacgugaaauagaugaucuuaaaauugcuaucagauuccuacuucuucagcauuuggcuuugguuuacuguuuuucugaccuuuuaccuuucuguauucuauaauguucccuugagucaugcugcaugcuuguaauagaagacuggaggucacguggccauccgcucucggguguuuuccuuccugugcaguguuuaugcguugcuuucucuuugcuuucuugaguuuuccaugagcauugaggauuggauuuaaggcuuuggcgugguaaugcugggcaggcacuuuaccacuaagccauagcuccagcucauucuuuuuguuuugaguaaagaucuccuuaaauugccuagggugacccuugaacucacuguagagcccaggcagcccuugaacuuguagucuuccugcuucugucuccugagagcuuggacagcaggcuuaugccaacagacucagcuuccuccauuaauaacuuaaauaaaaagguuucauuuacuauaaagauagaauuagucacuuuuauguaacaguuuauuagagacauuaauauaauaccauauauauaaaaccaacauucauaagguauuaguggguuguaaauuuuagucuaauauuagguaaauuacuguggggauuucacauuuaaaguggagcagggguauuuuaguuucauguuuaaagaauacacaggacaauaaauagagucugguauauucagcagucagugccuucuccucccuugcuccaugagggcuaucucaggugugcugaauaaccaucaaacagccuuugaaaggaucuuaggaaguuaaaguuagguaaaacuuugcuugcuuccucucugcgugguaaagaguuggagaggcuagagugcucacugacuuccaaguguggucuuccuccuccucacuuaguuuccuugccgagauuauggugcuagaggccgagucuggggcuucaggccggcucagcaaagcuaagcaggagcuuacacuggagcuccuuguuaucucacagugaggagacaggcgaggcucuaggucccuggugagcuaggaugucugaacuuuggauguucuugccucagcccuuaaguagcuagaauuaucucccugugccaccaggcuuuguuagaauaacuuaggaauccaaauacaauuuuuccauguauuacaaucauuauuuuauauguuacacaauuuuauaaauguacuuccauacauuuuguuuagaaaccuuuagauuugcagcucucauacagggaaaugacuguuacuuuaguuuagguuucgggucuuuugucuccguuuucauggccuugaacucagaaauccuccugccucugccucucgagugcuaggauuaaaggcgugcgccaccacgcccagcuugccuuugauacguuucagaaauuagacuagcacaggcacugaaugagcagagaaacuugaucaugggcuggcgagauggcucagcaguuaacagcacugacugcucuuccagagguccugaguucaauucccagcaaccacaugguggcucacaaccaucuguaaugggaucagaugcccucuucugguguaucugaagacagcaacaguguagucacauaaaauaaauaaauaaaucuuuuuuuuaaaaaaaagaaagaaacuugaucauguuuccuagaucccagguucacuggaaggcuuugcagaggaacuuuuucuuuugucuuugagacacugcgguauagcucaggacuuagaacucuuccuugcaggugggcucuucauuuucagaauguagagcccugauaauucacgagaagucagugagcugcugcugccuccacucucacugccugccccucucuguccugucuauugcaugagugagugugcaugccagagcacacacacagagggcaaagaacaaccuggcaacagugcguucucuccacccacuguguuguccccugggauugaacuuacauugucuggcuugguggcagacccuucccggccaggucuccagcccucuccucuuuucugcaucucuguaucuaggugucuucccagcaucagcagugaccuagagagacuacauaaucgcuauugcaggcaggucccguuuggguaugaagaaauaacuggccugucaaacauuucauuuuauuuagagaaaauccaggcuagggauauucccccuccucuuucuuccuucucauuuggggccugcuguggacugagcagugucugugugcaugcuagguaaacacugccacugaacucauauccucuucccuugugcuucauuuuuauuuuauuuagagauaggcacacuuguagagaccuugucagacuuugaacuugggauccuuaugccucagccuuguaaguaguugggauuacaggacaacccauuuucaaaaaggaagugaauuucagaauucaaauaaaauacuaagucuugguucugcccauuauuaaccaguccaaggaaaacugaaagguugauuuuccugauaaaaaaugauuuuugucuuuuauaagcuuuuguacuuuaaaagucauucacuuccuacugaccuguuagacucgaguggggucacgggccgcuugccuggccauuagcaguugcuguuaccuugccuuggaaucacuuuauuccuagucacccccucccuccuccugucagccaugcugugggccuguggggagcugcagcagaccucaccaugucacggccaguuauccagacacuuuagugugucgcacaugcgaccuguuuuaugacuguagauuuuggaugguguaaaauaccauauuuugcucuuuuguguacuucugagccaaguucccagcguguuugcagaggugccuuugcccccaaaacccugggacacugagcccuuuugcuuggagggugaaaagagaacucggguccucuccaggagcugugauggcagaguguuuuuccuuuccuuaccagguugcacagauuccauuuuguggggaaauugacugugaggacuggaucaaaaagaugacugccagguaaguguaacccugacucccugcaccgagaagggccuaguacacagcaggaugaaucacuacugucucuuugauuccagggaucaagauguggaaccuggugcuccauccaugggagccaaaagccuuugcauuccuuucaacccucugugugagcugcagcccggagccaugugugucuguggcaagaauccugccaaguucuacaccuuguuuggucggaguuacugauggacaaaacagaagccacucucucucucgcucaucuuuuuuuaaaaccacugauacgaagaucuucucagaugcaauuuuucuuuuucauuuuuuaaaacuucuaaaaaaggucaugagauaaaacagcuauucuuaugccuaaauuaacaguggaaaauacuuuucuguaaacagccaggguaauaaaaaccaugaacuaauuguauuuuau

SEQ ID NO: 582 - RNA, 10868 nt, Mus musculus
cacgcccacucaccaugucucuguggcuguccuugcuugcuugcuuccaccuaaaugcugcagcuggaaggaaguuggugagauuuccuggcugagaugugcucucauaggaauccuuguagguacaugugugugcagacccaugugugugcccauguguggucaccuuguuuuagcugcuggccggauguugaacucacuugggagggucuuagagccaggcuuccacucugaaguucuguuuuacgcuggucuuagcuagacucuuucucuacuucuuuuggaugcuuaugauaacaucgguaauuggacauuuuguuuguauuuguuuauuuaucuauuugugugugugugugugugugugugugugugugugugugugucuacgccgagucuaugucuguguaccauaagugugcaggagccuguagaggcuagaagagagagucugaucucucagaacuggaguuacagguauuugugagccgccaugggggugaugugagcugaacccugguucuccaaaagaucaguauaugcucuuaaccccugagccaucucucccgccccaguuuugauaauuuaaugaguauuccuguuccaagagcaguaugagacucucacugggcacugcuuaugaaguugauacuccuguuacuuccuucucugaugcugguugagaaaaccgaggccaaacugaugcgcuccgcucagaaaauccucauguucacguuagaaaacccaggaagcaaauggagguacucagacaaccguuaguaacugacagcauccaugcacaaaugguauauguuuaaggacuuuugcuuuucccuaaacgaggguucucuuugcuuuccaaguauuuagaauaccuugacuuuuccuuuuauugccaggugaaauuuuacaugggacaagucaacaaaaaaaaaagcccgugguuuuagugcaacacuuuauuagauguuugaacuuggguugcauguuguucuuacgaccucaugaaaaggaaggcuuuguuuguuucugagaauugugucuaugaauuuuauauuugggguuaaagguuuuucuuugacuaccuggagagucuggguuuccuuguaagguacauggaaugcucccaaucuggccuuuuuauauguuaauuuucuccaaaggcucaggcggcucucaggguaucuaacuucaaacccuaguaccacguccuaggauuuggcucccaaacauguaacuuaaacaguuuaagaaaaugaagcauacuuacaauaugagcaucaauuucuuucuuuuaaaaaaagauuuuaucuuauuuauuuauauuuauuuaauuuauuuauuauuauguaucuaugugagugucugccugugaagcuggaagaggaggcuagaccccuggguccucugcaagaggagccgggcgugguggcgcuugcucuuaaccacagaaggaucucgccagcugccuccaaagcccuuucuuuuaagaacaguucccaaguuagaaauaagucaccccaccccacccccacccucccuccgcccagccccauuagauuuuugcaucaggguuugcauugugaaaaguagcucucucuaccugcuuacucaguguuuuguaaaggcgcaaaaugaaaggcaugcaaaucacaagagauucuucaggguccugggugacuccugguaguggcucaagucuuauuacuuuauuuaauugaaggaguguuugcaauaaaaaauggagcaguggucuggagaagaugccucuauuuaagagcaugcucugcucuugcagagacagaaccugggcucuccaggggaucggacuuuuuacucuuuaucgugcaggcuccuuaucauccuuuuaaacuaaggggcguuuguuacuuugucuuccuucgguuuagacaaaaguucaucaacuuuauucuuucccaaaaccccaguucugcccggcuguucucugggcucucaccuaguuguguucacgguuacauuauuguuucuuuccuucugcugcuuucagacuugcucuuuuucuguuuuucugaguggcaggccagcucuggcuuugacauccuccucugaugucguaggcgcuggaugcuuuaugcuuucuucucuuccuguugucuuuguugcauccagucagcugugcaggguuuuguuuucauuuguuugaagaucuucuccaguucccucuggagguucugacccguugcuuauucagaaugguugcugugaauucccacauacuuuugaguuucccagaauuccuucugcuauuguuuuuuuuuuuuaaauuuuuauuuuuuagcuucauuccacuguagcuggaaaaaacaagaugcuauuucaauuuucuuaauuuguucuauauuuauuugucuguuaggacuauuuugccuacacucuuucucaagaccaucauuuccuugcuauuuuuuucugccucaauauuucauccauugaaauuggagucucccacuauuauuguauugcugucucucucuccuaucaaugguauguuuagguugugugaugcuggguggauauauguuuuauauuuguuucaucuuccuagucaguugaccauuuaauauugcgugacauaaagaagucaugcgcuacacagaaaucauuauaggaaaguaagcccuuucccccguacuauccuccugauugcuuugugucaggcgaaauguuuacuguguguaggucauucaucuggcccucagacaaauccuuccccagcucugggccagccacggcauggcuggaauuugcaagcuguagcauuuuuaugagagggguguugggauuaaagagcagguggcuaucauugccaugguauccugacccagugauugaugggucagcacucugaggugcccagaggccuagguugcuuuacucauggaaacauaaguguuuuuuguuccuagagacaaucauaaacuuuggcgaaagcccuuugccccaaggauguauaaccccaguucaacauuguggguaccuccuguggagggucaacugccaaauuaugccacccugauguccccuuccccuuguccuuuaaggaacuugacucuuuguugcuuuucgaggguuccagggcuaacaaaaucaauacaaguccaguaucugaggaaggaccagucggcauuuccacauucauugugaugguuucacugggccuguccacagguugucacuuucugugggucucuucuggugccaaagcuauauuggaguccauguuaugggguguaaucacaccaugggcuuguugcagguaggagguaggaccccugucuaaugucucaacaccaccauaaugaaauuuuacagggaucuccguaaggucaguuaguguuacugguaggggcccaagaucuggguggcccacaggagaguaaggcugcccagguuaaucugguaauuagucagucagaagaggaaagaagcagaagugucuagaccagaugggucugcagguuuucuggcacuugggcagggucugggccugugaggcugguaagcaggcuguauuguguugcagagaauaugcccaucuggucuagggugaaggacuggaacguuccuuguauccaaaggauaucaaggguuuuuaggagcauugggagccuauagggucuggggccaacuacagaccuuccucauauccaggaggagcacaaauugggauguacuaaaggggauuugggguaucuggaagggggagguacagagacauuggugauuacuccucagguaggaucugaaaagaagaugccuggguauuuugaggcuuggugggcccuagagguguggagugaaauugugggggaaccuucucaagucuggaaaaguggacccaggaggaguuaacauuauuuaauuuggugacaguguggggugagugagaagacuuugugggggcccugccauguaggugucaccagugagauggaccugagaggcauacugugcccccuuuuuggagauuagggaagggagugucagguagaggaaaagggugggacagagucagugugauuucaaagcucuaugcugggacagggcagggcgacuccgggacagggacaguagaaguugugauguguuguguuuuauaaaaagauaaagagaaggaauauguuugguggaggugcgguaaggugugggggaaggaggugccucugagggcccaugcugaggcaucccuucuccuuagaauggaguuuauucagggcaugcggaggggaguugagaggguaguagagacagagaaaggcagagagagagagagagagagagagagagagagagagagagagagagagagagagagagagagagagagagaggagagagaaagaaggaggaagaagaaggagaaggugaggaggaggagaaggagaaggagaaggagaaggagaaggagaaggagaaggagaaggagaagaagaaggccaugagcacauggagagauggaggaggggagggaaauggagaaaggugggaaggagcaagaggaacagagggagaucaagaagguaagagagagaggaggcgagcagccccuuuuauagugagucaggcacaccuggcuguugccagguagcugucuaggcacagagccuagacaaaaugcuaacagggugugucuacugugauuggggggcuugagggaucuuccauacaugaauucaaauguacugauuagggauugggggggggguaaggaguuuuaacaagucauguuuuaauucuagaguugguuuggcaaggauauccaagcauguaagcuguagcacgggcccauuauuugugguugggaaggcccccaacucacccugaaaaggugacugugaauacuaggauuugugucuucugacuggggauacauggugacuucuaccuaauaguuuagggcagguaacucuccuuucacuuggugagauggaaauuggggaagauggagguugaaguaauaaaagacauggguaaaaguguuguaagagguugacugccuuagagcaacacuuaaggaggucgagggguuuggggguugcuagguaggaguguugcaggguugggagguaaggauggcucaaauacaagguugggaaucuaguaaguaagcagagcuucacucuggguaaccgggaggguuaggaaagcgggcaguugaugaggugugugugugugugugugugugugugugugugugugugugugugugugugaugugagcugauauuuuguuugccuuagggacaggcaguaccacuauggacagggucuggaggcagggugaucagccuuggauggccaugucuagcuguuuggagagauaggcuauggggaggagaggcauauguccauuuuggcagaaggucgugaggguuugucguugauuagcauguaaaaggagauagaccggucugugugggucuugaaguguuaguguagaggagggugagagagugaacuuagguacgucuguaggaggaauuaggacaagggucacucuucuaggggucccuuagugacuucauagagaggccgaucugugguagagcaguuggggauccacacuugaaagacauuaaaaaggccucauagugcaagcgguuugagucugguuuguggaauauggugcuagacgaggagggccucuauucuggcuuggaguauaguucuuucuccuaagauggagaggcccagagaggugccaggugguugacagaucugggccuugucuccagacaccuuauaacuccuggagaccagaaagcucgugaagcguuggagauaggucugugggggaaaggcugcauaagagaagaucauuuauauacuggaaaaggaaacuaucggauaaguauaaauucaugagguccuuauggauagccuagcccaauugguggaagguaucucagacucccgggggcaaaccuauccaggugaauugcugggcaugcagggugacugaguccucccaggugaaagcaaaaaagggauugggaagauggcuguagagggauaguaaaaagggcaacuugaagaccaaagacagaaaagaaggcagcagagaggggacagagaagaggagcgugcauggguuagugucuuaggguuucuauugaugugaaaacugagguacagagacaagcaccuugccuaugggaauacacugaauacuuaggaagugguggccuagggucccgagcaaaggcaggaucauuccagaaccccagggcuuuguaacuguuuacagaaagggauggaacugagcacauuaugagcaguguauaggcugauccaggagucucuccacuguauccucagagcuguacucacuugccaguggacuuggcucuggcaaaggauggagauuuuuuuuuuuaaccuauucuuuugagaauaaggagggucuuuguuucucuucccugggaaccgagcagccccuuucucugaggguagaguuggggcauggcucaacagaacgacagucauccuggcuaguaagacucagaggcuggccuucaaaggcuugagcuccugggugacugagcaguggagaaacagaauccugcccuugaauugcuccccaggcgggcuuuaugcagucuggggaagcaagggaugcccugugauucuuaaagaaacugguauaauuuugcacugcauagcagacucccaagacacacagccuuuuccaggaggaguuccuuagaggggaaggggauagguugcaauggucugcuuagccucccgaaggcugcagaagcugcuaagacagggguaacugaaagauagacucugugagguugaacagcaaucuuuaugaccugacccccuaggcaccccuuccuguucugaccuugucaaagcauggcucuagucuaugaccaagugggucacagcaguuacugcaccccucugaugauuuugcuugguggauaugaaaugaccacuguggucauagacuuauugauugacucugguuaggaagaaaauaagagaucuaauccagguuugcaaauugcuccaagacacuauaauuuaaccaguacguauuuaacuggcauuguugugauuucaugggaacuuaauuuuuauuuuuugaggaagcuccauacagauuuucaucgaggugucaccugucuacccacaccagcagguuacaaagguccccuauucccagagccucaccuacacuugaggucgaggguuuucugagugccagguacugacuugagggagggagagucucaacuuaguguuaauuugcauuucuuuaauggauaacgagguagaacacuuuuaaaacuguuuaccagagacuuauauuuuuuucauuugagaaucaucuguuaguucuuuagaccuuuuauugaugggaugauuugagguuuuguguguguguguguaauuuuuuagugcuucaaauauccuaaauacgauauuuuucuacucuguaggucaucucuucaccgugauuguggcuucuuggccaugcacagaccauuuagucgcaugugaguccaucugauaagucuuagguuagucuccugcaguuacuaguuaguugccacuggaguucuuuucagaaauuccuugcuuugaagugucccuucuauggguuucucuagcaccuucaaaguuuaucauaaucaucauguuaucauccacaucacccccaucauugucaccaccaccaccaccaccaucaccaccaacaagguuuuacuguuaaaguuuguggccaauuuuaaauugauuuuugugcagagugagagagagggaccuaccucauuguucuacaugugaagaccuaguuucccaacacaauuuguuuaagaggcuaucuuuucuauaauguauguuuuugauacuuuuguccaaaaauuuagcagcuauagccguauggcuucauuccugagucuucuauucccuuggucuacaugccugguuuuuugcuggcaccauugggguuuuguuaccauggcucuguaguaugauuugagaucacauccugggaagccacagguguugcuuaaguguccucuggcucuucagagcccuuuuugcuguuacaugauuauuuuauuuauuuauuuauuuauuuauuuauuuauuuuaggauuuuuauuaaaaaaaucuuuggaacuuugguaaggauuguguugagucuauggcuuuuuuucaguaauauaaccauuuuuacaauauuuugucaguucauaagaguuggggaucuuucuagcuucuaguauccuacacauccuucccuccuuuaguuucauacccauccacuuguggagucugccacuuccuugguuucuacauagguauuuuuuucaauuauugugacugggauccauucucccaguuucccucuuucuuggcaagcucacuguugguguauagaaagacugcugauuucucuguguuaguuuuuguaucuugguauuuuaauggaagugcagauaagaacugauaaggagucuuugggagucuuuuaguuauaagaucaugucaucugcaaagagggauaauauggcagauucuuuucuaguuauauccauuuuauuuccuuccucugucuuauugaucaagcuaagacuuugaagacgacuuggaacaagaguagccauagugugcauccuuuugucauuucuaagauuaaaggaacauuuauauuugucccuguuuaguauugaguuagcuauagguuugucacauauaguguuuauuauaucaagauacguuucuucuaauccuaauuucuuuggggauuuuuaucaugaagaggaggugaauuuuauugaagcccuuuucuacaucuauucagaugaucauacgacuucugucuggaagucuaccuuauugcauuacaucucugauuugcauacacugaagcaaaccuguauccuugggauggaaccaacuuggacuugggauaugcccuucuacugugcugaguuuguuuugcaagcauuuuagugccauguuuugcaucuauauccaccauggaaauugaaguauagccccccuguuguuguaucugugucuagcucugcuaucaggacaguauuggagugaguuugguaacggccagucccuuucuauuuugugugacaguuucaggaguauuagcccuucuugaaagguuucacagaauuuagugguaagccugucuaauccugggcuucuucuuguggggggaaguuuucucuuuccacuccaaccccauggcuuguuacaagucugaacuauuuauaucuucuugauuuaauauugguagauuuauccauuucucuuagccuucccaguuuuuuggcauaugcuaucaaauuauucccuaaugauuugggcuuuguauguaucaguugcgauuucucccuuaucguuucuucucuuuauuacugugggucuuugcuugcccccccuccucucucuccaggaaaccuuugcucugucgcucuaucgagucugcacauuguucagucagugaccacuuuguucauuuuuuuccuuugucuuuauuauuucuuuuaggucggguuugguuuuguuuuucugagaucuagaagugaauccuuaucuaccugaggucacucugaguucuuagcaagcacuccuagcugugcauucuucuuuuaaccgccuuggcugagucccagcgccccguagugcacucuguuugcuuuucaaucgauucugugaauuuuaaaauucccuccaugcuuucuugaaugacccucuguucauucgaggaguguuguccccuuucuaagcauuuguccuguuucuggaauuucucuugcuguugguuucuggcuuuauuucaccauuguccuuugcuuagguauaagacaucauccauugccuuuucccguuccagccugcgaaaauaggcucaugggccauugagagccagaagugacgagcuuuuuuggcacccgggaaucacagauagcuguucugcaguugccaucaugccucaaugacaauauauugaaucgcaccgcaagugcuauguauaacguuuggauaccauacuuaguaucauuugggacuaagcuuuaccauaaauagugccaugcugagaaaauacagaugaaaaagacuauuaagaugcaugaaaagagaaaccgcaagcaaaagcacgacgggaagacgccacagggagcaguuccugccugucugcuggacagagaggggcagucgagggcaaaauuacuuuccaacaugauuaagcagaaacaagaagagaaggcaggaaaaugggaaguuccucuacccaaaguucguggccaaggagaaucagaaguauugaaaguuauucaaacaggaaagaaaaaaaacgaaggcagggaagagaaugguuacuaacgcgugcucuguuggugaugguuugacauaaaaugcaucuaaauaugaaagguucauuaggccacugggcccaugcuuccaaaagcccaugucacacacccugagcugaaagccaccuuuagccugucaauauguggugugaacaagaauccaucauccccauuguauucaaaucuggugugaucaccaaaggugcaguuacugagagaaugugagcgagccaggccuugugacacaggagggagggugauuuggggugagugugcccaaguuacugaaaacaacaggugcauaagugaggucuugcugaucugacagugacgucguaccugucacuccagucacuaccaaagacuacccaccgucaggaaaacaccaucacugggaucucccugaaccaccaaccuuaccccauaugcugucaccaagaaguauuuauuaaauuguaaugaaaaauu

SEQ ID NO: 583 - RNA, 1048 nt, Mus musculus
gguauuuuuuuuuuucaaacugggcaguuuuauuuuccuuuacaacuuaguaaauacuugaugacugcacgugggguaaggcugcucggugguucagaaagaccccagggacaguguuuuccugacaggguguagucuucaguagugaguggaaugacaugugagugacgucacugucagaccagcaagaccgcauuuaugcacccaucguucucaggauuauugguaacuugggcguacuuuccccaaaucaccuugccuccuugugucacaaggcccaacucgcucacauucacuucaauaacuguaccuuuggugaucacacccaggguuguauauaauggggaugauggauucuuuuucacaccgagaauaggcaggcaaaagguagcuuccagcucagggugugugacaugggcuuuuuugaaacguagagccauaggccuaaugaaucuuucauauuuaggugguuuucuuguaaagccaucaccaacagagcagacguuaguaaccauucucuuccaugccuucuuuuuccuuuuuccugaucgaauaacuuucaauacuucuguuucuccuugggcacgaacuuuggguagacuacgggaccucccauuuccccgccuuuucuuuccguuucugcuuaaucauguuagaaaggacuuuugcucucgacuggcccucucuguccagcagauaggcggggacugcucccugcggcgucuucucaucauccuucugcuugguguuucucuucucaugcaucuuaauagucuuuuucauuuguauuuucuccgcauggcgcuguuuaugguagagcuuagccuucaggccaaucauuuuuuuuuuuuuuuuuuuuuuugccuucuuugaacguucaugggccucccgaccuucuuucuuucucuuuuucucaugguaguccaaacgauauccauaucguuugcggugcaauucaauauauucauuuuguggcaugaugacagcugcggagcaccgguccgcgaccuccugggucucaaaaaacucuuaauuucuggaugucacc

SEQ ID NO: 584 - RNA, 29582 nt, Mus musculus
ugcgcgcgcggccccgugacgcuagggacguggccgcgcgccuugccaucucuccuccgccauggcugcugugcccagcgcuguucaccugccgcguugugugguguccccgaccgggagacacagugccucgcugaucuuccugcacggcucaggugcauuacagucucguggucuccgacccgcucgcuacaguaggggaagcacccucuucucggucccccagcgcccagggucgcccgagggcuccucuuucuguauagcacucaucuucauccucuuccuuccuucgcuggugugcuugacccgugcacccacagcauggucgaacggcaguccuuaccuaaccccaaguucagucauagcaccauaucgguguaagucuccaggcacguggauuaaccacuguuucagggucgaccagcagugaucugacauacauaccccaccacacaccccuauugcagguccuaagcuguugucugccuugccggugucauagagacguuuuuggaucauauuuacacuguguaaguguaugcuuagcaccaccagcggguuuccccugcgccucccaccugucuuuuuugaugguccaccacccugguuuccccuaugcccucuuguaaaaccuucgagguaaguauaaaguccgcuucauuuagggagcacccuuagaggaaaacacaagaaucaccgacuuaauccuugcucacugugcuugguuggcccgggguaaguucucaggaaaggaaaaaaaaaaaauuuuuuuuuuuuuuuuaauuuaagaaaugagauccaggcgguguccucaaggggccuaccuaaauuuaaaaacaaaaacaauucaauuaauuugagucagcaguggauaggagaucacaagauggugcaugggcuacugccaagagaauaguaaggaaagaaaaaaaaaugggguuggacauugugaaugaagggcuugucagagcuuuucaggagcacugcguuaugcugaggccuguguaggcuuaggggacuagaacacgacgggauuggaguguucccuccauuuugaaaaaaaaaaacaaaacaaaaaaaaaacaaaacgggacuagaaacgcuuucuugcuguugcuuaaggaguagugaggcuggguuugaauccaaaugucugacuuggaauuaauauucuggggggagggggagggaaacccucaacuaugguguaucauucuagaaauagaguaauaaaaguuguguaaagggaaaggccuggcacgagacuuacaccuuuauagcuagcugccuaauaauccagcacccaagagaauucagugaugagcauccaaaauucccacauaguaauuccuucucguaauuaauucagugucuuuagaaagaacuagaguuuguucuuuuccccccaucuggaccaccuugcuuagugcuuccuauuuuucuauuucaaauuacugacauuuuuauaaccuauaauguaugucugaaaacagagucaccuauucuguauguauuuuauucauuuguguguauugucugugugugugugugcgcgcgcacgcgcaugcguguguaaaacuugccuuuguacauuggaaaaaaauucaucuaaauaauucuuccagauguucagguauauuauucuuauauaauuggaucuccauugauguauaaaaagaucuuuuaggaguuggccuguucugcuaauuguuauuauuaauuaauuggaacuuggagucaccugagaaaagugagucucagcugagaaauugcccaguucagguuggccuguggcagugucuauggugaauggucucaguuguugguugauuaggaggcuccugccugcuguggccauugcuucuccugugcaugugggucuggguuguauaaaccugguugagcaugagccauggggacaaaccaguaucagcugugcucuguguuuccugccucugcuccuacauaaguuccuggccucccugggugaauaugccaccagguguauuugaaccuuuuucuacuuccaaacuuugaggggaaacggcgacucuuacagugaaugauguaaauggucuucucuguggcuggcuucagccucccacacgggucccuaaacuccauuauuuccuucacggacauccaucauaccugugauuccuaagucugugacccgcacugaccuuuaaggcugauaaaggcuguucuguguaugguugcugucuuucucccuuuauaaugucuuuaugaaggugcucagucagaucuugcugaaguuacaagaaaccccaggaagugggagccuuguccaguagacacugccuucuccaccucucuuuauccacccuccucucagugacauguaaggcacuuggguucuuuuccugucuccaugcagguaaacauacauuaacucuuacacuauuacacuuuuugggggggggcaugauguuagguuauauaaauauuaucaacaccauuaaaaucugauuucuucacauuuauauuugaaguacagugacugccuuauccacuccuugaagacuuguugucaccaagaaaauuguauuaggucacaccagcuacaaugguguaaaucacacugggauuuuuuuuaaaggguaaaaugagaaacgaauagugucaaacaacagcuuaacagaauucucuucuagaagaaauuauccuaccuacuacaaacaaagagaccugaaaugcaccacgaggaucguuuucuaacugauaaacacugccuccagauaauguaauaauaaagauagugugcucagccaacuaauucugcuauccgaacagcucuuuuuagcauguggggaguuuucagguuuucugucccagcccucaagugagcugagaugugaagagcaccuucagaugcacuguguugugagcauguuucucugacaguguggauuuugugauuuugucaggucacucuggccaaggacagagagaguggaucaagcacgugcuaaaccaagacuuaacauuccagcacauaaagaucauuuauccaacggcccccuccagguacgcgaugcucaauuucaccuuuaaguauaacuccguggaauaaaauauuaucuaugugccaacuagauguuuuuagcuuuaacucuuuauuugagauuuuaaguuaggguccucuccucccaccuguaaaaaugcaugcuuuacuuggaaauuggcgcccguggccaagcuuccccagguggccgaccacuccucgaugggaauaacucaucuguucugagcgacccugcagccugcuucccgugagucucaucuuucaccccucuccacuucacacaccccgaaagcaaacuuaauaacuucagccaagauagucguucugaccuggguucauagucccuggaaaagaauuuuauaacauucuucuuuccaacuuucaaaggauuuaaguacucugagguucuuugaaucagugaaccaggauagacaugagguguggaaaccugcauuuaauggaauucauaaagauaggagugaaguaauucugaggccauggacugcuuuuuauaaauauuaaauaagcacccacauggucauuuucaaauuuauuuuuugcauuaacagauauugucuugucaugcaaccaagucugauuucucaugauuuagucuugguuuucuuucuuucuuccuuccuuccuuccuuccuuucuuucuuucuuucuuucucucucucucucucucucucucucucucacuucuuucuuccuuucuuuuuuuucauucauucauaucccaaaugcugcccccucccaguccccccuucauagggucuguucccauccccucuccccuucuccuuugagagggugcccccugcucuggguauucccuaacccuggcacaucaaguuucaaaaguuuguagucuuuuucuagggaguuaaaagggaaugcugauaucucuguggaaacugagaagauugugaguuuuaggcuaauuguaaauguaaguuauuaaauaauaagaaagacauuagggacaugaugauucuaagaauuuaguuauuuuuaucucuugcuaagaauugaaugguuuucaucccuuggucaucacgcguuaccaguuguaacaugaauucuauauuagugcuuaucagacuuuaaaccaaugguauuuuauacuccauauugccauaugccugggguucucugugguguuugugcuggccucuucaaauauguuugccaguguuuguuccuuuggucuuuagaggucuuucuguaucccauugucucugaguguuugauagcacuuagagaacucacuugcaccugaagaucucuugggugaguuguuggcaacgaauuuguuuccuuuuauagaaucuauguuuucagauuuucuauguauuuuguauuuucaagucagugucagugauuucuaucugcuggaauuugucucugacuucaaaauacuuucuuuuuuucaagauacuuuuuuuuucuuuuuucuuuuucuuugguucaagacagggauucucuguguagcucugacuguccuggaacucacucuguagaccaggcuggccucuaacucagaaauuugccugacucugccuccuaaguguuuagauuaaaggcccagccaagauacuuauuuuuaauguuuacauuucuauucauauauuuuauuuaaauucucauaguaauauuuuguuguuuugaugaugaugaugacgaugguguaugugugugugucuguguguucuaacuugucaggguucacgaaucauuuuuagagccaauuuaggcgugguucuuuucucuguuugguguaguuuggacaaggagucucagguagcccaggcuggccuggaaccccuggcccuucucuguguccugagugcuaggacuccaagugguccccaccucauccagcacaauuuccucuugcuuuucguuuucuguuccauuuaugucugcccauuuucuuuuccccuccuauuuauauuagagcaguaauuuuaucacgacucuagccaaaucucacaauguuuuauuuuucuguuuuauuuauguuggaagguuuucugucaccuucguguucccuguguaauucuuguguaacaaauuacccccaagcaacgcuuuuauuauggccacaaauucugugguuuaggaauucagaagggcacaauaauggugacucaauuccacucuguuguucuugggacuucucuugggaaagcuugaagguuggguguggcuccugauuugucugcugggcacuggaucccucaucugucagccuugucacacagccagcagauaucagccagggcuuuccugcuggagucucuauacucugacaccuuaauaggcuuuaucauuuagaguucauuuuauuuugauuguugaguguguguaugugugugcauauugauaugugugugcugucuaccuuuucuuuucagacucucaccaaaucaggagcuuagcaguuuggcuaaacuaccaggguagcaaguuccagggaccuagcagccccucucugaccuccucccaucuuccagcacugggauuacagacagugcggacacuggaacgcagauccacaugcguuccauaggacacaucucuccagccugucauuuggagucuugggcuauguaguagcauggaaguuuguucccagaguagauauccucagagaacaaggaaguuaacaguuguagagcuaaugcagaaggcauccaggaugcaaaggaagagugcagaccuuugccucucggcaaaagucugucacugugguaagggcuugucugguuacuguuuuaacuccaccucucccuaucccccaagaauuccuggacccccuuaaccaggaagccaucagaugucuguuggugacuuuaugcaucgagggucggcucaguugucuuacuguugcugauuucuaguuucauuccauugccaucagauaaaauauccuauauaaccccacucuuuggcuucucacaggacuuuauggcuuuucaugaauucuaccaugguaacucuucauguauacuuuaauuuacagcauuuaaauuguaucagggcaauauaagaugacugauaguauuaacuuacauuuuauauauggucaauaauuauuuuuaagugguuuugagagucaugagcaaaggacuuuuauuauaaaaugauccucuuaacuucugguaacaacccaaaguguaguuuguauaauaauuguguacugcacaacaacuuuccuacacuuauuuuacauuuuugucaucacuuuguuaguuugauuaguguucuuagcaaacuuccagacuuuuuaucuuuagcuugucuaucaguuguauuuagaauguguuuguuauaggcaacauguaauugggcuuuguuuauagcuuuaaucuauaacaguuuuugucuuuuaaaugauuuguugagccauuuauauuuaauguaacauugaauuuauaggcuugacuacaaaucuguugucuuuucuccuauguucuauguuucucauuuuugcacuauuuaaacuuuuuaauauuucaauuuaguuaucuuguucccugauugugguaaggcuaaauacaaaucacagacuuuuacccgucuuagaguaaauauuugccaguuuaacugaauuguagaacuuuaaaugacaaggccccugucucccuuccccuuuaugauucucaugucuuucauuacauauguuaagaacaccaaauuagucugaacacgugagagggugcgccagagaaccugacagccucuggaacaggcagaagcacagaggggcugaggcagcacccugugugggccggggacagccggccaccuucuggaccggaggacaggugcccgcccggcuggagaggcggccuaagccacagcagcagcggucgccaucuugguccgggacccgccgaacuuaggaaauuagucugaacaggugagagggugcgccagagaaccugacagcuucuggaacaggcagaagcacagaggcgcugaggcagcacccugugugggccggggacagccggccaccuuccggaccggaggacaggugcccacccggcuggggaggcggccuaagccacagcagcagcggucgccaucuuggucccgggacuccaaggaacuuaggaauuuagucugcuuaggugagagucuguaccaccugggaacugccaaagcaacacagugucugagaaagguccuguuuugggccuucuucuucggccaggaggagguccaaauacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcauuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagugaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcuccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacagcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuugccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagauccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaugagcuaaauaccuaauaaaaaauggaaaaaaaaaaaaaaagaacaccaucaagcaaggguauaauuucaauuuucauacucauaaaugccacugagaaccuaagaggggaacaguuguuuauugugucauucggcguagucugcgaucgcaugucauugugauuucacuaaaccauuagcuacccuucugcuccuaagugcuccuuuccucagcuauaaaucgcauauuaaauaaaagucaacaguaguuugcuguauuaauuaaaauggaaaaguagaauaguauuuuucauuauguuaauuuggacuuguuaguuggaaguacgcaauaaauauuuuuauucuguggcauauuuuagcuguguuuacagccacagguuuucuuaguuuagauauaauaacagacuuuccauuaaaaaauaacaauguuugauaguccauuuauauuuuuuaugauauaaauucuguugauaauuugaaaaauccuaagacccaucagacuugccugugccucuacauguugacuguacauuuccccaccuaaaaaggagugcuuaucauuuucagugaauuaaugcauguucacaaggggagugagugcacagauaggggugugcacaggcaucuguauuccuguacauguggauguccgagguccacugcucaugaucagacugaaaauggcaacaguuacaaucuccaaugaugagcacugugaagagcagugacuuuagugagacagaguccuugcagaauagaagcagcaaugaggagucaaaggugacuuuucaguugacaccugaguagucagugggagcccagcacaggguaugauggggaacacagggcugggagagggcgcugaugacaucaucugacuggagccuugagccagcacagggaaugauggggaacacagggcugggagaggacaucugaugcaaugcucccaacucacugaugagcuguccaauggcacuugagccuagagcaugcugggagaauucugaaaugaggacaaagagagaccagagccagcuugcuauccuacagacuacagaugaucuuuuggcucuuauaacuuuaggggaacacagauuaaaacagaaguggguguucaaucaaauaccuuuuuauuaaaaaaaaucaaaguguuggacauguauucuagucuaauacuugagcaguguguaacggguugauugauugauugguuuaggagccgcacagauguucuuugcugaacauauuuguuuauugugguaaugucugaacuguuuuuauaccagcuaauaaagugauuuauuugaggaagaaagugaaugaauauaacauaugugccaagccuuuuagcuguuuaaaaaacaaucuuuuaugcuuuauuuaaagguuauucuaacaucuuuggaaauuuauguacucucgauuguuuucuuagcaaaaagaguucuagccuuuuuuuuaucccauuaaauuaucuuaaugaucccauuuaaacagaaauuuuuaauuuuuucuuagggaagugagagacccggaccaucccaauccguaaauguggauuuucacuguguuuuaccucaguggagcaucuaccuagauuaaucaaauaaggcauugucaacggggaaagaguuagcgaggaucauuuuuucccauuaauggccgcguucccagaaugauucacauuuuagccgaugauaucauccuuauuuaagugcuuagacagacaaauaaacagugagagaaauagcagggaauggagagagaagucgauggaccuccagaggacuggguaucacucagcucuagaguuggccuucacugugacuucagccucagggaacacuucacaguguguaacaaugacugagaacaaaacaccugcuuucaagugcaguggacuugaaguuaaccuugaggaugucucugggaggagcaaggccugggugcuucugcacucucuugucccugagccaucuccuuagcuggcugagaggagugcugugggcuucuaucuuccccacagaaagcgagggccuggauagagcagugagaagcccgaggguuccgucugcagaagccugcccuccucccaggcuuugcucugaaaacaucaaccuccacgaauaacgcagauuaauugaaaaucuccaaagauguuuaaagagaaucauuuaugagaauuuuaaacuuucuaaguguuuugaaugacuucuuggcuaaauaagaaugacugccuaauguaguaagcaugacgacuagugugauggugguaagagaagucugaggcaggggcacccacggacagaugcauagaucagcgaggagucuggggcaggggcacccacggacagaugcauagaucagcaaggaguccugccacaucaaaagcauuugaacuucuaaguuaaaccugggcaguuuuccauguuaaaccaaugaagugcauuugaugaguugguggacccacucacgugagagcaugcuaguacccagcaccuccuccaugggaccugcuuguacagaugcuuuggagaaagguagauuucuuugugguagaaugauggauuuuuaccaccuuuauggaagcaacuuugaaacauguacuaagguaaaaccuguaccuuccaaccuagcauacgauucucagucucuguucccuaggaauagccccucuacaugaaaaacacaugcaucuauauuaacuaggcauguuuuaugucacccuguccacagaggcugggaucuauauauaucauggggagaaaggaugauucaguugucaaauagguuuaucuaugagcaugaacaacguuuauguacauagucauuugaugcauagggaagggggcugguaugguuggcagggaccagaaugcccagggacugacagaauugugggaacucagcacucgcuaaugagaaggugcauaggugaggaguguucagauggauuucugugagacacuguggagaagagugcguccguauggggagaagacuggaugcucuugcucuuacucccccaaaacucuauaagccucgaaucacccaaaguaaaguugaucugccuccugauagcugguccagugugguggucauucacuguaaguacucacagggcuuccaaacccuugcuugucuucucugcucccacugcccuuguggaccuuauggguugaagagcagguagacccacaacaaagcaucuccaaaauugcacacacacacacacacacacacacacacauccuuuguaaccucuccuaacacagaacuuagaccugaaaccuuuaaccacauuguaauuggaauauuugcagugugcacaguaugugcauagaacaugaaguucauuguguagcauuaauguacaggaauggacaaagauuccuagaaccguaauuguccaaccuccuaagaauaguuacuggguuugagaugugcuguacgagguaugggcaguugucaccacggcugaagaccuguguuccaccccuggaaucuucaugguggagggagagaaaugacacuuacuaauuacacucugaccuccacauagcccacgccacaccucucccaagucaaugaguguaccaauuagacauuuaaguaaagauguugaaucagguuuagaaaauguuaauggaauaaauaaaagaaaguuaauggaguauguauagggcauuuuccauauaaauucuauuuuccauaagauucagcaaaauaaauaaauaaaugaauaaauaaauaaauaaauaaauaagaaagauaccaacccuucagauacuacagcagcuguuuaacauuacuccuguugucuuacauuguguuaaacaggccguauacuccucugaagggagggcucuccaaugugugguuugacagauuuaaaauaucuauggacugcccagaacaccuugaaucaauugauaguaugugucaagugcucaguggauugguugaugaagaaguaaaaacuggcauucagaagagcaggauauuaauaggugaggacuuuauaacauugguaauguauuuuacuuucuuccaauuauauuuucugaguuguauuuguaacauuguuuauaaguacgugaauauugcuugacccauucacagucuuggauaagcuacauguguugcuuucaaaaauauuagagucauaaacaacagcucaugaaacuuucauugauuuuucauuuuuaauaauaacccucuauuggcuuguuuauuuguuuuagacaaggcgcuacuguagagccgagacuacaucaaaauuccaaacucuccugcacucagcucuuaagugcuggguuauaagaauaugccaccaugcuaguuugccguuguuuuaaugauaaauaucuuucuacuuuaauuuuuaacugagauuauccauugcaauuaaaauguuucccuuucauguagcugggaucacaugaauauaagauucaacugcuccuaccaugauaaaaauagaguacauggugagaguguacugucaaacucacgagcacaaagucuuucaaguaugugucacaagacauugauaaccuuguguuaaacaugucacagugaucccugcucucaagggugucuaaagcuuuauugaaacucuguauugaauacuuucucugucugaaaucaucaaauauacaaaccugcaaaaauuucuuuuucucuaauauauacaaaugccaggugggauguguagaauguuggcuguccaaaacgguaugguugcacaguguacaaacuuguaacagcuguagugcaugaugaaauuauaaauauuccaauuauaacguaaacaccuccaucaugugcuaaauagcaucaacaugcacucagcaaucuuccagagacuagauuaaagaacaguuuuaguacuguaacauuccuuggcacucacucauugaagccaucaaggugcugagcuguucaguuaguuaccagcauccuauaaugcaguggauaagaucccuucugugucuugccuuugguuucuacuuuaguuuaagaacugguauggcaucaaacccagcaucaccaccuuucuaauccugaggauucuugucuguguucuuccguguuucugugcuuggugcuaaguauagauaucucuacuagagguaaccauggacaagcaggaagccugggaagggaacaggggaggagaugcuacccaaccugcaaucuuaggaaacagcaaggagaagucauggaucccaucauucugccaucagcuuggucucccuuaaucccuaccauuguggcaggaaauuuucucaguaccuaaagggacaaacagauaaauaaagcaagcucuguaucacagauuucuuccucuaaguuacuuaaagaaauaacuaauccuacugggcugcgacgagggaaguacuaacuauaaaauggaccccuuguucuuucuguguaacaauggcuaggguucugaccuacgagaugauguguguaaugggacugugucucugagauuauaguuucaaccuuugacacuuuguaaagaauacuguuugagaucugaugcagauaaggaaaggcccauccuuuccuugugucauuuugauugaugacauuuuauuguguugaacuuagcuaaaagcagguccuuauauuguaugugaucugcuaccucuccuugggagucgucgaucuuguauuggaaugguauuuagacuuuuuaugcccaaguuguuaauaaaaauguaaguguuagaguaguaaccuuucucagaaacucuaauggguuagacugaagucaaacacucuaaugcagaaguauuguuugagaaaugaguggaagauguggggcagguaguauggaggcaaaaauagaucuuagugguuaagaacaucuucuuccuagaaaaauaaccuucugucuuaucuuaaagcauggaaaggauuugguaaacaagggagaaaccuguuccauucccaagaaacagugcggcaugcaucccaggacuuagcgucaccaagugauacacagagaacaggugauaugauggaaugcugacugcagagggaugucagccaugaugggguauucacuacagagggaugucaaccaugaugugauguucacacagagagaugucagcuugaugggguguucacuacagagggaugccaaccacaguguggagaugacaagugcagguuucuaggacaucaggaaggauauaaccagauaaggagauucauggaccaaugaacugacaccaugacauugaaaagacagagacauaaugguuccaaagaagguuacagccgacuguggaacaggcuaugaagauuucauuuuccaaguuuuaugcaaagggcaugcauuacugucuuaacaggcaacauuaauaagcuucugcuguaaaggaaaagguagguaaagcuuugcugggggcacacaucugauacacagguaagccaguacaggaauugucucuggagauauucacuaauccucaucauuugaaaugagaauguaaaacaguguauaguuuguuuguuuuuaacauaucuauaaucacaggagucuauaaagguuaugauaaaacuuagaagaaacacaagcauacaauuaugaacuuuccaguuacuuucugaagguugaccagauguguucagcaggagcagcucuaccuccuauacugcaggagagcagccugccuucugggguucuugcucauucacugugagugccauguguaaaauagaagcacauuucauagccaggccauaccucucgggcuuccgucauggacuucuguauauuuuuauuuaagaagagaaaucaaaauggagagugagaggcuccagugugcccuguuaugcugggcaaucaagagaugaugguaacucuucagcuuagcacauagcagccaucauacaccacuccuguuuguauggaaaauauucauaagccuuucucccauaugcagcuguccagcuugagccuugcagugaggagauuaggguauaguuguguucauuccaccagugaggggauaaaaauucagagauuaugagcagcacagagggagccuagaacccaagccccuuaauuuagucaagaacuuucuaccaugauuagaaucuguuuguggccacuagguggugauaacuuuuuaagagaacauauuauaauuuagguucaauuuugauccaggauguauagaacccgacucuuaccagaauugugauucuauaaguguaugaucaaaauuuuacaguaugguggagaauguacuuacaggaccacauguaugucacaugggugaucuauauacucaucaugaauggcacagugaaauaauuaugguccagucauaaaacugcauauuaugaagccauuaaauucaccaucuauacauagaagucacucaacaaguauucaucaaauuaugaaauuagaucuuaacuuucauagguuucauaaucccacacaaagacuccucauguuauggauccacaggagauaaagcaggguacaauguggagggcguucaacuguuaaaauaaaaauugaaaaccuacuggguacuaagaaucucaguauugguuuccuuuauuugcuuuaucuauggaggaagcacauugcagagugaauuguaauuacuauguuaacauuauaauaggauuuaaaauauaggauuuuuuuguuuguuuguuuguuuucgagacaggguuucucuguauagcccacacuguccuggaacucacuuuguagaccaggcuggccuggaacucagaaauccaccugccuccgccucccgagugcugggaaaaauauaggauuuuaaauugaauuauaacaggggcaucuggaauccacaggaugcagcuuagcaacacaauuuucugaacccccaagcccucccuggggcaaacauauugaaugauaauauuguucaugcuauacaagugcaaauagauguauuuuugcuaauuaaaaacaacucaggauuccuuuagcaacacuuaccaggccuuuaaaggcuugguugggacuguuguccuagcacuugucuguggaagaguggaaauaucauaacuugcaagcuuuguaggaugaaaugcagaaauagacacaguaacugugaggugucuguucccagaacguuugagccuuuccugacauucaaagaauucuagagugccauguaaaugaaauagagggacugggauuuuuauuaccuuaaacaaaaaucuguucccuugauagcaaacuucauuguuuuguccuuaggaauuugcuuugagauagaacauguuaauuuucccaguauagagucuuuuauagauuguuucuguuuaauuuuauacaaagaguuuauaaagccaaguuuauuauuuuuaacauguuuuauucaacuuguuaaucuuaaauauauguuaaauuguuaccucuuaguacuuuaaauacuucaccagcaacuauaaaugcccacuauaaccauuaccuacaaugaauuuacuauuuucuauuuaccuacugaauagcauauuguaggcuggaacuuagacuccuagauggaaaauugacucaaaugacugguccuuuguguucaguuucuucuuugagagaaaauauacaaaguuccuuuucacagugccccaugcuaaaggugacaguguugucaaagccagcaaguagggaacuaugaugaccucacuggacuguaaauggguuagggacuuuucaaucugcacacguucuccauugugagaaauagaaacacgcucuccguugugauauauagaaauauguucuccauugugagauauagaaauauguucuccauugugagauauagaaacacguucuccauugugagauauagaaauauguucuccauugugagauauagaaacacguucuccauugugagauagaaacacguucuccguugugugauauagaaauauguucuccauugugagauauagaaauauguucuccauugugagauauagaaacacguucuccauugugagauauagaaauauguucuccauugugagauauagaaauauguucuccauugugagauauagaaacacguucuccauugugagauagaaacacguucuccguugugugauauagaaauguguucuccauugugagauauagaaauauguucuccauugugagauauagaaacacguucuccauugugagauagaaacacguucuccguugugugauauagaaauauguucuccauugugagauauagaaauauguucuccauugugagauauagaaauauguucuccguugugagauagauauagaaacaugggauaaaaguguagagaaaccuuuugugcuuucuuuucuuuuucuucucuccucuugucccaccccaccucugcccucucucuuguucuuuuuuuucuuucucaggcuagucuuaucaaaggacacugaagccacauaaacucacuagauuuccuacuuauuaaaaaugaacugucaaaagugccuaauguguaaaguuuuaugguuuuauagucacuuuaaaacauauuuuggccuauuuguuugcuuuauuauacuuuauuuuuaugaucuuuaucuuagacucaagacuaucuuuucaugaauuaaugaguuggauuuuaaaaaaauuguuuucucugguaugguucuuccuuguuggaguccagcugccaccagugaccguggcucucuaaguucaaauuuaagcuacuuaaugauuaaacacaaaaauuugguuuccucaucacacuagcuguccuugaaaugaucauguacaguguguggggaaauguaguucaaggacuugaguuucucagagaagaauagcuguguagccuugguguauaucgacagcagacagauccuucuuaagucacugccauguuugcacauaacccauaaugcucauuguggaauugcucacugcaacagcugaggucccaaauauccaacucaggacagaagagcgcuucagaucagacauaugcaaugagauuuuucuagugguccaggaccgagucucucucucucucucucucucucucucucucucucucucucucucucucucucucuuucucucucugucugucucucucugucucucucugucucuuuaaaaauuuuuuuaucuuuaaucuuuuuuuuuuuacaguccaaucauuaucccccacuccagauuuccuuuccuuuugugagcauuguuguucgaguugcugugaagcucacaguuccccugccuucuccuccugagagcuucuguuccaccugagcaccaccauuccuagcuucaaccaugcacauauuuguaaaagcuuuauuaucauaucaaauuaaauugccagaaaaugacauuuccugacaauaaauuugccuccuugcagaaguaucuuuuucaaacuuuaguuuacauuaacuucauuuauccagugaauauuuaugacacuccugcugugcccagcccuguuccaagcauagggagaucuuucuucuccagugaaugcuagcuccuuaugcucucucccgaagaccuuauuaaagugucaguagcagaagcggccgugugcacaaugucuggcauuugaauuuuauguuuaauaaagauccacuuaauaaauuccagcaagaaauuaaaugcuaggaacgguuucuaguaugauuuauuaugauuccuccugugaaagaguauuacccugcuagagaggaacuguuaaacauccagcuaugacugaauuaccacugugucagugugauggccugccuccuuucuucuucuccugagccuuguguccuccccccaccccccgugugugaguguacacuuacacacaccuuccuguuucuguguuaucucucucucucucuguguguguguguguguguguguguaugugccucccuauuucucucucucuguguacaucuaugugugucucucuucuugaccccuacacacacacacacacacacacacacacacacacacucacaccacagaaucccuuuuagagauaucccuugugguucacaguguguuugccuuuacaauguauauaacuggcuaagagacaaaagaagagcuagaagagugaguauucccagcaucaagcaugagggcagaguagcuguaauucccuccugagacacugauucuuacuccccugcgaagaauggauuuguauaguuaugagaaauguaaacuuugaaagcuuuugaagacucaaguuuuagugccuaccuaccacauaugcuguuuagaaaccugaucgaaauugcuaaggcuaucaacucuagcccuccaguuuuccuggaaaguaaguccuagauuuuaaugaauuuauucagacauuuagguaggauuugucucgggcaaacuaaaaguaagguucccauauuuucaaucuaauccucauucuaaucuaccuuuucuuaucagauauuuucuuuauuugcauaucaaaugcuaccgcaaaaguucccuauauccucccccugcccugauccccuacccacccacucccacuucuuggcccuggcguuccccuguacugggacauaugaaguuugcaagaccaaggauccucucuucccaaugauggccgacuaggccaucuucugcuacauaugcaacuagagacaugagcucuggguguacugguuaguucauauuguuguuccaccuauaggguugcagaccccuucagcucuuuggguacuuuuucuagcuccuccacugggggcccuguguuccauccaauagauaaaugugagcaucuacuucuguauuugccacgcauuggcauagccucacaugagauagcuauaucaggguccuuucagcaaaaucuugcuggcauaugcaauagugucuagguuugguggcugauuaugggauggauccccaggugggguagucucuggaugguccauccuuucaucuuagcuccaaauuuugucucuguaacuccuuccauggguauuuuguucccuagucuaaggaggaaugaaguauccacacauuggucuuccuucuucuugauuuucuuauguuuugcaaauuguaucuaaucuaacuuuuaaguuaggaaaauauuaagagaaguguauacauuauugcuaacauaucaauuucuaagauauuaaauugucauauuuugguugguugguugguugguugguucugagucagaucucauauagccuagauugaccuugaacuccugauuauccugccuucauguccucugugcuggcaauauagaggaauaccacccaauguggacuugguuauacugacuuaaguauucaguagacaucaugugccaggcacuauacugggcugggugguuaaagagaaacuaguuaaggaguauaugcaaaggagaauagagauaccacucaauggguuguaaacauucagccaguucaguuucugacacuugaagaaagagcugccucuuccuuuugagguuuguaacccucagcaaacuaguguguuuucagcaaaugaaaaaugagaauuuugcuuagcuacuauguagcuacugcauagagacuucaaaagaaagaagucugaagcuuagaaccacagaaaagccauaugaaauaguaagucugagauucuacucugcacacaugcauguucaacugcuggagaugcugaucuugucuguaccgaguucuauauguccaaagcagacacauggacgaugcgccauuguacagacacauagcuauaguccaccagcucuuccaucugggaagacucacaagguagagacaagcuacauuuaagugucuuaagauaugcacauucccucuuccugcacuaagcuguuccagaaacuuccuuuguugucuuguaucugaggaggcugcugggucuaucauccuuuaaggggucucuuguccacauuggucuagucacuaaaccucuagauuguagugcuaccagugagccccugucauuuuucucuggagaaauaaaauuauaggcauaauacucguucuuaucaugcauuauuauuuacaaauugugccuuuuaggacaaaucuaaaacuugcaaucugcuagccuaauuaauagcaguugccuuucccagaggaagaaaauauucaaaggcuaagugaacguauauuggcucugucacagugaucugcaucccagaagucuuuauaccuaaaauuaaggacauaccuuuaagcaggcaaccuuugcuauaggauguuugauuauauugugaacuccaagacugugaacuggaaaaaacuuguuucuguuuauggguggcucagcccuuagcauacaccuuuaaucacaaacaaugaagguaaaguuaguuuguagaaggaaccacuauguuuaaaagugaugucuaauuguguggcagacaaagugacgaaccagagaaagauuugacagaauaggauaugcccaacucucacaagacaagaaaggaaagggaagcuacucuacuuaagggauaauacagagaggggaagaggcaguuuuacuaagagaguuguagagaccaguagagagagaacaaacuagacacaagugaagacagaaggagcuagaagaugaaaauggauugccagaguuaguugguagccaagcaaagcaaaaagucagaggccaaagagaagccagauugaguagaccagcuuagagaggaguuugaaccagaccggcugagaucagaaaaaacaagaaagggugaaauuauuccgcaguaauucucagagacugaaagcauucuaagccuaacuaagauuguauagaagcuagaagcuuccaagacuagggcuagguuagcagaaagaggcuguaagccucagagacaacaguugcuucaggcaaauaaaaguuccuuuuacuaaaguaccuguuuccucaggccucaggcuucuugauguagagagggauuaucuuauaaauuacuacaugaugguuucugauggguuucagaucucacuuuauuaugugaaguagggcaguagacugaagauuaggagacacauaggucucuaugugucuugauuugccuaguucuagucacuagugcaguauucugcacuuaagaagacuaaggcaagagaagcaugacucugaaggcuuagucaccagggagugggacugggugaaaggauaaguagaaguagaugcccuuguuggaagaacugucucccugggcuggugguggaauuugaggucucaagugucuacuccaggcccaggcaugcucccccacacccuguccccaucucuucacuugaggaucagagugcagcucucagcuuccucuccaacaccauguuugccugccugccaccaugaugcccaccuugaugauaacggaccaacccugugaaacuguaaacaaaccccaauuaaaagcuuucuuuuauaggauuugcaguggccauggugucucuucagccuaagauggcaacugacguucuuuuuaggaguauaucuccuucauaucuccagagucuuuaaaaugcuugugaacgauugguagugaccuguuugauugugaaguaccuugggaccacgugugugcuccucgucuucuaauaagcacgugcguugcuucuuccuguagggggauuuucuaugggaggcugcauggcgaugcauuuagcauacagaagucacccagauguggcaggaguauuuguucuuucugguuuucugaauaaagcaucuguuguuuaccagguaaguuccagauuuaaauaacaaauaagcaaaugugacaugaaacauaagcacaaugaaacuaaaauugaguugauaauuaagcaauaaaauguggugccuacuugauacagauuaauaguuccuggaauucaugccgaguccaggaggccucuguguucagcaaguaccccaugaaaagggcaguuagagacgaaggguaugcuuaguacuauaugaauccuuuauaccaaacaagaauguagaagacaauagucggacuggcuuguuaugagucuacucaaaaaucaauuguaaagcuagcacuuugguguaacagcuucaugaccagaaguugaacagggaaguagaauguggcuuuucucuucaauuaugccucagcucuguacuucuuccucuuagucuccccacgaagaagucuguccuugcauuuccauccaguucuugagggaaugcuucacuggccuuugaagaguccucagugguggaaacacugagcacacacccacacaucccucacagaggccugcucacuggcauaaacacacaccucggcacacaccucgcucuguaccaccuccacacccgcuuccucuacauacgggagcuguggugaacuaggcauggucuucuccgauugacugccuaacugggcugucucacaucuuccuuuaggaccuucagcaagguggccgcaugcucccugagcucuuccagugucacggcucugcagauaaccuaguucugcaugcuuggggcaaggagacaaacucaaaacugaaaucucuaggagugagcacaacguuucacagucuuccgaaucuuaaccaugagcucaacaaaacugagcuggagaagcuaaagucauggauucucacaaggcugccaggagagacagaugggcagagugaaugauuccugaccagcauauugauuguucaucuuccauuuaacauuuuuucuuauuugauccucacaaaaauuaagguuuuugaaacagcccgugccccuauauuauacaaaugaaauugcauaucugucuauuuucauucaacaagauugucuuguaaaucaucauguagugaaugucaacuguucauuuuguugcugcauagguaccauugagggggcacacuggaaugugcuuguccaugcaucacagauuugggugacuuccugugugaggcugucauaaauagggcugcuaugaggugcaaacauccacccuaagguggagagcugggugacaguguuauagcaucgccugaaacggcccagcugcuucucaauguggcuuuagcaccuuccauuccagucagcagugugguggccccugaggcccaguuaugcaccugaccuucaucuuguuuguucugguggcuucauaguguucacguagcauuugauuucugcuuucuuggugccaaugaugcgauacagaauccuacacugaaggcuucccagauuugugaaaaucaguuugcccugcccaaucuguuuguagauuaucuuugugaaaauuauucacugccaagauaaugacaaauaaauuaugaauaaauaauuuacugacuuucagauuuacuuacuaaaaugucuagucccaugaugaguaauuuagucuuaauacagguggaauuaauuuagaucaauagcugugcauucuguuuuagauaacugguaauaaacacacaaagaucuuuuaaguauuuua

SEQ ID NO: 585 - RNA, 503 nt, Mus musculus
uggcauaaauaaauaaguaacccagagaagaaggcuuuguugugccuuggaaaugaucgaagguuaacgucucauaaauaacuguguagcgcagcucucaucucggggaagcccuuugcaggggucaggaguuagggaggacguuguugucuacuccuguagacauggagauaggcacggugccugcucccacagucccugcagcuagcgugugcuguagguagggcauggagucgcugacauauuaccaaucucaaaaugacaaauuucucucuacuguaaaggcagauaucauucacugauucagaaagagccaaagaaaugcuaagcagaacacaggacagagagaggacaaaccucuagcuggccaggggcucucaagcuagauugccaacgaccugaaagggaaaaauuuucaauucugacuuuggccacaggacccagccauaugucuuccacauucauuuugcugagugccaaaguucauuuaaaaaaaaaaaaaa

SEQ ID NO: 586 - RNA, 1113 nt, Mus musculus
ucagugacacaaggggcaucucaggggguuggccacugacuagcaaaggauuauaaaacccaugcagagagcauuccuuuaaagcaagguaaauccagcaccuaugucccggggauaaacagacagcaugacucaccuuacaacgccaaguuagaaacacucaucucugagugggaugagaguuucugugagaauaaucaaaacacauuuggaaaacaccauugcacaaacuuggugucaugaugacuuuauaauucuuucuagcuauaaacuauuuaacguucuucaauaaaagaucggaaaggaccaaagaacauguaauuuucuuuggaaaaaaaaaucccuggcuuaaacacagugaaaagguuuguguggguucaaaaggggcgacauagacacuauuuuugcuaucauuggcuugcuuucaacauugguguccaaaacaaaugaaucugcauggaaguaguuaggggcugaggcaaacuaagccaauucuuuuaaagauacuauugcugcgcuauccucccccauuucaaaucugugcuggaagauagaauccacuucagcucaaugagucacuucaacauccuugccaggacaauuaaacuuccaguauaaaacaugacccaaagccugcccuccaccacaccauuccacuucaaccuccccccaccccacagggucagcgcuugacauucaagagcuuacaauuucaacugcuuagccaauguaaccaacuuaaugcuuuuacaaaugauuugcacccuucagcacauugggugauauagaaaacguggugucaguuccuccgccugucugagcaacauuacacauuccucuuguccgugguggaggcagucuuugcaggaugaggaaagacaagaagccagcucuccaucuacuacucuuucuuccugaacugacccucgagggaaggacgaagggaggaagaauuucaguaaccacggccaagaaaaagauguauagcucgggcagcccugucacagacggucgcaugaagucuuggggauuaaacuucuugaacuaccaguuacugaagcaguuaauacaucuugcaaauuugcgguugccuuauugcuaacagcugagacg

SEQ ID NO: 587 - RNA, 1883 nt, Mus musculus
ugcuagguuuuuaauaugaugcaguaacugugaggaaaauauucuagcuugagagcaugcuguuucuggagauugugaaauaccacguauguccuccagguggcagaguuucugcucucauugaauuucucucccccagaaauugaguaguugcuuuuuucacgaguguaacuggcauugauuaaauuguuacagcuggucaaauagccaaacugacccuagaacaguuuguucacuaaugaucccacucaauguaaaauccuaagacagagaggcuucuccaaggagcaaauaaaaccggucaucuguaagaugguuuccgaguugcugggacucgggucaccaugacacaugguugguugcugauuucuuucucugguugauggauagcuugccacuuguuaggaacucuaaugaugccuuuguuuuuaaaaacacauaacagaccagauucaaaaaccacaaauaggaauauugaucacaccuuuugagacacaauucccucaguuacuugauguuaacuuuucaggagucccuggcuuguggaagcaacagguuguguuaaacaggaaagaaaauuuuauuuuaaaauuguguucauuauugaguaugugggggguagacagcaacuuaugggagugcuguguuguguggguccuggggaauugaacucugggucgcuagauuugguggcacguguguguguuaccuguuaagucaucgcaccagcccuacugcaguaugacagggagacacuuguuucucaugucuaaggauaucuauuauucguuuguuuucuaaaaugcaugaaaugccuguuaacucccaauuuuucuuauauuauuaguguguggggggguguucauccauagugugugugugugugugugugugugugugugugugugugagugugagaaggucaggggacaacuuggacaacgguauagaguugugcgaguuccaggcauggaacucaggucacuagcuucuagagcaagcagcuuuauccacggagccaucuuuugcuggccuccucaucuuucuuaugguuguuaccuguuuucuucccacgugggagauuggcuggccugugacccacagcuucuugcagacuucacugcugugugcggugguguaguuuuagaugaauuacugaaaucguggaguaaguguuuucagaggggagcugugaaaugauguugagauaaacaaggcugggggaugucgcgcaugaugucucguggccucuuuucccaccagagagaaaaccagagccauuccuaugggcgaagacuugagagcagcuucacccuaacaggacagccugugguacccugccuccuugcucguggugcguuuauuuguuguauucucuucccacgcugccugaguuugugugaugagugaaugauguggcuaauuucauuaauaagaacuuugauuaaaucugugaguucucuaacguucuuuucugagaguuggaguagucacuagagaguuguggucaggacucucaaguuuuacgcaucaaagccaucuaucuggcuguacuuucagaaauaguuauuaacauauacuuuugcuucuuaaaauacuuauuuaccaguuuuuccaucagucauacaaaccacagagaggcuuuuuuucuuucuuuuuuuuaugcaauuacuguugcccuguguuuccugcuuuauuuucauguuuuuaaacugcagagcgagguaguagaaaggcagaguugcuugagauacagguugaugacuuugcuaguagaauucuucacagucugaagcccccugaggggaaaggugacagucaccuacagcauaugcaucuuaaaaaugcuuccauuugggucucuggagauggcgcagucagua

SEQ ID NO: 588 - RNA, 1257 nt, Mus musculus
gaacuuuauugaugguauucaagagaguagggagggcucccuaggccccuccuguuauggggaucugggguggaaauugugagggagaugcucaguguuggaggcugaguugggauagggacuccucagcaacugagggccucucucucuugcucucaguguccuugcuggggugggugguccaggguuucuuacuccuuggaggccauggaggccauaagguccaccacccuguugcuguagccguauucauugucauaccaggaaaugagcuuaacaaaguugucauugagagcaaugccagccccggcaucgauggugaaagagugggaguugcuguugaagucgcaggagacaaccugguccucaguguagcccaagaugcccuucagugggcccucagaugccugcuucaccaccuucuugaugucaucauacuuggcagguuucuccagguggcacgucagauccacgacggacacauuggggguaggaacacgaaaguccaugccagugagcuucuauucagcucugggaugaccuugcccacagccuuggcagcaccaguggaugcagggaugauguucugggcagccccacagccaucaugccacagcuuuccagaggggccauccacagucuucugaguggcaaugauggcauggaucguagucaugagcccuuccacgaugccaaaguugucauggaugaccuuggccagggggcuaaguaguugguggugcaagaugcauugcugacaaucuugagugaguugucauauuucucgugguucacacccaucacaaacaugggggcaucggcagaaggggcagagaugaugacccuuuuggcuccauccuucaagugggcccuggccuucuccaugguggugaagauaccaguagacuccacgacauacucagcacuggccucaccccauuugauguuagcggggucucgcuccuggaagauggugaugggcuucccauugaugacaagcuuuccauucuuggccuugacugugccguugaauuugccauggguggagucauacuggaacauguagaccauguaguugaggucaaugaaggggucguugauggcaacaaccuccacuuugccauguggagagcagauggcagcccuggugaccaggcacccaauacggccaaauccauccacaccgaccuucaccauuuugucuacaggacgagucuggcacugcacaagaagaugcggcugucucuggaacaggga

SEQ ID NO: 589 - RNA, 1032 nt, Mus musculus
ggccuuucggcgggaggcgggugugugcgcggugcgugcgggagacugugcggggccggucggggagauuccgauccgagggcgcccggaucccgccaaguguguccuccaggggggaggggacgaagugcguccaucugaggaccuugcccucagucacuuuggccgcggcgcccgcguagccugacggucuggagccacucggccgccggccgccgugcgaucacugguuggucuuaaucauagccccucgaaucaccacugagcagaagagagaggaaagaaaggaaagcugugguccgggacuggucagaaagagucaggguaaggucccccagcuccagccaggcccacuggacucuaucauccauuuuccaacgaauggaugcagguagaucuugcuuaaggcgggacagaugguggcuauggggagaccuugaccuuguccuuuuuccccuaagcgucagagccucagacuagguuucuaugguguuaaaaaucaagagucuggagguagugagucuggaaagcuuucccgaccccggggcgagacgaguucucaggcaugcguggacguggacuggcgggcucugggugguuguaugcucucagccucggucagacacucuuucccgcaggcgcgcuguggcccgcuuguggcuccuuccuggugugucaaaguguccuuugcaaucuuggcagagucacggucuagauggagagcgaugcagggaagguugugacagcagaauacuggucucuuaucaguuuggaggaaaacgagagcgcggggaguuaggagccaggaaauguacaaucugggaucugcgccccugcccugcugcauguccuugccuagugcccccccccccccccccccccguggcaagcaccuccaagcaauucgucaauuuccccuagauauacuggaucuuacuuuuaggauccuuccuggaacucgucccgcucaagguugccaaggcugcuuuggcaauagacuagggaaggacgaaggcuaagcucagacuuuug

SEQ ID NO: 590 - RNA, 887 nt, Mus musculus
gagagggcgaguguugaguuaaacaguauuuuaaaaaccaaacauucuggaguuggugagauggcugaaugggcccaagccugguuacaugcguccacauccacagagcccacguaaagguuggagacaagaacaagcauaacaaaauuguucuacaaaggcccucucaucuucucacgaguguauauacaguauguguauacauuuaaaaucaauucaaggaugauaccaauuaguucaugcuaaaggaugacaauggaaaauauuauggguaaauauaacuuuuauuugucugaauugucaucuuggaggcuuaaugccucaguuugcuaaccuaguguaaggaacauguggacccagguggcaaagcuaccagccacaccccagcuucugaggcuggcaggcacuggccuacccucagccccaagguaaccauggaaaccaagccauagcgagugugugcgggaggauaaggauagcuggagaaguaaugugugaaacaccuuacuuaggauuggcugaauuuagcuuuuuaaaacuccagucuggcacggcaacucgcucacccccaggacccaggggagauguguagacaaauccaugaggaugcucgcccaaaggagacaagccuacaucgugugguucagcuccagcagaauccaaaaggcagcaggagagucacggcuuacuagugccaucccauuucaccauuuacuuguuuguugcuacuuaggaauaaauaagcuguuuaaccuuuccucugaguucggggauuuccuuucugccucugucuuuaaccccaauucacgauaguuuugugacaccuaggccuaauccuggaagcuucuaaccucuguacggacuuaucuaggccuagaauguuuuca

SEQ ID NO: 591 - RNA, 3482 nt, Mus musculus
uguugaguaaaaggcagcugaaugccaaugccacaguugauaagguaccguccuuucugguggaaagguuugccauccccagugccgcagcucuagaguuugccguuaggauccugaggguuuccagucacuuuuguacugcuaaccguuuccucccguggcgcuguuuggauuguagcgggauccugccggcugaagcugaacugauguacaucaacgagguagagcguuuggauggauuuggacaggagaucuuccccgugaagguaacaggcugucccugccccugcacauguucagaguuagugccacgggcccgaguggcuucagcuucccagugucaugugacauuaguugauaaauuaguuacuuuuucuucucugugacuggacgagcggcaacuugaaggaggaaggucaaucuuaccuuggccuuuggugcuggagaaggcacuggggcagugggucacauugcauaagcaaccagugugcagaaucagcagggagcagacugcuaugaugccucaggacugucccuggugaccuguuuccuccagcaagguucugcuaccuagaaagguucuauaacuuucccaaacacuucucccagcugguggugauguuuucuaacacgugagcuuacgggggacauuugucauccuaaccagcacagcgguguuaagaauucacuuuagacaaagagaaccccuucuuagcucagagacuugggguuugaucuucagcagaauaucugcaguucuaggacauccaucugaagccauguacuggcacugcucaccuuaaagugucaaggccagaccuugccuuucuuaaagcaggacaagcagcaggcguccuggggaugugaacggaggcuagcgagggggguucuugugcucuucuuuggauguggggcgacugcuggcaacgcagauaaaagcgucuccaguaugcaaccaugucuuauuucuccagcucugcagagcugugugugguggguguuuucuggaaaccaugccuaggaaaucaugaaagcaccucacacccacuguaagugccucaccucccggaguggguguggcuggaagcaucauggagcccaggauccaaagucauuucccccucucuacugaccaacucuucaaaggaugggcacgcuaucagaaacccauugcagcuggccaucccagcgaucuggggacgccugucauuucaguauuucacuccgggccggaucugccggcugcuuucuacgcaugaccugcucccucucugcuguuugcuugcaauuugccuuaaugagaauggcuugugagcgucggacagaaucaagcgggguggccgugucucauggugagggcuaaauggcucucuuuuuagauuuguuuaauuuucuuuugcuucucuaaugccgcccuuaguagggcuguaauccauucuucuugcaguaaugccuggcaagcccaucugcagcccgcugucagcaccccguagauggucauaacauuuugugucacugaaaaagcaguaaacuuuucucuguuucuaccaaaccagcuucucugccuggaaguugggaucucacucuguagccaucugcuuguuuguuuuucuuguccgaaccggaggaagggcggccagugaagccagcacuguagaguuucaguggguuucugucagauucuucaguggguucuucuagcagguucuuuaggaauuagcagccuuccucagagugggacaaccacaguguuuugugacaaguugggauaacaauacccuaguuuuaaaaaaaauccaaucuuuaagacagucaaaaauuuuucagaaauuaaaaguauaucagaaguaggcuggagaaggggcuccgugguuaagagcaccuggugcucacacagaggacccagguuugguucccagcuuccugcaagacagcucacagguguccuuagcuauagucguagggaaucugguacccucucugucuuaugugggaaccaggcaugcauacagagcacaaagcaggcaaaagacccauaaaauagaaauaaauauugaaaagugacauauuagaaacgggagacaacagagaguacaggcugagguggagggaagugcaucagagcugucucaugaaggcgggagccaggagagaaagacuaguaggccgccuggaauguuuaccaucugagcuauucgagggucugaaaaggggagcccaggaaacagaggggagcaccuaguggguggggcuacccgugggccugagggccagcacugaaggguggagagguagcagggcuugggccccaguggggugaguaagauuuuacacaaacccaagcgauguccagcgcuuaagaguauguggguagguagauuuuucuaagaaagaaagaaagagagagagagagagagagagagagagagagagagagagagagagagagagaaggaaaaaagaaagaaagagagaaaggaggaaaacugaaaauuugguagaauucaacauauuugagaaaaauccuacaauuggcucuaaauagaaugugguaaagauggaugcaugcggucagggaaucccgugaccccugcagugcagccagcucugcuagggugaccucgggcaggcugcagacagaugcuuaagguugguacugucucuugccuugugucugcauuuuuaagauaacaaauuaaaugauguguauuuauuagguacagacucuauugauaucuauguucauguaggaccgggugcgcgugcgccgggugggggaucaagcuaacucacacguccuuucacggucauagcuuuuuaaagauucauucacucacucauucauucauucacucacucacucauucauucauucauuuguagcuuuuguguuggccugaaccuccccaccccuguagccucugcaccuugccacccuacucuccacucugaugaggucaacacuuuccaagugaacuguuugucuccccgugccuuucucauuucaccuagaaucauggcguccccugacacaugccagaguaucugguuucaagugcacaugguagccugcucugagguauaugugcacaccccaccccacaucuuccucacucaccugucucgggcuggacgaccuuggcgacugugaguggugugcuaagaucacugugguaacagaugccuucuguugaucugcaggacagucauggcaacagcgugcaccucggcaucuucuucauggggauuuuugugaggaacagggucgggagacaggcagugauauacagguaauauccuccccccguccuucccuucaggggcugcaggccacugauggcugugcagugcgcucagagucacaccagcccggagcgagcugcauuuucucaguuuaaauuaaauucagcaucuucgggauugauggggcuagggaaaaaccgauagugcucuuucugguggcucacccuuccugaagaccg

SEQ ID NO: 592 - RNA, 658 nt, Mus musculus
aggcacaucauaccaaagcugagcuaauccaucaggagccaacaugcccugguaaguaccacuacucuguugcagucugugagagucaccguuguaaauacugcaguaaacacagucugugggacacaggaaagcaaggugcucuacuccugcacuguugguacagucucaguacacagcaagagagucucguguacucucuaacuagagcugccaaaugcacuacagcaacagucucagggcaucauugcauagugggcaguacugugcguguacauagacuuuccacgcauauccaaugacggacauguauguauuuaugugugucccacagcagcuguguggaguucagaagauaaccugcagcagucaguucucuccuaccacauggucuucaucgcuguacaaugccggacaucuccacagcccacauggucuccaucgcuguacaaugccggacaucuccacagcccacauggucuucaucgcuguacaaugccggacaucuccacagcccuuucaucuaaagacuccucaucugccaguggagccagucuugcugucuucugaccaacguaggcaugugccuuucccauacucucgcccuaaaacucuuucuaucacuguaucugaaaugaaucucuuguauacaucacag

SEQ ID NO: 593 - RNA, 279 nt, Mus musculus
uagauacuccauguuucccuauccucuaaagaguuugggucgagacuggaccacgccgugggaggaucuacagaaauauugcuggcgcagacacauuuccaguugucugagguggccaggacauuacucccgugcgccuuacccauacuucaguagcaggcauuucucauugaacuguagaccaccuuuucuguuugagucuggaacgcaguuucaguacuauaauuggagaucugaccaccuuagcaacgcauccuugauccaucucucucgucacgu

SEQ ID NO: 594 - RNA, 31653 nt, Mus musculus
ccccucuuuguugcgguguccaauggccgcauucggaacaucggcggcugcccgggugacucaguuauaugucacagaauaacauucgagaaugggacauggaaugaggcgacgaccgccucaaccccaacagccuucugcagcaaugaggccggcccgagguggguccccgggccccgcgcgcgucguggcggcccgcagcugccacucgcggugcccgcgcgggacccgcgggaagggggcggcgcugcgcuugcccgggaaccccggcuggagccgccccucucgcgccaggguucggggggcuuccgggaagacgccaggccucccuaacaagcagaggcugcugcggcucccucgcgccaaccccgggcgcucacgugcccgcucgcugugggaccguggcaguccaccacaucuggggacccagggaugcgugaagcuggaggggacccucgagucuucuugcuacacagcugucuugcuuuuuccuaccccguccccuccucaccccgcgcuccuugcaugccuccccauccccgagugcagcugggugugaggcuucguggcgucuuuccagccgccuugcuagguaaucggcggggcuggaagcucgcguuaguccugaagggugggucuggggcagcgaggcgggaacccccaugccugucuuauugagcugcagugucugcuguuuccacugcuuucaggcccggucggugagcgggguucccuucguguguccuacggccgcgagaguuaaaggccaccccaaccucccgcggggcccugauccccggcgugccggcguccuccgcccccuugccgugugccccucaucaugaccggcucugccgccgacacucaccgcugcccccaccccaaaaucaccaaaggcacccgaucccggagcagccacgcgcggcccgugagccucgccaccagcgggggcuccgaggaggaggacaaagacggcggggugcuguuccacgugaacaagagcggguucccgaucgauagccacaccugggagcggauguggcugcacguugccaagguccaccccagagggggagagaugguaggcgccaucagaaacgcugccuuccuggcuaaggucaguggcuucgcuggaaagggugggaugggaugggcggguuggcagggaugggaccugcucagcccauccuuggcagggcagggagaagagaccucguguccagcuacugaguccuguucugcugccaagaggagcaggcagggggcuugcuggcuaagcucugagguugggcugagccaaauccauuauguauucagcuccuguaauaucuucaucaaaagcuaaugucaccaggucaacaccaaccacuccaagaaagcauagaaccccaggguccacccuaucugcccuccgugaguguuuuaccuccccccccacccccaggucucccuagcaaaugacuuauggagugaauuuguaaucaaucagccagacuucucagugugaaucauuccuagaguuuuugcuaaccaucuucaucuucaucaucacacucuuccuauccuuuuaugacagugauuuuugauuuuuaccucugaagcuuacagagaacagugaccugucccuuaccagcuuaaucuggcgccaaugaagcauuuggcuguggcuuaaagggacuuuccaggacacuggaugaauuagucucuggaguaaagggagacaccaagugacccucucuuuuuuacucgggagagcagccagggagcaacugagcucaguggccaaggauaugguuacagagagacauguucucuggugggagugucguguuauauaaaaugaaaaccuggaguguggccauggagguggcuucccuggaccccagggaucccguuugcugagcaggacuccugagaggugcaggaaucacauaucccagagacauggcagcagucagucccgguccuggcuggcgacagcugagcaugcaagccugcaggccagaaggcuguguguguccuuggggaaguggaggauguucucugcuuccugcuucaucguguuuuauuacuuugcuaggcagggaguuuauucuguccaaaggauaggagcuuaccugcgcuagaagcuugucugugggaguaucagcaguaauaauccuugcucuugaacucgggcagcccuggcucugacuucagcaucuuucucugcuuaccaugagucaccagagucuuuaaacaugagagaguugggcagagggaguggagacugaaugccacuguuuugagcaggcuuucugaauccugcaccucacucacugugccuucguuuuuaccccagcuccaugugcggggagcccuucuccaugugacaagcauuggaucuuacuauugaagauaucucucgaguccugagaguuaggcaggagugugauugagacagugggacacugccuuuguucucuguggccuccucucccuucccucucuccucuuugcuccuucccguuccuucuuuuccucuuucuccucuuuuuucuccgccucucucuucuuccacuucuucgucuuucuuuuccacuucuuuuucgugucugucugcucuuggcuaggacuguggcugguuugccacagaugcaguauucgaaguauccaccagguaauuuagaacauagguuucuacuccccaagacuaacaccugaugcuuccaggauuguagcugaguacuuccuuuuuauaaaaggauauucugcgcaggaaugguggugaagaucugaacucuaaacacucaggagggagaggcaaaaauuauaaauucaaggcuaccuugggccccacagugaguucaaagccagccuagaauguguacugagaccuuguuucaaaaaaagaaaaagaacauucacuuuucuuauaaguaucuuuuguauuuucauuguaaccaagagccuccggacaguugcugauaagccgggacucccucagcccagugcaggcacuugucugcuuuuaaguuuguugcuuuuguuuuguuuguucauuuucugagacagggucucacacugaagccuugauuguccuggaacuggcuguguagacccagcuuaccucuaacucauagaugucugccugucucuuccuccugccuggucuuuuucauuuauuuuuuuuuaaaauuugaagauuuauuuuguguaugggugcuuugcuggcaucugugucuguacaccaugaauaccacacaggucagaagucuguuggauccucuagaacaggaguuagagacaguugugagucuccaugggcacugggaauugaacccaguucucugcaacaucagccagugcucuucaccacuaagccaucuccccagccccguuuccguucuuugacagggucuugguuauaucugaggcuagucuucauuauaucugaaguuagcccucaaauuuaugauccucuugccuuagcauucugaauucugggcuuauagcaugucccaccacccccagugaugaggggucuuuuaacuugaauaauacuguaugauuucauuucccaguauugcuaauaugguuguuguuugguuuugguuuuugagagguucuuguguagccuagguuagucaaaaauucacuccacugaggcuagaccuccuggcuccacccuucccaguggucacugacucucaauagcugucuuuccaucucuaaccccaucacuggcaccuccuggccucaguaucccucaaacccuggcuccugcccaggcacaggcgugucgagcugcucuguuagacacuguuccucuccaacuccagucucuccuggggccaagucaucauccucuagccaagccaacaccaugcugugaggaauuugcaccgaagaaggguggugggacugugagcagugaaggaggacuggugaauuugggaguagcuacugcagcaacagaauguggguugagguaagauaguaucuggagcaaguucccagggucugagaacgcauggauggcguguccaggacguucugauaggggccauaguaaguucugcuugaaggcuuggguggguggagguggcuaucacuugagaucuucuuuccaaauuuugucugcauucuucuucacaaguguuacugagccacucaagcaccugaccaagccaggcuuuuacugggauaauuuaagaaaaagaucaaaagucacugggguuacacaggauaggcagagagugacagagaggcaggugcagaaggagcaacuggcccuucuaggucuggcuuuagggccuccuaguguccagagguuaacucugcugaggcaggacaccagggcccucagcaggaaacaucacuauguuuccugcagccccuaccucauuuucacaugugucucauuuucacagugauuccaaauuuggaaagaguucacauuagagggcugagagccgccuuugugaugugugagcagagaucugagacucuccacagacucucccccugcacccugugcucucaggaugcucccucccuucuguguccuggauuuagaacuaucccucuugucugacugaauccucccaaggugugacuccaggaccucagucccagaucacaagcugggcccuuugaugcaggagccuggggcuauccuggaauuguggcuguucugugcagcuucucucagguuuucaggaggcucuuuuuccugcugccuguucagugaaagaaaugcuuugguuucuccuuguucuuguugaaggucgcuccugcuggggccucuugcugccucccugcuucaggccuggcuucccuucauuccuuuauggcaucucagucacaggucugugcucaccugcaggucuccaucuuaccuucugucagcucuccuguuuggcaaggaggaaguggagaggcagaccgccagacucugccuuguacucucauuauucuucccugcucacugcguacccucuucuuccaaauccuuuaaacuucccuuggcuuccuggacagcacgggcaucgccuuucagacuaugccgacuaacaggaagcacggaggauggcguuuuacacagccuuaguuuguauuuaaguuauuagcgaacuuaaaccuuuuccagagagucguuguuugcauuucuccuucaguaaaacacuuuuugugagcuuauuuguuuauuaugguggaauacgggauacacgaccuaccuuucaagcauuuugaguguauagcugucaauguuuggcuccugaguguccccaaaugcccaccuguugaaggcuuagccccccagccuaugaugcucuuaguagguagggcauagcaggaaggacuuaggucacugggcggugugcccuagcaucagaacacugcccccccauuucuuggauucugugaggugagcagcccucuucccccugcucucuccaugaugugcugcaggucugacacuauaguuacacgugaccgugagcacugaaacugugagacaaaaccaccuuugcucuuuauaagucaguuaucucagguucuugucagugauagaaaguucuagacacacaugugaggucagacagguguuggucaccucucuccauguggguucggggcuugaacucaggucaucaggcuugguggcaaaggccucucgcugagcugucucucuggcccaggauuggcuguuuggagguugguuuacuucaggauugacccccaugucagugugucucuacuaugugccugcuuuugaaaagagucuagcacuugugugugucgggauggagauuuauuuguucuguccucucagaggcucugagcugucccugcauuuucauggcugcccacugagcucucugaucacugccugugagucuccaugaacuaaggacagcagccauucccucagcagcgugugcggagccugagcucggcaaugcagcggauguuuucuccuguugggcaggaagacuucucaaggagugacaccucaggguugugugcugcugauucugagccucuauagugcagcuccugggagcauguuagugauggauaauggcccagcuuauaccggugcccuaccugcagugcucgcccugcugccuucucauaacagcaggccauguuguccucacagcagcucccagagcagaagaggcaguguugcuauuuaucuggaugcaaguggaggcucugggguccugucauguccauagcugguaggagauuccaaccacuguguuuguuucaucauaaccccuucagggagccccucuggcuuacauccagauccagcaggaacacaggcugccuaaggugcugagccccagccagcuugccggacaucagggugaauugcaauggaugauauccuacagugagcccugcugcagcccguguggggaacucuugcauuuguccuccugcuugggagcaagugugaccacaggcagcugagguaacugcagcuguucuucuaaaucccgugggcgccauuggcugcuauucugaggcccagcugcuuucugaguccugcuucacacccugcucugugggaucccugaguggagggggcuggaaauaacucggaggucagcucagcucccaaagaggacucugagccaagucacuggcuacacgugcaagaacucucucucaggucccgucccucaccucuccacuuuucucugaugggauuuaucccucucucccuuccuucccugcucccgugcuuccugcucuauaccugccuauagcuuaccauauggagaugcuaaggaaggcuguuccuccgccuacuuucuuuucucaccucucugaaaccucuggucgguucuuacagagguuuguuagacauguggguguuacugugaaaaaacaaggaagucuccacaauugcuaguguuuguuggacagagaauucagugugugaguuugugcgugugaaacuguuuaugugggagggugugagugucugucucucucucucacuaacugugugugugugugugugugugugugugagagagagagagagagagagagagagagagagagaggaaugaagucguaggaacauauguucacauuggaacuguuuccccucccagacagggaguuggaguugaggugucagagagaaaacguagcuugcagaacaucugggcccgugugugcccacauagccacgcucgugcucacacacacacacagcacuuugguuugggugugcuaaguaugacugcuucccuuccagcugaagggacaguuucuaugaauuuagaacgccucaaagucaaggcugaguagaggcacugagaggaaucuuaucagcagagaacguuugcaguaaaugcagccaaagucacacaaauggcagaaagccugcuacccugugcucagagcaccacgcccaucugucacugcauggcggagccugugccuggagugccagggacucuuuagguggugucuggcucugcugcccagcuaggcuguccaugggucugcuuagccaccuccccuuccaccggcaaagcuggcccugcugccucaaggaggagacuuaucuugcuuuucacuccucugcuucuuacaaagacgcgaaugccuagaagagccuccucucucaaaccugcauccagagggaacaaguuucuuugucaccaaugacgugguccaccacaaacaugaagaagaugaggagucaguggggaauaaacaaacccaaauguguucccggcuggcuggcuggcguccucgugucuugggagcgguuugcucaaaugcugacuguaggcacuugggagagcuggcugggcugcuuauagucaccugcugauaugguaccucccccacaccaucuucccccugagauaguccaccauugaagggcccucuaagcucccuccagauauacuccacuaugagcuaugguucucaguggcccuccugacauuuacuguaacacaguuggccuucucuaugggaauguaagaaggcucaugaggcaggggcauagcacuuaccagggaagaguugaggcaagggaagggccuugcuuaaucuugaacucaggaaagggacuaaggaaagaaagcagugggcaugcgaggagugugguauugaaaaaugauuccccgggcugugagauggcucagcugguuaagagcacugacugcucuuccagagguccugaguuccauucccagcaaccacaugguucuccacaaccaucucuagugggaucugaugcccucuucuggugugacuuagaaacgauacccauggcugcugugccauucugccacuugccuuauguucugugucaacaauguucaagaggggaacacagauaaaagggucacuauuagccacgcugcagaauggaucaugagauaaaaaguuaagaaucagugaagcacguugggcuccauucgggccagucuuggucaucuuaggugcuuugucacagugauaugguuccuggacuucacaaggaaguuacauucccauagagaaggccaacuguguuacaguaaaugucaggagggccacugagaaccauagcucauaguggaguauaucuggagggagcuuagagggcccuucaaugguggacuaucucagggggaagauggugugggggagguaccauaucagcaggugacuauaccgagcaugugucugcuccugggagcagcugucacuugguuucagccccaugccuguuccagaagcuguaccauagcagccccucgauaacacgaguccccucucucugucucucuguagccuucaauuccccaggucccaaacuacagguuguccaugacgaucccagacuggcuccaggccauccagaauuacaugaagacucuacaguauccuuccagccaggggcugagcaccccagacaagggauggucauggugauggcaagcuuggcagcaugucuguugccuuuggucauccaaagcucuaaggcuggugagcacaggugcuggagagcacccuuagguaagagcuuauagcccgugauagcagcgaccagaacggccagggcuugucccuuagaggugaagauggucugccuucaggccgugacuucucuuucuccaucccuggcccugccuccccgacacccuuucuuugcauccauccauuuucuccaccucuuuguucuguccuuccuuuucuacaugauugacaucuucuccucuucugaccuucccucucuuccaucucucacuugcuuuaacacauuccugaucucucacgaucccagcaagccagguaggugacuucgucccaguuguaugugcacgguugggagggccucugcggugggacccugcuucagcucgaacugaaagagcuacugaggagccagaggguucgucagaugagcuuuucuguuugccucggugcccucgagugguuuacagucaggguugguuaguuccguucugcaggucccucagaagcagcacuguagggacgaaggggccgagguaauggccgcacauggcuucugguguuuuccagcacaggaguaagauggggacccucuccaguguccucucaggggcuugggcuuggguugccugcauggagaggcccaggcuuguuggcuugcuuucugcuugcuucuccccagccucgaggaugagaguacugaaggaagcauggugccuguguucccccauucucugcugcaggaaagaacaacucugucuccugaagggaccagacaacagcaccuccacagggcugccuagcacccuggagacagcaccugcucugcucauuaagaucgaauacuuuauuagcgucucaguuucugccccauaaguccgcuuuccuguguggcauccucuccauggaguccagcugucuccgugggagaugguagcucccuccagagagaggcuggcaggacaaggucccaccagaguuauuggguauugcuucuuuucuccaaaccgagacuccacaugguuugcugcuggugguugagggacacaaacagcuucccaaacagaccugggcuccaagagcggagcuucuuucaguugucacuaucaccaaacauucccagugaccuaaaguuagaacggcucucacuucuaucuaggacgaggccuucccagggagaaugagccggcaugggcuucaucaguagggacaaauuugcauguguuuugcauaucauuuucucacacugauauaaaaccugccacacaaacucagcucagucaucacggcucuugaagggcccccuccuuaccuuuuaucugacacauuaacgaaggcugucagccuagauuacugucgauaguguaggcaguagaaagcauaaggggaccagggaucagguccuuaggucuugggagccaucaucaguggaggcagaguagaaacucuuccuucagacccucggucugggugucuuguccuggacgccaguggcagcauauagggguugcuaggggccauuccuaacgacaggugcauucagcugucagggguuuugaugggucugacccugccuuccccuggaacagaggucaagaggcagugaacuggaaagcuagucuuccugugugucuggaaagagaggccauggcuuugcuagcauggggcaccugcccaggagcucugugcuucauacagggaaggcuggagagaaaccuccaggagcccagcuauuagccacaagaaacuuggaguacauagcuagacaaccuuucacaacuuaaguguggauuaaucuuacuuuguagaaacugaauccugcuucagauauacagggaaccccacuguuugagcaaaaucuucgauaaaguaaaaaaagcaccacuuuacaaauaagagcccucucuugucuuuucuuuuaccacuaagauuuuuuaauaucuuaguuuuagaaauguucagcaggccuacgcugcucuaaccauggcucagggcagcuaccuagacucgccucuggccuagcuaccuagucccugaaguggggcagaagucaugcgcuguggcugucaccuggcucuucaucugugaccucaaccuggaggggaccuuguuccucuccggcaguaugaggcugcuugcgucacggggacacauagggagugaucccuguguaucugacuggacacggugcucuaggggagcaauucauuagucauccacagccucccaacacaggcucuguacaaauaggauuuuacuugaggcagaagaaaaaaacauauaaaucaaguuucuuuaagcuuaaaaaaaaaucaacauugugucucagaaagcaugacaggaguaggucguugguggaccaggcuugcuagcuccggagagccgggcagucgaucagaacaggguguggaaggcggugccaucugcuuagugaugucaggugugcgucuagucaugagaugggggacauuuucuuaaguucuaugugcuguugaauaaauaacugccauuccuccacucuuccaucuuuucuuccauagacugauacaguggucagaauacauacguacauacuacacacacacacacacacacacacacacacacacacacacacaaauacacacagauacacacauauacaaagacacaaacacacacauauacaaagacacaaacacacccucacccacguacacaaagacacaaacacacacauacaaacacacacacaucuaaccauacuuuuguccacccaccuauucacuuaccuuucuccuaucauccauccauccacccauccgucuguccauccacuuacuuaucuccccuccaucuugccaucuguccuccuguccguuuacuuuuucuuuccuuucuguccauccucuccuuuguuuguccacuaagcugcccacucaucacugaaugcauuuucuuacucccauauauuuaauaagaccugcuaacccgggucuuuugagcuuccuucaggcuuuaugagggauccaaagaugauaaaagaaaagucucagcucucaagagcuucuggccuagcaugugacuuaagacaugcagucaaacaagcguagcacaggguagcccgcuaugaagugcuacgaacgaacgucaaaggugaaccucagcuuugguuuaggagcugucuuucuaggcugcacaguggggagcaggggcuguuggcuccccccuggccacuggccaggaaagccauacuuuaacccacggagagaugggaaucuguggcuuugcuggacaaccaggacucuggaguuuccgucuuuuuccuuuacauguuucgcacagauacaaccacacagggacccaguucuuugaaaucaggaaaaugcgaccucugagcggguaaguggcacaugaucugaggaccacauggcuucucuccuaccacugagccuccagcacccucucccaaucugucccuguguccuagggcuccagaauucuagucugaggguggagguggagguacgucagggccuguguagacgggacugaggacuagucgcuuuuggcagcuaaauuuaguggucaagacugacucucaggccagguguggugacauacagcuuuaaucccagcacuugagaggcagguagaucucugaguuugaggccagccugguuuacauuaaaaguuccagaacagccaggggcuaaauagagagaccgugacucaaaaaugaaccagacucacuuucaggacagcagagggccugcaauccuguaagucccuguuuccaugcugagcggugcucacaccaccuccucugagguagcugggggggagggugcaggcucgaggaccuuggcucugucaggggcacgugugcuuuggguucuuucuagggagagaauuguucccuuucucucuagaucccugcauggugccuaguguggaggugggcaugcagacagacugauggauugacagacagccaaacugaccgcauaacugccgaaguucugagaugaucuguugugcucugucuuacagguuaauggagacagcgaaggagaugacccgagaauccuugccuaucaaaugccuggaggcagucauccugggcauguauccucuaagcuuugcguugucccuuugugacccuguucuggaguuaguugugucuuugauguccuuggagaaaaaugucagauccuuucuuaauuugaccuggcuggaguugaacacacccaagguuuggcucuuuggaucagcuucaucuaaccaguuaucuguggugcugccagacagaugucaggcuagugacuguagauucagcagucacgggagaauucaaauucagagggacuuuggagagugccugugugacuuuucuugcauuaauaugacacugucauaaguaagacacuuaaacggaguuaaggccaagagggcgaauauccagauccaucacugggggacacugagagcgaguugcagagaagagcaguguugccagugugucgugguggaaucuggggacacaagggucuggcagugugucgugguggaaucuggggacacaaggggcugguacugugucgugguggaaucuggggacacaagggucuggcagugugucgugauggaauuuggggacacgggggucuggcagugugucgugauggaaucuggggacaggagucuguucucuaaugcucaguuauuuucacugcauucuuggcucuuugccuggagaggaauugguccagaaaagcugugaugacccugacugauggugauggcaauugagcgccaccugagagcagagcgggagaaaugcugggucuucuugugguaguuggcuggggggaccauagucauggaagcaggaagcagaacaagguguugggcuaauauucggccccagacaaaagcuguuggcaucuugaaugcugugcuaaguggccuucagaaagcucugaagcugaagacagcugcguucucauccuggcuacuucacauacaguagcuuucugaaggacagucaggacguguuggaggcagcugggcuggaucugcagagcccacugugagugcuuaggggagggaaugaugacaccuggaccaugaccuuggccguggggcuggguuggacgagguaguuuccagaacugccaggacuuggaagccagccagacauaggaguugacagagagucaagcacaaacggagaagaacucgaagaaucgagggugacagggcugugacaugcuuugguacagaccugcacugggacagaagcaguaagggcugaggggaggggcugcagguguccaggcugcaggacuguggaucgcuccauuccugucuugaguggugaugccacagcccaagggaagggcuuaagaggaaggcuccagcugugggcgugaguucagacaugcacuggguggauuuaaaacaugaaaucugggcuguucaggaugggauauuugaaguguggggcuuuugaggggcagaucuaugccagaaauacaaacugagugacgugaauguuggggagacaaguucagagggagagaaaaugaucaaggaugaaccccaaaauucuuugacugagauggacacaaagaacccaugaaggagccuucgccuuuguuuucuguugcugugaacgaugccaugacaaaagcgaguuagggaggaaaggguuuauuucugcaagugcuucaggucagaaucuaucacugaaggaagucagggaagagaccauggggaaugcugccuauuggcuuguucccugguucguucucggcaagcuagcuucuauagcccagaccgccugcucuagagauggggcagucuguaauugccugggcccuccauaucagucaguuauaacauuuccucagagacacagccacaggccagucugacggaggcaacucuucaguugagguucccucguuccagguggcucuacguuaugucagguugacaguaaaaacaagcagaacagagacuuuagggaacucaaguagguugagacccaggagaggagacagggauuaguggaaggggugcuucagaguuagaugggacaaggagauggucugaaacaggacggucucuuuguuguccauugcuauguacagcaacuuaucuggccucuaggcuuccagggacuuuccuaccugucgcccuacccuacagaacugauggggcuacagaugugaucugccauaccuggcuuugugcagguuccugcuauugaacuccaguucuuugcgugugcaauaagagcuuuaaccuacuaagauaccuccccaaccaucuaccugacuuuuuugagacggggucucccauugaacccggugcauccugguuuggcuagacugacuuggcugggcaagccccuggacccucggagauccaucugccucugccuccugaaugcuaggguuaaagcugugugcaccacugccuggcugcacagugaggguuuuuuuuuuugggggguggggugggguuugagacaggguuucucuguguaguccuggcuguccuggaacucacuuuguagaucaggcuggccucgaacucagaaauccaccugccucugccucccgagugcugggauuaaaggugugugccacacugccuggcugcacagugaguucuuuaacaacugagccaccuccucaaccccucuugugucuuuuugguuuuguuuuugcucuuugagguucuccggaccagauucagcaccuugguugugcucgcccagcacuugaccugagcuacgccuccggccccagauuuucauagucuuuuguuuaguuauguguauacucuguguauauauggguggguauuaaagccagggcuacccacaugcuacuggaccucuccacaggauggagauuuugugauucuccauuucuugcagaucacaugggggucugaccugaagcaugacuguccaucuguaccuuagcaauuggaagacggcaacuugagucuuucugaagccucucucagaucuucuucuugcuccucaucaaagaggaaaacacacauuagggagugcagcaggaggacaggcuggggaguaauagaaaggucagggcuccagucuuguagccacagauauaggcagagacucuuucuggaaaccaguggcuagggagcugcuggcuuguggaggacacaaggccaggccuauccuucagcaggcacacucagccgcuuuggccgccugcugagugugcaggguauauaggcccagggugagugggucugggcuauguaggccugggguguguggaccauaguuugugggucuuggguaugugaggggugggguauaugggacuagaguauguaggcacaagguauguggguccgggguauaugggucuaggguauguaggucugggguaugugggucugggguaugugggaucaggguacaugggugcacagaaugugggaccagggaugcaugggucugggguguaugggccaccuuguucuuugcacauugucacacaucugagcaucauguucccggaauuaucuagaacaucggggcuuguagagaauagaucuaggaacucgcugggucagggcucuugauuuuacuuuguucuuaccuaugugacauuucagagaacaagaaugugggucacaaguguaggagcuucucccuguuguguucaacucagggaaacuggacucuuggcacagaccuccaucuaaacuuacaguuuugcucugucagcacucugguguccugcuuuuccccugggaagagugauucagucacagucagcaucucccagagcuucccacuguccugggaaacaaggauugggaagcugguaggucuggcugacuucuagucaccuguccuucugucugaugaagccagggauaacuuuagauggggcuacacaggcaccauccaucuucuuaucuaucucucuaucuaucugucuaucugucuaucucccuaucuaucucccuaucuaucucccuaucuaucuaucuaucuaucuaucuaucuaucuaucuccaucccuuccuccauccauccaucccagccugggauuguaaaccuggguucuggguaucuuuacagacuaggccaucuccccagccuuugucuuacacguuuucacuucaaccucaaguucaggaucccuuugcacacugcuaacuaaugggugugcagacuuucccaugcucgucagacacaugaaucuuaacauucuuuucugaaugauggcaaguauuugggaggaacagcugcuguggccagccuugcgggaugagggaaugaggacugcgcugauguuuggucaaggucccaggugcccuggaagaaacacacuugauacuggaagugaagcuaaaagcuacuguuagcacaagcaagcaaccuggggugguugguuugguaacauguuuuaacaugauuacuuuauuugguuuugaaaccgucuuauuacuauguauuccaggcuggccuugaacuuccuccagccucccagccccugggacuacaggccugugccccugggcuuggguaucauuuugucuuuuuugguggcacugaggauugaaccuagggccucaugcuugcaaggcaagugcuuccccacucggcugcagccccuaucacugaguggcauagcucccuaguacauguaaaagccauuugaaggucccugcucuucccuacucucuauggcugugguaagacacucugaccaaggcaacuuaggggagaaagaguauuugggggcucacaguuucauagaguaagcccauaaccaucauggcugggagcaugacaacaggaaggcauggcccuggagcaguagcuaagagcucaugucuugagacgcaacucaaauggcagggagagaauuaacugggaauauguguguguguguguguguguguguguguguguguguguguguguguaucaggccuagaggcuugcacuagugaucccagcgcuggagauguggaggcaggaagaucccuggguaucacuguuugaguuccaggacaagagacccugauucgagaaguaaggacagcagaggaacauggagguggaucucugaucuccacacucauguacaccacaccacaccacaccuugcaugcacauacacacacauacauauacacacaugcacacacauguacauauaccacaccauguacacgcaugcauacacacauauacacacucauauauacacaccacaccaugcacacacacacacacacacacacacacacaaguaaaaacacuuuaaguagcuccaagugcccuauagaagccagaaaaggaaaaggugccugguuauuguuuuguuuugcuuucguuuagcuuuugaaaauggcagauuuucucuuuaucccauauucaccugauuuugguaaugcaucagagaguugauacucaaagacacccagcaacuucuuuguacaggauucaucugggaaaguuagauacuaagcugcuggagacaggggaauggacucacuggccacagcagcaguuucauaugcuggaaggcacgcucucugaauucuuggugguuuguuuguuguuuuguuuuuuguuuuuguuuuuguuuuagacaagguuucucuguguagcccuggcuguccaggaacccuauuuguaaaccaggcuggccuugaacucacagugguccacccaccucugccucccaagggcugggauuaaaggcgugcgccacccugcccaucacucugaaucuucaaggccccacucuuuuccuugacuccacuugccucagcuaucucaccaaugggcagccuuccauugagcgguucccuaucagcuuuaaaaccuacuucucaggaaacuacuuucaccaugucgugcuggggauuuacugcaacgguuacuacgguucacugggcaugagccgaagggcugagcugauggacaagccgcugaccuuucggacucugagugaccuugucuuugacuucgaagauuccuauaagaaauaccugcacacgguuaagaaggucaagaucgggcuguacgucccccacgagccgcacagcuuccagcccaucgaguggaagcaacuuguccucaacgucuccaagaugcugagggcugacaucaggaaggagcuggagaaguacgccagggacaugcggaugaaggugagcucagggcaagccccugcugugugggagcuuccuucucaucccuauugguuacuguacaccaggaggaaaccccuggccugacgggagggaggagggugcugaucccaguucaagggugcucuccaucacgggaaggaccagugcuagaaaccuggagcaacuguguccacugcugggcucggcucacuuucugguuuuuauucaguucggcuuuagcccaugggauggcacugcccacauuaguuugugguucccaccucaguucacccauccgagaaacuuccucacagacaugcucagagagcugucuucuccacagauccucagucccaucaaacugagagucaggauuuaacagucacacugucuguggcucuuugauuggacgguuagucuuugcaugugagcuggucugcccucuuugcugguagauucuugcaccaucaguuucagccaacuguggaucgaggacaauagggaaaaaaccuugcagcucugcugaaaauauaaaguuuuuuuuucuuauuauucccuaaauaauauggaguugaacaacuaucaagcuucaggcauuccaggucauuugaguugugacucagucuacaggaggauauguacagaucacgugcaaacauaagugacuugaauacccauggauuuguguguuccuuugggauccuggaacugauucccauaaggacccugaggggcaaauguugcuucacaaaccacagcugaaaccaucuuagauauugcaaagaaagcagcugagacagucacccugucuuaugaucuauuucagagucacacuucaucugugcagccuaaauugcaagaccuucggcaucuggugucacaauagacaggagggacauucacaguccuugagcuugguagauggucucaucauccacucuucccucugucagcucaccucugugguggcagcacacccacuugucccugucccuccagagcccguggagacacuaagagaaagugacuauucugauucaggcuuaucuucacucuucagaacaugggguggugaucugaagccuacucugcgacucagugugggagguggggcccgcagcagcugguuucuggagagcuguagaggagacauugccucccagggugagaaacgugucaguccuggaggcugaggggcugcgguuggcuccccucccuccacagaaaaggagcugacugcugcuccaucccacucuccaggaagugacccuucucuuuucccagugcagaaugagucgaacaugcauuuuggacgggcugcaguugggguguuaugcugugggaaggugagagauggguguggcuaauuacuccugucuucuucagaucuugaaaccugcaagugcccacucuccaacccaagugagaagccggggcaagucccugucuccacgaaggagacaagcaagcccuccaaggaggcucggcaggcgagacaaaucguaagugccauuuucuuuuuccuaguuugcagggguguccuggccugucaggcaguacucuacugaggaugaguugaaccagggaagaccuaagaauggaagaacacuggaaauagaauuaggaagccuggaucuggaaucagcuuagcuacuuaggagcuacugugguguuuuuguaacucucuugggucugaguucaaauuugucaauuucagagaccugcauuccucugugcccagcaggauaugguugcugccagccguuauagcccagagaugcuucccggcucuucuucauccuugucuaacaaccauaggcuggugacgcugcugcagcgccuccuccuuaggucaaauugacucaaauaagacacgacaguugaacugcugagaguccccagcguaaccaggggugaccagauagcaaguccugaggccauagucacauaaacacuaaaaugucacugcuugcuaaaauaaugacaguggggauugucacagcaaguggccgauugcauacuggggacuagagcaauacacagaagucuugguugagucccugcucaggugcaugguagccauguggucgagcaaacccuggucccgagggagccagaguaugcacuuguaagaggcuaagaaggguuccacccaauacuguugaagauaucuaauuagaucacacgguggguguggcuucuuaaugguggcuucuucacuuucacaaaagcauguucugaucaauauguucaucccguaggcuaugaagggaagguucugcuguguucacuucuggaugaggagacccgaacacaaaaagaguuuguugucuugguccagaggccuguagcugguuagaaagggcaccaguacagcucccuagacucuagggaggugacgggaagaaggugcuucuguuuggggaugacaggguaggacaaaguguuucaaagaaggcucuugcuugucacuccacaucccacugucccaccccccaaccccagguuuagcacggacagcuagcagaaacuugcuaaaaugacaggcauccaggagugggaagaaggaguccaggacuucuaaggcaagaaagguugagaugugauguuccagcauauggccauuuucuuagacaggccaauggcuucucaccuuccaugucuggcccgaaguuuggcccucaaugccugucucugacuguaacacccaucuuuaccaugucacccucugaccuugaaacccauccucaccaugucauccucugaccuugucacccacauucaccacaucaucucugaccuugacacccacacucaccaugucacccucugaccuugacacccacauucaccaugucacccucuggccuugacacccauccucagcaugucacccucugaucuugacacccauccucaccaugucaucucugaccuugacacccacacucaccaugucacccucugaccuugacacccacccucaccaugucacccucugaccuugacacccacacucaccaugucauccucugaccucgacacccauccucaccaugucaucucugaccuugacacccacacucaccaugucacccucugaccuugacacccacacucaccaugucauccucugaccuugacacccauccucaccaugucaucucugaccuugacacccacacucaccaugucacccucugaccuugacacccacacucaccaugucacccucugaccuugacacccacacucaccaugucauccucugaccuugacacccauccucaccaugucacccucugaccuugacacccacacucaccauguuacccucugaccuugacacccauccucacugagcccaagcucucucgacucagucauccauuccagcugugcugcugucucagaacugugaacagagaaacccuuccugacaggucagugacacagacccagcagcagaaagggaaaccugucuuuugaucuauuguccaugaagguaacagucauuaauuccucugaagcucccaugagcaguagggguugaacugcccacagaggaugcucuuccccaaagaacuggggccaguacacaggaacugugcuucucuggggcagugaucucugcauagaaugacagccaugggcaggucacugguuggagucccuggacccauggaaaguuaguguuggcagaggauuggcaaguucuuaaccaguaaaagugagugacugaggggacauggcagaguggcaaucaggauggucaggagucugacgaugaugguuugauguagaggcaggggaaaguaugaguugaaacugcaggcucugaggugcuucucaggcucccaggaggaauguucuagaaagugcugauaguagagacccaaggcuuaaugacagcuuuaaaauugaaggcuccuacccagaaguggcaguucaaacagugacucauuggugaggaaagaagaaagcaaugaguagcucuggggaggccagagaaagcagagaccaacuaggagaugaggaagggauggcuaagagggagauucauauuauuuuaccucccuaucaguaaccccgaguuauggcucguuccacaugggcugcucuuaacuccaguggcucgcccacgugaacuguucuuacgaucccuugccccauggcgucuuccucucuccuucucucuccugguucucuuccucaugguuuuccucuagccccaagcuugggaaccaaaugcuccaccuaucucaauucugcccagcuauagguuguaggcaucuuuauucaucaaucggggauaacuuggggggcaggguuaaguguuacuuggguauacgugggaauucucucaucccugggggcaaccauacauacaaagcaaaagaccaaaccucaacagcccugcucuggggaacccacugaccucucuacccaccuggugcaugggagagccugggagugaggagaaaggauggggacagguaguguccccuaaggcaggaaggguggucuucaagaagaggggggguucacuuugucacccuccugcuuuuaugccccaugguucuuuucacccccaugaugggagcucuaggcggggucaaggugaggacucgugguccaguggcaaaagugucaccucaaaaacagcaugggcagugaggcugggggaggggcugauccugaggagguucgagggagggguggaagauacuggggacucuggggaucuuuggagcagcgugacagggcaugacaggguuaagcccgugaaaaggagagugaugggggaagccaggaggacagcacacagggugagcccuaagcugagacccagugaaccaggaugguggcuuugggcaaaccauuuccuugggcccugguuuccuuacuuugaagaggagcagaaauagaguagauuucuugaaguaguuuuuagaacauaguguacucccucugggcuuuuuccuugcagaauugaagagaacuacacugucguugacggccagguggaaauaaccggggccaagaggugaagguucaaaaagaaaguggugaauucaggaagcaagguuuuggggcagccagggacagagggguggcuugcuacagugugggcuuaggggcagggaggggcuagagaggcuccagguagacaaacaagcagagaggcugaugguuugugacucccguggccuugugccaggggaaggaagccaugcugucuggaaaagacagccaggguagcagacugagggcugcaaccccaggcugggggccucacugacagguggcuccuggaucucagaggggccuugcuccaaaucagaauggggguaaccagccuucccuagagcuucugaaccagcagcuuugggacgggaaucugaguuuuuauuuuugacaagcccucaguucugcuguuggguggggaccacaacuugagcuccccaaagcuauucagcagcagacccacccccacugggcuuuaugaaccaaggcaaaguguuuacacuaacaaccaacauggcaagaugaaaguguugaaagccagggcuggagagauggcucagcggguaagagcacugacugcucuuccgaagguccugaguucaaaucccagcaaccaugacuggucccuaugcucaggccugggaggugccucugagucucucuccagggaggcagaaagagauugacuuuccuugccccagacccuaaucucuaccacuuugucaugcagccaagacaaucggccacaccagcaccuucuucugcauccaaggaagacagcuguuagacaguugugaguucgaagcugugggugccagggccccaccccuccucacacuagaguguccugggaguggaaagaaggaccaggaggaucuggguccccaagugguuucccuuccauccccuucccauuacugccccccccccaggucuauuguagcuccugcggggcagucauaggccaauauauuuuaaacucaaaaaaaaaggugggguggcuguacucaacucccuaggcccucagacucaggcccaucuccauagcccuuuucccuggcugagcagguucccaggagccccucauuaacucuuuccaguggggaguguggagaagggaucgaccuguaagucagguagccuuggaacaguguggccauccagagcccugcacuuguggggacgcgaggagagugcugcagagcucauuaccacgcucuucuccaaaucaggaauccuggccacuuugcucucuaucugcauuugagauuaggaggggccucaaaggguaucuaggaggcuucuguuuaaaguggacugaggugagcggguaggggacagucuccccgguuccucauauacccugcuuccuaugggacaggauuagggaagaaaggacucaugcugccaugcaggagagggaaggaugacagaaaacacaaguaaaagaaaaacuggagagcaggaaccacaggagacauggacacuccaagcugacuccugcugacgcauauauuugccauaacacaagcuagaccagcaucagaagcuagaccagcacugcuggcucccagacauaggucaacaaaaggcucuucugcccauagccuccuucaggcaggcuuugguccagccagcuagucuugcuuuuuaaaagagacaacuuugaucaugccccgguggcuucagacacuggguucaaugagcuggucugcaucaggaaagucucuuggaugccauugucaugcuguuaucucuuuaccuaaggccagcaagcuguuucuaaaucugcugagugcucagggaggaaaauaaccacaguuggcucgaggcugucagcugggucccauauaugguucuaggggcuuacgcuacccucugcucacaucuggagccacuucuagcuccacauuccucucugucuuugcacuugccuaaauaaucccuuuaggaacaucugugucacuggguugacacaacauucagcugaguggaaugguaagagugacuucaccagccucaauuaagaucaaguuucuaaagggagacagccuuccccucucccaggggcgugucucugcucccucggaguguuuugaucuuauuauuaucacuacauuuauguguguaagaacaccauacaugugaggggcagaggacaaccuguauguucuuaccuuccaugugggucaugcuuggugacaagugccuuuaaugacugagcuguagucucccucccccuaaugucaggagcaccuucuacaaagaacagucaaguuuuuuaccucucaacucuacccaccaggaguucuuagaggaacgugggcaaggagauuggggucuguuuucaaagccgcugucaacuuaaaccaacgucuucccaacucugggagucaauucccuguagcucuuuucugaugguuguccacagagccuuuugagugggguuagcucgagagcagguuagagaauccaggggaaccugacugcuagugcguccauuuuuccaguuacuugagaggugggagccaggaagaucacuugagucaguuuagacuauauugaggcaaucaguagaaaagaagggcucaguugacugcuuguuacacaagcuugaggucccugaguucagauccuggaaccacguaacaagccagguauggcagcacacacacgguaagcccacuauguggggcgagggagacagggugaugugaggcuuucuggaagccucauucuacaagcugaaagucgagugagagauuccaucucaagaaaauaaaauuaacuuaggugaaguaaggaagauaacaggccggccgcuggccuccacaugcaauggacacacuuggacacauaccuccacacacauccucacaagaacaucuacaggaaaauaaaagggaaggccagcucuucacuggagucggcuucucuaaaggcugacuuuuucuucuuuccugccuuguuuccuuuucuucuuuugcuuucacuuuccuuuuggcuauuaaccuacaaaggguccccaagguggguccuagaagccacuccagguuuguaggcagugguccuguuuaaaguagcugaucucuaucuagggcaugauuggaccacagcaccaucacccucaaggccuugagcucacugacacggcugagcgaagugugugugcauccacauacauccauacaucacugugggcaucccaggaaccaugagaagacacacaaacguggugccaccacccacaggagacuacgauacaaguucuuuaguggggucaaguagcaaguuuuagugaccacugugaaguuguuucauagagaaugaucauagaucaagaugucagaaucucuuaguggcuacuugagaggcaggaggauuccaaguucaaggcugccugguaacugagauuucaucuccaauauaaaaugaaaagggagcuggggagagcucaguggcccagugcuugccuaccacaggagaguaaaguguuuuaggguggucaagcccuucuuagacagguugcugagcuacgaagucugcuguucauuugcaguugagagagcuggacuacuuuccugucaagaggaaacaauucgcuagagagaaaucuuucaaagguuuaagaacuuucuuauaccugaauuuucacuuuuuagcacuuaagauagugucauuggaugucauuuaaagacaucuuugaugcucuugugaagaugacagaacuccugaaguagaacucaccagcauccuaaaucccacuuacagucucgcucauguugacccacgcugauaagggguucaucagauauuggaagcugucagaggcuuacacagugucauccuggaaagcugccagugccuucacuggugcccuacagugcuuaggcaacuugcuggcacgugcuuuaggaguuucuuagcaaagaugcuuugcucugggugguuuuaugcuggggcgugagguuucagcgauuucugaaaggcacaccuccauuuuuauuuauuuauuuauuuuugaggcaggauuucucuacauagcuguggcugucuuagaacauacucuguagauaaggcuggccucaaacucagagcucaaccugcuucugccuccugagugcugggauuaaggcgugugccaucacagugggcaacacaccuugauucuacacauucaagccuacagugugaacaucucucagggguaacugaaugcccaccaaaaccuagucucgugaccccugggcucacuguugccaaaagaauuuggcuuaguccuguauuauauguaacuuguuagggccugagagguacuggguuucaaaaauuguagcccugaacuuagugcuaugcaccuauaauauccgaacaugggagacucaggcgggaggaugcaaaguucaaggccacccugggaaacagugaaacccugucucaaaaaagcaagagccugcuuaauuuugcuguuuucaagguguuuuguuuuaguuuuacaacguuagugugacuaaguucaggcuuagagacuccuucgaucccagagaugcuuuuaaauuucuucacugaaagccuuuccuuagaaccugucaaggucgauggagacucacucgggagccuagagugcggugcggggagcaggcagguccugggaggguuagcuagccacacugcaggcccuugcaggcagguccuggaaggguuagcuaaccacacugcaggcccuugcaggcagguccuggaaggguuagcuagccacacugcaggcccuugcagagcuucguuccucuaugguggucccucucuagcauccuucugccuuuccccuuaggccugcucugaccgagaagaagguggcugaccucggcacucugaacgaagugggcuaucagauccggaucuagccgagccaggccggccaggcuucuauggugcucuucucugcacuuuacccagcagcuucaggaggaacugcaacuuguggaguuuugauuuugaaggauuuaccuggagauggaaucugaguggguuuugaaaacucaccgggcagcaggcaugacugggcugaagugaugggcaaagcccuggguugacugacucccucacucaggauccuaagaacaaugcugacugcaguuuucuacuuuucuccauuugccgacucuucugcuugcuuuggacauuaugccucagcucuagaaaccguuuauggaguuccucccacuuuuugguacagcaggcaacucagccaguauuacugucuccucagcaauaacaagcaaagauggguggguuuuuuuuaagcaguugauauuaccucaacauuuuggcaucagauaugcaaucuuaaugaguuuuuuauauucuauuuguauuguuuccuauagggaucucgaugguuugguggggguuuuuuuguuuuuuuuucugguucacaugugagaugagauuuaaguuguuauaugcaaaugcuuuagaagcacucaaauucuggcaauaagggaauauaauccgcuuugggauguuggcgucacuuuucuuaaagcaucugccgacagguuuccuucuaacaagcacgcugaggagcucggguccaugcaguugcugacauuuaagccuuuucugaggcaagcaaaaggcacaagagaucaucugcucccaaaaaaacgcagcagugcugagacgucccagacagccucgguuccuaguggcuccuuguuguuaauguguucugcugucucacaugaaggcaaacaugaugguggacuguuucccaggggcuugucuuuagguacuacgucacggcaucaggaggugcugggggaaaccaggaccucguggaucgagccugucgugaagggaaagcguuccagcacagugucgugccgccgugucagugucacccgugccgccgugucacccaggcccugaagcacagcccgccugccuguggcgacugcagcgcagcuucugcuugcagaccauggagaaggaaacacaguuucaagucauugaucuuagugcagucaccaugccaacucaggacagaggaccggcuucagcuggauugcuagccccgagagcucagcaugccacccucuggcugugacugcggcagagcuccaagucaaccgucugcuuauggagucuuugccaggaaaccuagggccauauggagggcaaaaccucacuccacccuuaaaccaguauuauuaaugaaaagucguuuucuuggaaaagcuuaguguccuuuagcggucaggacccggaaacuaaaaccgaguguaaacuucaaauucugaacucaauggcuuucuucaagaauccuaugacuggaguucaaagugaguuauggggccuccacauguccucacgagcugcuaccuguugucagccucagggcagugugcauuuaaauguuccaaggagcaaucuguuaaacuaaagccaccgggcaaagugccugcaacugccuguguucaaggacagcucccaggaacagagcgccaaacagcgggacaaccuuguuguguggcaagggaaagaagagcagcuggcugugacacugcccuuguaaucucucccacaacuacuuucugauuuuuagguucauuuuucaaggcagaguuagucacagaaacaucuaaaaauguuugucuuugucacucaauuuuacugccuguaguuaaacuaacucccaaaaaaccagaaggaagccccgaaacaccuacauucuaaugcaauaguuuauugggauaaaaaggcggcaaaaaugaaugcagcacgucugaccucucagacugaccuuucagccuggcugugaugaagaugaaaacugacuugacaggaacaauuauccuaugcaccaugacaagaugcccugagcugacaaguuucaagcugacugcuauugguugugagagguggccuggguguuuucugcacacgugggagccgugagcacaccccuuuccuugagucagcuguuucauggauguccucagcagacauggguaagcaaagggaagccuuugcagcccuccagcucacuauacaaggcuuuccuaggcuagacuuuuauguacaaccuuguacaguuuuuuugacauacacuucagauucuuguuuauucucuuagacuuugaucuggccaauacauuuuuaaaaaaucuuucugaagaaccauaauuguuuugguggguauuuuucuaaguaugugaagacuugaugguauucuacagaacaccacaagugcaugcuucaggcucgacgacucucucucaucauguguccacacagcauggaacuguaauaaaaccguucuggaaacugaaggacuucacgauguuuguuuuguuucuguuugucccacucaacauauugaccacuauguuuccucuuccagacuuuguuaaauauuacucuauuuucguguacaucaau

SEQ ID NO: 595 - RNA, 858 nt, Mus musculus
ucauaaccuccuccaaguccagcuccaggggauccgacaaccuccucuggucacuguagccauguucauacacauacacaaauaaaaauaguaaaaaaaaauauuuaaguugaccauuuugugcauuuugaagcagcccaucauccacugauagccagugcugugcaucccagggguuccagagcagguuacuacucggaagaggcccacagcaucacagccgucccagcccgggcaagcacugccuguauucuggcugcauggcuuugccuauggcgagugcgacgcugccgugcacgcuuucugugccucauguguuccuagugcugcuucacuuuccuguggcagcugagaccaccgugugcucuggucagcuccuauuggcgaagugaccuagagucaccucaguuaaaagauugcccagaucagguuggucuauggccaugacuguguggcacugucuugauuauugauugcuacgauauagaaggacccaggccuucugguggacgguaccaucgcugcgaugguaguccuggguuguguaagaaagcugacugugcaugcgugagccagugggagagcaagccagugagcagcacuccuccaugguuacugccuuggcuuccugcccugacuuccucagugcuggauggugaccuguaaguaagucagauaacacucccuccccgaguugcuuuugcugauucucuaaguugggguuucuauugcugugaagagaccccaugaucacaacagcucuuauuaaggaaaacauuucacuggggcuggcuuacagguucagagguuuaguucauugucaugaugggaagcaugguucuugaaggcagacauggu

SEQ ID NO: 596 - RNA, 1360 nt, Mus musculus
cagucuccuacaguccuccuuggacuucagacuccaccuccuuggauucacacccacaacccuaagggcuugagaccccacuccucagcacagcacucgggcgacacuucugcccaugucuucucacuuucucauguuuuuuuaaagugcuacucaaacuuucuggaagcuguaggcugccaaacacacuggaagugagcugcuuccauucccauacucugcccgaugcuaagacuccauggggaagcaaccggaagcacagagagcuucugccaccugguaaucaauucaaucuggugauuucagauaaauuuguccucuuucuucacaagaacugcugacacuaccggggcucuuuccuuuaaagaaaaaauuagauuuacuuaaggggaugggggcacauguggaggucagagggcaacuucaggaguuguuucucuucccccaccaggcaggucccagggauugaauguagaucacugggauuacaagaacccugaccuacuuacuggaccauuccuugggcccacuuuuguuguugguagugcuagggauugaauguagccuuuugccccuguuggauaagaucuugucacugaccuguggcccugauccuuuacuucuugagacagggauucacugaguuguccaggucuuuaacuuguuuuguugcggagcuuuugauucuccugccucagccucuggaguaacuggaauggcagguuucugccaugaagcccuggcucagcccaggcucaacucagguccugcagaugaguccagcugcacggcuuaucucucuagagcaaccagcuacugcuuccuguuggggggacucucccauuacgugagacauuaguggguagccccacugcagauuaacaaagccaaggcccaggucugagccccagacugggcaaggacagcguugugucagacuucaauuccugaaguacugagcaauguccggaggcauaggcauucuuccggaugagcaaucuaagccuggccacaaggugcuuauugaacuuccugucucuucccugcuguuuccuccagucucucccugguccuuccuuucaguaaacccccucccuggcugucaacacacacacuauuuucuuguucugagggcacucaccauagcagagcaagacgguuggugacccagcggcucccucuucuucucuugcuaagagaacccuguuuguuuguuuguuuguuuguuucauucguucacccauuuuccuuaugcacacugacuggucagagcaggaguggcagaaaaugggagccauggguagagcuuggauccuauccccucagauggagggcaaagaagcaaacagaaaggggcaga

SEQ ID NO: 597 - RNA, 13043 nt, Mus musculus
cagccugggauugguaaccuggaguuaagcgggcucccugccaacgcgagggcuuuaaaaggggugaugcaacgcgcucccagccacagucucacucagcgagacgccgcgcacggugcuuccccaguggagccaaucggcuaacccgcgcuccggcagaguccuuggcgcucgcccgccggcgggacagaccacccgccucuggccgcucucuggacccuggccgccccgagcgaagacuggaggugaguuagagccacaccgaggagcgcugcccuccucacccuaaguuccccucuggugaccagucccgggacccuugcgccaccggagacugaagcccuaguguccgugccacagucgcucggcugagccgcucuuugccgcugccguucuuagcugguaaaaaguuucugguaaagugaaagaacgaacuuucucuuuugacucgaggcgugaaagaugcccagggacggaggaguugcgcucucaguuugcaacuaggagaggucgucuggguggaaggugggugcuggugcgcggaggugacucacacucuggcgaucgggguccccucuuccauccaucacuucuugucccggacccuggacucggagcgggucccuccuaaguccgcguagaggcgcaguggccgcggcuuguugaagcgcugcucccgguaucgagcuaaaugaaugaagaccggacgcucgaacggagguccggcacagccgcuggaggucgccuugcgcuccccggagcagagaucugggcagcaugaccgcguagagcgcugugagcgaaaguguguuaggauaaguuuggaggcggcgagcccugguguggcgcugucccggggcugaaggccgagaggucuccgcaccagcuaacuucggaccgcuagguuugagacgucacuuccagccucacucgcuguugugacuugcugugcucuggcugacuuuuaaccggcccuugaguuucuuuauguauuggaagggaagcgaaggaaucggaucaagcggguggagggaccaggguguggaaccacuuguacuugggggggggggcgugcgggggggggguuguuuguauucucgugacagagucucacucuguaauccagacugcccauaaaaacuccggccaauccuccugccucagccucccaagugcugaaauuacaggcccacacgcccagcaccuuucugugcgcugugugcuucagauagccagcuuuugacagauuuguuucuagacuaaaauaauuaaaguaaaaggagccagggagggauguucaguguggaggcucccccacccagcguuccuagccggucucugagacaggacaggaaagggggccucucuuacaucucugucuccuagcucucucccguuggauugauucccugcuucgaccccaugcucauuuucaacucccauuucuguauuuuccucuuagccauuuuauuugauuuaaucauguagcucacgagcuuucuuauaaauuaaaggaguugccaagcccgauuauuuaaaagguuuauucuccccuccuguuguuccacucuuuugagacaaagucucccuauguaacuggggcuugcuuuaaacuuauggcagucuucuagccucgguccccaagugcugagauuacaggcaugugucaccaagaagggagcacauguuuugcauguugcauuuguuaugggauaauguuaccacauacaggcucuugcuuggagcggguggggcugggguggggguugcuguugcuucuaucaagagguuucagaggcugcugaccagguucccagagugaagaaggcauugcccagcaccuguggcuaucuaaaucccuucuuggcacaccaguuucuucuggucuucauucugucagagccuccucuaugaggggugccagguaugggucucuucagcccucaguugccccccuggcaggcagcucucucugugguugcuuauuugguugaucuauugaacuaacugauggguccuccugguagugcagaaugaguagagggugggugugggcagcuuggcuggacuggaccacacccaucucugugaguuuaguuaggcaagugcuuuccuucugggaccucaguuuauucaaugacaaaauggggguuugagcuagacaauucuaaugcugggagucccguugaguuccuuuagccaaagucugugauucuuuaaggaacuggcuacagggguuccuugucaagggaggagggacauagccaggaccccccagaaacuucaagagagaaaugguuuccuaugugagaacucacaaucuuggccaauccaacccuaauggaggaaugcugaugucagccaauuggguguaauucaccuggugucuuaggaacucgggggucaaccaccaguugugacagacuggcuugaaauucuugaggguuccagucaauuccugaugacuagaacuaaacugaacugaacuagaucagggucccugaggggcagggagaaugugaauguauggauccuaauuuccuuauguuuuaaaguuugugcaugugauguguuguuccccacagcccugggagggaacuggucaguucagauaggaacugaaggucagaaagccucuggcucgggagugggugcccaacuagugagaaccagaggcagaccuggaaaugcugucucugacccucaagcccagccucccgccuccagccuucaaacaggagaaaggacaggauguagagucaggaaggaguacugguucccuaguacuacaggacaguuugcagacagcuugguggaaggaaguggaaaucaaaagugaaaauucaaagccaucauaagcuacuaggagauaaaaaucuaggagcugaauuuccaguuaagugagggaaguuucauuuucuugaaaauggcgagauugccgauggugcggcauaauuucugguuggaagucaugaagcagcaucuggaagcauaucugaaagacagcuuuaugaucaguguagaaaguucacucagcucaccccaaaucuccccucuuuggggccucagcuccugaaaucaaguugaaacuuucaacuuucuuucccuggaggacacagccuggcucugccugacucucuggagaccucugugcaagacaaaccagaaaagacaagagcccaaaucuuacagagugugcccccaugggggcuucuuaacagcuuucuaacaugcuuguguccccaaguaagccccacccccagcucuucacagaaacauuccauaccacugacauuccucaguuucuuccugacuuuacacuaagaaugcuguugggggaaguccuauacagcggacuuuaaccucaaagggcucguuaauaaacuuaacugggcugcuaaaggcucaugcucaacugcuguggcucaagcuaguuaaguauagaugaacuaguuaaguauagaugaacuauucaguccuacaaaugauggccaggccaguggcagcccugaauuccaccccuggacuguugggguuuuuguuuguuugucuguauuuccaauaaaaugcaaaggagaauauauaggaggaugccgagccucuggcuucagaagucauagaaacaucccccagguacaagguuacagcuuccaauuaagagaccuucaguucuuacuccugucuggaaaagaauuguauacaucuuuuugaguucuuuuacugcucuggaauuucugccuccaccagugggccuuaauauccagggaaagggaucuucaggaagggcucaagaaggugaccagaccccagggagucuccguaggagagcagccaucccucugugggagcuccugggagacccagaguagcuccucauggcagaaugcuuuccagggcauuucuuguauuauuucccaaauugcuuccaccacucuuggggaauuaggguacucauuaccagccuuccuuuacagaagagauaguacaccaggguacuaucaccacacauaacugagcagucuucaaaucucaguuaacaaacaaacaaacaaacaaauucugguauagggauuuuauggaaggcugugaguucugaaaccacgcaaaacaaaucccagugccccauacuaucccauguuaaugugaucugacuaaaucucaguaaguucaugucuaaaaugggacuaguuuucacaacgcuggcugcaaagcucaagggagacaagguagauagauuucuccuuaaauguuagagauuugccaaaaggcucacugcccucugggacuuggcugaugaccaguguagccgaggacggucccuauaccgcuccugcuuugggaaaaggcccgugggggcgaugggggcagcaagucugcagcagaaagaggcaccagaacacucuuccuagauugcuucugcccgugguucccccugucaccccuguggguuugcugaccuauagacugaugaggucaucugcuucggccaccucggcugcacuuuauuuauucaguuguuuaacuggccagccgggacagagcuucagcaaugguuugcucgcuuucucagccaacuuccacauguagacugagucccauagggccaaauugccugcuccuucauccuagaucuuucuuuggcccuguuccaagcuuugcuccuugcaugucaaagcuaaacaacacccccauaaaaccagaacuuugcuccuggcuuuugccugcugagugagguccuuugcuuugccagccaucucguuaagaaggggcuccguauuccugcaugaccugaguuaccaccacuaccgccguucccugccagugacuggggcaaagaaacauaccccacgguguguuuaccuucuucauucggacccaguuuccuccaggagaaaguucugccacagaguuguugaauucagggccccagcuuccacuggcuaacagauguggcccaauucaagugucuucccgauucuuuuugaaaggagacugaaaaugggaucacggcaggcgcuguacuuuuuuuuuccuuccuuccuuuugggaccgaggccacauuuguauauucugcauaccggccacagaagagccugaaaugaggacccccuugagccuuauuuuagaugugucucugagcuguguguuuuaaggaucuguuuuacucacagugaggauagcauaacauuuuuuuugauggugcauugaauuuaauuagcauuguuugcacggguguggggauaguuauuggcacaugggcaacuuaacuacugaauaaauguucccuuuaacugucaggguucacugcuaauagcuccuggguuaggguugggacugcaucuucccucuacagguccugugcagguaaccagagcugcuggguucaugagagaaacugccgugucacauccagaaagcagcacuucccagaagucuccuacccuccugagcuuaccuccuuuuagccccgauguucccugagcuaugaaugugugugugugggggggugcuguuuaggaugggacauggaacagccacuuauucucagcaccuuguacaguuaugaaucucugcauuagcugcugccuguugcaaaaggaaacugaccaagguuguauugcuaaucugugggccagaacauaaaggaggcaguuuuacaacacauauguuuagcaaaacaacaguaauauguucuccuuuacuuccuauaauuucuccaggcaugggcaaggcaugggcaugggcauaaaguaauaagaaaccugaagccucagggcugaugggauuuguuucugagguaggcugucagaccccaugccccaggacgccugaagcagugugugcuuauucuuuuuucuuucagcaaaaugaugcuucaacauccaggccaggucucugccucagaagucagugcgaccgccauuguccccugccucucaccuccugggucacugguauuugaggauuuugcuaaccugacacccuuugucaaggaagagcugagauucgccauccagaauaaacaccucugccaucggauguccucugcgcuggagucaguuaccgucaacaacagaccccuggagaugucagucaccaagucugaggugcguucugcaacacaugauccuuucuucagcucaugcuugucacacaugcuccacauuccagcacauucagaaggcuuaaaguuggggauaagaaccauccaaagcucugggcucugggagguuaaagucuaaagauaacagaguaaagacuauaauacacgaaugagcagguauagugugcacccgagaaugggcagauagagugugugcaugugugugugcgcaugcagguacaugcauguguaugugucugugcauauguguguauggaugugcauacaugugcgugcgugcaugugugugugugugugugugugugauaucaagaaacugaaacaggaagaucaagagaguggugaguuugagggaaaucugagguacauuuccauacugucuuuuagagagagagagagagagagagagagagagagagagagagcacucagcaguuaauagcacuugcugcuccugcagaggacacagguucaauucccaguacccacaugguggcucacagcuaucuguaccuucaauuucaggaaauccaacauccucugcaggcaacugcauaaacaugucacaaauacauaaaugcagguaaauacucauacaugcaaaauaaaaauuaugucucuuuuaaaacaacaacaaaaggaagacagaagcaagcaacugcacaaacucagacacacacaggcaaaggcuggugugcacagaagcaagcaacuacacaaacucagacgcacacaggcaaaggcuuaugcacauacaaauaaacuuuauuauuauauuuuaagaaaagaaacggguucagagauuagcucgaggugaaauuuucauuuuagauuaggagacuguggaaagcuugccuggucauggccuacuagcuaagacuugaggagagggaguugugugggaaggguucucucauuaggaagaagacugugggcugggagugaacugggcaugucacacagaagcugcugugucaagaguagaagggaaaccacugggaggcuuuuggacagagaagaagcuggucugauacauuuaugugguucccuggucugauacauuuaugugaugcccugaaaaccguauuggguaggccacuggaugaguaagccagagaaguaugcucagaaaugaaacuaugagacccugcacuuacacggaggaaggucugggauauagugcugaagguggcuggcuucuggaccuaggccagcugucuuagguauggcuaugguuuuuggaaagaugagaguauccauuuguugcaggaacuguagaaggccaggugggacaagaacagaacuuauguccuuggaagaugucaaauaggcaggcacagaugugagcugggaguccugggccagagauccagggcugggaaguaucugacuguggauggugcuugaagcugugaguuuggugaggccacagucugugcagaggcuuucuaaagaagcaaggaauaugguggcgauuuucaucacucaauggauccagggaccaaggauuagcccuacccuuccugauaacaaugcucacagaugugguacaccauguguuugcucugugcucacacauguucacacacauguucuguguugagaaaccuuugcauaagacgccuggaguaacagacauggcuacugagcugugguugcugguagcucuguugucucaagagcaucagaggugaacacuuguaacuuugcuaggcuuucuuaguuaggauuauuuuaaguuuacuuaauggguaugauggcaacuguggaguaaggagugaaacuggcucaaaagaugugaauuuaaaaggagcuugaggucugggguuguaggucaguggcggaauauaagacauugcauuacauuggggauaaaaagagauugaucaauaggacugacauuuguggaagucugaggggaaccugaaucauagcauuuaguagaugggaaugaacuauuuaugaugcuguugcuauggaugccguuaggggcauuagcugugcuucaagcuagcucagaggaggucagagaggguaccacaaaacagucauggcuaucaaguccaauacuggagaguuagagccugggacauucugggagauauuuuuuucuucuaaugaaauaguuugaaauaagacacaguaguagggauagacggggaagggaggcuagacagguggguggccugggaagagcaguuggggaucucuagagggagaagagugggugggugaugcucccaggcauuccugacucuagggggaaggauguauuuaugaaauauucuuuguccaguucugaauuacagggaucaguguuuuauugguuguuuuugguuuucaagacaggguuucucuauguagcuuuggcuguccuggaagucacccuguagaccaaacuggccuugaacuuauagaucugccugucucugccucccaaaugcugggauaaaaggcaugugccaccacugucuggcucacaaaggccaauuuaaauaucaaaaccuuauuucaaaauccaaauaacuuuuaaaguagacacaaucucaauuucccacauuaccaguguaauuccuuuuuuuacuuguucuuugauuuucaugauuuucucuuuguauuauuuuuuuuuaauuuuauguaugugaguguuuugucugcguggauauaugugcauugugugcaugccugcugcccacagaggucagaagaagguuuuggauccccuggaacuagaguuacacuugagagccaccaugugggugcuggaaaccaaaaccaaguuuuccauaagagcagcaaaugcucuuaaccacugagcuaugucccugucuguguccguguccguaugugugugugucugucugugucuauauguauguaugcaugugugugugugugucuaucuguguguaucuguguguguguaugauuuuuguauuucuugggacaguggccuugaggcaugaaggauagaaauuugggguuagauuccuugggcuuugccucuguagguuguaaauacuuccaucucaguccaccaugucuucugauucaaaagaauggggaaaggucaggagugggccagucauggcaucccaaagcuggcagggucugcacugagcaucccacggggagaguucaucccagcugugcuuuacagaguccauggcuggaugugcucacugcucgucgguucauagaccaucagggucagggugaacguccacggaggaccauagccaccaaagcuggacguggcucaguccucugagcaccccaguucuggcucagaaggaggcgcagggaaucagucugauuuguuggccgaaucagcaggugguucaggacucuacccaucaauagcauccggcuacgggcucauucguaccaucugcuaccacuaauggucucaagucccuccuccaggagcucacugaccucauggaaaggauguaccaggaugcucuugguaaagacagaaauaaauguugguuguuuuucuggaacuguggucacaugguugacagaagucaugggaagaaguuugauuuggcucacacaguugaggggauacaguccguugugcagggaagacaggcagccagggaagcuccgugcccaguggugaaaacgugugcccaauugugagagcuugugcaugguggugagggcuugugcaugguggugagagcuugugcucagugguaagagcuugugcucaguggugagggcuugugcucaauggugagggcuugugcucgauggugagagccugugcacaucuuucuagcucaagaagcaaagcuuagauaaaaguagguuccgaguucaacaguucccuucccuuguucaacaauccaccccugccagccaugucucccaccccaaagguuucacaaccuccccaaacagcacuguucucaggagaauguggcuaggggacagucuggucauuccugacuccagagggaaggacaacuuacaaagucuuguguguauguguguguguguguguguauguguguguauugauuauaauuagcaucagugguuaucauuuuaaaauucaaauucuuauuccaaaauccaaaugcauuuuuaagguaggcuuuaggguuuuauaaaaagauuuauuuauaugaaacacugcagcugucuuuagacacaccagacagaagagugcaucagauuucauuacagaugguugugagccacaaugugguugcugggaauugaacucaggaccucugaaagggcagucagugcucuuaaccacugagccaucucuccagccccagguuuuagguuuuuaaagcagcuuuuaguuuacuaauuuccaauauaauucuauuguacugaacaggcuuuagauuuuguuauucauugucaagcguuugcaugcacaugugugugaaggggauucauacagaaacuuaagucgugaggcuggagauggcuuggugguuaagaacacuugcugcucuucccgaggacugaaguucccaacacgugcaguagguggcucacagcagccuguaacuccagcuccugaagauccauccaacacucuccucugguuucugagaucaccacgaaugcacguggcagacauacacacagacaaauauagauaugcaaauguacacauaagggauuaaaaacaagcaaacccccacagccuugauauuuggguucaugguggcuuaaaugugugccuuuuggauuuuauaggcggccccugaagaagaugagaggaaaaggaggcggcgagaaagaaauaaaauugcugcugccaagugucgaaacaagaaaaaggagaagacagagugccugcagaaagugaguccugccugguccagccuguccuaggggauggaaagccuuguggguggggcagaaaugccagcuguaggcagaggauggagcaaagcuauuagcauggcagaagcggcucuggagauauauguaucuacacacacacacacacacacacacacacacacacgcacauauuuauauacauacauacaaacauacauacauacauacauacauauguguauacauauauccagggccagcaacagcuugccaugaaaccuggcacccuaguuugauacccagaacccacuguggaaggaaagaacugauuucuaaaagugaccucugaccuccucaugcaugcugugacacagacuagucaguccacaaacccccagcaguuucgagacuuucgagucacaccaacauaguuaaagagacuuuacucaccgguuuuaccaaauacaacaaaacuauaaaacccugcuauugccuuuggcucucagauuucuuuuccaugucucccaacuuccgaggccucuacaggguucauaccaccuuccaccuaguuugaucaucccaucuuugugguacgaugguuccucuagcaggucucucucucaguuugaggagccccaagguucccagguggucccccaccucccugcuccuuggcucccuccauugauuguccucucuugauugucccucaggagucagagaaacuggagagugugaaugcugagcugaaggcccagauugaggagcugaagaaugagaaacagcauuugauauacaugcucaaccugcaccggcccaccugcaucguccgggcucagaauggacggacaccggaagacgagaggaaccucuuuauccaacagauaaaagaaggaacauugcagagcuaagcagagguggcacggaggcaauuggggaguucuuacugaauccuccuuuuccaccccacacccugaagccauuggaaaacuggcuuccugugcacuucuagaaucccagcagccaagagccguuggggcaggagggccuguggugaccuacugcauugacccacucugcccccgagugaaccguggagcaggcaggagcauccuuugucucaccaauuccaggauuuaggccuuaucaucccggccagucucagaugaccuagcuggccccaggcugggguccuaugcaaagcaggaucccacuaaugggauucaggcagaagugucuaccuugauagguggggugggaccacauccuccacuguggcugacaacgcccuuccaagggaauauggaaugagaacauucauuauugagguuguccaauggccaggguaugcuuucuagaaaauaugcuguucugucccagaaugacugugcauaggguauccguuucagagccugguguugugcuauuuagauguuugucuugcacaacauuggcaugauuuuuccgggaguuucaucagaucugauuucugagagucuggggaucugccaugguggaaagugccccucaaaagcauuuguguggccacaugaacuggcuggcaccaggggagugaaacuggcugaugaccagcugagccacuuugugccaacagaggauggacgacaccuuucccuguacccacugcagaggaagaacccugggcacagcagcuuuguccuuggcuacaaacuguuacaacgucacacaaugaaggcacaaaguccaacuuucaaaggguguaggacuccauacucagugacagggcaggaagagccaaagauaaccacagccacagccuguggagaccaggguuggaagccaggugcagggccaggcaucugcauugugggauguuaauggcacuuuugucuuguagcuauuuugagaugugguccagagcauuucagcugggagaucucccucuggccaccaggacucuggcuacuguuaaaauccugauguuucuguggaauccucaguguuuaaucccacucaauaguaucauuacaguuuucuguaagagaaaauauuacuuauuuaucccaguauuccuagccugucaacauaauaaauaucggaacaaaaccugguaaac

SEQ ID NO: 598 - RNA, 782 nt, Mus musculus
ucacucugucaaccaggcuggccucgaacucagaaaucugccugccucugccucccaagugcugggauuaaaggcgugcgccaccacugcccggcuugcccugcacuuugacccagcgugcgugcacguccucgauccuuggccagcccuucaccaguguccucccggccccucccuugucccucuaggacaggcugcucccacccuccaagugagcuccgccugccagcccaauggcccaggaagagcaggaguccaguggccucuccuguccugccugcucaagagaagcuaaaagccccuuguuuauguaccugcucuuggauauugugggcaucuugacaggauagggagguugguaggauggacagggccagccagaggugaggaagaugaguggaaggagccugcuucuccuguuuuccagacuccagagaucgaaaccgccuuuccucucuggccaguugaccagcuggcccuguauccucaucccaaacucucucugagcugauaccugaagagccaggcaucagaggcugagcagguggacauucugggcucugccuccugccuacaccaccauagccagugccagcacggccuccagcauucccaggccugcgcacuccugcuccugccuguagauuuaugcugggagaagacacccuugcccccucucccuccuccucugcacgcagcgcucuccucuguccauccccacuucucugucucgucuccgugucuggucaggaaccugucugcaagugaagcaauaucuucgu

SEQ ID NO: 599 - RNA, 782 nt, Mus musculus
acgaagauauugcuucacuugcagacagguuccugaccagacacggagacgagacagagaaguggggauggacagaggagagcgcugcgugcagaggaggagggagagggggcaagggugucuucucccagcauaaaucuacaggcaggagcaggagugcgcaggccugggaaugcuggaggccgugcuggcacuggcuauggugguguaggcaggaggcagagcccagaauguccaccugcucagccucugaugccuggcucuucagguaucagcucagagagaguuugggaugaggauacagggccagcuggucaacuggccagagaggaaaggcgguuucgaucucuggagucuggaaaacaggagaagcaggcuccuuccacucaucuuccucaccucuggcuggcccuguccauccuaccaaccucccuauccugucaagaugcccacaauauccaagagcagguacauaaacaaggggcuuuuagcuucucuugagcaggcaggacaggagaggccacuggacuccugcucuuccugggccauugggcuggcaggcggagcucacuuggagggugggagcagccuguccuagagggacaagggaggggccgggaggacacuggugaagggcuggccaaggaucgaggacgugcacgcacgcugggucaaagugcagggcaagccgggcagugguggcgcacgccuuuaaucccagcacuugggaggcagaggcaggcagauuucugaguucgaggccagccugguugacagaguga

SEQ ID NO: 600 - RNA, 1114 nt, Mus musculus
ggaaauccugaauacacacacuaagcgggucugaccaccaguucaguuucacaaguguguacacucucucucucucucucucucuguguauauacacacacacacacacacauucauuugguaaauggagcacggccacagcagucacuuuuauuuuuuucuuggccuuuacguuacuucucagacaaaaguuaucuauguaaaaaaaaaaaaaauaccucauagacaaaauguuauacaagggaguuacagcaggauauuguucaaagcaguguuucauucuauaaguucaaagcaguaguuuacauggcuuugcuuuaucauagugugcacccauggccucauccuuggaccugaccuagaauaaaugaauauuuuuccuuggucauuaauuuguuccaagacuuuuuuuuuuuuuugguauugcaguggaugugcuuuuaguguaugagagcucauuguacuguauaucuuucuggcaaaccaacuaaaaccaucuccuaagacugucaauuacuugaaccaaaucaagaauucuauaaaaucauuaacucaucuaaacaaacaauucaagaaaguauaucuucauauugauucugcacagaaucuccucuguagugugggcuagugcccaggaaucaaccaaaacagacuauacguggaaagggucguugacagucacaaccugucggaaaagugaggaauacagugaugacaaacacaagaaggcacggcagcagcaaguagcacuuuagaauggaacauguggggcuguaccuguccaggaaucacccaucaaagccaugcaaaacugcaggcccucuccaggaaaguugcuugccuucccagcauggcaucugccaguguauguugcaguguuuccuuccaugauaguugacuaaaccucugaaacgaagcaagccucccaccucccaguaaaaugcuuucuuuuauuaaaaaaaaaaaaaaaagacuugaucauuguuucucuucauggcaauagaacagugucuauaacucuugguaaaaagugccaguacuuugaucccaaacuucuuuuuggauacauuucaagcaguguggcuaugcaaauauaaguuucuuuugguuauuu

SEQ ID NO: 601 - RNA, 48057 nt, Mus musculus
ucucgcucagccgcgggaacccaagguucacaggcucccugagcgccugcgcgggggggcccagagaggaacuggcgaaccgcggggcgaccgaggcgcaugcguacacugccugacagcgcgcggagggaaaaauccgcgagaccgcggcgggagaagauggcggugcugggguagaguuugcaaucuuugugacugggcgagucggguaacuguccgggucauggcgucaaacucaaccaagucguuccuggccgaugccggcuauggcgaacaggagcuggacgcuaauuccgcucuuauggaacuggacaaagguacggaggagggacgcgggcgaagcgucuggggggaguggcgccaccuaguggcggcagcuacagaggcuagaaaggcgcaugcgccgauguauggggcgggaagcacggcugcuagucuuggagccagcgcuuaggcgcaugcaggguugcuggaguagccuugcacaguuggagcagaggcucgugcuugcgaggaugccuuugaccacuugggggcacagucucugguuucccaggcagcaaauaagauaaagugcugaauuuugagauuauuuuuuaaaacguucagugcaggugaagccuucauuaagagagccaaaugauuuucugagcguuuuacagcgauuugucuugcgagacugucaauugcgcguucuaaagcagguuccauguggaugagaacauccgaaaagcuuggcugaacgcgcucauucucugcacacaaguuccacgaguuaguuccccuuauacagguagcuaagagaaaaaauuuuaggguuaggaguuaaauuccaguucuacuaaagugauuauggaaugcggcauuaucaucuagccucgauaugucagcaaagugggcacaguaugucagcuguuguaaauguuaaauggcagugguaugcgaaaagaugccuuuauuaaaggcugaagagggacuuugacagauagcuauccauaaagaaguccuguguaaaugugagaccuuugcuucaguuuccugccaagguuuuuacacuauaggcaauucuugguuaacuguagccaguguguaaccuguagagaacgggacuggaaaccaaggaucuguaaguucaagucuggggggcagggugugccaaguagggacugggggaugcugagagaaccuggaggucaauuagacuuuggcauguuaaauaugcaccuuaguuccuuguccaaguuugaaaccaguuacagguaagaguuuuuuacguuuuacuaaagucugugacauccagguuggccuguacucccuaaagccaaggauaacucucaacuuuugauccucagccucccaaguccuagaccugauguggcccauuacacuguuuuauucagugccaacucccuucccaccgaaauguguauggcucuagcguagcuaaucuugucccaggcuaagaguagauaguguuguagagcaggguaaggauauggagcaaggaaaggaaggacauccagaguuaccuucuaaguguugugagccagugugaugguuuacugugugaaacacuuccugugcaagccugacagucacacacaugugcacacauacauacaauaacaaugaaauaagguuuacauuaaaaaaaaaaaaaagaugcugcggcuguagggaugacuuagccuuuaagaggccacacugcuguuuugugggaccagaguucaguucucagcacucacaccccaaaccucacaacugccuguaacucuagagggucuguuauacacccaucucucccucccccuacauacacauaauuaaaagugaagcucuuugaaagaaaagguuacaguuguaaugaaaguaauaguacaaccuuuuuaauaagaagaguugaaauuaaaacacauauguguaagaaauaagugggggcuguugaguguuuuacagauaagcccuaagcucaacaagacacauuguaucagccgggaacaguagugugacacauugcuaaaggcugagucccacauauuacucuaauaaguguagcuuuuccuaauguagauuauuaucaucagaccaaguauuugccccuccagugauuggaaguuguccagaugaaaacaggcaagauccccuuccugcagagagaaagguuuagugacaucacucaaccugauggcucugugcacaccuggcuuugagaggaugggugggaguggggaaggugacucauucccuuucuugcugcacaugaguggaagcuggugaaccuaaugcuguaggaaaagccugaucguggagugcugauucaacucuugagaacugggugagagucaggacagaauccacacacuaggauuuccuagcguuguuaccauccacccaguuccaccaucuuaauucucccugugaagaccacuguuguacugcccaugugugcaggaauguaacugguguuagggagugaggacucagcacagccccucugagagaaugaauggccuuagccacuggguugggugugcacuaggcggcugacgccaugucauuacuggugguuuuaagaguaguagaaacauggcccuauggauucagacuuuuuuuuccugaggauauuuauuaccagacuacauuuagucugacagcauugguaagugaaccuuuaagguuauauagaaucuagauucagcaacuaguuuaccacauugaagcugaauuagggagcauggacucugcaguuugguuggugacccugauggacaaggucagauaaacuaaacagaaauccacuuauugaaaccauggccuuacuuuuauguaugacugugagcuguugucuuaugauuuacaaugggaauuauuaaauagucucauuucuuauuguuuuaaacuaguauuuucucaugugcagucugcauuauaugucagcauguuuauuagcagugauuucugaaguuuugugggaggauacuuaguaauuaugucagaaauugccauuucugccuuccaaaugugaagugaccuuuauuaacuguuuauuaagcuguggguuguggguugccuucugucuuagucaggguuucuauuccugcacaaacaucaugaccaagaagcaaauuggggaggaaaggguuuauuuagcuuacacuuccauacugcuguucaucaccaaggaagucaagacuggaacucaagcaggucaggaagcaggagcucaugcagaggccauggagggauguucuuuacuggcuugcuuccccuggcuugcucagccugcucucuuauagaaccaagacuaccagcccagagauggucccacccacaaggggccuuucccccuugaucacuaauugagaaaaugccuuacaguuggaucucauggaggcacuuccccugaagcuccuuucucugugauaacuccagcugugucaaguugacacaaaacuagccaguacaccuucuauuguguaguuauacuuacucuauuucuuuguggugcugaggcuugaacaaagggucucauucccgguguucuguugcuuugcaauugagcuguauucuaacccuguguggugauacuuggaaauuuuuuuuaguccuguuacaaccaagcaccauuaaaaaaugaauauaugagauguauacauguuagagauucaauuuugagccauguucaucugagguaaagaaaauaugcagccauugucuaagacacccuuuccugguaaugcuuuguuaguggugcuuuaguggauauugguugcaucugugguuacuuagugucucgaaugucuaccugaggaguagcccuuaggagccccuucucaugaagguggaggcaaaaaguucccuagcuugucuuucgagagcagcuccgaguuaccagauccugccaguaagacacaugcuuugauuagcagcaggagaugaagagcuagcucaggggugcucacaguuccuguggcggcacagugucagcugcauaggcccuaaaugacagggcucacuguagcaucucguuucuuaguaacaguaguugcucucaucuaauuaguuuggcagugugguguuagguguucuuagaaguuuagcagguuuaaaugccagguguggugacguauccuguaaccacagagccugggaggcagacauguagucacucccaguuugagaucauucauagugaguuucaaagcagccaggucugcauagugagugccaggauaggcuguguugaaaagcaagacugaaucucagcaauuaaacaaaacccaagaagucuagucuaaaaauguuuaagagauuaacuacauaauuaacuagguaguuuuugcugauuucagaugagacauuccaacacaugugccugagauuuauauuguuugaaaacaguuuaugggguuguagagauggcucagcaguuaaggacacuggcugcucuuucaggggacccugguucaguucucagcacccacauggcagcucguagucuucggugugaggugauccaaugccuucuuguggcaucugcaggccuugcaagcacaagguacacauuuauacauagaagcaaaaugugugguguguguguguguguuauagcaaauaaauaaagucucaaaauauuuaaaauuauagcucuuaacaucuauauauaaugcagacuaaggguugagggucaucuuuuuuuuuuuuuuuuuucgagacaggguuucucuguauagcccuggcuguccuggagcucacuuuguagaccaggcuggccucgaacucagaaaucccccugccucugccucccgagugcugggauuaaaggugugcgccaccacacccggcugagggucaucuuuuaguuagguguuuuuagucuuuccagaaucaauguuaaaaauuugauuuccacauugagcuuggucacuauucuauuguugugaagagaccucaugaccaaggcaacucuuacaaagaaagcauuuaauuggaggcuugcuugcaguuuuagagaguuaguccaucaccaucagguguggcacuagagcaguagcugagagcuuuacauccugauccacaggcagcagucagagggagagauuggacuggacaugggaaaggccacgcccauuccaacaaggccacaccuccuaguccuucucaaacagcucuacuaacugccgaccauacaagggucacucuuauucagaccaccacagcuauguugauacauuuguuagguuauagauuauugauuggaagcucuucuuuuccuaacaugaguauuugauauuaacaacuauuccuugaaauacuguguuagucauagccuacaaacuguauugucguuuucauuccguugaaaauauauuuuuuauuuuccuucuucuuuccccuauggguuacuuaacagaauauugauuaccaaauacuuggaagguuucuagauauucuucuaauucaauugauagaaagcauacguugugugugucguuuugcuugcuuguuguuauuuuuuauaguacuaaggauugcuuuugagaguuccagacaagugcucaaccacugaacugugguuccagucucucuucaugccccucaccucaccuuugagacagaguuuuacuagguugcucaggcuagccuuguacaugcucuggagccaggguuagccuugaagugugauucuuuugucucagccaggcuauacccagggcuauaagcuuauacuaccaacccuaacugaccucaauccuuuuaaauucacucauauuuuauauuccugaauagucuuaaucaacuuucaacauuuuaaaaauuauuucuuuuucauugcuuugugucuaagagaaucaguuuagggccuagagagauggcucagcaguuaaaagcacuugcuacucuuccagaggacccaaguuaggagacucaccaccagguguaacuccaucuccagaaucuaacaccuucuggccuaugcagccacucacauguaugcaugaaauaaaaacuuuaaaaugaauguuuaugaaacuucuacggcauuuacuuauuuguuugguggcuauugugguuuucuuuugagguaguuuuauauuacgguauuauguuuugcuuuguuuagugaccuuaagugacccaggcuggccucaagcuugguauguggcugaggauggccuugaacugaucucugccucuucccauguggugcaguugcaggugugugccaccauccaugcccugccugcaaguaacuaauguacaugccauuuucauuuguuuuugucagcuguuuuuuguuuuuguuuuguuuuuauuucgaacugcagucuuuuugccuguguguugggguuagaggcaugugccaucuugcacagccuuccauuuuuaguuucgaacagaagucauuaguuuugaacaauacuucuuuuuuuuucuuuucuuuuuuuuucuuuaagauuuauuuauuuauuauauguaaguacacuguagcugucuucagacacuccagaagagggcaucagaucucauuacagaugguugugagccaugugguuguugggacuuggaacuuaggaccuuuggaagagcagucagugcucuuaaccacuaagccaucucuccaguuccuugaacagugcuucuuuuuacuuguugaaaacuugcuguccuccuguauaaguuaguauuugacauuucuguaaguuagcuucugucaguauuugacauaucuguaauuaguuccuccugugcuuuuucaauaggacugaggucuggcaaacucggggagcagugugaggcagucgugcgcuuucccaggcuuuuccagaaguacccguucccuauccucaucaacucagcauuccuaaaguuagcugauguuuucagaguuggguaagugugcugaaugccucagcagcccaaaggacaggcuacuuguaucucuguuuuauacugugucuuuucuucugguccauuagaacuucuugccacucaguuacucucggugaaugcauaaugcuuuguaccauacuuuaauaugagauuuaaugacacuuuuagaaaaaaugaaaagguucagagcgaaauuguuucuucagggaacaagauaaauuaagucagaacagccuuauucugcuacuguauauguauuuuguaaaauuguaggcuuucuuacagaugguuuuagaaauuccugauuucauuuagugacuuguagguacagucuuggagauguguaugcuccuuacccuuaucucuucuaagcuguguggaggaagaucgccugacucacuggcugucgccuuugagugacugcagagguuaauucuguccuggagcuguuucuugggucaggccuuuaggcgucuuucagcggggcuacgggcuuuacacugcuuucgcucgggagccaccguauacagaguugggugguucuuaguggggagcaggaaaagcacugaccauuagcacuggucugacucaacccaaguuacacgcacuguuccuagagugaggcauuucuuugccuguuucuuuucuagaaacaacuuccugcggcuguguguucucaaagugacgcagcaaagugagaagcaccuggagaagauucuaaauguggaugaguuugugaagaggguguucucagugauccacaguaacgaccccguggccagagccaucacucuccgguacugugucccugcgcgagucagcacaaggcugguuacgcucucauuauguuccuaaaaggacuugcuuuuuacuaagacugcaagaauaugguaaccauccucauuuguaaauuagguuaacaucuguaaugcuguuuugguuguuaaauucuuugcuuguguuucaagcaucccaccuuguaagaacgagguggacuucaguacaguguauccuuggcuccuuuugaagauuccuagauuggcagugaacuuggggaaucuuucuauguuggccucccaagaaacugggauuccauguccaugccaccgugccuggcugcacucuucuuucacuucuguuuguguaauuacauguauuauuaaagggacauuuuugaaacucagauaauuaaauuauuagucucuguucuggauuuuccugcucacauagugcucuuuuaagcuagaaggauucaggaaucgacuucacugagaguauuuuuuucuggguugagcauagguucagaauuaguuucuuuaucacccuucugccuuuugauuaaguugaacaucauuugauauuuuaaagucaguucuuggggcuagggauguagguaaagggccauccuagcacugcugcuguucuggguuuaguucccagcacugcgugauacugggugugauggugcacaucuguaauccuagcacgugggaagcugggccaggggaccagagguucaaggucauuuuggcuacccaguaacuuuaaaaccagccugaacugagacaccaagauggcauuguuaccuuuagaaccaucuagccaggcaguggugacacacggauuuaaucccagcacucgggaggcagaggccagccagaucuacagagugaguuccaggacauccagggcuacacagagaaaucuugucuaggaaaaaaauaaaacaaaacaaaacaagacuguccgaccuugcuuacuugaggcaauaaccucaacacuacaaaaccagagaaggacugggagggugaagacaauaaccaacugggacuuaaagcucagacacauggucucagcacuucggaggcagaggcagaaggaucucugaguuugaggacagccugagcuacaguaaacuccaagagacccugucuuuccaaaaaagaaaaagaaaaguugaagauuucgucucaguaguuaauugauagacuauuguguaaaagaaagauacgcuuauauuagcacagaaagugauagugcuaaaaaagauuuugggguuuuauguguaugugugagugcuuguauguauguauauacacugcuugcaugccugguaccuuggcaggccagaagagggcauccaguccucacaggaauugugagcugcuaaguggaugauaggaacugagcccaggaucuuugcaagagcagcaaaaaauggcaucuacguuagccgauuccugucagugaguacaguaucagagguucagaaaaggucucaagaaacaucaucaacagaggggucacugaguuaggggcucugucugaacuguuuucacaagcauguauuacuugaguuguuaucagaagcaacuaagagaauaauagaauuuuuaaaaauauauuuuucacaucauuuggagguaguuugaauauuucgacaauuuucauacuuaaguguuucauuccuuguauagccuguauuacugaguuccagcaguugggccuuaagaacuguugcugccaauaaagcugguaauuucuaguaaguuuuaaaagagauauauuuuaaagacaaacuauugccuuguaaucuuuaacaguacuacuuaaaauaagaaguacuaaggaauuguuucuaaacaguuggaucaauaguaaaaaacugcugaccaggauguauugcaguuggccuacucugauccuuucugguagaguauuagauuaauaauaaguuaugauuuguuuugagacguaauuaguuucaaguuuuuuuuaugaaacuuaauauaaauuaaaaggguccauauuaugauguuucuuuguuuuuugagauaaggucucauuguauagacugaauucaacucuucgaguuacugccucugccuuaacugugcugggauugaaggcgugcacuaccaugcguggcuaucugucuuguuuaugaggaagucaacuucccuguguagugaauuuuaucuuugugaaguaacaaagugaggugugugagguuagagguuacuacuaccuaggcuacuacaggaacauggugcugucaguuucaauguccauggcuuucugcagaaaggauuucucaagcucucugugguuucuauuuaaacauuuauuuuuauuuucuaaauauacuuugugugugugugugugugugugugugugugcaugcaugcaugcgggcaugugugcaugcaugagcucucucacagaagacacauuuggggagucaguucuuuucuuuggcuguaugggucccagagacuggacucaggcuggcagagcugguggcagggaucccucccgcugagcugugucuggcccuguguuuucuagguuuuacuucucuuacuguugcagaugcugagaugagcugcagggggcauucuccaccucuagggaaaucuucucuaauaugguagauuaaaaaagcauuaugccaguggucauugcuguaugcaggggagggggaaagugugccuugugauucugcuuacuagcugguagguuguauuuuuaguacuuuguaaaguagacuucuuuaugcagccuugauauugggaugcuuucauaauuuaaaaguucuuuccugggcucugauuccugaccuguacuucauggugauuuuuuauaaauauaccuguaugugucagaggcaggguaaagagagaauaggaugaagcucacuugacugacguguauaaaagcacugagugcagccgccagggccaggaaggaagagagaggcagguaggagagaagggaacuugcuuuuccuacguauuuuaauauuucugauauacuuaagcauacggauaugcuuagauuugagucacugcuagauuccuaaacuuaagcguucuuaaccugaaauuuauagagugaccuaaacuuuuuggguugauaaucuagcuuaccuuccuuuuccuguccugauuuugaguuaaguauuuuucugugcuugugucucuccguuccugcaggauguugggaagucuggcguccaucaucccugagaggaagaaugcccaucacaguauccgccagagucuggauucccaugauaauguagaagucgaagcugcuguuuuugcagccgcaaacuucucugcacagucgaaguaagcauaguccuuuuaguaauuuggcuccugaggaaauuuuugaaaaagauaacuuaguaucuauagucacuuaauuauauagaaagguguaaauaaugacuuguauuuucuaagaaguuguacaaaauguuggggaagaauauucaaauguugauucccaaaagacaaggaccucauaaccugguuuggcgaagcugccuuugguagcuuuggugucuauugaauagccuuccauaaacauccaugaucugauugucuuuggcacagcuggcaaagauaguaacuuaaaauaaaaacugacaugcuacucuugggaggaacacaaaacacauuccaagagcaagcauucagaauuccccucacauaaguccauucuuggacugugcuuggacacccugcacuggcacugcaggcauaccauaacuggcucuuuuuaaguguguguuuugggaauugaacucagguccucaacuagaccguuaccaauugagcuaucucaccaguucgauaguauuuauuuauuauuucuauuuauguaaguguauaugauaugcauguaauuccuuguggaggcaagaagagggcagcagaugcccuggagcugaacuuacaggcaguuauaaaccuugugauguggauggcaagaacugaacuagauucuuccguaagagcaguaagugcucuggaccauugagucaucucucuagcccuauaacuuuauguugcuuucugagacagggucucacugugcucuggcuguccugaaacucacuauguagaccaggcuggcagagauccuccugacucugccuuccaggugcugggaugaaaggugccagucacuauacccagcccagcccagccccauaaauuuuaaaauagaauguugaccauaguaguaguaguaucauguugggcuuauuuguaauaaaaaaaaaaugucauccccagacugauaacccaaacuaacuuugauuucuagagaccauuuuugauaauacauacaguuggccauaaacaugugcuucccuuugcccagugagauucauuucugagaacuuaacuaaggaugaacaagguacacugauacagucagaggugcugacugugcuguuauuuacaugguaaacauuugcuuuuauggaauuggcaacuccugauaauaccaaaguuuucuuucaacugucuguacuuuaaaaagcaaauuaauucuuggcuagcuucagaaauguauguagugcaucugaucaugccuagcucaagucuucccacuucccaggcccucaggaagucucucucuuucccauuuguacucccucuuuuaguguuuuagucacuugacuagaguuccugaguaugagcccccuccauuaacuccucagcgaggggauggcucucgagccccuccccuguccacaguaggauacugagggcgugacauguaggucugugcagguguccucggcugccugagcucuggagugaggugcucaugccauguccagacagcacuccacaccacuuccuguccuucuugucucuuccuccuuacccaagccuugugggguuugauauaaaugucccauacaguacugagcauaugaccugcugggaaaguuuuaauuuaauaaucagaguaaugaauaauuaauaauuugcuuaagcaccugugcaaaauuugauaaaaugacccaccuugaguugggaguucaggucguaaugagcuguucuaugcggguacugggacccacacucggugcuuucagaagagcaacauauacuuggcuacugaaccauccccauucccagcuuuuguggcugucguuuuguuguuguugcuguuguuacugagugugagguaaucauacacagagaacuuguauagggacuaugcugugaacaguuaucaucugauuaacauugucaggaugacuguauauccaaugguuccaaaagcaguuuucuacauucaguuucucaauuuguauaaguagauaauuuagugauuaaauuuauguaugaggaucaucuuuagucucugaagcugauuuuuauuuuagcuguggaauuucuguuccaucugggaaaugaugguguauaucacagaaacugcuuguucauuuuuggaacugaugacaaguaacaugcccauuaauagugugacacuggagauguagcucaguuguaccguccuuguuuagcaucuacaagguccugaauuugauucccagcaacacagacacagaguucauguagaaacuguguuaauauauuaccuguuguguaacuuuuccuguggagacuugaacaaacauuuauucaccccagauuggacacugcugacagauaaaaaauauuucacugaguaguuuacuggaguugccuacaggaggaugagugagggauugcuuauaagaacauaggugacucacagcuagcuguaucaaccaaaaugcccaccccggcaugggugaugacuugggaaagcugcaucccuggagcauccuuuacuggagccaguaggagauccuacagguucuguuuauauaacugugauauaaagggguagcuugugaguuucaggaacuuccugagacuugucaguuauguaccuccugagcuuuauaagucugguuuacuuuaugagucuuuuuuuaaaaagauuuauuuauuuuauguaugugaguacacuauugcugucuucagacacaccagaagagggcaucggauuccauuacaaaugguugugagccaucaugugguugcugggaauugaacucaggaccucuggaagaguaaucagugcucuuaaccgcugagccaucucucuaguucacuuucugagucuuacguagucguaggggcagacuguuucaguuuagaggaaauugcuauucaacauuaguuuucaguaauauauacuuguauuuguauuauauagugccagauuaauaggaaagccugaagcacuuauuugucaaaguauauacauaauuuuuaucuuuucuuggcuugagaucaugagucuccuccaacauuaguggguuucuguuauuucuuucaguucuacaucuugcuuaaaucaaaguaacuggucaaaugcaauuuaaaauuuuauuuagucaggcauacugguccauccauuuaaucccagcacucaggagacagaggcagguggaucucugagaguuuaaggccagcuuaaacugggauacauagugggacccuaucuccaaaaagaaaaagaaggaaaaagaacauauuuacucuauucugcgccugugcugcuauggcugcaucucgguugccugaaaggguuagggugguauguuguagaagagauugugcuggcuagcuucaggggugaagugaacauagagugguguccccuuccagccacuaauuaaaaagaauucuacuucauuagaaaggggcagcuguccaguggcaccaacccauggcuguauugcaggaaugucugcucugggcugucaggcuugguaugacacagagaugaaggcugggguugcacaacuagaacaucagaugacuuucuuuagucucggcaguuucaguagugacaccaagaauuuauuauuaaaccaaaaauuaaaaaaaaaaaaucagaagacuccuacucugcauuuuuaggcccaaagagcuuaaacuagauucuuaaacuuuagaauuguucuucaagguuuugaaaauaccuugcugaauauccacugccauugccuuugaggcagugggugcugagagaauggagcugguaaagggggacuagaaucuuaggcacaacucuuaugccaauucuauucagggcaccaaacaguccauacgcaaccugagggcuaagaaagggucaccugaguaaaguucuuacgaguucaagccauauguggcaaaagcauauuuuucuauagaggcauauaaaggauaguuagacauuuaauugcauaacauugacaagccauagugaguaauuuaaaguaaacucagcuacacccgagagcaacaugaaaacacuccaagaaaaacgucacaagacacuugucuuguugucuuggaauguuccuauaggcacucagaauucuccucauaggacuccauucuuggaccauguaccgacaauccaccaugucuagauauuauucuaaauacuagugacaacaacaaagucaaagcuuuguuagcacaaauaccauuaacugugcuguugaaguagccacagugggugggcgaggacucuccagagagauggcuaauggccaaagcugagugcugaagaagugccuucauaguucuucuguugagagggggggaucucagaagcaucucucuguguagcuuaggcucgucucaaacuugagauccuccggccuuaguucccaauuauugggacugcaggugcaugcugccacauauggccugccuuuacacccuuaaauaaaaaauguguugguagauacuuauuuuaguguaaaauagcuuuauaaaaguguuuauuuuccaaaaacaaauuauuuugugagaaaaauagccuuaaacauuuuuuucaaagaucuucaaggccuggcuaaaaucucacucaucugcuuucucaguaacauuuugacuaaaguguguaaagaaaaucccaucucccacaaguagugguggaaagaagggagguuugugaagcugucuuagguucaugaacgcuuuaauaccuugucauuuggucuguuaggaagcacugauguacuuguauuacucagaucuuguaaauguuccaccugcauaugagagcaccacaccaguuuagucagaaggacuuguaagcguuaaacuuucaugcucaugguaaaaaguuuguuugcuguaauuguaauuuuugcugacagcuagaguacuguacuuguuauaaaagauucucaguaauuugccuaauguuaucaguugacuuuaacuccucuuccaagaaaaaucuuuggcaaguagggaagucuaaguaucugugucccaggaaagcauacauuuauaucuuaucccaaacauuuggacuggugcuguauguguuuuuuaaauugaauacaaugaguaguuucaguuuugcugagacuguugcauacaacuagcuuguguucucuccuuaauaugaguuuacaguaaugaagaacacgugaccugggacaguugcuggcauugccuugguucuugcuaccucauccauguccuuuuaccaaacaugguggauggauggguggguggguggguggauggaugaugccaaugccauuguaccuggauaagccaugagacugaagcaaauguuacuuaacacaaaauguguuuguugucaagaguucauguaaaagaaaacauucuguaauuagguggaacuguugcaaaccccucaccgcagucagacacgggcagugcuugaucuccucacugacugcagucggugcgggcggcaugagcuggcagccccucaguucaaguguguucuugcuuggcugaggcacugugccaauuaaccgugacugauucuaugugcacauaugugccuggagcccacagaggccagaagagaucauuggaucuccugcaacuagagauauaggugguuguaagcugcuggauggguccugggaaccaacccugggucuugugcaguaggagccagugcuuucaagcacugagcuguuuguaaggagcacagcugccuguugcuaaaacacucagcccuacucuuugaauuccagcucauagucucaaaauagucguugaaaugucauuggcaucuuaguucuuugugaaagaguuuuguugaguaagacaggaaguuagugucuuuacaaggaaaacaguacauuagcgucugcacugcaaggaaucgugugcucacagucuugguuuuuccuccuugcagcuuuguaauucuuuagacugagucaggaauuccaucuuuuuagcaucucgucaucuuacauaaccacaggcugaggaaauaagucuuucacuuucaaagcaaugaucuucccggaaggauaacgaaaaugcauuuucuuacuucuuuuuauaagaagguauugcacaaauaaaaguuugagaaaauuuucaguuuuacugcaaagcaaggcaaggugugcucacgcuguggguucucccuggagggcuaggcagugccugcugguccuggagggcccgggggagcugacagcugaaguauugcaauuaugaggagccguugagcucacugcacuugcucgcagagccugggugagcaagggcuuguugacagcaguguguagcaccuuuggggccacaccgaaaagucuucauccagcauguauaauggcuuccccauaccuucagauggaguucccuuccccuagucuucuccccacauguacuguagccccucccaaggccacaugcaauuaagacagacuugcauaugacugauugggagugguggcuggauacucagguaagcgugccauggcccuccgugucccucauuucuaugaggggacagagucagucaguaaguccagguguggucuuuggaagcaagcacagcuaaauucaugaagauggcagcucuuucuuuagcuugaucgauagugcuguacaacuucuuaugaucugcaaucacacagggaacuuugugaucucaaagucuggcugauagggaggguaugcagauuaagauagguggucuaagauaaugcaaguauacuagaggaacucagcccacugggucaaucauacucauauuuauaugucaaacucgucaucuaggaccuuucuaggaccaggauauagcuuauuaguauaaggcuugcucagugugugcagaggccuagauuugauucccaguacuacaaaaaaccacaaagaaaaucuagaaaacagaagaaagcacauugcauuagcugucaagaggugaagucuucauugucugguguauagagaacucucauugacuugaaauggacagaauauaucuuagcagcugggaauacuuuauuuagacuuguaaugaauugcaaaucguacuuuauguccugcacaucacuuaguuuugcuguguaaagcacguuauguaacauuuuauucuagauguucauguuauuaaguuuuuuugguauugagugauguuucuguuagaaucaaaaaacugugucuugaaacagcuccuuuaggcaguuugggaaaugaagagucagucuguauuugcuugcaucucagauccuuccauacuagggccuaucuguuguccauauguucagagcuuguguuacggggcauccgcaggcguguguggaguggggaccuugguucuugcuaagucucaggcugauccagcaggcacacuggucagcaucuuucccucaggcaagccuggaaaaguacugccagagccugcaaagucuugguuguaauuuggaguauugaugcugcuauaauuguguucuuuucacuuauaaaacuuaaucacagccuggcagugguggcacacaccuuuaguuccauuacuugggaagcagaggcagguggaucucugugaguuugaagccgggcuggucuauagaguuaguuccaggacagugaaggcuauacaaagaaacccugucucuaaaaaccaagaacuaaaacaaaacaaacaaaaaaaaccaaacagacaaaaaacucaaaccuaccuuaaucacauuuaauucuguaauuuuucaauguuuuugccaauuguuuuaauuuucucuuucuaaagggauuuugcuguggggaucuguaacaaaaucagugaaaugauucaagguauguauauuuuauuugauaauguaaagaggcuuacuaggaaucuuguuaauaauguuugcuccugauuauuagguauauacugugugcuagucauuauuuaaaacaauacuaaguauguucuguaugccaaaaaugccugagguacuuagaguauagaaauaaagcaagacccuuacugucauguaaccuaaguucuagucuagugagcuguagacagaugcagacaggauguagcaagugcugcagagaaauuggcagggagagucccaagcaugggugacaugguggagggcaggaggacuugugcuuuaccugaguugaugacagagcccuaaugaagcgacgucaaggaaggaaaagauguggccugcagagaggggagcaguaccaguacaagcuuuucgggucuaucugauagcauccauccaggacuuuccccuugcaacuaagaucaggccccaaucguguaccaugaccccauguuauccucauagugucucuuaauaggcagcucuggcuuuagccuugugcaguucgcaggaacacugcucccucuucccucugaaaaggucuugcugugcugugcagcugggugauggacaaaugagauggaaugaggcaaugaacucaagccauuuggucuugagacuucagcuuuuaggcccugugcuguuugccucucuagauaggauauuuuuuauguaauuuaaauguaaagagaauuugcucacucagagaacaagagacaaaugcaauuuuagccugcucucuuuuauuacuuuuucuuuuucuuucuuuuuuuuuucccccuuguaccaaaauugguguuccagugaggcuagcuuugugacauuaugaagaaaaucacccauucacugagcagguuuuuguguuacugguuuuuguugguguuguugguuuuuaauuuuauuuugugcguaagcguguuuugccugcauguguguuuaugcaccaugugaagccugaugcccaggaaugucagagagggcgugagauccuguggagcuagaaguagagaagguuguaaaccaugauguggauagugggcagcaaacccaugucaucuagaagagcaaccacugcucguaacaguugagccaucuuuccagcccccugagcagguauuuauuaaaugccugcugcguuacauaugauaccaucuuuuguuaagauaaucuaaggggcauuuuauaaaggaaucauuuaaaaaaggauagguaacacaugcuacgggcugauguaucccaagcucccaagagcuuuucuagcccucaggaaggaagcagcagaacccucgugcugccccuacugugccuuuaaaagccgugugcuggacaugguggugcccgucuuugaucccagugcuugggaggcaguggcuggcagagcucuaugauuucaagaccaaccugcucuauagcaaguuccagguccgccagggcuauguagagagacccaagcaguuuuuacuaccauacuuucugauaaaucuacugaauuuguugguuaguucugguauaauuaucuuuaauguuauaaccauuaugguauauaauacaaguuguuuguaagugaaacuuugcuaaucaaauuauaccuuucuuauuuuuuaauuaaaaacaaucugagcucucguuaauaguggugagacaccugacacacuuguugcacucaggcuuagcuacaccgguggaccugaagcugaagcugaucccgauccugcagcacaugcaccacgaugcccuccuggccuccagcgcccgccagcuccugcagcagcuggucacguccuaccccuccaccaagauggucaucgugucucugcacacuuucacucugcuggcagccuccucuuugguugacacacccaagcagguaauuccauuuucuuuaauggcuuauucuuuauaaauguacauaccuaguuugugauaaaaaaauaaacaacccuaagucuuaauaaugcuaaggagucuuugacaagggucaguuagcuuucucuuuuacacauucauccucucucucucucucucccucucucucucucucucucacacacacucucugucucucucucucucauacuugugagcucuggaggacacagacauuaggaaauauguagaaggauauguuguugguagguaggaaagaaaugauagaguaucauaacugccagguccucugcuggaaucugacaaguuacacaguaccauuuguguauaaggagaaagagguccaagccugagucuguagcugcuagugagagcucugagcuacagggaguccauucuguauucuaagagucucccuaaguagcauagcacuggccucuauugacaguuucaggcacggacuuauucacagaaugacuuugcugucucuguagauucagcuucugcugcaguauuugaagaaugaccccaggaaagccgugaagagacuugcuguucaggaucugaagcugcuugcuaguaagacaccacacacguggaguaaggagaauauucagguacaugguacuuaagaaaaagaaaugcuaaguuaccuaagccaggguggcacaguacagaugaaauuucugccuuuaauacuucacagugaggcaacugaaaccccccagagaugaacucaaaccagagugacaucccuguaaagcuuggucuugccauguagaguuuaguuccucugucaucaggcaguugucuugcuuauuugauaucugaaugugauguguucccaugagugcagaugacauucaaggccaggaggcaccagauacuucuggagcuggacugaaaggaaguugugagccacccaguguuuagaaccaaacacagguccucugcagguuacucuugacuauugauccaucacuguagccccugccuccucccaccccaugauacauguguuuuuaaaaaagaaaauaauaaugguagcucuaagacaguaguucucaacgugugggucaugacuccuuuggaggucaaacaccuuuucauaggguucaccuacgaccauuggauuucuacaauacgauucauacauagcaauagcaaaaaauacaguuaucaagaacaauaaaaauaaucguaugcuuggagguuacuauaacaugaggaaauguauucaaagggucgcaauguuaggaagauugagaaccucuggucugaaauuuuuuugccauuagaauucauaguggaguugccauuaggaauucauaaucugucugggcgugguggugcacgccuuuaaucccagcacucgggaggcagaggcagguggauuucugaguucgaggccagccuggucuacagagugaguuccaggacagucagggcgauacagagaaacccugucucaaaacaaaacaaaacaaaacaaaacaaaaaaaacccucauaaucuggagucucauuuccugaaggggagaagaggaguuuggucuauucuggauauaacguggccagugugaccaugaacgcaacagcuugguuccuugaacaagagcugcacaaauaauaggaugugaaagugggaaggggacagguuagagaagggguuggaagggauaggugggcauacaagagggugacaggugaguguguucauacaguacuguguacacaagagggugaacgggugagcauccuacugcauuguguacacgagagaguaacaggugugcauguucacacuguauuguguauauaagaggguaauggcugcguauguucauaauguuuuauguguacauaugaaauuaucaaacauuaaaagaaaagaaaaaacucaaggagaaugcccagaugugguguaugccuacaauuccagauaggaagcagguggauuagcuuuggcuacacaguuugcaaccaggcugggcuguaugggagaaaaggcauccacuuggagaaauuaaggucaucuaugucuggagaccagagggcugacauuacagauuuuagcgucaccaguguguacauguguguaaauccucaggccuggaugagugcuggggauagaacaugacagaacaguauagugagggacaccagcugaagagcagauaggaguagcucuggacacuugaguggugagagauuguaaagccgaucuuccgagccuuaucucugucauggaucuguggcuggauaaaugcauaauuaugugaagcuucucagguucacaaugucuguccuaacugaauggucauugaaauguaugggccuugggucugacuaugguuuuaugugaaaggucuuuguaaugaauaauuaauagauuacacucaccgugagauccuguugcucuggccuguuggcugagaagaagaguguagucagcugcaugcuuuaccaaugauaugcaccuguuugucugugugggugggcggggcugcaugugcaauuguggcggucaaaggaugguaagugacuuaugggaguugguucuccguccaucgcgaggcugccagggauugaacuccacucaucaggauugauggcgagugucuuuaaccuuuaagcaucucuucagcucuguuuguuuauuuguguuaggaaagaauagugacuguggauaagagugagagagaagagguuuguagaagcaggaacacucgguauacucagaggcagaggguugccaggaguugauagauuugaaggcagcagugugugaugucugacaaauguuuuuaaaguugccugaaaagcuacaugauggguaagguaacuuuggaccuuucccuuuccuggacuucaguagauuucagaacuggagcuacaacgucauaauaaaaugaacuggguguuuuuucucuuccuggucuguagcacuuagaaacagucacagaaguuuuguuuccugagggcacagcuaucgugcuauacugagucugagacuuucuccaggaaguguucugagaacacuuccuguuauuguggucaucacgugacauugucugccucuuugugagucaguuggauguucgugacaugagagucaucuuucuucaaguugaugauguuucaguuuacaauacauuugcuauccuaauaguguaggucucucuugugugcccuccgaugccugcuuucuuucugguugguuuguuuugacggugcugggcuuggauucagcacacaccccagugcccugcauugugcuccuugcaaucugcacuuacuggaacuuggguuuguuuguuugggguuuuuuggugcuuucaaguguuuucuuuccugcuuaauaaugaaaacucuuaaagcuacuaauuuccaauuucacagauuggcuauagcccauaaauuaugauguauaauguuauugccauuaauuugaaaugcauuuuuaaaagacuuauuguauaacuuaucuauagaagcuuucuggguucaguuugauggcuuuuuauacacucguuucucuaaucacugccacaagcugagauauaggauauuuucuucauccuaaaacuuccucagugucuaaccagucugucuucaacugcugauaauaccuaacuuguuuucugccccucuaauuguguuguaugggacugaaaagauagcucugugcauaaacgcagcugccuugcaagccugaugauuuuguuuuauagacuauggaugcaggauauuugaucacacugugaacccugagacuguuacuuacuggaaaaagcuguuucuaguugugguguggcucagccuuaggacgcagcuuucgucccucuggcuggaauacagacacccaccccuacugugugcucaccucaaacugugucccucucccacuaacagcucuuugcuccaucuuccugcuccugugcccauucuugcaacaacugcugcucuuaaugcaguuguuuaaguggguuuuucuuuugauugaaaauagauccacaaggauaguaauuucucagaguuuaagcuggacagugagugaagcacacaucucuuugugcuuccccugaguuuccugugcagaagugacgacuauaaaugcaaaagucuccaucuacauguaaggagugcgugccugccuuuccccguaaaaaugagaauauuguaugugcacucaaaagcuuuggucacauaacaguccaccuuggagaacauuccuguuagcagacagugauguguucuuccuggcuuuacuguguucccuuugaguuccaucucacuggggggagguagcaucaucuccaggaccuguaagaguuuaucacagucgcuuugugagcacgaguuucuagcagagggaucagguaggcccaguaauaauauguauuuaauaccuuuaauuugaaaacugugggagauuuuaaauaccugaauuuaauagguucuuauaaagugugucuauaccgacuuuuauuugauuuugcuuguuagcaagaaccuccuguguucuuccuggcuaguugcugaucuuaugugaugcaguucugucaguuggcuuaauacuuuugaguauuaaguauugagucuuaauacuuuuuagaguuguauuuuuuuuauauaagaauaagaaaagagacagauuuaauuuuauuuuauccaguuggguuuuuuuugaguuuauuaagugauucauccaauuugaaaugucauuagcauuuuaaaagccugguacauauuugcaucucgucuauuucuugccugaacuuuucugagcuaaaaaaaaaaaaaagacccauggguguggugguccaugucuuuaauccuagaacucaggaugcagaagcaggcagaucucugugaguucaaagcuauccuguucuaccuagugagaucuauaauagccaggacuauguagagcaaaccuguauccaaaaaauaauauaauauuuguaauuagauguucuaaaucacaucucucccuaaauccuguuaaugguuuuauugggaucugacuauauuuaugauuucccaaauuuuaauuuuaguuuuauuuuaauuuuuucuuuuaguaaguuuaauucaguaagacaguuguccugucucagaaugaaguagagucauugugcucugaguacauguuccaaguucacugcagugaaaaacaagacguguauaguguuuagucccuccggcugcugcugucagugguacagugacccaacagccagaggccagcaaguuuuccauguacugaauacccagccccccuuuauugguaguucacauuagcucaccacaguuguuauaaggggccagggugggguaggagucagaacucaguacacuugagauacccugagagcuggagagauggcucagcgcugacugcucuucuagagauccugaguucaacucccagcaaccacauauaauaauggcgccucacaaccaucuguaaugggaucugaugcccucuucuuuugugucugaagucagcuacaguguacucauauaaauaaaauaaaucuuaaaaaaaaaaaaacuggaaaaauguaguaagaaagcccuugcugccacacuguguguuuccucuggguugcuuugguuuuuacccaugcccuuuuuucuguucuaggacaccacauuauaucuggcuaugucuuuauaggcuccuuuaaggacucugauaaugugaccuguuuuguucuuuaucguugaaaaaauaucuuaaaguuuuaguuuuggguuuuuuuuaaagcuaauaaacagauaaauuggauaguauggaaguguauauguuuugauguguucuaugucuaucucucugcauuucaggcacucugugagugugcacugcacacuccuuaugacagcuugaaacucgggauguugucuguccucucuacgcugucaggaaccauugccauuaaacauuacuucaguguaguucccgguaaggcaaagacacauaacuccugggacgagcuugcuuauccaguagacuuaaggcuaaaggguuuuuuguuuguuuuuaaugaaaguuuuguugcauuucuguuacuuccuuuuccuaucacuuaauuugaauuaaauaacucuaauguacuuuguucuucucaugaccacauggcuugaguuuauugggugaauucccugccacaugucuugauaggaacuagaaagcaugaugucucuguugcccucuugauauucuacgucucucuugcugugaguguccauacguggaccggacuaaugguugccaugacagaaugaauugggagccacaaauguggagaagugggagaugaugcacuguggcaauagaacagugacugugagacauucagucucaggaaagcacugccauggaggcugugucacagcuggucacuguggugugugugcacugugaccuagaaccaguaaugaggccacaguguguuuaguagauggguuugggggcuuugaucuuagcuguucuguggccucuccuuccauauuuaguguuguagacuuucuaguaauccugugagccacuuacuauuuuauauaaugaggugugcaacauuuugugucuuaaaacuuacuguuuucuuugcucucgcucaucauucagcaguuugaauugcauucugaugauaguucugguguccccagagguugcucaugacuguaguucucuggagccuuggccgaaacuggauagucaaaggucacccuuuucauaguguagaacagugugguucucaaccucuggaucauaaccuauuuagggggucacauaugagaacuuacacuacaauucauagcaguaacaaaguuacaguucugaaguagcaacaaaauaauagugugguuggggucaccuaagauauauauacacacauacauacauacauacauacauacauacauacauaaaaaauauagccuaaggagcuggauuaguggguaaaagcauggcaucggccaguaucuacauauacuggugguguauaaaauuucagauuauauuaguauacauaaauggagguaaaguuacacaaagaauauuucaaaaagucagcaauaaauuuaugcugguuugugagauuugaagaaauuucuauuuccuuuggacuuuucugcuccuucccaacaaguuuucuaauaguaaauauuaauaggggaaaauuaucaaguuauaaaacaucaugggaagaagaaaaagaauggcuguacccuaggaguuuauuuucuacaauucugaaagaacuggcuauguaguuucagcuuuguaauauauuauccaucuuaaaacaagaauuuuaccuaacugguauugucacaucuuacccggaaucaguaaaugguuauauagauuacacugucuaaaacugucuuggcucauggcugauguaauuuucaaccauguugacuucaugcucaagaguuaagguccuccaguaggagagacgggucagacuggacaacagucauaagaggaauauaaaaggccaagcucugauucuucaugaggcucacauauuuacaaccaagagcugcucuccuauaaacuaaaauauccacagcauaggacuuauggcacagccuuggaaaucugaguuuuaagagaugcuacagaagagugcuguguaguuaacgagucuauggccgugauggugggcuacuggaugccuuuguaccguuuaauagaguggagucacugagucgcaguauccuugacagcucugugguucuggauucuuuuuuuuuuuuuuaagauuuauuuauuuauuauauguaaguacacuguagcuguccucagacacuccagaagagggcaucagauuucguuacggaugguugugagccaccaugugguugcugggauuugaacuggggaccuucggaagagcaaucggcacucuuaaccacugggccaucucgccagccgggucguggauucuuaugugaaccuuuugagguauaacaucaacaauuuggggcaggaagaagcaagcaaaguguucuuccuugaccuugcuuuaucugacaagaagauggcauugggucacccauuuggcuggaaauccaucagcuccucagaugcagccuauagucauuuugguuucuauacuguuucagucaauugucacuaauguuuuuauggggaaaguccuauauugauuuuaaaaugcagucauugaaaaauggauggcauacuccgauuuuaccccaaucaaggaaggauaaaugguggugguauauuacuaauggagucaagguagaaaacacuuuuaauguauuagaaauuuccucauaauacugagaaaacugaaccuccaagcugaauugcuuucuugaaccguaugaaugaguuguaaucugaguuacucuucucugcuucuuuaggaaauguaggcucuucccccagaucuucugauuuagucaaauuagcucaagaaugcuguuaccauagcaacaggggcaucgcagcucauggagugagagugcuaacuaauauaacagugucuugucaagaaaaagguaagugcacucaggacgggcuugugugcugcucugcagcuuggacagagcucuguggguugggcccuuuagucauuagcauaugugcacuggucugcaugcacuugcauccaucuauaauguucugaugcagugucuuaggucugucuaauuuguguggagcccuuaggucugcgauuauggagucgacaugucuuguaggacauugccuguuuucgucccucuguucacugugcuguguguggugcuggagacagggacagucuacauaagauucagcuguacaacaacuggaaaauuacucagauuuucuagguacuuaaguauuaaauaguaagugccuucacuuaguggcaguugagcugacaggaacaugauuggauuuucauagaacccaucucaaggugcaugcaacauugagcugauuuacacaaacaaggaggauauauuuuauuaucuuccugauaucuuguaaguguaaggcuggaaauguuccaugccuccacucaagauuaggaaguccauuggacgguaucugccucugugaucacgauggccuuuaugggggccacaagcucagcaguccuccuacccacagcacagugugcuuccuguccccguauuuauucacacuguuugccaaggcccuacaguaauuugggaaacauucucccaguggacauuagauugauuugacuauuugaguaaaaagcauuucuugcaugugauauaagaaacagcugcauggucucagugaccuaaguucccugugacaucacagccucggggacccacaggcauuuggcaguacaguguuauagcugcaggacauacccagagcuuucuucuuagggccaguacuuugcaagagaggcugacuuucauaagaaucuaaaggguauuggacuaacugaaaauauaccuacaugguuuaugucugaugggacacaguuuucuuagcuguccugguagugauaauuucaguuucucuuuauagcuucaugaccucauugauuuaauaugaauacuuuauaucuuuaauaaugugguaguguuaaggaagguaucugaagauagccuuuauauuucagaaacaauuuuuagaugugaugugucuuucuguuugugccuuuguguguugucugucgucugaccacccagccuaauguuuuuuuccagaucucuugucacuggagcaagaugcugucuucggccuggaaucccuucuggugcuuuguagucaagaugacaguccaggugcucaauccacugugaaggugaagaugacaucacucaauacacugccucuuuccauagccuaaauuguggaguaaucccuagggugcaggccaucuacucugucauagcuccucaguuauaccauuuuaaggcggaagcagccaugcaugaaauguggcgguuagaggggagggcaugacuucacuagcucuggguagucggcuagauuuccagugcuaggcaugauuucucccguguugagaaagucucauguccaagucgagagcuguugguuacugaaagggcgugugcaucaccacugcacuucuagguuuauuguaccauguuguccauagguguuaaguaggacucuugauugcuucuguccuuuggaagcuugucugguaccucugguacaaugugaaggcuaguccucaggaggaggcucucaggucaguuccagaacaggagccucugugcccuguuucugaagaugccaacaauuacagauuuuaauaagauuuuggacuuaguauagugggcuguacauagaggaucaggaagguuccaggguuagaggcuccuccauguguaguaggaugugccauucauauugaaaggacugcaucgagugacuagugagagggaaaguauggaggccaucagauguguuaaagaaugcggacuugacuuuauagggagugaggagacauuagaauuuuaggauaguggagacagucuugccuuuguuguaguuauguuuguguagugugugcccaacuguugaagacguguauauauauuucaacuuguugaaagccaccuagcugaugugggcuccagcuaagguccacuuuguguucauugcgugugccucucagcacacuggcagcuuaugugguuguaguacgaaggaaagacagaugggcccaucuuuuccugagauuagaacuagugggacguuugugguguuguagaagaaugggagggagaauuuuagaaacauaaaucagugguggaaagugagaggcauccauguuuuuaguuuuguuagcuaggauaacacauaggucauaaaguaggcccaacagagaaaaucugcagcugucagcucuuaacuuucagcugagcaauaaauaagagaaaauuagaagcgucuucccauacugaugcucacaaagucauugagggcgucugaaaccaagucaucaguaaaccgaacaugcaugugcuaugcggagcaguggccucauaaacauucuagcguccgucaccauccugaguucugcugugggugguuuccgagcacucugcagaagcagguccugggaagugcuguagcucugccuccuuaggguuagccucaugauuuucaucugccuauugaaauucuggacauguuuuaagcauagcacacuucacuggugugggauucagaauccuguguugcuuauggagaaaaauggugaaccuacaaagaacgugcccgugaguccccauaacuuaaacaaggugcucuuuaaaguguagcagugcacucucccucuugccccuuugcaguacuggggacugaagcgagagccucagugcaggcucggcaguccuccacucagggguaaccaggcuguucucucugcagagugcucucagcuguauggugaagcuggccaagggccggccccaucugagcaggucagugguugacacucugcuaacucagcugcacagcucucaggaugcugcccggauccucaugugccacugccuggcagccauugccaugcagcucccgguacugggcgauggaaugcuuggggaccucguggagcucuacaaggugauuggacgaucagccacagacaagcaacaggaacuucugguaaggaacugcuuuuuccugcuguaaaugacuaggaacuagucuguuggcagauaccuaagaaugccagcacuaauguuggacuuuauuugaaaagcaaacagguuaacguaauucugcaggacuggggauauagugcaauguacaguguuugcccaacauguagaacacccuagcuuucaucacaguacuacaaaaaauauuuaaaauuaaggcaguaccaguaacuuuuguuguuuucuuuugagacagagugugacuguguagugcaggugugccuugaacucagggcaguacucuugucuugaacucacaagcacuggcugggauuacagucgugagucuuuguucccagcuaccaggagcuuuuucuaaaaguuaaaccucuuaggaaucugauaaaaaugcugaacuagaagccauaacauacacacaaaggaucuagugcagaaccuuagccgugcacacccuugcgagcugccuuggacccugaauucaugugugcuuugaucauauuggucuagacaaccuuuuuuuccuugcuguccuccaucccucuggcucuuacauucuuucugucuccucuucugaggguucucugagacauaaagggagggauuugauggaaacacucuguuuagagcuggauauuucaaagucuuuggcuugcuguauaguaugucagccagguuuguuuuuuauugaaguggcauuugagcuagugaucucuguccuuuuuuauuagcacuacuaaagccaauuuuaaaaagaaaacacgagggguuuuuuguuuuuaaucuaagaaagaauacaguaaaauguuugcaucugacuuugcugaaggaaacaaugcuagcccgggcauugugaugcaugccuuucauccagcacuagggaugcagagcgaaggcauccuggucaacauggugaguuguaggucagcuggacccagucucaaaaaagaugagaacaguguuagguauagaguuaaaucuaccccagcucugcuccacccugucugcagcuucaggaaggagugguauugagcucacagucugagagggcucuguccagcauggcggggagggcguggccaccggagccucacaggguggccauaucacaugaugccaggaagcagagaaugaugagcaccccguguguaaucuuugucaucgguccaggguuucagccacggcaugugcugucccugcugaggauaagucaucccaccuuggugaaacucuggagaaaccugaggugugagcccaugauguccuaauuaggguguuaguuacugggaugaagugucaagaccagaaagccaguuggggaggaaaggguugguuuggcuuacacuuccacauugcuauucaucauugaaggaaaucaggguggggacucaagccagguaggaaccuggagacaggagcuggugcagagaccauggagggaugcugcuuacuggcuuguuccucauggcuugcucagccugcuuucuuauagaacgcaggaccaacaucccagggauggcauuaccacaaugggcugggcccuuccucauuaaucacuaauuaagaaaaaaauuacccuacagguaugucuacaaccugaucuuacagagguucccucuucucaaaugacuuuaaccuaacacagcuauccagcauacaugguaauuuuaaauccagucaaauugaaagugaaggugaaccaucacacucccuauguuaacuccuccuccugucuuuccucugugcacugcacuugcacuugggugaccucagcauaugcauugcuuugcaugucuuagcuuugugcagagguuaugcugccagucaacuuucaccguuugccuuccuugcuaguaauuuauauugaucucuggguuuauuucacugauggauuucacugggugacuauaucauaauucauuuuuccuuaauugugagccuuuuucuccuaguuacuuuauaagcagugcucugaguaaaaggaauacauugcuuaaugacuuaaacaugauaaaugaaauaucaacagaagguaaguccacuuuguuccuuuguaucguacuuagcuauuuggugugaugugcauaagcgcaugaggaggucuggggacaacuucccuuucacuguggaaggcugagguauugaaccgaggucaucaggcuuggcagcagccauguuuaccugaugagccgucucaguggcccuaaauucucuucuguuuugcugaucuuuaauuuuugucuuugucuuugaauaaaauuacgugucuuuuuuacuuguuuucuguuagguaaguuuggcuacugugauuuucguagccagccagaaagcauugucugcagaagugaaggcgguaaucaagcagcagcuugaaagcgucuccaguggguggaccguguaccggauugccaggcaggcuuccagaaugguaugggcuucccuauugaguggagguguuuggugggauguuagaacaugcacuauaagugauguggucauuuuuauagucagaacucaaaguauauauggaaguugucuuagucagcguucucuugcugugaagaggcgucuuggccaaggcugcucuuguaagagaaaagcauuuagcuggggcuggcucacaguuucagaggguuagucugaucauggugggaggugugguuaugaccaggaggugcuggagaaguaccugcgagugugauccugauccauaggugucagacagagacgcugagccuagcuugacuuuugaaaccucauaucccaagcccaggcacacaucuacugcagcaaagccacaccuccuaaucccuguaaucucuucagacagcuccacucccugaggaccgagcauucaaaccugccccauggggccauucucaagacuugcuuguuacuuaggcucucugaggauggcaaaggcacuguccuaacuuaacuuuccucauaagcuguaguaaguguauaaguaggugacggcgcacacuguguccguacguuguuagcaacacguacacuuugcuauagguugugguaucaggaccucuucccaccugcuguuucugucauuauuuaucagcacauauuuucuucucauucuuucuccaaccuuaucauuggauuucuuuaagaaauacaaagcauggggcuggagagauggcuuagugguuaagagcacugacugcucuuccgaagguucugaguucaaaucccagcaaccacaugguggcucacaaccauccguaaugagaucugacucccuccucuggagugucugaagacagcuacacuguacuucuauauaauaaaaauaaauaaaucuuuaaaaaaaaaaaaaaaaaaaaagaaauacaaagcauaauuaguccagagaccagaguguggggcacggcucugguggucagagcaggagcauagacugcaaugcugacuguaagggcgugccgggaucuugggcaucugugccucuaagguccugagugccauucaccuucugccuccuaaauagcuccugaaaaaugacacacagguacuuuuuguauuuuacacuaaaauucuagacuugaguuacaauucacuccaguuauuuucccacuggggcuuuuaguuuuaguaaagaacuugaggcauuguguuauauaaaaagcagcucggcauuuuuuuuucugaagaaguagacugucuuaaggaguuauguaauaugagaugugauuuuugagcuuauucuggguuucucuuuuacuugcugaauguagagccucacccuggccucuuuuuuuguuagggcaaccacgacauggcucgagagcuuuaccagaguuugcugacgcagguugcaucagaacacuucuacuucuggcugaacagucugaaggaguucucccaugcggagcagugucugacugggcugcaggaggauagcuucagcucagcacuuuccugcauugcugagucuuugaaguucuaccacaaagggaucgccucccuaacggugaguccucuccccggucguggugacugggguaggaugcucgucucucugccuuggcuuaucuauccucuuuugacaacuugugaaaccugguggcaauaucagaaaauacauauacacagaaauaaaacucuuguuaguauucuuaguuggugaaaacuucuuuuauaccacauguacagaaaauugcugacuugaggcagaaugguaagugcuguggagagaggcuccuuccuccacguucuuaaucaguaagacucuagccugcugccauccaucccaucaccaagcacgccccauccuccucucuucugucugacugcucaccaaguagaggguuuuguaggguguuuguaauguuuggaacauuugugugugguaauccguucuccggugcccucccccaccccucucucugcagugauaaugucuaagccuccugugcugucuuaggaaugacugagcaaguaacaugcuaaguuuaggcagcaaugagccucugaaugucagugagauguucaggugucaggcgaugcuacccguagugaguuucucgacguuguuacaucugucacacgguagcuuagguauuuaccuaucggguuauuaugacuugugcauaaacugacgcaugcaguccucccauggcuuccgggaagguggauuccaacgcacucacguaggcacggauguccaaauccuuguauguucaagacccccauuaaaaagaaaggugcagccuuuacaugcgcuccaugaacacgccucuugugcuucagaucaucuccaggcaccuuguaaugcuguguugugcuagcauccuccugugcucugugaggaagagauaggaaacguuagucugcgcaugugcguuccauccuagugcacuuccucccugagcauugggaacgaggcgcugacacugcaugaagccccucucucuaucccaggccgccagcacaccgcugaauccuuugagcuuucagugugaguuuguaaagcuccggaucgaucuccuccaagccuucucgcagcucauuugcacguguaacagccugaagacaagcccucccccugccaucgccaccaccaucgccaugaccuuaggaaacgaucuucagaggugcggccggaucuccaaucaggcaugucuucuuuucucuccauuuuacaugauauuuauacuucagagauucuugaagaugaaagguuauacaaauuaaagucaaugguaugugucaaguacucacucucaauguuuggccggauaggaugguguguucuuuaaacaaucccagugcuguguguuguacaggaagaguggaauuacguuaaagaguugggaauaucuacaaaaguacuaguuauccuauugaagcucgaagaaaggaaaaugcaagugucuugucucuagaugucauaaguaaauauacccugugaacacuuagaacuucauuagccgucuuugucgauuuuguguaauaaaguuauggaaaugacaacucaauuuuuauuugaacuguuuucaaggaugaauuuucugugcuuuaauuuguuuuuccccuucuuuguagaugaagcaguccauggaagaauuccgaagccuugcuucccgguacagagaucucuaucaggcauccuuugaugcagauucggccacucugaggaauguagaacuguauccuauauuucuuaagauuccuuguucuugggaaguauucucugaaauguacaguaaauuugcucaacuaaaaauggaauagauaauccuaauauuuauuacaauuaacuaguaauuucuuccuuugaaauugaguaggaguaaaauaacuuuacucuugaacuuuuuguuuuguuguguuguguuuuuuuuuaaguuuuuaaggcuuucucugugcagcccuggcuguccuggaacucacucuguagaccaggcuggccucaaacucagagaucugcuuauauucugccuccugagugcugaggucaaaggugugcacugccacugcuuggcuaagcuuacucuuaaacuuaagccaaucuuuuuuaaagggaugacuuccugguggucuugucuaccuuagagaagaacugccacagccccuaguucuacccagggcaaugauacaaaccugucauccccaguaccaaggagacugacacaugaggcaggagaugggagccagcuggaaacacagcaaggcucccuuaaacagccacagcacagcacacugguuccaucuccuuuguccuuuguuguggucacugcuacaucuguucccucaacucccgaagccauccauauuuucuuauuagcaauuucugaucucauuggaaagaagggaaaaaagaaacuguugugaaguugucaggcuuaugaguuaguucuuagaguuuuuauugauugauugauugauugauugauugauugauugauuggaacguaaugaaugcucuguaacaaaaguguguaguggucuuucuguucuugugugugacuuaacacuguuguagccagcagcagagcugcuuacugauagcucaugccauagaagcccugguuuuggauccugaaucagcaagguaaguuggaugaugcugccuuauauaaugucgggugcauuguuacgggaccaacgaucgcaccaggguuugaggaagaggggaaaggaaagcugcuggggagaccugagauugcauugcaugcaagccuugccguaccacuuugccaguucaguguuugagagcucagccuugcacgguagaaagucagucucagccaaacagauauuuuucuuccacauaguguguccauuguaauaguuuuauuucuugucuuaaugacauuuaaaguguuuuacagagcccuggagucaggcagauaugaccacagaugucuuuucacugcuagcucagggaguauauuuguucucacuaaggcauggguacguaagcugcaggcacaacuccuucugcccaggcagcggagauagaaugagcagaugacacguagugccucacugaaagguuuaaaggacuuuuagcacguaugugccugguguggauugccugcacugcacacacuuccaguguguuuaggacugcagaguuuugucuuaucucugucagaaauguuuucagagaaggugacaggaaggaaucuaggcuaagcuuuccuagcucugucccagcagcucccgcuccguccagugcuuuuuuucacuuccaggcuuuccguucauagcauuucuucagccauccccaggucuaauggcaugcugaccaagugauuugcuaaccugcucccuguguuccaucuguuacuuauaugaugucauaucaguauguuaccugcuggcccuuucucaagugucuuuccuguauggugacaaauagccuucaugugaauagcuaagaauuaugucauuuguagucagauuuggguuugaguuacaacuugugacuuaauaguuacacaaguguagucagauuaaucuuaacaagccucaguuuccuuaucuguaauuggaaauaacuucauuuuuuaaaagaugaggugagaaugugagccaugguuagcaaaugcauggaggugaugaaggugcuaggauggaugaacugcuggucucugcucagcuuccaggaguauggguccacgggcgcugcccacgccgacagugaguaugagagaagaaugauguccguguacagucgcguccuagaggagguggagucgcuuaaccggaaguaugccccaguuuccuacauggcaaguggcauuuguuugcuaaguuuuuauaauuuauuauuaggacuucauuguaaagaacauacaaauuagaaauaucacacaaaagccgggcgugguggcgcacuccuuuaaucccagcacuugggaggcagaggcaggcagauuucugaguucaaggccggccuggucuacaaagugaguuccaggacagccagggcuacacagagaaacccugucucgaaaaaaaccagagaaaaaaaaaaucacacaaauguagccagccucucucagccugccagcacuaaaauaaugacacagggaccucuucuuauuccugaaagcuuaggccuauagcuuaggcuuguccucugcuaguuuguauaaguuaauuaacuccacguuugccacguggccggucaccucgaauucacucuugggacuuccucgggucuggcugcgagucucaccccucucaaguccucccacaguuccgaucucugccuggauguccugaauuuccucuccugccucagcuacagacugccagcucuuucuuaaaccaaucagaaagugauggagaagaaaguuuacaaaagaugaugcccuugcugagcaauuaaaauaacaauaccaaaguccuggcaguacucuacucucugccggcacagaaaucaccauuguauaauacaaggacaaccuucccuccaccccacgcucuauaauaccgucaguagacuucugcacaguuagggucaccagccucuccguuuaccuuuucacuaugcauuuauccaccagaauacccaugaaaggauuaaacaaccccguccauggcagcacuuagcccauccugacggcauggccucucucacauaucaagucucacuuccccagguacaggcagcuuuuaucagguccaccuuguguaggugcagagccaacuucuuuauuguaugcuucuuaagcaaucaaacugaagcugcaguaguuccuuacucuaacuccaaacuagagucacuuugggagcuuuuuaaaagccacaucaguauccagucaucccucccaacugccuccaaagacaguugucucuaagucuggaacaggccuggcccacagugauaccaggaauaagaguagaagccggccacucguacacuggauccagcauuagagguuucagccacaugaguucaaauuacuggagugucuagggcacuuuuaaggcaguguucaguauacuuaaacauguugaaugcauuauaggcuuacaauaugugugauggguuuaaucacagcauaauccugccauuagacaaggacagcauuuuuuuagaagcauucaugugauucuaucaugcugccaagguuaaaaacacagaauauaaauuuaguaaauaacucuaauuuuuuaaaaaccaaaaaauuaagaaaauaaaauaaggcagaggcaggcggauuucugaguucaaucaaggccagccuggucuacagagugagacccgggacaaccagggcuacacagagaaacccugucucgaaaaaaaccaaaaaaauaaaguagaaaucugauugcaauuuuuaggugggggugugugauuugagacaggguuucucaguauagccuugauaauccuggcauuugcucuguaaaccaagcugggcucaaacucagagaucugucugucuccugaguguuggguuuaaaggugccacuaccagacaaauuugguuuuuuaauuaauuauuuaauuuuuuauguaugagugcucuguugcauguacauccaucugcaugccagaagaggacauaagaucccuuuaugaaugguuaugagccaccaugugggugcugggaauugaaccuggguccucuggaacagcagccccacugggaugacuguucugugcacguguggauguugugccuucugccaagugccaugggcucuuggaagcauuuguuggcgguuuucucagcugacuucucucucccacagcacacagcaugccucugcaaugccaucaucgcucugcugaaaguuccucuuucauuucagagauacuuuuuccagaaacuacagucuaccagcaucaagguaagguagaaaaaacacuuuuaagauuaagauauaaaaaccagcuaaguggggcuggagagauugaauaauagcaccugacacaaguucaaucccaaaauccauaugguagaagagaaugauuccuacagcuugucgucugaccuccuacaugugccauagcgagugcaugcccacgcacgcgcgcacaacacacacacacacucucucucucucucucucucucucucucaaauguauuaaaaaccagcuagcuaucaucugaagauuuaaugagacauagcuacgauuuaguaucuuuccuuuagcauagauaaaaauuuaguccuaagacuuuagccccuucgucugaugauuugaggaagucgugggguuggaaaguuacugugauaagaccugcauuugaguaauggcagccuaucuaccucuuaaccuccaggaaggagugcuuguaagcuuauuggcaggguugagucuuugucugagcaggcccagcuuugauggaauggccugcuucaguaucacggguccugcuucccaaguccuguugccacugaagggcaagcauggggaacuaacucacagggagaguuaguauauugaagugcuuaagccacucaaaauuaaaagcuauuuuuaauuccgacagcagaaugugaaaggagauuguuagcugagagagacggcuugaauucugccugucagaauguguccagugaacuuugcagccaguuaaugcuuuugguugcaacuaacguuccaaaaagaccuuaauaacaggaaaggugauugauggguggauaagugagcaggccuaaggcaggcugucugcacauugcugacaaguuccaaggcucagugacgucacauugcagcgugagcuuucugcaguugagaugcagcugacuuuaaucccagcacucgggaggcagaggcagguggaucucugaguucgaggccagccuggucuacagagugaguuccaggacagcauuugcagugcuuuauuuuuuucccuuuaagaaaaacuaaguuuaaaagcaaccuggaggcccuaggaucaauccuaacaccccaauuuguuuuguguucauuguggaaacugacuuuuuaaaauaccaaauaacuccauuaaugugaguuaucuuagaauuuuaaguuuguuugcauuuuaauuuagucuauuuuaaauuacuuaagagaauuaaacaagccgggcggugauggcgcacacgccuuuaaccccggcacucgggaggcagaggcaggcggauuucugaguuucaggccagccuggucuacaaaguaaguuccaggacagucagggcuacacagagaaacccugucucgaaaaaccaaaaauaaaaaacaaaauuuaaaaguuuccuagaagcaaagcgagacccaguggacauaaacaucacgcguagcauugcaccugaggaagugguuuguuaaagccccccuacaagacccugcuggcagccagcgccuuuguuugcuacccucaaacaaaacaggugugagcgagagcccagagguguuauaaggaagcuugacauggagguccuucugcagggugguggggcacaguuaggccguggggacagucaagaguguguucaucugugaccagugaugagcguggccaggucgucagcgcuugccuuacucuucuguuccagcuugcucugucaccuucuccccggagcccugcagagcccauugcugugcagaauaaccagcagcuggcacuaaagguagaaggcguuguucagcacggaucuaaaccaggccucuuccgcagaguucagucugugugucugaauguuuccuccacacugcagaguaaaucuggccaagacuacaagguaaauaucagggggcgucauaacuuaacaacacggcuggggcuuggggagacuuaaucgcuuucuuuuuucuuugcuugaaccaguuaguggacacagcaucaaagcagagaucaaaacaugaauucugugucucuuagugcaguauggaaccuaucugagguccacacggcgagaacuuucugaucuugugcuucugaucagguuuccuacccuaccuagucccaugcaacuaaagagccuggcccugugcuccaaagggaagaaaacaaggccacucaccuccucaugccugcuucuugcucugaaaccuuguuccuaagacucuacuccucuggagccaucuugggcucugccuucuggaggagagcugccugcuguggugccuaauauacuaugcaggucacccagccccaggggaaccuugggaauuugcuuccucuagcuguccugagguagguuaaguuaacuagcaucaaugagguugauguugccauucacagucagcaucuugcauaugugccuaugagaugcccgugucucuuugcuuagacauuucuuuccaauuuuuuuguggugaucaaauccacagaauguccccaggcuagucaggugcauuugaacuaaaucuguguaacuagauggagugaagguuuaaaagggcauuucaggacugguaaaaugccuucuugcaagugugaagaccuggguuuggagccccacaacucgaauacaaagcuaacccuaggggauggggugaagacagugaguucuugacacucacugacagccacccuggccaaauaaauccacccaugagaaccaaguugacugauucacugucucaaaaauaaagguggaaagugauugaggaaaagcacccagcuuugaccucuggccuccuacucauguccucacacauacacacuugcauguccacaugcacauacccacacuagcaagcauauaaugugcacacccacgugcacacacgaacauacacgaucauuucaucaucacaguuuuagguaggaagcugaaggaggacugguguggccucugucucacuuucuucaguguuguccucucagccugcaaucugcucacuguuaaggcuuggucuccauucucuuccuuucuuuucuuugauuaaugcagcccuuagccacucuauaaauauuuguugagugauaaacggugggcugugucuagaacacucccguuauggcugggugaucucagauguugcugggaauugugaugagaauucauguggcuugucccaguuugcaggugucucccagcacccuagacuccagggccuggcuccuggagaauacugaguaagcaacucaugcugguuuaacaauucuuguguucuagauucccauugauagcaugaccaaugagauggagcagaggguugagccacauaaugauuacuucagcacccaguuccuguugaacuuugcuguccuuggaacgcacagcaucacaguggagucaucggugagagaugccaauggcaucgucuggaagacuggccccagaacuacuauguuugucaaaucccuggaagaccccuacucccagcagauucgccuacagcagcaggcccagcagccuuugcagccacagccacagccgcagccgcagccucgcagugccuacacccgguuuuagcugugcuacaagcauacuacugccacacugcacagccaucagacuacaagaagagucuuccgcaugugcauuaagugucaauguuacagugugaaauccaguauucacugauagcuguaauguaacauucuggugaaguuguuuuuguuguuguuguuguuguuuucuuaaaaauuuaguguaagaaauaaccuggcucucagccaaaauaaaagugcuuuuuuuuuuuuuuuuuuuucgagacaggguuucucuggguagcccuggcuguccuggaacucacucuguagaccaggcuagccucaaacucagaaauucaccugccucugccucccaagugcugggauuaaaggcgugcgcccaaauuucuuaaacccagucuucugucucacacuuagcauuuuuguuguauuauucuuugugguuggugagcuuuucuucuuccaagaauagucacagaucauugguaaauuugacugugucucugucuaccagaauuauugugcugacuggcccgaccugggguuuugaggcaggcagggaguacuguugagucgugcagugcuuguccugggcuggagaaugaggccuucacagaggccgcaccugccuucuggucugugggagccugugggccacaggcucagcggccugcugcauuggcaccucuuacccaccuucuguccugaagcaauguuaguuuauuguuuuggucuuugauugacccaaaaaacagcuccagcuagaaagguuggaaaugaauguguuguuuuuucugguaugugacuaguguggacuucugauauuuuuuuucuacaaauggaaugugguucacauaugucuuccuguuugauguaaagggaacagauccuuccccgcucugguuucuacuagaugacguauuacucuacaccugaugucuagacagcuaucuccgagacguaaccucagcugggaugcucagggaacagacucuggcuagccagaaaagcccuuuuucuacuugagucauggucagaaacuacaugacaacacacugauucuagguuugauuuaacaguugacuauggcugcucagugcuuuuggaccacgguuaauaugaugagcugagccugccgauacccccuguggucauugguguugggugcagugggcugcuaagggcaugagcccuggauuucccuguguaaauaaaucuccuaauuucuuugcuuguguuuuaccuuuuuuuucucuucaaagucauacugauucauaagaggacuugacuuuuuuuaaauggaguuugguuuuuguuuuuuccugucgcaucaccccagggacugagaagugaucgacaacuuggguuccccugaggucacuuugcuuugugagauguuaccucugcauagcccauucugcuugucauagucugugcaagucuacuguauccacuguaagugaccuccccccccagccaccucagugcacauggugcacagucggcacuuggucagcgucuggggacugaugccagagugcgagggaagacccgugcggagcccguguccuuugcuggauauggaaagagcugagucaauguuccacuuugggcucagcagugagucgcgugucucuguagagucagccucuuagcaaaugacugaauuaggcuaggucucuccacucuaacucagcuuuaucaggcaacuggauuaaaaaaaaaaaagauaguggugaagaaaauuggggaaaaugccagagauugaacuugguugaggacccaagucccacuuacucugucaccggccugacuuagcacccagaggaagacccuuuuuuucuuucuuucuuucuuuuuuuuuuuuuuggaagacgggauccaggaucucucuguguagcccuggcuguccaaccacuugcuuauagaccagacuaaccucuaacucagacugccucugccuccugagugcugggauuaaaggcgugugccaccacgcccagccuguccuuuuucacucuuaaguagcugauauuguagagugaguugcaggucucuggcacuguuacacaguagauuccagaaagaauguaaaucuaguaagacacucauuucuuuuguggcccucacauuuuauguuauuaagauguuuugauacuugugguuauaaacucuuggauuccauguacuguggugacccccagaccccaacagacuuagaaaacaaauaaaagcagguccugauc

SEQ ID NO: 602 - RNA, 1626 nt, Mus musculus
auucagcgcacaaaauacauuuauuuuuaacauaaggaggcuucuaauucuuauuaauaggacauuggguucuuuuucaaucacagcaugaacagauauuuuaagaacaaugacccauuuaugcagcagauuauuagcuuucugguaaugcacauuaccccccaccugcucuggauggaagccuuuagcuccccuuccccaagucaaagcggggccaugucacuggcuaugugagcucaagucagcaaacugcaugcagcucccggauuggcuauuagggaacaccuuuuuuuuuuuuuuuuuccuaacacacuuuuuugguagaugucuuagaaguacaauuuggcaguguggugacucuguucugaaugcuuccauacucagucccuaagcuuuggauacguuucuauguucaacaggucucucaguuuaauguucagagaucuagacuaugcuaacugugcucagaaaacacaugucaacucugcguuauuacuaugaauauccuuuauucuuauuauuuuuuaauuaguucucuucugggcaguugggccuaguuucucucucucugucucucucucucucugggcguggggugucuuucucgcggguggggguaaggcagggacccucuacaaagcucuggauguccucaagcucacagagaucugccugagcgcgccaccaagccgggcuggaacagggauucuggcucucuaggugugaggacuauaaagugcucggugcacucaccgcacccucagggucaucaaauccucaacacacaagggcuuagguucaggacccgagugcagaggagucggaaaaggguggggucaaaguggaaaggucaaaaggccagugucuccaguccagagccucggacauccguuaccauagcgacuucagccaaggaauggaauuaccgaggccccaacaggcuuugcgaucccaaaucccagggguuuucggcgcggcucguauuccguagagcagcuagacgcagacaccaacgccgacgcgguugccuagcgacacgcauuuucccaggaugccuagcaguguuguguuuucucagccaaucagaguugagaugcaccuucgcuguggaccaauagaaugcgaggccgaagcccgcgacgguugacccgguggccgguugcucgccgacucaggcaggcagacgaggggcucggguuucggcgcgguuggccugcagcgggcgagccugggcuccgagcggcgcgguggugugguugccaggguggccgcucgccaugccgucccggguggaggacuacgaggugcugcacagcaucggcaccggcuccuacggccgcugucagaagauucggaggaagagcgacggcaaggugaggcgccgggcagcccuuccacggcgggcuuagggagaagcaagcgucgcccacgcuggggaggggcagggcggccaccugaacucucgugaaggaccgggcuguagccuccuaagaagggacgggcucguggagcgggcagccgcggcugggaaccgguggaggcgcgaauccgcggcgagcagaaagacgagcucacgugaccugcuucgccgcugcgccacacgccgucccggacucaagcgcuggg

SEQ ID NO: 603 - RNA, 1626 nt, Mus musculus
cccagcgcuugaguccgggacggcguguggcgcagcggcgaagcaggucacgugagcucgucuuucugcucgccgcggauucgcgccuccaccgguucccagccgcggcugcccgcuccacgagcccgucccuucuuaggaggcuacagcccgguccuucacgagaguucagguggccgcccugccccuccccagcgugggcgacgcuugcuucucccuaagcccgccguggaagggcugcccggcgccucaccuugccgucgcucuuccuccgaaucuucugacagcggccguaggagccggugccgaugcugugcagcaccucguaguccuccacccgggacggcauggcgagcggccacccuggcaaccacaccaccgcgccgcucggagcccaggcucgcccgcugcaggccaaccgcgccgaaacccgagccccucgucugccugccugagucggcgagcaaccggccaccgggucaaccgucgcgggcuucggccucgcauucuauugguccacagcgaaggugcaucucaacucugauuggcugagaaaacacaacacugcuaggcauccugggaaaaugcgugucgcuaggcaaccgcgucggcguuggugucugcgucuagcugcucuacggaauacgagccgcgccgaaaaccccugggauuugggaucgcaaagccuguuggggccucgguaauuccauuccuuggcugaagucgcuaugguaacggauguccgaggcucuggacuggagacacuggccuuuugaccuuuccacuuugaccccacccuuuuccgacuccucugcacucggguccugaaccuaagcccuuguguguugaggauuugaugacccugagggugcggugagugcaccgagcacuuuauaguccucacaccuagagagccagaaucccuguuccagcccggcuugguggcgcgcucaggcagaucucugugagcuugaggacauccagagcuuuguagagggucccugccuuacccccacccgcgagaaagacaccccacgcccagagagagagagagacagagagagagaaacuaggcccaacugcccagaagagaacuaauuaaaaaauaauaagaauaaaggauauucauaguaauaacgcagaguugacauguguuuucugagcacaguuagcauagucuagaucucugaacauuaaacugagagaccuguugaacauagaaacguauccaaagcuuagggacugaguauggaagcauucagaacagagucaccacacugccaaauuguacuucuaagacaucuaccaaaaaaguguguuaggaaaaaaaaaaaaaaaaagguguucccuaauagccaauccgggagcugcaugcaguuugcugacuugagcucacauagccagugacauggccccgcuuugacuuggggaaggggagcuaaaggcuuccauccagagcaggugggggguaaugugcauuaccagaaagcuaauaaucugcugcauaaaugggucauuguucuuaaaauaucuguucaugcugugauugaaaaagaacccaauguccuauuaauaagaauuagaagccuccuuauguuaaaaauaaauguauuuugugcgcugaau

SEQ ID NO: 604 - RNA, 6483 nt, Mus musculus
cgucugcaaaggagggggggcgaagacggcggacgccuccgggccgagcgcagucgccgcggacgccgucucccgagcgcuucgguccgaugcucggcagccccucggcacgcaguggcccgccgcgcccuccgccucgccagcccagccgagcgccggcgcuugaguagcugcgcggccggcgguuuccccacagcgccgcucccguucccgcgucagcgccgagccucaggccgccgccaugggcugcuggggccgcaaccgcggccggcugcugugcaugcugcugcugaccuucauguucauggugcuggaggugguggugagccgggugaccgcgucgcucgccaugcuguccgacuccuuccacaugcugucggacgugcuggcgcucguaguggcgcugguggccgagcgcuucgcccggaggacucacgccacgcagaagaacacguucggcuggauccgcgcugaggugaugggcgcacuggugaacgccaucuuccucacggggcugugcuucgccauccugcuggaagccgucgagcgcuucaucgagccgcaugagaugcagcagccgcucguggugcugagcgucggcguggcggggcugcuggucaacgugcuggggcucugucuguuccaccaucacagcggcgagggccagggcgcgggccacggccacucgcacggccacggccacggccaccucgccaagggcgcgcgcaaggcgggccgcgcgggggucgaggcgggcgcgccgccgggccgggcgccggaccaggaggagaccaacacgcugguggccaacaccagcaauuccaacgggcugaaggcggaccaggcaggugagcgccacaguguucgggacaggcgcccccuggcgaccgcggugggugccacgccccgcgcccaggugcgcggugguuucgugcccacugaacaaguuugauaaugaugugcugggggugugugggcccugguuaaaggcggccuuugugaacgggaguguguguuucccugaaccgaccaccuaauccggaaaaucacuguuuagggaccugccaaggcacguugcacccucaccuccucggguuggcauaauggugcucgacccaguggugauguauuacucucgugguuuuaacgagcguuuuucaucuugagcacgugugcuugaugguaauuuggaagguaaguguugaaaagaaaugagaaagaaccuaccacccucgauguuaacauuguguguaucuuccaguuuuucuugccacuuguaucugguuagguuacuuacggaggcagcuuaccuucuccaaugcauaggaacauguuuggaaguucagguggugcgugggaaaggagaaagagaagcuccucaggugugcccucugacgggaacuuucagguuacuuagugauuguugacuuccaacuuuguugauagcuucagguuguuuuguugguuuguuuuugguuccucuagacggguuucucaggauagcccuggcuguccuggaacucacucuguaggacaggccggccucaaacucacagauuaccuccugcaugucucucuggggucaaggccugcacccccagcaauagacccagguuguugauuugucaguuugugaacccuucuacaaagacgcuauguuuuauguucuugacgaugauuuuacguuagagcugcuuuucucagucugucuagugccacugacagagacccucacaucagguuuguuccugucagaggacaucccuucagugaugcuuacugauugccuagaguuuuguuucucuuguauguuucagagaggugacgcaguguuuacacgaccccaucccagcagugagggcaggugagaggugggaaggaacaaggagcaguagcccagugacacaguggacucuccgcuguuggguacuggcgggacccagggcuagcucacuguggguugcucucagcacacugucauugucacagcuuuaugaaacaaguuuaaacucacucacugccagacaagauguuucuguggacacuuuaaaugugcuuagugaaaauuguauuguuuuguuguagagccagaaaaauugagaagugaugacccaguggauguacaaguaaaugggaaucucauccaggagucugacaaucuggaagcggaagacaacagggcugggcagcugaauaugcgaggaguguuucugcacguccuuggagaugccuugggcuccgugaucguggucgugaaugccuuggucuuuuacuuuaacuggaaggguuguacugaagacgacuuuuguacgaacccguguuuuccugaucccugcaaaucgucuguagagauaauuaacagcacccaggccccgaugcgugacgcuggcccaugcugggugcucuaccuagacccaacccuuuguauuauaaugguuuguauacuucuguacacgacuuacccauugcucaaggagucugcucucauucuucuacaaacugucccuaagcaaaucgauaucaaacacuuggugaaagagcuucgagacguugacggcguugaggaaguccaugagcuacaugucuggcagcuggcgggaagcaggaucaucgccacugcccacauaaaaugugaggaccccgcuuccuacaugcagguggccaagaccauuaaagaugucuuucauaaucauggaauccacgcuaccaccauccagccugaauucgcuagcgucggcucuaagucaagugugcucccgugugagcucgccugcagaacucagugugcccugaagcagugcugcgggacacggccacaggugcauucugggaaggaugcagagaaggcgccaacaguuagcauuucuuguuuagaacucagugagaaucuagagaagaaggccaggaggacuaaagcugaaggcagucucccugcuguggugauagagauuaaaaacgugccaaacaaacagcccgaaucaucuuugugagucuugaaaaagaugugauauuugacuuuugcuuuuaaacugcaagagaaaauagacuccauugaaauacuaaguuugccaaguaguguaauugaaguccuugucuggucgcacaguuuaauucuauuuuuguaagaacauaauggaacugccuaauagagagugcuacauugcagccuugugauucuuagugcauagugcagcuaugcuggaacacguuugaaagccaguuuuaacacuauguuacauuuuuguuuaaaguaaguauaaaucuuauaugacauaaugaaauuugauuccugguuuucccaugauaaaaauuagggggauaaauaaaauuguuacuggaauuucucugcuuuucuuccccccccccccccauugcuauaucuuaucuguuaggauuauaauugcuaggccuuuaaaaucaucaaguuugucuccuuugauguuugaggggaugguugcuugcccuuugagaucauaaacagaccauaauggcagcauauuuccagagucaugacucuuagcagaaagucaguuuaguuacuacuuuguuuucucugcugcugaggaauagucuaguaaacucugagauaauucacaagaugaguuguaguuacacaucguggagcauauaggggcuaagagcagggaggaaggcaagcuacagcuacguccguuacuucacaguaauaaugcugauuauagcucuaaaguaucuugaaaaucucuaauggcuuuauucuaccaaagucagucuaaacauguuugccaguguugcuuucuuucaaagacugguauuagcaacauugaguuaaaugguucuaaaugcaugaguauuuuuugagaaugcaggcuugucuuggcuccuuaacugcaaacuauuaaucuuaaauuaugucuuaaagaaacuuccauagugacccaucagauggaaugaauacauuucuucaugggcagccaacacagugugugcuuagccaagagccagugacuuaaaaaugaaaucacauggcucaugcaauuuggauauuacuuuagaaagcaaaaccaguaagaggaaggcuuggaucuuuagccaccgugccuuggcaugcuggcuugcaaagugcuuucucugcaggacucugcacuuugcacccaggaagucauucacggcugcuccauugccacagauuucaaauccaacgcagacauuugaagauuuuuaaguuauuuuuuccagaaagguuaaugcuuugugaaggaaauguagauuuuugucuucaaaagagugauuauuaauaucaguuauguauagcucuauuuuucuaggaacaaaguauucugacuacuucaauaacuuuuauagcugacuacuuuugggaaaguuaacuuuugggauuugaaauaauucauugcuuaauaaucugaaaauggaaguguuagaguaugacaguuacuuuaaggaauggucgcuccccuaguguaauaagccuguugcuggcaaugggccuacauaagaacagcuggguuuucugauaagaaauguaauuuuuggaacauaguuuguaagcucacauuuacuacacugggccaaccuucaaccuacauaauacuugacuaauaugugaucugaccccuuggcaggugguuacuuugacuuuaacaaaacauuuguuuuuuaaaaaaaacaugaaauugagagcucugugaguggugugagcgggagcuccaguugucucggaugguacugugcagaaggguucaguguuuccacagggguacaggaggccauccaggagguggccuucagaaccucugggcagguuuaugucauggggaggagggcugugucagucugauuuucagaagugcuuuaagguggugguggccuggguuaaguggguucuauguauaaaagugguaccguaggcuuuuuuuuuuuuuuucaaagguguuuguuacagcaaaguccaugggcgccaacucaccuugagguuuuagagaauuauuuauuucuuuacaaugcacuuucuaacccauuuuuuagcuauauuagcauuaucuuuaagaagaaaagauguuuuuauauuuaaauguugugggauuugagugucuuuuccaaaaauagcauauuucuugaaagaaaaugaggagcuaccuuggccucuuggggacuaucccauuguuuaaaugugcuuccucucccaagucagggcugcagggggguugggguggggguugggguagggggaggcuucccugguuccuucucacuugagccaggucaguguggagcugagugaggaagcauacacucaaacaggauccuuccaagccaugugcagccuuggaacaauggacuugcuuucccauggucagcuuuuaccuugugggaguaauucuuuucugggggguuggggguggauuaucuacauuguagauggacaagccagaacaugaaaaacaauucuggaacauuuuacuguauuuucacacccaaaacaaaaugcuggguaccuuuauccuaagaggcauaauuugagcagggaggguuuccaucaaguuuaccuuggagggucucgggaggcuguuuguaugugugugucuugucagcaucuguuauuuugaguuccugaaaauuuugagggaaaagaaaaccuaaugugaaguauuugguagguaaacuguuuuugaguguuuuuacuguuuuacaagcagauaccauuugaacaaaaaaaugucauuaaccugcugucuuaagguaguccuacacaaaucuggagagcggauuggcaauaggaaauguuuauuuuaguacugcauuucaguuaagugguuaacaguguuaagaggucuugggaaaguggagaaggcuuuuguugucuucgaaaucgaaacugcccuagugcuucacgaccuggaaaaugggacuguaaucacacuauuuugauacagugcugcauauauacauauguguauguauaugcugaucuuguuuuguuuuacuaacaagcucuggaauauuuagcagucauuuucacuggcacaagagccuuuuguauauuaaucaauuuaaacuuuuaaaccaaaaauguuaagguucagugucaggcaaaaaaagaugcugaggagaauguaacauagaauugauaugugguuauauaaaaagacacaaauggccaugauaugggucugccuugaaacagcacaauggggugucagugugucugauucucugagacgcucucgaguugguccugucuacugccgccugugcucugggccacaggcauaguugauggggcucaucuugaacucgagugcggcaaccuuuucccuaacuuguguguguuuuaugacuguguguuauuuccaaagcuguuccuaccucaccaugaggcuuuauggauuguuauguacuauaaauguucuauaugagacaagacuacuguguuucuucucauuuauuaaaaguuaaguagaaaaauaaacuaauucuaauuuc

SEQ ID NO: 605 - RNA, 2768 nt, Mus musculus
gccuuguugucaaauuauuauaauuuuuuggaagauacaaaaauauaaauaacagcaauauuucaagaguuuaaaguuucaaaccagggaaggauccaagauaaaaagaugacacaucagacaucggaggcaggaagacaagaacaagagccugcucaguccagagggcugcgcccaagggacagccacaccuuuuccugugcugagaaguuuccuuaucagguaacacuacagauccuccaagucaguuaaauccacggccacuuucaagaacagugugucgucuuuaauguagguguucuuggaguucuccagaguagagugcgacacaaagcggggacagccagaggcaauguucaucucgccaucuggccuuuugaagcugcugcuguuggggucagcuuugaaggucuccacaauaugguucuucuugccgcucugguccaaaagcaucagggucacccucugccugaacggccacugcagcagcgagucaaacucaccgcgcaucaccacaaaguacagggacaggugcguucccuuccccgacccguccccguucagguacgcccuggcacagagccgguagccgcagcggcugguguagaaaggcuggcugaagacggacacugugugccccuccacggccucccucuucuucacccuguaaucugucaccuuccagaugagcuugccacuguagcaggcgcccuccagcugcuuaaaccgcucuucguucuuauucagcugugcuuuguggauauuaaugugugcgucgugcuugcuggucucccccucuaaaagaacuggaaggaaacacaggacaggaggcugcagcucgggccugucaucugagcacuaccugugaacuacuacaugcauugcuaacauuaacucaaucgugguaagcugacgccaagcagacauggauguauccucccucuucacucucagcuugccugaguauaagacacauuggacauucaccucgagugaauucucaugcugagccuugugcccgucuaacuguguguguuugugugugugugcaugcaugcacacgagugugcuugugauguaagugucugugcauacuugcauguguuuggcugugaggugcuuguggcauacagaggccagagguugauacugagugucuuccccaguaguauuucagucuuuugauguaguucucucacugaauuaaacccugauauucuggcuagcuuguccuggagauccugugucagccuccagagugcuaggaccacagguagcccuccaguccacucagcaaucacauggcuacaaggauccaaauucuaggucaugugugcagcaaguguguuaucuacugagccaucuccccaacuccuauaaugaauuuuacauuuaaaagacuuauuaugggggcuggagagauggcucagcaguuaagagcacugacugcucuucuagaggcccugaguucaaaucccaggaaccacaugguggcucacaaccaucuguaaucagaucugauucccucuucuggugugucugaagagagcaacaguguacucacauacauaaaacaaauaaauaaauaucuuuauaaagucuuauuauuauuguuauuguuguuacuguugguggugcgugcgugcgugcgugcgugcgugcgugcguguguguguguguguguguguguguguaagugaaggcauguacaccauaguauacaugugaaggucauagaacaacuuucaauaguugguucuuucucuccacuguguggguuccagagaucaaacucuggguguuauaguuucaaugaguuguguguccuaaguccuaagcauuggaauacuugguccccaguugguggguuguuuggggaggauuaggagguguggucuuauuggaggagguguggucuuguuggagguguggucuuguuggaggagguguggucuugcuggaggagguguggucuuguuggaggagguguggucuuguuggaggaaguguggucuaguuggaggagguguggucuuguuggaggaggugugucacugggcuugggguuucagcagcugcuccagugccaugccugccugccugcuguuucucuaugagauggugguaaauucuuauuucucugcaaucauaagcccaaauaacacuuccuccuacaaguuaccuuggucauggugcuuugucacagcaacagagaagccacugauacacuggucaucucgauugcauagcaaaucaccugcuaagcaaucucacuggccccagugcaccaaagccuaagacacccaucaccucucucccuuguucuuaaugauuaccacucccagcucuugggacugccugggccauuucagucucgucugacuccacacacaugguggagacccucauuuucugaggcagcuagaaucucaugcugcuucacaaacaggauucagccacugggcaacccagaaagcugguugugacuuguuagcuucuaccacaaaugcacacagacagggaagccaugagagggaacccgacugcuucauacacacacacacacacacacacacacacacacacacacacguaccuaaucucuggucacuggcuuccagcugggugauccucuguuucacgcugucaaccgcauccaccaaagaccucagaucaagucgacuuggcugcugguuaacuauuuguagcagcugccgcaccugcgcuuccagccaagcugacuuguccgugugacuggugagagccuu

SEQ ID NO: 606 - RNA, 786 nt, Mus musculus
ggguuuuugcuuccaucccugagacaccucucugacuauucagcacuugauccccacuucucucugcacagcagccaugccgccguacaccauugucuacuucccaagucgagggcggugugaggccaugcgcaugcugcugacugaccagggccagagcuggaaggaggaggugguuaccauagauaccuggaugcaaggcuugcucaagcccacuugucuguaugggcagcuuccuaaguuugaggauggagaccucacccuuuaccaaucuaaugccaucuugagacaccuuggccgcucuuuggggcuuuaugggaaaaaccagagggaggccgcccagguggauauggugaaugaugggguagaggaccuucgcggcaaauauggcaccaugaucuacagaaacuaugagaaugguaagaaugacuacgugaaggcccugccugggcaucugaagccuuuugagacccugcugucccagaaccagggaggcaaagcuuucaucgugggugaccagaucuccuuugccgauuacaacuugcuggaccugcugcugauccaccaaguccuggccccuggcugccuggacaacuucccccugcucucugccuauguggcucgccucagugcccggcccaagaucaaggccuuucuguccuccccggaacaugugaaccgucccaucaauggcaauggcaaacaguaguggacugaagagacaagagcuucuuguccccguuuucccagcacuaauaaaguuuguaagacagaaaaaaaaaaaaa

SEQ ID NO: 607 - RNA, 542 nt, Mus musculus
gauggcggcuauucagguggugcaugcuuaccaaaaguagccuacaaucuuuaaagacaagaguguguuuugcugggagaaaccggcaaggaaaaacucccucgguacaacaaaaacaucgucuaggcuuuaagacacccaaagaagccauugagggcaccuacauagacaagaaaugccccuucacugguaaugucuccauccaagauuggauccugucuggugucgugaugaagaugaagaugcagaggaauaucgucaucugcugggacuaucuccauuacaucugaaaguacaauugcuuugagaaacgucacaagaacaugucugugcaccugucccccuguuucagggauguacagauuggagacauugucacuguuggagagugcaggccccugagcaagacuguccgauucaaugugcucaaggucaccaaggcugcuggcaccaagaagcagcuucagaaguucuaaggggacucuggccaaugcccuagaacaaauaaaguuauuuuccaacuuaccaaaaaaaaaaaaaag

SEQ ID NO: 608 - RNA, 1415 nt, Mus musculus
acugcuuucuuccuaccacguaucccuaaauaagccuuggccgacugucugaauacugccuugccauuuauauugccuuauggcuauaccauagaauaaaucguacauuuacugugaugacaagucuugauuggcaccuugacuggaucaagaaauaacuaagagacgcacuucuggaugggucugugaggguguuucuaagaagaauaacucagugggggaagagcuucccuucgaagaugcagucccuuucaaaggugguucagauaugaggaggucugaggaaaaguguugccugccugcuugcccaucgccuguggugagugugaguacaucccucucuacugcugccaucuucagcaucaggcuccagugccucuggccuuccaauguaaacuaaauaccaacucuccaggaacuuuccaggcuuuuggcaccaggcugggccugcugaggcagccaguuucgugagcugagcagcuacuggcuucucagcuucuauaaugcacagauagugauuguuagacuacccaaccccuaucauauaagccaacguaauaaauccucuucuaucuaucuaucuaucuaucuaucuaucaucuaucuaucuaucuaucuaucuaucuaucuaucuaucuaucuaucaccuuccuuccuuucuuucuuucucucuuucuucuuucuuucuaucaucuauccauccaccuauagauagaucuauacauauauaucauuuugcucuucuagagaaccuugacuaauauacuauuuauauguaaauuuuucauuuuaauuaaguagagcuaaauuaaaugguuuuuacuuguuuuagcuauauuucaaguauucauucacacaugucuccuagcuacuauauaguuacaagaacagaauaguuucauuguugcagguaauucuuuugggugucucugcucuaagagaaccucuaugaaggaugcugagaggaaaguucuuggaagaguugugcugggauggauguccagaggaggaccuugcuagucaccauuuaagccuuuucuaugcaacaacuucuuucuggcaacucucuucucucuuacagaguuggacaauaugggucacaugggguugcuacagaaugaaaaggaagcaucuccuacugacucuugugcugcgcacuuaaugcccagcuuugugggacuaucuugggaggagaacuucagacggugagaccuaguuggaggaaguagguaacuggaagcaggcccugaauggcacuuugucccugguccuggccccuuucugucuguguuucuucuugugugucacaaguggaaaaccuccucaccaugaaguucugggaccaagcaacugugagcugaaaccucugaauucuugacccaaaauaaaacuguauccucuuguuucuaucagau

SEQ ID NO: 609 - RNA, 2657 nt, Mus musculus
ugugagaaucacugggcauuuuaucaaaaauaaauguuacauaaauucaaaggacaagauaggugugcaucacagaauucagauucuuuguggcuccaaaggacaaaauuggcaacagcuagugaaacuuaccggaaacaaauuuuaggcaauuaaugaauugauuaauuuaagaguuuuuaaaugagguaaccauguuuuguuuuuaagaauagcuaauuggaccagguauccagugugguggcauauauuuuugagucuagcacuugggaggcagaggcaagcacauuuuugugaggucuuagccacuaugguuuguaguaaggaguuccaggacagccagagauacauagugaagaaaaccaaaccaaccaaacuaccaaacagccaacucuacaucccaaaaucccgugucucuaauauaguugaugaaagugaucuucucuucucuucucuucucuucucuucucuucucuucucuucucuucucuucucuucucuucucuucuccuccuccuccucuuucuucuucuucuucuucuucuuccucucucucucucucucucucucucucucucucucucucucucucuccuacugagaauucagucaacuguuuuuauaugcuuucagaagcaucccacaucccucuuucuuuuuauaccggugaagaguauggccacaagagggcaguaggggacauuugucagacacuuugauguguugaguaaacucgguguguucaaucuccaucggggaauucgaagacccugagaccuugcagggguauagcuugcacaggcccucgcgggaaagccguagccgcaguugcagauucacagacuacgaaccaaggaaucaagacccgugagcgcggaagcaaccaggacugaaaaauccucuuuucuggggauauuaaaguugucuuaaucuucuagccauuacccucugccuccaguacgaggcgggcucgcgggucuggauaaugcaaacgcuccugguacuaugguuuccacagcacccacccgagucagccccuaccuccuuuuccaauggaacaggaaaccggagaugcaaagccagacuccucuuuaaaauguagaaauaauuaucaacaacuucaaaccucuuuugacagcucguuggcuuucuagaauuuguaggguagagaaauuugcuguuccgaaauccgacaccccaucucaagcccaucaguaauauaugucccuccacacucaccccuagcucacaggugaagagaaaggaggggaggcuuugcuuggugacaggugacgccacgcgaggggauggggugcucucaucacucugauccccucccgaagccuagccagcuggcuuaccaggccccaagacaugagucccuagacccugguacaaccuuucugggcccuugacuacugacagugucuggugguccaaacugagcgagcagaacgccugcagagccguagcucugccggguucuuggguggaccagcuaggguauucggucugcgcgggcggggcgcgugggcggggaggggguuaacgcggccucuaugauaaugagcugagcgguaauauaggaggccggcugagggcgccgccaccggagcugagcugagccgcgcugcgcgcagcacuguccgcgcagagccgagugggggcggcuggagcagcugcugggauccuucagcugaagacgagcgaucagaucugguggacccgugagccguggagccgcggggagcuuaugggcccggucgcagacagagcuggcagcgguuccuggaggaaauagggccgagcaagccaggagcagaagggaaggaagcgcgggaucgcugaugucagagcagcccggaaagucgugcuggagaaaacugaagacacccggcuuugagccgccccggagggacccugcgggaccccacgccccuucacaaccgggucccugcgcacaagcgacugggacgaagacgcgaggaaccauucgggggccaccccaggaauacaggcaagcggccggcgcgggccgaggauuuuaaugauccuggguuacauguggaacuggcugccagugugacucccgucaggcaggacugggcgcacgcugcccugggcaaccgccaguugagcggacgaagaggggacgcagggacagacagacacugccgagcuggguaagcagcgcccuccgcccuuuccccgagcgcgcucccgcggcgguuccuccggcgcagccuccucagguccccuuggggucccggccccggccccggcuugguuguggcggcgaguauacgcgcgugauccgccacuuucgcagcugcagucuccuguccaggcuuccgggccauagacuccagcggcucuggugguuccggcgcuccguggcgcgcuuauagcgcgcaccugccggcugucugcagcucuggggagcgccugagcgacgaggucgucccaggguuggagcccagagagggccuccguggcacuagcaagauagccuggagcgacuauggccggaggccgguuggggggcguucaccaggcaguguagucccggguggccgcuggcuguuccagugguucaguagacugggaaucaccgggaaggagaaggcauccuuugcgugcguuccgggaaucuguga

SEQ ID NO: 610 - RNA, 2657 nt, Mus musculus
ucacagauucccggaacgcacgcaaaggaugccuucuccuucccggugauucccagucuacugaaccacuggaacagccagcggccacccgggacuacacugccuggugaacgccccccaaccggccuccggccauagucgcuccaggcuaucuugcuagugccacggaggcccucucugggcuccaacccugggacgaccucgucgcucaggcgcuccccagagcugcagacagccggcaggugcgcgcuauaagcgcgccacggagcgccggaaccaccagagccgcuggagucuauggcccggaagccuggacaggagacugcagcugcgaaaguggcggaucacgcgcguauacucgccgccacaaccaagccggggccggggccgggaccccaaggggaccugaggaggcugcgccggaggaaccgccgcgggagcgcgcucggggaaagggcggagggcgcugcuuacccagcucggcagugucugucugucccugcguccccucuucguccgcucaacuggcgguugcccagggcagcgugcgcccaguccugccugacgggagucacacuggcagccaguuccacauguaacccaggaucauuaaaauccucggcccgcgccggccgcuugccuguauuccugggguggcccccgaaugguuccucgcgucuucgucccagucgcuugugcgcagggacccgguugugaaggggcguggggucccgcagggucccuccggggcggcucaaagccgggugucuucaguuuucuccagcacgacuuuccgggcugcucugacaucagcgaucccgcgcuuccuucccuucugcuccuggcuugcucggcccuauuuccuccaggaaccgcugccagcucugucugcgaccgggcccauaagcuccccgcggcuccacggcucacggguccaccagaucugaucgcucgucuucagcugaaggaucccagcagcugcuccagccgcccccacucggcucugcgcggacagugcugcgcgcagcgcggcucagcucagcuccgguggcggcgcccucagccggccuccuauauuaccgcucagcucauuaucauagaggccgcguuaacccccuccccgcccacgcgccccgcccgcgcagaccgaauacccuagcugguccacccaagaacccggcagagcuacggcucugcaggcguucugcucgcucaguuuggaccaccagacacugucaguagucaagggcccagaaagguuguaccagggucuagggacucaugucuuggggccugguaagccagcuggcuaggcuucgggaggggaucagagugaugagagcaccccauccccucgcguggcgucaccugucaccaagcaaagccuccccuccuuucucuucaccugugagcuaggggugaguguggagggacauauauuacugaugggcuugagauggggugucggauuucggaacagcaaauuucucuacccuacaaauucuagaaagccaacgagcugucaaaagagguuugaaguuguugauaauuauuucuacauuuuaaagaggagucuggcuuugcaucuccgguuuccuguuccauuggaaaaggagguaggggcugacucgggugggugcuguggaaaccauaguaccaggagcguuugcauuauccagacccgcgagcccgccucguacuggaggcagaggguaauggcuagaagauuaagacaacuuuaauauccccagaaaagaggauuuuucaguccugguugcuuccgcgcucacgggucuugauuccuugguucguagucugugaaucugcaacugcggcuacggcuuucccgcgagggccugugcaagcuauaccccugcaaggucucagggucuucgaauuccccgauggagauugaacacaccgaguuuacucaacacaucaaagugucugacaaauguccccuacugcccucuuguggccauacucuucaccgguauaaaaagaaagagggaugugggaugcuucugaaagcauauaaaaacaguugacugaauucucaguaggagagagagagagagagagagagagagagagagagagagagagagaggaagaagaagaagaagaagaagaaagaggaggaggaggagaagagaagagaagagaagagaagagaagagaagagaagagaagagaagagaagagaagagaagagaagaucacuuucaucaacuauauuagagacacgggauuuugggauguagaguuggcuguuugguaguuugguugguuugguuuucuucacuauguaucucuggcuguccuggaacuccuuacuacaaaccauaguggcuaagaccucacaaaaaugugcuugccucugccucccaagugcuagacucaaaaauauaugccaccacacuggauaccugguccaauuagcuauucuuaaaaacaaaacaugguuaccucauuuaaaaacucuuaaauuaaucaauucauuaauugccuaaaauuuguuuccgguaaguuucacuagcuguugccaauuuuguccuuuggagccacaaagaaucugaauucugugaugcacaccuaucuuguccuuugaauuuauguaacauuuauuuuugauaaaaugcccagugauucucaca

SEQ ID NO: 611 - RNA, 6269 nt, Mus musculus
aucuuacagcacauaguuugagauauaccagcagugaauuugcacaauccacuuugcaaaacacuuccucaggcuggcccagcuaugcaaugcuugccaagguuaucagucagccauaagagccuuuccucuucuguagucuuguguagacuuucuggguuuggaagugcugaucagcagcaagcucaaagaugaccaugaggaggcaguggagagugcagaguuugccacugaauauguguuccuuuagcagggcagaaacaaacaaauaauuaagaaaaaaagauuaacccgucauauucacaacauaagacuauugauuuuucuuuucauuuuauguuuuguuuuguucuguuugguuugguuucgagagaaagcuuuucuguauaguacuagcugucuuggaacucucuuuguagaccaggcuagccuugaacucagagaucuaccugccucugucucccauguacugagacuaaaguugugugccaccuuguuagaauauugauuuucuaagauguguauuuugacucugauaccaaaccagcaguagcuauagaguaaaaaccaaugugucauauuucugggaagagaggcuauagaaagaaguuauuaggguuucguauuacugcagucuaggcuuuggagaauuccuuuuaccguuggauucauuaggguaggcugucuagaggaggagguagcaaaauuucauaggcuacuuggaagaaagacuaagcaaaggauaauuuuuaaauaaguuauuuuauccuauuguuaaaaaaacuauaaaauuguuucuaacauuaucaaacagacaucagguuuuaggauuuuguagcauaucugauuuaugguuaggcuguuggaagauuugaacaccgggacagcacagauggccuuucugccuuagugccuuaggucuguucaguuccagggcuacaauguaagauaagaaguacugcaacugguaaagcauguuggccaggaaucagcccaguguguuuaauaguuggaccaccaccagaagaaucacuggggcaaggggugggggggaaucauaggccccugggaaggcucgaggacuggcgugguccuagcugagacuguuucagaaaggacuugacaguggggugguaugaaaucaguguaauguaaaaaaaaaaaaaugcauuuguaugguaaagucuuagcaaaacuuauuuuauauaguuaaaaauauguuagaaaaaauuuaaaaguauguauauauguaauaggaaauauugaacuguauaauaugugauaaaugcauuguuuuuaauguguacauauagagagagaugcauagaacgcauacacagagggauaggaguuccauguaacuugggccuuacugaggguuaagaucuagaauauauaagaguacuguccugaaaggguuccuguguucuuagcauagacuucagguugcaguuacuuccccgggaacuaccucccugaaagcagcuauagugaaggcuuuaagaacaauuagguaggucugaggcuguuuacccaaguggggggugcuucuuucugcagaggaacuggggagagggcccaaacagaggcagggguuauaagccaaggucuaccucuccccugucauuuaaauguuuuccuagaauacagagguuuagacccagccuuuguccuuugcuuccugcuuuaauagcaauuuccuugcuuucuaagauuuauucuauuuguuugauuuuuguuuuguuguuuuguuuuguuuuuguuuguuuccuuucaauagaaaucuuccccacaucccaaagucugggcuagaaagaagcuaucccaauguacuuugcccuauuaguguuguguuuugggauucacugaguaagauaguggaauucaccuacuuagguuccugguagaugguagugagcugacucuuccucguagugucacuaaggucucagauacuugggcucaaaaucgcucaggcuaaauguguucauuugugcuccccuacccccacucccaaagaagcauuucucauauugugccugcuucucuaugccaauuggacuguagaguacugacccacaugcuguaccucacacagagguuuaaauuaggaccuuuaaucuguaagaggcuuacagcuuguggauagccagcugcucuggacuugaugugggcagaagugagcuuugccuggcuguugugggguucaguaaaucaugaagguugaugguuugguggcaggagcaggcccuaggagugggugaguagggccuuguaugauagaauaggacaaugacauguccucguugugauggaauggaagcacauaguacuaugguuggcugcugguuccuccugagcauuaaaccugaguacaguuuucucugcaaaacgugugcuuucaucucacaaaugugaaguugguaugccuagcacaaugccauucugugguggaggaaaacucagcaaagugagaauuggccccuuccucauguuacuuauaauuuauuugaggugcauccacaggccaaauauuuuauuuggcugguagcuguucacucaggguagcaaauuauaaaacuccaaaaucauaagcaugugguauuguuagaaacacugagaaaggagauagcccugggcucugaaugucaggauuuagaaguugagaugaaggcaagucauagaaggugggaggaagguugugaaccaggacaaagaagauggauaggcaggccauccaucagacacuaggaaucuuaucucuuguucauggccucucccugaaaugccuugucagucucacguacuuuaucauuucaugacuuagaccuagcucuuggguuccuccuuucccccuacauauuguuaugauuccuaauuuuuauugagcacuugcuacguaccaguguucuguauauguuacauggaguguccuauuacauauucauaucaaucuugcuacaggugccuaguauguaguaggcacuuuauagccagcaaaaggagguguguaaagauuaacuagcuugugucuggaguccauguuacaucuugacgacuauauucccugaaaguggaaagccaauucccaaaccugugguugacaaaccugugcacacauucaaguuuccagagguuuccuaaaguguuaaagccagacuagguacccaguggucuugugcuugggaagagguuucaggggcaucaggaauuucagggcuugauuccacuguggagucugauuuaggaacugaagcuuaaucucuguauuucaaggucucuaguauuugacugaguaucuuguuuuuaaauuuuccauaguacuaucuaacaggccccuccuucauuccucuauagagggugacuauuuauucacucauuuggagacaggguaucuauccuaccauacucuaagagacacauaguauccuagaaaguaacauauagagagaggaguggaccuggaaggaugguuuuccuggagccagcagcccuguuuucucugacugaaaccuugaguacagagcccacugacaaagcucagguuaucucugacugguuucucacaucuucuacuuuccugggucccugccuucaauggggaagagagagggucacaugagggcauaucuuaacaaguucuguuccucccuguccucagcugaaccugaaauggacacgaagugcagagucgcugggguggcugggagcaacccuaaauuuagcaaaacuguagcuguuggggggccggccugcaggaggccagacccaguggaguggacuagauuuauagucagcaaagggguuagcauugucucugcuuagugucauagguaugcuggguaagcaugagguuauguagcauaagccagaacuuuguuggccuguucuacagggcucccuagcucugcccuuggagacuaaacuucacucacacuaagaaaacugugucccuuggguuuuggucuuccauuuauccacucaucugucccucacucgugaucuggaauuuuuacugcauaaccucaccuuggacuguagauuuuucucaugccugucggcaggcuuugcuaaccuuuacccccaaagccccagagagaagaucugcacuucaguagauucauuucagagcagggguugggagaggaaaagcugagauggcuaagcaggguguuaaggcccaagauuccuuuuuuuuucuuucuuucuuucuuuucuuuuuuucuuuuuucuuuuuucuuuuuuuuucucucuuuuuuuuuuuuuuugacuccuagaaagugagccagcugauagugguugucacuuaccacccagagucaguugugaugguuugguguccaagucuuggacagucaaggacuucucuguggccaguuauggccuguguucugauauggagucugauuuaagaacugaaacauaaucucuguauuucaaggucucuaguauuugacuguguauauucugucuuuaaguuuuucauaguacuauacagcaggccccuccuccaugccuguacugaggaugguucuuuauucagucauuuggugacacgguuucuauccuaccacacccuaacagacacacaguaucagagauuguaaugcaggaguggaccuggaagcaugauuuuccugaaaccagcagccuguuuucucugagugaaaccaugaguacagagcccugaucaggauaucucugacugguuuggaggaaguuccuuaugagauuagauagaguagguagcagacuugggacucuguccuccuacuccucagaucuaauagugauuucuuggccaaaggagucucugucuucuuagcaucccagaagauaaccuggcugaguuuucucagaucuuucagaguggaugauuacauuguuugucagggcuaggaucaugucucugugcuaagauuugcucguauaaaucacucugucucaaccgggagcuguugaaccacuaccauaaucuuuguuuucuuucccuacucccauguguacaggagucuugauggagaaauacuucaguguuuuaccauaauuguauccagaaaguuguuuccagguacucaucacagcuccagccccauuagcauacuuacucuccaggcuggucacauggacuacacaaggguuuguuccugguggaccaagcaugcuaaugaugcugaucggcaugcguaggugcugauaccuuuaaggguagcaaggcaaccauuccaaacaggccucgugugggaaugauucuagucuagccuagagcuguuuucuuuuauuucuguagcugaaguguucguucugccuugcagaacuucugcuugcugucguucuccugaauacaggaaacacacacccuggagaacaugauaccugcuuccuagauaaaagacccaaccuuucgauacaugugccaguggcucucuacaacacucagcagccaucauggcuuuuaguuauacaccugcuguuagcaaguugcuucauguggaaagugggaaugagucuccuaagcagggccucuguuaguucuggguugcaaaggaaggggacaccuuguauguauucuaggacaugcuaauuuuuuuuagguaucaaguuuuuuucuauguaaucucauuuucuauacuauacaaauuguaugccugagugaagaugugagugauuccuugugacuuugaaagaaagaggggagacauggaggucagcaaggcagaagcucagggaccugggacccggaggacaugcgcgugcucuuccugggugcuucagguauccaugccaacacuuugcugcuugguauucccuguaucccuuacucucaccacguuucucugucuuugugggcaacacaggcuucucuuguggaaaagcucacaguuaguaagguacuuuugcuccaaagagaagauauaacauucacaaaguauguuuaggugccugucuuuuaaauauucuucccuuuguaguagaaaucacuggggauuauugcguggcagaaauccuugguguucuucaaguucagguucauugccugcugucuauuauaggcaacugagguaagguuuguggguucugcagguagguucugcugucucagcggucaaguaggcuggcagaaccaaaaguugcaagagacccaaucagcaaaggcaaguauuugacuggaucaagcaaaugagaauguauauuuagaaacucaccccagaggaagaacuguggguaagccugccugcucaucuuugcuguaggucagagggcaccca

SEQ ID NO: 612 - RNA, 809 nt, Mus musculus
aacauucaggacugcggcaccuuguaucuggacagggauuugggacugugcaggagacgacuggugguccaguguggcuuaaggacuugauggcguaacccacuucuuccacguauguauuucuugugauaagggcaaugucuaggguaugugggugcuguuuuucuuaccuucuuucuugccuuuugcugucuuuuucccuuggagguuuauuuuauuuuauuuuuacuuuaauuucuucucccuuagugucaucuauuuaagucugaccaggauagaggagaggagugaaccauccccggcuucccacuuaaccuuucacccuuuacccuguuuucuguugguggauggagagacugguuuuccagguuguuugggugucaguguccaucugugcaggcuuaugggaaaggaagagagugagaagugacaagaagcaggcaagagggacuguuuuuccaggcauucucuuauuaaaacgucuaguugugggcaucuggggugguggaagagcaucggcauaggguagggugugggcugagagaaguggggugaugcugggagguugucacugcguaguugagaaaaguggggaaugaugacgcagucacuguugcaucuuguuaggagcucuguggagacagguagugaagcuccugggaucugugggaccagcagaaggguuaaagaugagucuaggugggaagcuaacauuuagagauuaaaugucauccuuuuggcguuggaaaguuguuuaccuugcuuucucugugucuccauguuggcucccuuccaguucacaugugaug

SEQ ID NO: 613 - RNA, 2299 nt, Mus musculus
ugcuaccuuuuucuuuuuuuaagaaugugaaaaugaguacagauuucaauuuuucuuaaucaaauuccuaggugguuuuuuuguuuuguuuguuuuucuguccaagaguuaucuuccugaaguauccacuuggaggguaaaaggcuuggaguuucacucagagugacuguagguguuuauacucaaagcaggguucacccucgcucaguuucaguucggacucacaaucuucucaaggggaugucuccuuggccccucuaugcuacuaaacauaaaagugaaaauacaccucagaaaaggcaauucaucaggaaugacgguuucuucucucagcaguaguuccucagagccugagugggcuggggccugguggaggucaagcucuguucuaccugaguaugaccugccuccagagcuccuucagugcagcugacaacaggagugccacuuacaagggggaaggagcagguauuaggggagacaggagagagaccuaaggaguuacugaguaaaggugaguuccaggcuuaucaacugaaauuucaggauucucacucacucaaguauguaacauuaacucuaaaaucacaugccacccagcagcuaagcacauuuggcagugcuguucaguguuuaccucucagcuacucuauucaaaacaauguaaaaacucaaagaacaacauuuuguaagaaaaacagguuuauauaauuuuaauacuggagaaaagcuauauaguaaaucucuuauguuggaaaucaacuuuaugacaaaucaaguauuuuuaagacaucuugacuuugaacugaguauaguaucugugcauacauucuucuucuucuuguuuuuguuuuuguuuuuguuuuuucgagacaggguuucucuguauagcucuggcuguccuggaacucacuuuguagaccaggcuggccucaaacucagaaaucugccugccucuggcucccaaaugcugggaucaaaggugugugccaccaugcccggcucgcauacauucuucuuuuccauacauuuuuuuuucuucucucuuuguuuuuuuggggggugggguggggaggggugucucauuauguugccuuggcuguaacucacuauguagaugagacuggccucaaacuuagaucugccugccucugccucuugauugcugggauuaaaaucaugugcaggaugauccuuauguaacuuacagcaugaccucuaaauuuggggguuaguaguaauuuuguuauaugauuucuaaacaacuauuuuccuaacaauauuuuccuauguauucuuugguaccaaaaaaaaaauuguagaacagcauauucaaugcucauauguuugggucaaguagaaaaaauaaugcugaaauucacuggauucuugacuuuucugcacuauguugugguauuccucagguaucagucuugaccacaguuuuuaauaagacaacuuacagaugauaaaauaauuaaaucaaucaauauuaauuuaaguuauaccaaguaguaucuaauggaaaacaaagaaaauuacuauuauggaaaacaaaacaugaguuaugcaaauaauacucauuuauggaauaacucuuaccucucacaggauguaauuaaagagaaaucuuagaugaaguaaagaaaaucaugcauauauuuuaaaaauucacaaguggaaacaguuaaauaaaaagcaccuggucagaagcacguagacuuuuaagauuaaugucaagcaguauguugcuuccaagaggagaaagugaacaaaggugauugggaagagaaauggagacguguguggacuaugcuaauuugagacaugucagugaucuuaacuuauucuuuuguauaugugaaagacuagucugacugaauagcaacugaauagcaagcccuggaaucgguccuaucuuugcauccccacugcugugauuacaaagcauggaccagcacaccuggcuuuuuauauugauccugagaauuaaacucaggucuucaugcuuauggcaaauaauuuacugagaaguuaccaucccaguccaaauucuaaccuuuucuuauacaugagagacaauaaccaauacuauagaauacuuuuggcuauuuuuuacaaacuuaaaugaugcuaaugcucuuaaaguauuacuuguacaauguuugugaugagggcuggagaagaaucauuaugcucucaaguuaucacaaauaucuguuuacaucaaauccaguuuuuaaaacgauacuuuaacagcaauuugagaacaucuaugcuuuuuuccaguuauucccca

SEQ ID NO: 614 - RNA, 24330 nt, Mus musculus
caucuucaggaaaagagagcaagaagcaagagagagaagcaagagagcgaaaaagcaagagagagagagaacgaaaaccccgucccucuuaaggagcauucuccuucgccucggacgugucacuccuugauuggcugcagcccaucggccgaguugacgucacggggaaggcagagcacaaguagucauaagauacccuuggcacaugcgcagauuauuuguuuaccacuuagaacacaggaugucagcgccaucuuguaacggcgaaugugggggcggcucccaacauuacacuuuaaagagcaucccuauuuuccauuaauuaugguuagucuuauaugaaaaagaaaacaaagacuccaguacuuaguaauaaauuguauuuuaauagaaacauagcuuauaccuucauugaaaaagcaguuuauuauaaacaacacuuauacacaaaaccaaauuauguugauauuauaguucuaaaaaccaucuugguuuaucugaagagucaggaugcaaccucaacaguaauggccucacacuugccggugucuuggucugugcacgucaccuguaaagauccaucccuaagacagacaaaaaaccauguuucauaagcucguuccuacaaacaccaagucccugaggagggcuuggaaauuuucaaaagaaguuuauuaagauaaauuaaacacaaguucagugucuuuaaauuugacaugugccuuuuucuaggaggcucuuagauuuacuucuagaccucugagaucauagcuauauucccuggaaauccaagacgauaaacguuuuaagacuuuacaaagcucaagacaggucaugccaacuucaaagccaggcuauggccagcccacucuaaauucuuucuaaauaugguuuacagacaauaaagucaaugaggaacuuuuccuugaaauaaacaaugacaagauggccuugcuaggaaacaaacggcgccagcugauuuuaacuaggaacaaauuccuuggaguuucccacagagacgaaaagggacaacaggagacccacaaggcugcuaauuauucaauacacacuuuucucaaaaauagaaacucucacuaggaaaacaacugcagcaucuaacaaaggauuugccuagaaugauaauuuagccaagcuccaaaaggaccgagcuucagagagucuucauaauauuggaaacacuucauuuuguaccuuuucauaguaagaacagcuaauauaucacgcaauccauuuucuuuuuuaucuaaguccuggaguacaaccuguuggugcaaaaacaaaacaaacaaacaaagguaauucagcacuuuuuauuguaaaggaucaaggcucuaaccaaaacaaaccuuuuaaacuagggcagcuuucaaacuaucuuaccauuuagggagaauucagaaauuaaggaguuaagccuuaagaggcuucuaucuccuuuggaaggaggauauaagacaauuaaagcaucugucccucuuuuaugucauauccaauuaacaugauuguugcugagaagcacugcccucaaaaacauggacgauuuugaugcuaagucauuaccaugguaacauggauuacccacagcacacucuccguguauacucggacugcuauccauuucaaagaaauauacagaguuuuuggguaacauuugucagcaagagguauuaugaaagucuguaauuucuuaguucugaaagauagauguuccaauacacccaguuagaaguuuggcuuugugucuuggacucugccaagaucaaguuuaaugauuuuacaaguccccguccugugacucacuuggaaagggugugugaacagacgggcgcaaagaaauauucucuucccagcuugguuccauguaucuucugugauuuucuuuuucuuucuuuuuccaaggcaggguuucugcauguagcccuggcuguccucaaacucccugagaucggccugccucugccuccugagugcugggauuaaaggcaugcgccacccacuacugcccagccugcaauuuucuuuucacaaaauucuucuuucuuguuauuuugugugcacacaugcacaggcgagauagguguguaaaggucagaggacaacuugaggcaggcaguucuguuugaacauuaccucauacagcaucugguauuuaccaaaccgaaaaaucuuuucuccuuccaguugucaaauuacuaagaugagcccagagcacagagaagcagugugaacacaaaaugguuucauucuuauuguuucagcaauuauuucuucucacuuucaaaacacgaguaaguagaagcaacuuaguguuaagaauuaccagaguacauguauuuuguguuaauggagauguuaacugaauggacuucaggaggaaaagugaaauauuugccugagacaaagcuguaauguccaguuuuauauauuuaccugugcaaacuuggccuccucuuuagcagaguucuuccccucagacucauagaguucaaggcaaacggaagacacccucccgggggccugcagugugugcugucuucgggcuggcagcggggucccagagggaaacaguacugugaaucugucggcaccugacucauccacucccuaagagucagcaaagcaagaagggcacggggggggggggggggguguuaaucuuuucaacugaaaacagcccguuacuccugcuguaauggaaauacauaguccucgcugacacucuggaaaguggcagagagaaaaaacagguacaacccccagucccaccucccuguguuuaacuacauacugacacacaguucucucugcauaugcuagaagcugguguuuaaaauuguauuuucauaggaaaucaacauguuccauagauauuaagugacacaacauaaagaacccauagacauaauuacuaguucuuccuguacuuguuacagggcucauuacauguuacaauaugaaugaaacuuacagcaauuguaguaaauuuauguaaaugcauggaaaacuaaacacaccuuaacuaaaauauccuuggcugaacacucuaucaugacagagucaucuccugacgugcucucuuucccaacaagaaucccggcuucuauggcugcaccaauagggaugaccucaucuggagggauagaguugaggagguccacggcugggaagagaucuuuaaucagcugcugcagcuuugggauucuggaagauccaccacacagcacaaccuagaacaugcaggauaggaugagccaucccuaccacacgagaccaugucugacauaacguuacaauauacagugggcuucucagcuuuuucucucaacagauauggaaucacauaauaaauauagcacagcaauagauaccgggcuuaugacuaauaugguacaguuuaaucauauagucaauugaacagaaguaauuaauauucuguauuauuccaacacuuuuaaagaaauguguauauacauuacaucauuuuuauaaccaguaucguuaaucucuucauaagaaaacaacaccauagauuuuugguuuuuuuuuuuuuuuuuuuuuuuuuuuuuuuuuuuuuugccucuacuauggaaaacuagcaagggccuugagaagaaaagauguuuauguuuguaugaaauguuaagcucuuggucugcaaucugaguaaaucucaucucugaagaacuucauaucaaacuacucuguaaagcccucggauuucucugacccauccaaccaucaucccagucucuggcuaugcagagugcugaacacacacagccugggaagggagauuggugucggcugcuuauguaaucuuuuaaugaaggcuucuccaaauucaacgucccugaagcccaguuagaacacgggugcucuugaguuuguggaacgagacagggaccacagcagucugcagggggggggguaaaaagaccaguuguguuugauuuuuaguguggguuugccaguggaggagccagagagagcacccaaggagcuaaaggggucugcaacccuauagguggaacaacaauauggacuaaccaguaacccgcccccccccccccccagagcucuugucucuagcugcauauguaucagaagauggccuaguuggccaucacuggaaagagaggcccacuggucgugcaaacuuuauaugccucaguacaggggaacgccagggccaagaagugggaguggguggguaggggaguuggggcgggggaggguaugggggacuuuugggauagcacuggaaauguaaaugaagaaaauaccuaauuaaaaaaaaagaaaauuuuuccuaaaauuuuugauucuaauaaauacaguacaaaaauguagaauuaaaaaaaaacucauauucaacaaaaagcuauauuaguaaacuguaagcuaacauaauucaacaaaaaauuauuaguaaguuccccugcgggcccccccacccacccaaaaauaaaucccuggaaaauuuuggcuuuuaaugcuucauuuucagaugaaaaguacccaguggcacguugaaugcugagaguagacagucagcucccgagaaacuagguuucacuucacggcacacaccacccuagccauggugcuaaguaccuguucuuacuacuguagugucaggguuuuauaaaauaaaacaucugcaaguguagacaguaccuaccauguagggcuucuguggggauucaacguuuccaugccuauaaagccuaaucguccaucgccuucucuguaagaggaguggccucacgucaggccugucuaggacccuagcuguauacacugucauacuacauagaaacugaagcauuagagguagcagacguccucaaaugcccauccucuuucaggaguccacggggccagaacugcucauggcaguuccuuuaaccuacauccugugacugugaagccagaggagcugccauggcagcagagcuccagccacagucugcuagucacgcggcccggaaccugcuacagcaagggcagcggacgaaaggcagguauggcuuucuaaauucuuaaaagccuauauccacagcaacagucuaaggcuuaagaauacaucaauucaaacaauucagaguuauacugcagugacuguuaaaugccagugccccaaagggaaccgacacuaacugaucacccacaguauguuuccgaauguucccugggugacaggagcccucagaaucagcuacaccauuuaccucuacaguuaaguauugccuccaucuucuaagagagaaaguaagaugcacacaagaaagccgucaugguacagcuauuuguuuccacugaacucaaacagugccccagagggacaccagaacuugagggagcugaggaaacuuuugaagcucccacgaggccugccccuagguuacagaagaguaacacuuggcuuggggacagcaggcaaugugguaggguugccuguaagugcacagggaguuccaggaggcagaugcuggagagcagaugucaucucugcuggugaggguuuucccacgaugcagcugcccugaguugccuauguuccuauagguuaucucccaaauccugcuucuacaccucacuaauuucaagaucuucuagaaauuacuucaucucugcacuugagugucucucuuaucaagcuggggcagaugacaggaccuaccucagagcugguggucacuggccagcaagcacacgugcugcugcacaggacauacuucaguaugugucugccucacauguagauaaacacugggagggaacuagucagguucuuauuugugugagugugugugagugugugugugugugugugugugaagaaacagaauauacacauacacaugaguucaccagaucauuaaacauuaacaaaaguucuaaaacauaaauauuuuccuacaccauuauucccuaaguuuuaaaucugaaauuuuuccuaaaagaaauaggggagagaugaagccuuaccuuguugauaucaucugcugugaauccagucuggcgcaagagcucccggauugcuucuguacauuuguuaaaaagcggagaacagagcagcucaaaucuugcucugcaggcaggcaugaacacgggauggagaagagggcagagcaaacacugagugcagucuggcuucuuggacgacuaacugaucccucaagaacugguuugcauguuaucagacacuuuauaugcaacucuacagcaugcccgacaguaaauccacuagcaugacugaugggccgcuccgcucucgugugcaagcuuucacaggcauucccaguuacaagccuuuacaccugagaucccgucacagcaacauggagccugcacuaagaaggcugcauacugacauggagcauugacacacaucuauccacgaaagcuggacuggcucauuucacucagucuuuuuaaaguuacaagaaaaacucagaaauccccauuaaacucauagcaaguucugcaacugccaagagugccgguuggcuucucauaugcucguguacuauuuacuguuuguuuguccgaguccacauggugcguacacacacagagguagauaagcaccuuuacccgcugagacaccuugcugacccucacuugauuucuuaaaugcaagugagagugauuuuaaauuuucuuaccuacaaauacuaaauacuuuuuuuuuuuuuuuugguuuuucaagacaggguuucucuguauagucuuggcuguccuggaacucacuuuguagaccaggcuggccuugaacucagaaauccgccugucucugccucccaagugcugggauuaaaggcgugcgccaccacugcccggcuacuaaauacuuuaugguugaaaauguugauaaauuccuuuuacacagauaugaauaagcaaacacccagugugugaacagacccagcacuaaggcauccuagaaauagaaacaacaugaagcuucucaaccuuugaagagacuuccaugcacuuccauacaucuccuguccuuugggcuacacuaaagagcuagccacuagccacagaggcuccuugggaaguaucuguaauguuuuccuucauccaacaugacuuuaauuuaagcaucauggagcaggauuuucagaauagccaagggaaggaaagaggcuguuuuaugaaaaaagaucaaggagaaggugcccaaaaccaggcaagagaaucuaugagagcaggugacugacuaugcuucaaagugcuguguugucagauuuggggaaauugcaacaggcuaacgaguuguugcuaguaaauguucaacgggagaggcggggaaacaacuaauuauuggcccuuggguuuagggguaaagauacaaucacuuguaagcccugucgggucauuuaaaagacaagacuauuaaauacaauuuuauuuuaagucuguuuguuaaaugucauaaagauuguuaaaacauaaaauauugguuagagacauagcucaguugguugagggcuugguuagcacguaugcaguccuggguucuccuacugcacaaaguggcacuguggcgcaugccugcagucccaggacuggggaaguaaauacagaaggccauccuccacuacugugaguuuaaggcuagccugggcuacaugagacccugucucaaaaugcaaaacaaaggguugaagagauggcucagugggcaagugcacuugccugguuagggugaguccccagcacccauauaacaaacugggcacggcggcaugugccugcagugccagcacugggaagguaaggggggaccgcugauagcuuugacucccuggccagccagccuagccagaccagcaagcgcagacagcuaucaaucuugagugaagaguaaaaacuacauaguaagaacuuuggaaucaaacugcagcagcuauugagucuuaaaaaaugagcuccaaaucugaagacagggacguucccucaccacagacaaccaaggaaagaaaggaaagcuguucacuggagaaccaccgcggagcagcuaaacuucuggggaucaguuuuaccuggacacauugcaaucaaagucuugaccuucauacaaggaaucuacaaagcaguuggcacuucccaagguugacagagaaugcuuggccacuucagcgcuguucaucaauuucaucauggcucgggcauuuccucucacaucauguuugaacaaccuaaaaacagaacauuuuaaguuuaaagguccuagggcauuuacaauguaaugucaccaaauucuaaacaccauuauggcaauaauaaucaagaaguagcaacauggcuucaaugcuguuaaacuuuucuacccauauugccuggguccuuccagggaaaaaguguuuuuacacuacuuugaauggcuuuucuaaguaaccaugagacccuggucuuuggucugagagucuauagcagacaagccaaucagaccagagaugaugggucaccacacacacugugugcagugggagcucggugcuaacacugcugagcucguggugguuccucacacccccaaaaauguguaaaauuaaagucucucaucugcaguguggguuacuuuaaguaaugaccaacuguuuuguuaagcaauaccuuuauaauaaaaagcagcacauuuuuauuccacgugggaaaucacccuuuaaaaauuaaaaaucaagcuguccucaacuugaguguccccgaguguccucugccgugccuugcagguacugaggcuacaaaugucaccgccaugccuggcuuaaaaggcgcaccgcuggcacagccucuacuucugaggacacuauaauuuacagaugaagacaccuggcuuccacaagagaaacacaucuuccugugucucagaacagcucaauacacugggacuaaagagaaggcucagcuguuaaaagugucagaacugaguucaguuccucuaugucuuagucaggguuucuauuccuguacaaacaucaugaccaagaagcaaguuggggaggaaaggguuuauucagcuuacacuuccauacugcuguucaucaccaaaggaagucaggacuggaacucaagcaggucaggaaguaggagcugaugcagaggccauggagggauguucuuuacuggcuugcuuccccuggcuugcucagccugcucucuuauagaacccaaagacuaucagcccagagauggcaccacccacaaggggcccuucccccuugaucacuaauugagaaaaugccccacaguuggaucucauggaggcauuuccucaacugaagcuccuuucucugugauaacuccagcuugugucaaguugacacaaaaccagccaguacacucuauaagaggcugagcuaccuccccagccacagaaaucuuaaacaaagaaaaggaaaagaaaaaaaauaaauaaaaggacaaguuuaaauugucaaaauaaaccaaggaagaaacccuugaagugaaaucuugaucaaacuggacuggauacucaccucuggaacuccgaagccagguacugugcuaaggugucugugaaaugugcgcccccuauguugucacugguguuuguggaaaggacccgauacaucccacuguuaacuuccaugacacugagcgauaaggacguuccuccaagcuuaaacaccaaaacauugcuucaagagagaaaaaaauggguaaagcaucugagaaucacaucaucuuaaagccagacuguacuuuugaagccauucguuugaauuguuuaugagggcuggagagguggcucagcagguaagagcacuggcugcuuuuccagaggaccaggguucaauucccagcaaccgcaguguggcucacaacuaucuguaaugggaucagaugcuaucuucaggcaugcagguguacaugcagaaaaagugcucauauacaugaaaaaauaaauuaaaugauaaugaagaaagucuacagcccagaugagucaucggcuugucuccagucacccgugcuggaccaagccuugaacuuacaaucuucugaaacuaaaugaaagcuccuuucagucaguuaacuggagaaucuauuuuucugagugacuagguuugaaaacacuaaguuuucaaaguaaaucaaacaaggauuucaugauuauuauaaaucugaaaggaauuaaauacagcuauccuguaaauauuuuauaaguuaauacaacauagcuuauggauccaacccaggacaguagaaaccagcucccccaucauguauuuaaauauauaucaggacucauaauuucuaauauuuuuacauuaaucuguuuaccucaaaauaauuuccuagugauuuauacacauuaguuucuuugaccaugagauauuuggacagggucuaacuauuuggaaagguuaacacuguaucuaaaugaauuucucuaacguguggucaucaacucuguuaacguaacaccagcugucucuaaacaacaugucuaaacacugggagugaaaucaauggugggaguacuccacaauuagccaaucuccacaacgaaaugagaugacaggagacacucagccucuccuucccugcuuucccaucuccgcugcucagcaugacgggaggcgagaauuuccugugugaagguuggcaccacguggcugggcugccagaguccuacugaaagccggagaucugggguuuaccucuucccgguaggguggucuuguccaaucccauaagcaaggagagcugcagacggcucauggaucagccgcagcacguuaaauccagcagcuccagccgccucccugcaaacaauuugcucucagugaauugugggucacaacauacccagcccugcacuuguagcugugcugaagggcucaugcucuggcaaacgauccuccagaagacacagcucgggaaagcagaacccguggaaaggaagugacuagaaccgacuuccugucuaaaaaugcacuguucagagccaguguuuucuauaaaaugguuugcauuuauauugaguaagaaaaaaaccccaacaaccuguuagagcuaugggugguuuagucaguaaauaggccuucuacccaagccugagggucuagcuuugaaucuccagcacccacauaaaacaaaggugugggggugcgugccuguaacuucagugcuggggccgggugugucacacgcacauaugcauuugcaugaucaagucagguggcagggcaggauccuugauaaccagacagcccaggaaagugguaagcgccaggaucagugagagagccuuucucacgagauaaauaagguagagugacagaggauaccugucgggcccucuggccucccaagucccagcagaugcauaugcaacacacaugugcagauacacacaaacagaaagaaaugcaaaacauagcucuccaaaggaucuuuuuuuuuuuuaagguucacuucuucugggcagucucuaggcccugaaagucuaggagcaguaccuggccuccauguugcucagaacauucuccugacucaaugagcacacugucaggauuagaguuagcucugggaggucagagccacacccaugcaccccugugcacuguaccugaauacacuggaccuuaugagguaaaaaacaucaguaauuuuugacugaauaaagaaaucgaauauacgcccaugauuauaaaguuuaggaaguaauaaaaugucuggaacauuauggaaauguucaauuucuuuccuuugggcacacagcaguuuucugcuuaccaaagcacagguagaacuguacagaguagaguaaggacccgcaagcuaagaaucgcaucgcaugacaccugugagggcagaaucuauguucuuugguuucgauguuaaacugaaauaauagucuaguuucagaaauccuuucccaaagucugucauuuagacaaaagccagcauccgcucagggacuuaggaaaauaacuucuacccaauaaaaagaaguggcuccuuaucucgggcucuuccauugacauagcccguaauagcacaucaaggucuacgcuggcuucuaggcucugucacacacuucaaagcuggcucauggggucccuuccucucaggcacacguuucccuuaaagccuugggaauccccuccuucccucugcuuuucccagggacaaccucaaugguuccgaauaaacuucccucuuaccuaugaagcugcuauuuugguuucuuuacagcacccauuucauucaauaauuauuuuuuuuuuuaaaaaacaacauucuuauguauuucccauauaagccucaacgacaugagacaggcaaaaugaugccugaacaacaguuuaauaaccugguaguaaaacagcucccaucauaacagcaagagggcacacaacaucaaugacauuaccaugagauacuuacaauaccaugaaauaaugugcugccuaagcuauguccaaagauagcgucauauucuauuacugaguguaaucuguauuuuaacuaaccauguuaagacaguuacacuuaccccagagcagacuucugcuuuucuccaaagucaaaugggacagugacaaccacgucauuugcaucugagcccaggacagaaugcgcuguuucuguacauucaagagcaaacacaaauacauguaucgugaugacacaugcuaagcaauaaagcucuuccuagcuuccuaagccugagauuuucucaccagagguccagguucugccgccccuccacucccuccuguggcccuuggguuauucagugauuccugugggucucaugauggaugauggacacgggccagguacuguccaagagcuuggcucuucagcuuugggcuaucaaaaaucuacaugagacuggguccagagaacuaguuccaaauucauuuaugagacgagacccuuuguaaggacuaccuugccucucaagauuccucgggaggcagaggcaggcagaguucugaguucaaggccagccuggucuacagagugaguuccaggacagccacggcuacacagagaaacccugucucaaaacaaaaacaaaaacaaaaaaaaaaguguuucucugaguagcccuggcuguccuagaacuuacgguauagaccaggcuggucucgaacucccacaugagccaccaccugggaauuaggacucuuaacuggcagacucuagguaaauauccccaaguuuaaaacaaaacugaggggggcugguaagauagcuuagugguuaagagcacugacugcucuuccaaagauccugaguucaaaucccagcaaccacaugguggcucacaaccaucuguaaugagaucugauacucucuucuggagugucugaagacagcuacaguguacuuacauauaauaaauaaauaaauaaauaaauaaauaaauaaauaaaauuaaaaaacaaacaaacaaacaaacaaaaaaaacccugaaauuguauauagcccugaucccaggcauuucaggcaugaccuguccuuacagggaagguuaaggucagacccaagcaaagucuaacugcuaacucguggaaucgcucauuguuucuccucaaaucuuuguguguguguguauguguguguguguguaacucaaguaggccaaaaugggcagccagcaggccccaagcauacaucugucuccagcuccucagcacugggaacugcuguccccacucuuuuaagggaucauuuaaaguuaucagucagguguuggagagguggcucagugguuaaggacaugcacugguuucccagaggaccugaguucaauucccagcacccaccucaagcagcucacaacugcuucuaauuccaguuucaggggauguuucuaaccucaggcaaugcacagauacagacacauacacagguacauguaaauaaauaauaaauauuuuuaagaaauugcaaaacaaaauaaaguaaguuauuaacuucugugcaguaccuuucauuuuacugaauaucagucuggcaacaucuucuggauuaacaaguuuuguuucuucuccuguaucuauuucauaccgcaacuucccauuuuucucaaugaccuaaaaaaauuauaauuauaccaaauauagaauaauuuaaauaaaacuuuagaugagucucaguuuaacacucuaugucaugacuguuaguaauuaaucuuugaauaagggggagagaguaaaggaaccauacuuacuaagcauuuacuuucugagauguauuucugagcuuguggaucugcagagcuguucauggggaaauauaaagauaucucagcauuaaaaaauuaauauuguagacacauaaggugaagucuguacuuuucaccccacuggacagauaaagaauaugccaacaaaauuauuaagcugcucaauaacucagaagcuugaauucaauggaggguuuacaacagcuguaauucuuacucaucauauuugaaaguauuaauuuucuuguucagaccuugaauuugaacacagucaaugauucuuuuuuuuuuuuuuuuuuuuuuuuucuuugagacaggguuucucuguguagcccuggcuguccuggaacucacucuguagaccaggcuggcuucaaacucagaaauccaccugccucugccucccaagugcugggauuaaaggcgugcggcaccacgcccggcacagucaaugaucuuauacccuccauuuucauaccuacaauccugaagacccaaccaacugagauacaaaggaauuuuguaacacuaaacucacauuuguugcuugguuuuuaaaauuaaugcccaacaccaaauugagcaaaaguaugagcacuguauauagaaagcuguacucuagguauacauacacuaagaauuauagacuaaugccucaaauaaaauaccaaauaacuaaagguaugaaauaaaaaaaaugggcauauuacuaagauguuaauaccaauggaugcaacugucacuauuuuccaacuuaccacccaucuagaccuuauaauaccgagugggacugcauuacuaggcgugcaucauuuuagacacagguacagaggggcuuacacuggggugugccaggagucacuuacaggcuaacagggacaaagccaggacuggaccccagcuauaccucagcagccuucugcuaacaugguaaaugaccacucuaauucuguuccccaaagaacucugauccuuggcuuaauuucacagugacuaaaaugcaagucagcaccuuucuaguagacucccaaggagcuguggccuuucucuacagaguccuaaaaauuuaauaggagcugaaaauuaauaguggacaacagagggccaggagucauuugagaaccuugaccucugccaucuaagaauaggcucauuugguuuagaacucuggaaucacaugcagguucaucuuaccuuucuuagaucaccaaaaaauuaauuugagaacaaauuaguagaggccagagguaggaagcuugccccaagcgucaaagcuaauuaaugguguaauuggccaacaaccagaccuacaguguaggguuuaggaaauguuuuuuuucaugaaauuucuuggccuucauuuuuuccaaacuauauggaucucauccuagauauuauaagggaggguagaaaaaaaaaaaaagacaaaacaucuccagcguaggaauuuguaccauugcccuaaguuccacauaauucucauguguucagaacagaauuuaacuggccaggaauaucuacugacuguagagaguguaaguuauuaacugauaacauaggguuauuuucaagaaagguauuuucuggaauugauugaauuuuagaaauucauuucuuagcugucaugcagagagggcuucuucaucuggguauaggaugcacacauaggcacaggagggauaacauacauaacuagcacagguagacacagaggaagcaggacggaagugacaaagggucaguuaccaugagaaagaaguagacaaacccacaacuccacaccagucaaaacuuuuauuugucuacagcaggauuaaguuacaugacaaagaugggcaacuggucugcacagcaccugguucacaccaugcccugcaggaggagucuagucucccauugcaccacaaguucuuaccagcaacccagcaaugcaugcccaccuuauccucaaguaucucuuacaguggcccuggguuuggcaacacccgugcucacgugcuguggguucuccuuccccacuccugguaaaccccagugucuacaaaucuaacugaacauucguucaucugugcacugauccucacaacaccccugugaaguagguaggacgggcgaucguuaguucccauuuuaaggaagaaccugaguuacagaauggugaaagggaggagguaacuugauggaggagguacuggguuagggcuaaaguucaggcaggacuccagccugccuuccugcacauggccugcaccgugcacugucuccucuaccacuuugcauguuuuccuaauaacucuucaggaccuugagauuuauuuccuuauuuuguuuacucugccuaucaggguuuucaagauaccucaacuuuaacuccaucucugcuccagccugucucucacgucagguagaggcccaaccacacacugccaccguuagauccuuacuagguaguuaaauacuuuucuguuguuuccagaauacuauggucuacauuagcuuuauuugguuacaacagauauguacuuucuacaucauggccucaaacaaaagacaacacacacuuauauauccacuucaaggaaagaaaggcaucaguggguguccauccaguacaaggcuuagagcucucaccagcacagugauaaauguccacacuacagagggugccuuuaaauacagccauaaacaguauuucaaacguacauuaacagccacugccugaaaauacuauaaauagcucaccucauuuuuaccuuuaccauauuauuuaaaauucuagaacugaaagauacuauaaaaauguaguagaaauuccucaacuuggagauaaaagaaaucgaggcacaaaaaggguaaguguugcccccaaugccaacagcuguggcggggacggggcuggaguuggguggucuagccagauuccagcgaaguccacaacacacugcucaggcagucagcgcucacucuacagcuugcccuuugccaccuacuccugguuccaugaggucccaccauuuuuuuguuuuuguccuuuucuuuacuaauucaaauguccagcuuccacuaagccccugacuacaaugugacacucccccgcccuacuccaaaaucccaaagcucucccaacaccuguucauuuucuccccggcuucugaguggcauuuaaauccccagagucuuaccugugauucuagaguucuacaagacccacuaagaaccaguucacugaaggccaacaaccucacagggcugugguuuacugucaccaacuccucuccaggacgugugccugggucaggggaguguacuugcucggggcgugagcuugaagagaaccaucucugggcagaggucuuuaccacuucuagcauucuccaggcucaagagcaaagggagcugcucucuaucaucacaggcacuaacccuaccaacucuuguuuacaucacuuggaaaaaaguuccucuggaucuaggcuugcccucaauuacaugguagggcccaaacaaaacacccacuaacagaaacaaagucaaucagccacaaguagauuggaaauggauugaugcaaaugcauuaauccaaauuauuuccauguucaaaugccaaccacaauguaaacacacaauuuaugcauuuaaagagccucagauaauacuaaaugcaaagaauuuacuuacauuuucuacuucauaaaagucacuauuuuaccucaucaaaaucuaucaauaugagauauuuaccucccacagugcucaaauagcucaucucuauagagaccaggaacuaguaaaaugaaagagagaaaccugguuggaccaagggguguuugcuaguagguaggucagggauacagcagugaaaauguaagagacaaagacacaaaugcaauugugccuagacuagggagccacagagagauguaagaaguugagaccucuaucuaagaggccaacaaauuaaacagauaaagacucaagcaaugaggucacaggacacugcuauaccuguguauguuguaaacgaaugugcuuaccccagcuccccuuagccaagggcaaaugcauuaauaacuuacauuauacagugcuuucaaacuuucaaaccuuuucacaucuauaaacuacuugauccucacaacaacccugugagguaggcagggcaggaaugacuacugaucugccuugacagaugagaucgugguagagguaaagaaaauugcuccacacugugaggaagcuagaacaaacuagcucuuggauuugauuccuucugguuucuaccaggccacucuucauuccucaagggccuuuccauuaguggagaaucuuaggaaaaagaacucacuacucuucugcguauuaacaguucaucuguuccuuugucugaagacacagaaaggagccaggguuccagaaggugguuguuagaaacagacuuguaccaguuugggaaagguguccauucaaucaguuccuagcuuuugguauuugaaaucaaccucugaagcaacuucucaagcccuugcuggaaagccccaguugcuucuuccacugcuguggccaagcgucugacugcgaugacagcaucccugcgcagcucauuggcagugucuugcugggcacuggccuccucaccaauagcaaucaaccuguccagcuucucuuccucucucuuggagaguucucgcgccaaccuccuguuuucugccaacucagaugaaaugguucuggccacugagcgccuucuucgccuggcccaccuuggagagggcucccuggucagaggucuauccccaccagagagaaaagcaacucuugaggaagagccuggaggcugugguguggaggcugccccaggaggguugcggcuggugcuggugcagggacuugacucccucgacacacccagucuggucaugggguugcucugacagggggcaacugcaccucugaaaagguggugggagcugcuguagcugggggucccuugagagcacccugaaaaacaaagccacagcguugcagagaggacauuccgcuaagggaaugccugcagccagcagcagagcugagacacaaaaauauguaauucuugggaaggccucuuuccacaaggggauaaaagggaaaugauucuauaauguggacauuuuggcuucuuuaaccaguuauaaaaauggcaguauauuccccaagacgcuuuucauguggcuguccuacucacaaccccuccccccauauauuccuaaguacccauuccaaauaaugcccaaagccagacaagucacucaggguuguagcaucugccuagcaugcacaaauaaugcccaaacuaggaugcuuugaaagaccaugucuuuacgugugaagaguuugacuauauaccagggucauagguaagaaauuggaguacuguauuuagagagggggcucaaugagacagaaaugagaguuaugcucaagagagcgcuauccaaucuuuuaacacuaucuaggaccaagugacucuaagacccagucccucucaugcuugggaguuaccugcacccaaggagucaucccaggagcccucaaggucacuggcuucuugugucuggucacugauucuuaggugacaauccucauuugauuccuuaacuguuugcaaaauacgaugaugacaagcugucuguguccuuuucauuucccgaaugcuggugcccucuugcccuggcuugucagaggcuaccaaauucugauaacagugcuuggcccaagcagcagccuccguuaaguugucugggucagucacuaucugguuucgaagaagaugauccaacguaucauaaaaugggcagugcggugggucccccauacuuguggcaugggcaacguaggccuuuaaauacaaugccuucagaacuuuaaacuuggagcggcacuggcguucggugcggcagaagcccuccugcugcauucgccuagacaccgccugauagauaucugcauugugaugccuagucuggaggcgcuggauguacucugccucaccuaggauggagagaagaguucgugucuccugucuggaccaccggaugcccgcacugcuauuagugguugccauggugggcagggaaggaaggcuacugaagcaagcucccaggcagcagggcacaguuuucgaggcguggggaagcucuggguguucucagcauguuuccaggagccugcugguucuuuccucccagggcacucugcugagaaggcaggucugaggaccacacuucuggcuggaaggccacaggggaacgagaguuacagggcaggugugaggaucauccuggcagcaagagaagccgugcuaccugugugcagauuccgcagcauauggucaagacuuugggaguucauccgcccauaggaagugauggacuguggguuuaauggcuugauaacaaaaggacucgcucuucuacaagggcuaagcgcauccauggcugagacccaagauaaccauggcugguuaggucaagaaggaaacaacccgaccaugaggcagcuaacucaagagaagucuuagcagagccauggccuugggucugucugaauggcacuggccuuuuacuggcugcauccauuuaguguggugugccuguguguuacccauuggacucacugcugcauucuuacuaaaaggauuuaaccuucaaggccagaaaagcaagcuuaagcuggucugcugauacaaaguacauaaucugaaaagugacaguucuggaggcauaaaggaaacaaauccaaacacuacuggcuucgagaggauccuacagaaaggcucucugucuugacugaaucaacauuaguguucugguugcgaugcucaacuauagucuuguaggacaauaucacugacagaaacggugaaucuaauaauauacuggucaccuucauucucucacaggaaacgaaaauuaucuccaaagggggaagguuacuuaacaauuccuggcuccucaaugacucuggcuuugagaucuuucauauacccccacuuacaauucaaaaacauuuuaugccaauuuuuuguuuuguuuuguuuuuuuuaagacaggguuucucuguguagcccuggcuguccuggaacucacucuguagaccaggcuggccucgaacucagaaauccaccugccucugccucccgagugcugggauuaaaggcgcgcaccaccacgccuggcugccaauuuauuuuuaauaugcuuaccaguacauuuuaauacgcuuaauaacaccuaccaacauuaaugaauauaggauuauaaucacacaaaaacaucugaauucauucuuuaauagagugauaucaaguuuaguguaagcagucaagagcucaugaaauaaacaugccuauguaaaugaaauauucaaucuaauuaacaauccccaaguuuuaaauucaauacaaagaaaugccuaauauuuacauccuacuuaaaugaagaagaaaaggcagagggagcuaaggauuagaaguccccaccugcaggcuuaucuaauucaccacuguaauuugggaaagucacaaauuccgggugccuugaccuccugauaccuggccaaccaguuuuuauggggauggagaggauucaauagcaucauagaugugaaaacacucaaacaucgccaagcaccacacuccagaggaaaugaaagggcccuacuuauuaggauaaucuaugauucgaacagacggaagucuggggaagcaagccucuggaaucuucuaauuaaagucauaacagauaacugaccugcuucuuaagauauuaauuaaacuguuucuccagcgauuacauuugugagucaacuggaaaaguuaguucccagaaagugucacaaagggccaaggaggaaaaucaauaguagcugaagaaauuaugaccagugauaagagauuuuacaaaacucaaccaccaugcagagaaaucauccaauuccaacaaaauaauucuaguucacucaguucaaggagauacaagaaugcaaaaggccaaagaaccacuugugacuggcauaaaugacuagaagugagugcuggcauucacuaauacuaugagaccugucagcaagaagcaaacuucugaacaaccccccuggggcucucccuaaaguaaccgccauuaaacagucuggagugucucucguuuccuuagcauucugcccagaaugugcaagcaugguuugaauguuuggcuaccauaccuuaaaguacuuuaugccauaccuucugccaaggaucuguuucacuuucacuacugugcuugaaacaugucuuauucuacuuuguuuugcugccaguccaaccaccugaaaaagaacugcacauuaacaacaagacucugcauuauuuucaagaaccaccgaugagaguacucgaccguaccuguucacguuccgaguaagcaacaauggcuggugugacucuauccccugcaucauuugcaaccacaucggcccggccauccuaaggaaagaugugagaggguuaguucucucacacuggaaugcacaaucucauugaauauaccugcagauuguaauggaauuuuagaaaugccauuguaucuggcauucacucaggugccugagugacacccauucaggccuuaaagucaucuucuguaaauaaucagugaugggacuuaugggguugcucuuccuuugggaauuucaaacugaggaauugcauaaccucaguagcaagacauucuuggcaaaccaggaauuuuugcaaugguugauaauugcuuaggcaauggguccuucagacaacgagaucagagaagacauucugguauucaguaauugacuugccaaaaggccuuuuuuucguaacaaucaauaaaagcacaaggcuacccgaguucaguccucagacuacuccaccuugcaaaaccuuacuagguuggcagugucucucuuucuuagauugucccucauaaacuggucuuuuaacugccacuauuuguuucuuauaguuuaauaaaaggcuucuucuagcccaugcauuuucccguuuagaucugugcaguaagcuggaucaaauguauacaacauucuauaccuagcaagcaugauuacacgacucucccacaaauacagcuuuuccaccugcuucccuacaaacgaaguagcuacuccccugggacuuuccugauaaaucgaaugagacuuaaaaccgaagauagcaucgguuaaauuccuuaacauuguuccuucuccaucgauauugaggaggaaaaagcuauaguuccuuguuaaguucucaguucuagaaucaaguguguacagcaagagucaguucuuaacuaggaacccuucucucgagggcaguuacacagugcucugguugcucagaaauucaaauaccucccaccuccgggaaccccgaaccagugacgucaccgugaccucuuagggacucugcggucaguugucacuaggacuucucuagcauccaggggguccugacauccagguuuguucuaggcgucuuuacaagaacgaugucccccgccccgaggacuccaggcauccuggagcccugacgucuuuugaacucuucugggcauccuauggcccggucuccuaagugcacccugcaugcuugaggccuuuucgucccuaaaacuccucaaacagccaagacguccaggauacccuggaguauccaagauccggcucucuguauccacccuccacacagcgugcuuggccuuggagggagagccgagaacccgcaacauugccacuugcuugcacgcacgguucccgggccgaugacccggagcccagaaaacaggguggccgccacggaacccggagacagcuucccaggcucaccuuguagacagccacacaggcugaugugcagcccaggugcacgccgaucgccgccauaaggcggcggagaccacggcagcucaacgaaggacccuucagcagcuucagcuagcuuccucggaacaagcccaucaggcacugcggagacuucacguucccgcccgccuacugcguccggucug

SEQ ID NO: 615 - RNA, 504 nt, Mus musculus
aggaagcggacgcgaggcgacaagauggcggacaaagagaaaaagaagaaagaaagcaucuuggaccuuuccaaguacaucgauaagaccauucgggugaaguuccaggguggcugggaaaccagcgguauccugaagggcuuugacccacugcucaaccuggugcuggaugggaccauggaguacaugagagacccugaugaccaguacaagcugacggaggacacucggcagcuggggcuugucguaugucguggcaccucgguggugcucaucugcccgcaggacggcauggaggccauccccaaccccuucgugcagcagcaggacacuuagcagcaaaggagagcgguccagccccagggaucuuccuucuauggggugaacuucugugugauguuuuggucuuuuguucuuguuuuguuuuguuuuguuuuguuuuuuaauaaaauugcccaugugagcaaaaaaaaaaaaaaaaaaaaaaaaaaaaaaaaaaaaaac

SEQ ID NO: 616 - RNA, 1300 nt, Mus musculus
aggagugaggucgggccaugguggggcagagguugggaagauggcguugcaagguugggcacagcuaggcuggcgcugugguccggcgugggcgccucccuuggguggcggcuaccgggagcucucugcgacccaggccccgcagcugcuuggacgcagguuuaacuuguuucuucagcaaacguguggauuuagaaaagcacccaggaagguugaaccucgaagaucagacccagggucaaguggagaagcauauaagagaagugccuugaucccgccucuggaagaaacagucuuuuacccucccccuguccuauaagaacucuugugaagcccuuuuucuucaccauugaguucacaggcugugcauuugggucagcugcuauuuggcaguaugaaucacugaaauccagggugcagaguuauuuugauggcauaaaagcugacugguuggauaguauauggccacaaaaggaggaaaccucggaaaggagauuaacaagugguggaauagccuaagugauggccagcggacugugaccagcaucauagcugcaaaugcccucguguucuccauguggagagugccaucccugcaucgaaccauggucagauacuuuacauccaacccagcaucaacaaauacguauguucuguggcgcuucucaucuagcaucgugaacauuccggggcaggagcaguuuguggcaguguaucugucugcagguguuauuuccaauuuugucaguuauguguguaaaguugccacaggaagauauggaccuucacuuggugcaucgggagcaaucaugacugugcuugcagcugucugcaccaagaucccggaggggaggcuugcuaucaucuuccuccccgucuucaccuucacagcuggcaaugccuuaaaagccaucauugccauggauacagcugggaugauccugggauggaaauguuuugaucaugcagcccaucuugggagagcucucuuuggaauaugguauaucacauauggacaugaacucauuuggaagaacagggagccucuagugaaaaucuggcacgaaauaaggacuaauggccccaagaaaggagguggcucuaagugaagcagagcuggccaguauggugcaucugauccuugcugcuuggaaagucucagcaucggccaccccagugauuuaaauguccucaguacgugucuccuuagcaaauuauggcaaaguugugaaauaaauguuuauaucucuaguuuguaaaaaaaaaaaaaacaaaaacaaaaaaacaaaaaacaaaaaac

SEQ ID NO: 617 - RNA, 78133 nt, Mus musculus
agguuuccuguuucacccuggacaugugcagccaagcucuuucucuccuucaugucaagaccaagugagucguaguuuuucugugugcuuuuuccuggcuuugaguaucuguagcuguuuccuuccuuuucauuucuguuucuuuuuaaaagcuuguucucuguauguagauuuguuuugucucugcuucucugucucucauuauuuuggacagaaauguaucaagucucuagaucucuuacagaaagagacacugccuauaauagcuuacuguuucuuccuuacaugaacuuguguaugaaugguguugauaacaaauggcuucuccacuugugaggaaacucgagcugaguaaagcaggugugugcaucccuguggcugcaaucacuuucagcuguuuguuuagaagaggaagguccugggacaggcugcaagcugaggacaaggcagcauguccugagcacugguggcaaaugucugggaugaaccugcaugagugacccuggauuagacucuggcccuuaucguuccuucuaauuuguguuccuccaagcacgauccagugaaugcagacauuagcuagagcucuguuucauauuauaguugguuagagcaaacaggagaauguuaucagugggaaaggacuuuaaaaguccaguaaucauuagcaguuuaaaugugggagacaugcuucucuaagcagaguuaauaagaaaaccuucucuggcaagauuucacauucucugaaguuuggacuuugcuaguaaacuucaaguagaucaaacaguuuugcuccccaaccaagucuguuggcaaaacuacuacuguggaacguuuuguucauaugaagagucacuuauuggguccagaggcgaaugaaggacacagugaguuaagugccagucaccugguggcagagcugaaaccagaaaaaacaaaucucuguagguuuguuuauuuauuuauauucacguguaugugugugaauucuguguguguacgugcuguuggaaacuaggagagggaguucgaccuccuggagcuggaguuacaggcagccgugagcaugcaacaugagugcugggaacugagugagcaagcacuccuaauggcugggcccagaguuccugccugaacucaucucccuaguccuggucuagcuuccauuuccucacuccauggacuugcuugauuauacaaacccaagguagaugaagaaagauggcaaugaacuaguuauuagcuauccagacauucugagggauauuccugccuauggaaauguuuuuacaacaaaugucaagaggaagaaaaaacaaacuggaacagaucauagaaacuccucagucgacugugguaugaacguccucugagcuaguccugugaaacaagaauuacagagggaugaacgucacuguucagauggagaaacaguugaauuaucuguuaaucucuacuguuagcucucuuaauguuuuuacaggauaagccauugagcaccacccccaccuuucuuccuuccuuccuuccuuucucucucucucucucucucucucucucuuuucuuucuuucuuucuuucuuucuuucuuucuuucuuucuuucuuucuuucuuucuuucuuucuuucuuucuuucagagauuauucauuuuaaacacacaggaagaccucaagaaacccuucuuuucugguuuuagauucauguaaagaaaaagaugugaaacucagaucuuugcaccauuuggcaauuguuuauauggcuaacagcuguuucucuugauucuuugugauagcuacaaaucagaaccaggauuauacagagacccuugcuuuuaaaacuccaaacaguauagaacauaugucuuuuaaaaaggaaauaaaauguuuuaagaaauacguagaguaaauuuuuugaaauuaguucuucagcucucuaaaaaccauggcauuuucagucaguuuaugggauguagcucaggcaagaaguuugugaagugcucuguagugggugaguucuacugggagaauauuuauuuuuauuaucauuaaccaugagcauauuuuguuaauauacuacuagcauauuuaauggaauauuuguauuccuuugcucauaagugcucauuugguguauaggauauaagauaacucauauaugccauuucaucccuucugaauuaguuacuuguuuucuuguugugacaaagcauccgacaaaaacaauucaaauaaggaagggcuuauuuugucucacagucagaucaaaccauccauggugauggggaaagcaugcagcaggagcuuggggcagcuccugcauccauagucaggaaucagagagcaaucagugucacuguuuggcugguuuacuucuucuuccucagccauagaaugguaacacccacaucuagaauggauccucccaccucaauuaaucuaaccuagaaaaucccccccccccuuuuagaaggcauggguccacugucuuugcauaaaaagccacagaacuuuucccaaaauauuccacaagugaguucuauaaaugaagucccagggugauagacuauuggguuacgguuauauaauaacugugucaaacaggcaaucaaaauaagcagaacauacuguauucacgucacucugcuauuuaagugauaaaauuggggugacauauucuuaacuuuguuuuucuuuucccauuuuucuguauugaggucaccagggcucagugaacacuacuacauguccaacuguggagucugggugacugaauagaaauaugucuaaccaauuaucaccaucacaagcauucugaguccuuggauuucuggucuaccugaguaacugcugaacucuuugcaggauacauccccagggcuccuuucuuuaaggucuuuacuuaaagcagaacacuugauguuauuuauuuucugugccuguggcggucaaauggcgacauguaggaggcgcuucuuucuuccuuuccaccauuuggguucuaaggauaaaacucagguuguugggcuuggcauuaaacaccuuuaccaaccgacccaacuugcugauccaaguucuagaaauucuauggagacugucuuucugccucuguaccagucuacccaugugcauaauuguauggauggaauucuaaaguauccucaaaaauugcugaccuauaaagcacccauaucuuucucaauuucuucuaccauaaacuaugcccugucguguauuagucaguuuugcauuaccauaauggaauaucuaaaacaggauaauuuuaugaaaaaacaaacaaacaaguuucauuuacuucagggguuuaucagcuaaaagugcaggaucaauugggcucaguuugauuucugucagagcugaugcuaacuaaaugucaucaaaaccugggcuaugugugggaggaagagaucacaucuugaaacaggaagucagagaggcugaccucacagaaucucuucugaaggcaggcucccaaugacuuacugaccucccaugaggcuccaucucuuagugguccucagucucccacugccacacuuccaacacauuagcuuuuugggaagauacagcucaaaucauuuucaaaccauuucaucuugugauggaauuuugaaguuucagggaaggccucauauugauugguuguaagacacggagaugaucugaccuuucacuagaggcuaaaauggaagccauugauuagaaaugcugcagaauuuggcaagucacuacuagauuacugguggaaagggccaugcacugaagcaugugggaagaucugaggagcuuugaauggcucugauugacaaccggcaaaacccccacgaacuuuagugcugcaagcacaggcagaaaauucugccgucgauccaaaugagcuuagaagaagaccuuaggcuccaugacugggagagugaccacaaacccugucaauaucuugaauuuucuuugugauuuuuuuuuuuucagagaaacuaguuaggguggaucugagcugagggauauaugagugguauucuaaaccacuuagucuccaguacuuugcuuuacaauuuugguauuuuuaaaaaaaaauuauuauuauaucuaaguacacuguagcugucuucagaugcaccagaagaggaugucagaucucauuacggaugauugcuagccgccaugugguuccugggauuugaacucaggaccuucagaagagcagucagcauucuuauccacggagccaucucuccagccccacaauguugguauuuaauaugcuauagaaugaacuuuagauaccuacuggcuuacaacccaaucaaucuuaugucuugucuaaagccuuucuucuuuagcuccuuucucauuguuauuaaagaagagacaaauauauagaaauuuaauauuuuuguuggucuaucaguuuaggacauaagaccaacaauaaauuaucagaccuaccaaaccuaucuuguggguuuaauguacaaugauuuugggcuguuuauuaauuagcauacaucucuggagacuauuccccucgauuguccuauugauuaguuuuugucaaguugacauaaacuagagucauuugggaagauugguccucaguugaguauugccuccauccgauuacuacacaaaggcaucuauagcuagagaagagcuugggauugcaauguauauuccaaaguaguaugggaagaaagacucugccacuagugaugaguuagaugaucaugcugaggaccuagugaacaggguuagugaccaagcugacaguguuagccagcuucuggcauucaaggcuacucagggcaaaccaaucccuggaugcccuccaaugacagagccaaacagaggcuacacggaacaggauggagacaucacagcugagccgugucuacguugucacagcacugugagcaaauuacucaucuuuauguuaagacccaagguuugacauaauuguuacaaugcauuaaguaaugaauguagacauuagaaaauaugauauggguaaaagucauggcuuccacauaggauuucaaaaugaaaauuguauuugguuuuuuuuuuuuuugagugaauuauuaacucacaugagacauaguaaagauuucuacauaugcaaggauuaacuucuuuuagggcacaauuaugcuucuuucuucagagcccccucacaugaugguuaggauacaaaguaugggcugcaugaugaugcauaaugaaaaugacaaaaaaaaaaaggacaaaacccagcaugucuuaauccaaauugauuuugcuuuacuuuaugcccccaaaugcccaaaugcuuauuuuuaucuuucuuuaguuuucuuuggggaaucaauuugagguuccucccucauaucacaguaagugcacaagacuaaugccaaguucacaagugaccuuauggaugagugcuaaguugcaggugacuacauacguuuuccaguaauggaagaugagaggaucugucaucaugguggguuaggugacucagaacacccuguagaggaguuuuccuuuugugcuucaucuggugauagccagucuaccaaggccccccauggaguggguacucuaggauguccagcuguucucagaaguuccagguucaccugggcaacaagcacugaucaccacuaacugugaugccggcacugugauggauguugugaagcugugaacauaaaugauucuaacuuuaaagcccuauuuccauggucugcccacaauggcucuagggauaaccaaauuaaauuaguuuacuugagcuuaccuggaucagaacccugugguucccccaggguugugaggcauuuggcuuccuaaaguggauuucauacaaggcuguugucuacugucaauugaauuuaaaaaagaaaucaaaguaaauauuuucucucauucuuauuuguuuugggguuaaagaagaugugguacccaauaccacagggcaggcuuugaaggcauuuuuuaucucagauggccaaacaaaccauauguuuccauuucucugagagggcagggaagguucacuuaucauguucaggcagucuacccaauggcuuggcaucauggacgcugguccaguuuguuuuggagggacaagucaggugcacugguaggauagcgucuuaccaaagugagaguccaaagaaugcuucuuaggucauuugaucaggcagccacacaagaauaccacagacugagagguauaugaauauaaggcccuuuacuuuauuuugaugcaguuguggggguuggaauguaagagucacgaagccagaaagaucguuuucugguaaggccucugguuucugaauggcugucuucucuuuguguccuugugucuguguguccauuuguccggguauccguuuaugugugugugugugugugugugugugugugugugugugugugugucagagagagagagaacgagagagagagagagagagagagagagagagagagagagagagagagauugggaggagaagggagcuugucacuuuccuuccuauaagauugucuugaugguuaauaguggcuguaagguuuacagggucuagagucaccagagacaagccuugagguauaucugugaggauguuauaaagguuagguuaauugagcgagaagccccaccugaaauguggcugaugcuguuccguaggcuguggucuaggaccacauuaaagggaggaagagcugaguaccagcguucaucucucucugcuucuggaugguuggcacagugugaacagccaccucacaccccuguuacaugccuuuccuauagagguauuuauguccccuugaacuaugugucaaaaaugaauacauucuuccugaaauugcuccuuccagguauccugcuucagcaacagggagagucacuaauaauaaacuuaugaucccauuuacugaaauuacuucuaucuagggacuauuggcaaacugcuccauugggauagggguagucaggauuucaauuuguauaucaaggagagaauacaaucuaggcccuagcacuucuuauauggcacaugcuaaauuaagcccaaggauguauagauaagcuuauaugucaggcgcaaaaugcucucagggagugcauauuaacagugaugugauaauuacaaugcugugcucaggucagaugggaagaaugaacccauucaguuagagcaggucagggaaggcuuuucagaggagccuuagacucagcgagacuuuuggaugcugggagugguuagaaguauuccaggcagaggcagaaucccacugucaguggucacagagcagcagcacaguggcugagcagagccccaggugcuuagggguguaggaagagcaugggaccauggucaaggugguuucagggaaggguacuuuccuuuggaggacugcacuaagcagcuugaacuucaccuuguagcaggaauugggaaccuguuacacauuagacauuggaucuauaaugcuccuaagagguucaugcuuucaguguguguucuaagccagugguggugcuuggggggcuacgguauuuucaggguguagauugcuagcagugggcuuuugaaaaugauaacuggcagcuuauucuacucuuauucuugucugcuucuggacacucauuuguaaagucaccauuggauacaccagccaccgggaaggacacaagcuugugaaacugugagcccaaguaaacccuccuuccccuguuucuaucagguguuuugucaaaauggcaggaaaaauagcuaaaacaauagauauuguagcagcagcagcagcagcaccugcugcagcaacagcagugguggaucaguuuugauuuaaaaguucacccagaaagcagcugggacccugacacaaugguggcuaggaccaguuagaacaccauuaccauacuguggucacagagcccagaggcaaguguggugggcacuaccggagauggggaggggauagcugcucauccuauucagaacuuaggaguugaugucaguguggguagggguaggagucuaggcaggaucccucugcuuggagacuagggagccaucagggggagaggaaacuccaugcaugggggugaauggcagaagacugcgagugaagcacagcagagagccccugggacugggaaggcucugaggaaauuauuguuggcuuaccucuaugagaaagcggcaaaggaauauugcaaaguuaucacuauuacgugcuguauuuuagacuaaugugaaguaaugugaauccuggggugagugugucuauugcuccuggauugggaggaugcccaggagcuggcuaagaggacucuguaagacugaaacauuuggaauagguaauuugcucauugaaauccacugacagcauuuuucccccugugcaaauaugaccuaagcucuuugagucagaaaaguuuccuaauaaauaaauccuuagucaucuguugccaagaaaaugaaaaggcuuugguauggaauccaucaaccugcuggccuuguucucacccugagacagggccugcuuuugaacucgugauucauguaaauggcugaacucgugauucauguaaauggcacccuuggaauuuuggguagggcagggaaacaauucaggagagcuagagaaugaaauuagauuuuuuuuuuuuaaagaucagaucaguccuuccuugaucuaaauucuccaucugcccuuuggugaggguggagaggaaagcccaggucaguggguucugagccuucaguugacugugacuuuauguaauuauaacaaacuccuuuuuugauuuucuuccaaaaaaaauauuuggcaggguuucaacagaccgaagagaaaggggugggggagaacaaaaaggagagagaacacagagauacaauaagagauacacaguaacauagagacauagacacacaguaagagagcuacagauacauaaagacauaagacacagagagacagaaaggacaaacagaaagagaaacagagagagcaagagaaggacaaacagagagacagagcaugagagggacagacagagagaaacacauauacaaaggagagacagaaagaugagaaauaaacucaaaagcagaugcauaaugaauuuuaaauugugggccccgugaacuugcagcugacaccuuccauuagacaggugacaacuuuuccuuccaccuuccugguccuuuccugggcacccaagcaaaggaaaguaaacccgcacaacagaggccccugccacaugaccaaggauccagagcucucaucugaguccacuagggcaaagcaaggcugaaagcucggggggcguggucggccguucgggggcguggccuaggaguugggcgugacuuagugaugacucagcggccccgccccguccccggcccgccccgccacuuaauucugacgcgcgaggccgccgggugcgagagccgccccgagccggacgggcuucuuacuccggcguugcaaccgccgucggaaccgcccucucgccaccucgguggcuaaggugccggguaccaacgccagcagcggagcgcgccagggagcagcgcgccuuugugcgagguaggcuggccccacacuuacuucucacacaaagacgaggggcuugcaaggcggccgcccgccgggagaaagcgacgggugucugaccccggccugggggacccugucguuggccugcagggcgggcugggguaugcggucccucgggcguaggcgagcagcggggagccugguggcccugcgcugcuuggggaggucuagggugcagggcccgggcggcggcccggaucgaggggcgccggggcggaggggcccccuggagaggggggaauccaggcugcugcuugguugguucauuguugcauccucggcccugcagacccagaccuuaagacccaggcugcaguggcugcgcgccccgggccagaugcccgccuugccugucccggcagcaggacagggucagcgucccgaagccggcuccuacccggcagacaaaggcggggucgugcugcuuugaaaggugguagugacacuguuuccugucugcaaguaacuuuucuauguuggacucugcugugccucuuggaguccggucaagccaggggguuugggugaugucagcgcagaaguccccacauuuuugggggacucagugauugccuccugaaacauuucuggaugacugggagguaaucugguguauaagagccaaguuuugacaugugugcuggaagugaagcguccccagcucucuuugaaauguagagaguuccuguugagaggaugaagugcacacaccagccaucccaaucccuucucagauuuuuguccaggacugcuaagugagguuacuuagucagaauggggggugauacuggaggcgccaacaggggaacagaaggagcccuguuuggcuugacuuucugaauuugagccucccugcuaacagguacacuuucucuaggcaugcuaccucacuagcauuuggacauguuaaaguugcucuaaauccugucagagaugccugucuagggacgguuccuuaguguuuggaguuucaggcuuuacaacuuugaauuaauaaucauauauauuugugauaaauuaaaaaccagaagauaggucacucauguggccaccacccacacauacccugaggaugaagguguauuugcuuuauagguggcagggaaguuuguguguguguguguguguaugugugugugugagagagagagagagagagagagagagagucuaaaugaacacauuguuaauuccuaaccuuuauacuugucuaaagcaugacauuuaauaaugauaacuuugcaauguuccuuuuacugcuuucacagaggauuauacuaacaacuuguuuuggaauauauuuucucagagcuuugccaguaacuauuuauucagaagggagaggcgggaagaugaagggaaaguaaugugcuuugcacuucacuggagauaacacaaaagacuuuaucauguauauauauauuuguauggguauaucuaaaucuauaucuguauacacacacauauauccauauauggauauagauagauauauaucaggaguagcuugggaccguuuaaaagguaaauaaauguuuuuacugugaaaaguucugagaauccugagaaauccaggauggaaagagcugccuguagaaagacuagccguguuuuccaugugccucaugcacaucucagaaaguuuguguugagaaaguaaaauauguuuucauuacagugaagaguuucgagugucuaaaaggccauucagcuacguacuuggccgguggacaucuuugucauuacuuauauuuuccccuuguaaaaauuuuggucuuugaguucuuuaguaugcaaagcagaaagaagccuuugagacagcccuuuagaggcagggugcucaagagaugaugaaguauucugcagucauuucugaagcaggagacaccauaggaggagguugggacagugugcugucaggucccauuugcaguuuuucaucugcuuuggguuccuuaauaugcaugcacacuuggaguaguugcaggguuguccccuagguggugggcagaauauuuugcccuccguagugauuucuguugcuuuucuagucauguacuuccuaacagcaucgagugggauggaagguccaggaggaaacagccgugugcccagucucauuuccuaccccucugagggcuuugggcugugugagcaguacaggcagcuugggccucagcucagacuuuaggagucccauguagggcuagagcuguugcuggagagcccgcuccugaaguacauaaaagacuuguacucuagagacacacccagagcaaucgaguucuugcccagaaggaaggcaggugcucuuacuaauugacuaauugcuccgaguuuuguuuaaaaugcugcaagcaaaggaagaaggauuuuucauuuuucaguuuuguuuuuuucuucugugagacugagggauagaaaacuuuuucuuccacugaaaggggggacacagacugaauacuguggcuuaguugggguuauugaugucuaaaagccccuucccucuggaacacgcugugcaggagugguuugagaacucagacuugggaguuugguucagugagaucuggauuuuaagauguuuguggaaguccauauauaccuuggugagucuagaaguacuggggagagaaacuggccagcuuugggguucacugguuccauacugggaaagcuacuguagagugaagaucuauguauagcuggucccacgggaacuacucauagccuugugucuuccccggucuaaucuuuuccucuucuugcuuuuccuguuuaaagcaaucucuuauuuucucuuuuccuuucuguggagaagugcugggccuuuuccaucugaacuuuuccucacagugaguacuuacugagugcacuuaaagggaugaaugcuuuuauccaucggugccucaccccugaaagaauacauuuauuugggaaacugacuuggguuaccuuuggaaaugguaaaucaaugggggcuguuucugagguugcuggaggaggccagacacugaguuuguuguaguuaacaagaugaacuugguccuuguggcagaguaugugaggaugauauuuuaagaauuguacaaagugacccccacguuauuuaauagcugagacuuucagagcugugaauaggaauuagcacuguuugauuuaagcuccuuuaggaagaaugagagaaaccacagggaaacauggggaauacguuccuaauccuguaaggcagauacuugggauacccugggaacaugaguugcccagggcuagcugggcauaguugaacuaacugaugagguagacugcuguguuuugucuagaauuuggcugggauauugggacaguuucuagugcagcuucauuguccccacugaaggggucaguagggccaucagggagucaauuguuguagugaugugguguccugacuuagagauucugagaaaugaguguuggugucacacagagaucagcagacuacagcuguguuucccuccauuucuggaaauucuauuacagaugaagagacagcuagaggagcuugugggaaaauagauacuggcuugagaguguucccaaacucagcuggaauacaggaaggaagaggggauagggcugcauuuaaagcagaggaaugccggacaguucuagcaaagaugucacucaaaguggaguaucaggcgacgagcagcuguacagcugggccugugguuggccugccguauguagugguguguguguguguguaugugugacuuaugugagaucacaaaggacaugugcacuggcauugaugacaguaauacucacuccacacuccacaggcauggagcagcaauagagcuugcugcagggguuaaggaggcccuccucagccccccuccuugggcugcuguugauuaagccuuugcuggucaugagacacagaaagcuuuaguuagggaauuugcggggccucuguaagcuuccuaagaaugaguuauuaagacuucucucuaacaggagagaauacagcuuacaguuugaugaccucuaaguaagucacauagccccugugaacuuuucuaauuugugaggcuaaugugaacuugguaauacugaccuccuaugaugcgguagguaaagaccauccugaggcaguggcauuccaaggcauggucccugagacuuggccaaucaccaaguuguugaugcuuuccugucagugucuguggccuuguaaaagugcacuuaaaaguuugucaugauagggcgcugagagauggcucaguugguaaagcauuuccuucacaaacaugagaaccugagaacggcuugccagcacccauguacagagccccugggcaggggaugauuguaaucuagguucagggaggcagacaaaggagaguaccugggucguguguguuacugcuaaccacaggcuugguucugagcagcuacucucuaaaagugauagcuugacugaaacuuuacggcuguugacuggaaguccccuuuucuucucuccucagccucuuucagcugucauucuucccuuugagucugugagcuugacucuuggauacuucauagaaaugugacugugcaccccuggcuccugugcaaugggcuuccuucccucaguaugacaccuucaagauuaagguuguagcauacuguaggcugaguagcauucuauuguaaguguauacuauauugauccaaaaccugcaaccuguugguagauagauagguguucccacaagacuucuagaagagaacaggaagccucuaugcuauuggccuuaggggugaucucguggcugugacacccagaacacagcaaaaaacagagugaauggaccccgucgaagcagcgcagcaaagcugugagcagaaaggaaggacaaucugcagaguuaguuaugguuccccagccauuuagcuaaagagggcucuucuccaagucugucaagaacuucaguagugaaaaaacccaauuaagggcuucggagcagagucggcauugcgcgcagccuuguaacugagcguuuuaguaaggcagcaugccaugggcgccauagggaugcuugaagagggcagggcuccaucccucucuucaccuugcuuuucuucuugucauguucgcuggagcauuuuaaagauuaccuggcugugauguuaggauguccauguugucuucucuucuugcacucagguuuuggccuccuuccugaagugucauaaugaggucuguaagagugaaggcuauuguuuaugggacggauccccagguugggcagucucuggaugguccuuccuucagucucagcucugaacuuugucucuguaacuccuuccauggguauuuuguucccccuucuaagaaggauccaaguauccacacuuuggucuuccuucuugaguuucaugugguuugcaaauuguaucuuugguauuccgaacuucugggcuaauauccacuuaucagugagugcauaucauguguucuuugugauuggguuaccucacucaggauaauauccuccagacccauccauuugccuaagaauuucauaaauucauuguuuuuaauagcuacguaguacuccauuguguaaauguacuacauuuucuguauccauuccucuguugagggacaucuggguucuacugcggaugccaacaagagcuugcugacagaagacugauagagcugucucccgagaggcucugucagugccugacaaauacagaauggaugcucacagccauccauuggacagagcacaggguccccaaugaaggagcuagagaaaggacccaaggagcugaagggguuugcagccccaaaagaggaacaacaauaugaacuaaccacuaucuccagagcucccugggacuaaaccaccaaccaaagaaaacacaugaugagacucuuggcucuagcuguauauguagcagaagauggccuagucagucaucuaugggaggagaggcccuuuguccugugaagguucuaugccccaguauggggaaaugccagggccaggaaguggaaguggguggguuggugagcagggggaggggagaagggauaggggguuuucggaggggaaaccaggaaaggagauaacauuugaaauguaaauaaagaaaauaccuaauuaaaaaaaaaaagaaaaaaaaauaagagugaaggccguggaagccugacaccaauguuccuaaggugugcacucuugagagggaagggaaaagucaggucucuaagcugccugauauaugcuaaugagacuuaaagacuugcauacucaccggauaaaaucccauagucuucagcgaguacagguuauuuaugaguuuccaagguagagagaugaaaauuccuauguccuggacaaaguuaagaaugccaucguggacaucucuauguagaugcauaaugugccuccccuacaauaauugaugucauuugaaauagguaucacugugggcacaagugugaccaaaguucauccgcagucucucccucccuccuccuuuccucuguccuguccacucuccuccacacucuuucuucuucucucuucuucagugguugcacagagcaguauagcaugccugaaagagagaagccuagacuacagcccagcuuccugggaguuagugcaugguuugagacaggcuguugagcuuucuccuuuguuagcugaguucauucuaucucucugccuauguuacccccauguccuuuauaacuaacgaugcauccuaugcgggucaguggcugcagaagagcaugcccuggguggggagugucucagagcaugggcuacgccuuaggagaugguguaaggagacagggccuggacagauaaggagaacacaauacauuuccuauagguccugcuguggugaccaguucagcuacucuguguucauggaaccugaaauguuauacacuaaaguuugacaugggccguuagggauccuauauucuuaucugugaaauacagugauagcaacauaguuacuaccaacucaaagguuuugaucguguccuguguaguagagugaaccuuguucauucaguauuuaggaaugcugauguguucuaguccauauggcagucccuaggaucuggggcuagaacagacuucuuuggaguuagcaugcuaguguugauagacaguaaaugaauacacagaccagguagcucuuucauugugcugccagggaaacaagcccagcucagggcugcaaccugcuggagaggaagugaugcuuuuaauugggugaggguccuauuugaguuuugaacaaaugcaacaagucugugcaacccacuccagucucucugaguagagcaaaggggcuaagauccaugggugcuugcuauagaaggaaccacaagaaggcuaauguggauggagccagguggguggucaggagcaaggcuuccagaugaggcccucuggugaggaaacuugcugauacagaccccaugggaggguccugugaaggggcuggaagagucaggccuugccugucuguggcucuggagugagucguggugccugagcauccggcacaggcauaggaagguugguagaaguagaugcuccaguagcuggaucguauauuuugaagauagggccacaaugacuugcuaauuauuuggaguugauauuggcuagcagaagaaucaugagugacacauggucccagacaccaggcaaacgaugaugucauuuucuggaugagaacgaauggcugagaauugucucuauaauacacugugcucucugagauuaguacugcuuuacucuuguaucagagauggggaaaccaaggagcagagaaggugagaggcugugcugggagaggcugggaaguggagaugggacacaccugagacccuccgccuuuucaucucacguuggcuccacugucugccucugaacgaggauggcagaugggugugguuucaugugaauauaugucuuuuucacagcacaccuugguugaaauuggauuuacauuucauugaauguacccauuaucaauguauaguuccauauuuuuucauaauuuguaggcuuggcagccaccauccugauucaguuuuagauuccacagucagcucccauucccauucucagcuuucggcaaccagggcucacuuucugucuccacagaguuuuccauuucagaaauuuuggacaaacggagucauacaguauaccauuggguugacuuuguucagcuaguuaguguuuuuugagacccacucauuguuuuauauguuuuauaagucauaugcuuuuaaggggcauucuuggccuuucuuagaaggauguacucugcugaugggaaaagcauccuuaggauguaccuuaagaugacauuaauaaaaauaguacucaccgaugcacggcucuguaaacauuguuaucuuucguguucuucuaagugauuccaugagggugcgucugugguuggugcuugaucagggaggggccugaagugcugagggacuaaagagccuguccagggcgagaggcugagguaagguccaggcuuuggcucuucccaucccauccugcuggacucuacugacugcguauuuaaagcuugcacagcucagcuucagagagggcugagaacauaggcuugcagauaaaucuuaauuuguaacuuuaagaaaaguguuuguuguggauuuucaguuuggcuuugccccauggagaugauggcaucuuaaagcgauccuucuauggggcaguuuucuuaggcauaacaucagaguggcaccagauuaaaagcacauaauuaugccauuaggcagcgcugcgugcuugaguuauguuuuaaauaugaugcuuaccagaaauacauuuuuguaugaaguacccugaggcuauuuaugaauuuacuguuacuggauggaauuuaauuaggcaucauacauuuuuaaagaugauuauauaauugcauuagauauucuuugugccaaguacauauuugaacaaguuuuuuucuaucuaugugacauuccuauuagaagauuucauauccuguaucgaagaaggauuccuuauguauuacaaguauucuggaguuguggaagacauuuucaacaacucauucacagcaguagcucggaguuggucacguguguuuagcuuggguaagcacugaugagcuguggcuuuuuaacagccaugagauguuuggaauaaggacagacuuuacacccagauuccacccuuggucucugcuaagacacucuucgcuagcuccacauuguucuaaguuucuaaaauggaauugcagcaugguuacacuagcuucucaaugguaguauaucuuccaucuuuuaggauuuuguuguauaauccagcuuacuaguucacagccacaacuaaaacccuacauuucuuuuuagaauaucuaguuuuaagaagaaaaaacaauaacaauuugaauuuaaaaaguuuuccuuugacuuauuuuaacugcagagucugcuuuuuuuuuuuucuuaagagauuaguagguaugaugcuagacccugacaaaaaucaaaucccaccccucuggaccccacuugaucccccucaacccuccuugagccucucccucuccaagcucccagaggcagagaugcuagaauggaacauuguucaagaggcaaaaaucucaguagcuuuucagcaucacugucucccuaucucucaacucccagcaucuugcucacuucugcuucgaccucccuguuagaacacugacuuuuuuucuacaaguuucaguuaaaacccugggcugcuauaaacuuauuugcaaaaguaccugggugggaagaucuguaaguuuuuucuugggguuauccccaggaucccccugauuuuucugaccucagaggcuuccccuugugagcugaguagaacacaccauccuugcuuauuucuguugcuaggccaggcccuuugccccuuugccugaggggugacugaaagugaugucaaccgaaaacucaggcaagauguggggaagcccagaagucuauugaauuugucacugucguuuuuaauauuggccucauuucuuaauaaugugcuguagccuuauuauaccuaguuucuuugaagccagaucuuuaaaauguauacauguagugguuccaccucuuaaggcucgauaauccacagggccguucuuccucagcaccuucuuccucgugcuguugguuguugucuaguagaaaggcccacuuccuugacugggcugcaguguguuuugagaacuuguucuacaaguucuuguggucuguaaacuggaacuuagcaccgcugcucuccuggguucuugcucuuagcaccccagcucuuuagaaagggcuaaguuguugguagugacaucugcuucauguugcaucaucccaaggcgaugucugcugucacucacagcaaugugaacaauggccauucgguuucuguguugacagcuugauccuucauugugaauuucccccauugaccuuucuccuaacguuguuagcgucuauugaugaugguugcuugaguuaaguauuucauuggagauuguuuaaugagcaaguuagcaagugugggaugagaccugcaauggccagaguguccagcaaaccaauuguuggagugacuuaaggacaguggggacuuaauagagaaaaacagaauggcuagacuuucccauuuacugcaugcaauguauuuccuaccaucaaaguuaauugcuauuuauaaaucuuauugugucagguaaguuuuauaguaauauuaacuucuguguguuuaugcucuuauagcauauagcauagggucuuacagcauaggauuacaagguacaguaccauguggugguauaguccauugcccauuauuuucuucaguagucaguugagcuuuuuugauguuuaugaacauguauaaccagacuuuuuaggaaaggcaaggcauuaauaaacuuacaaaggaguggugcuagagagaaagcucaguggcuuaccucccuucaaaggauuaaguuuaguucucacaaccuauguugggugagucacagcuccagaggaucuaauuccuucuggcuucuauggauaccagcacacaaggcacauauacacauagagcaugccugcacacacaugauauacauaaauaaaauuauuuucaaaaggggagaaugaugggcuugagagauggcucagcuggugaaguacaugcgaaccugaaugugagacccagaacccauacaaaaucccagagugcccugcaugucuggaaucccagugcaggggaaacaggaaaaggaagauaaugggugcucacuggccagccagucuagcugauuugaugagcuccaggcucacucuaaauauaaguaagguagauggugauuaugaaagacaccugacaucagccucuggccuucucauauaccugagugcacacagaaccauguaggcacucacucacacauauacauacauacauacauacauacauacauacauacauacagagagagaaugaaugaaugauaaagaugacuucuuccaaaacauaggagaaauggcaguuuucagcuugagucuuacgugguuuggaaagauggaccacugccauguuuccagaguagagaguacuccuuuuaaaggacagugucacagcaacugaaauuggcucacucuccaagcaagcuacacgcugccacuacagucagaucuggggauacccucagcauuugaugggcauggaaauauauugguuccuccuguguggaugaucauucucuugguauaccauagcgugcuucuggaaaccacauuaugacaaggaucaucaucacaacgguucuaagaguugggcauuccucccacagugccuuaaguaaagaccaugcuuuugacugugcaguuggugucaaguaaaucuuggcucugaccauaagguauugaaaaaagaugaaaccuggaaugauagaagauuuugacauuguaaagugaugcuaacaaaagccacagaaagcaggaggccaucugauuuaauccauuuuugaggggguugggcaauggugggcaaucuaaugcuuagauguuuagggagccuucccgagacugcacaacuaguggugguugcuuggagucuaaacucacaguagaaaaacacccuaauaccuaauguuuaugugaauacuaaaugauauaggacuauaacuaacgugucuucacuaaagcagaaacauuccauaaucaccagcucacaaauacuugaucauacuaacaacagugguccugccucucuuccucucuuacuauuuuaaugucuuuuuuuuuuuguuguuuuuguugaaggaauacaguauuuuauugccccaaaacauucuuuccagggccuucuguguacccugaagagcuguaugaauuuuuuuuuuaauugguaauuucucccagcuuuuaaaaaggcauugcaugagcuuugggcugcuagcugcuucaaguuuccuagaaaaugucuagguauauuuggacggauaguauguuuuaauaaguaucuugagccaacucacaugcaaaagaaaaaaaaagaaacaaaucguuccuuugaucauuucuauuucauaaaaucacuacauagucuuuaaauacuugaacagucaccaggaaauugacuugggagccaccagggaauugcucaucccuuucuuuucccuacacugggcaguucuagaccugaggcuuucugaagguaccucuggggaaguguguggaugguagguggggaggaauucaggcccuaagucacccacucuggugagagggagggagagaaaaggugucuggugccgacuuccugagguuagccuuaguuccuugaggcagcgaaggcugcagucaccccuucccugugcagcacaggaagcucagagagcuugccccagagcuguucauuagacuaguuaaccguguuaccagagcgcuccaggaucagauggagaacagcauccacucggauacgguuuguucucugauccaugauucauacaguuugugguaaaauagaaacacgcuuggcuuugcagcagcacuccuuagaugugcccagagaacgcuuguuugcuuucagugccccuaaauuacaauucuuugugcacuuccuguuucacaguuaauggcugagaucugugacucuagcaacacuguuguuuuucacuccaguccguuucugcuagaaacuacgcagccuguguacugucuggaacauguugcacgcaugugcuuugagaagaacagcaugcauagcugacuaauuucaaaaacagccuauuuauaguccuucagaguaauugucagacacuuggucugugcgcuuuugcucacgucauguggaucaacauggcuuuuuaaauggagauaaauuguuuuuuaugugugggugauucauuugauacuucucuauaaauucauaccccaacugugucucugaagugugucacugcaguaauagcccagggaggaguuuucaacaauuagcauuggauucaauaugagauggugcuuuagagaacuuacaacucuguguguguguguguguguguguguguguguguguguguguauguguguguguguguagaaaagggagggagggagagagggcuggagggagacuauagugucuguauauggguguggagaccagaggaggauucugaaacucccuaauguauucguaugcccuugacauagucucuuacugagccugagcuagccugauagugagugagccccagcaacacacuugccucuccuuccacugaaccccagagugccugggauacagggauaugcauggccaccuggcuggauacagggauaugcauggccaccuggcuggauacagggauaugcauggccaccuggcuucucaguguccucaugcuucaucucucccuagcucuuacuuuauaaaacgugcugaagcuguggagucacacaggaccuaaaggacucucguccuugaccucuaacuuacaacagcauuguuggcugucacacauggucuugccuuaucauaccuagcccaugugcuugccaccacagagaauacaaacaggaacaggaaacggaagucacuaguuacugagcuggugaugguuuuauugcgaggaagaaaugaugaaguuugaaauucuguguggaagaaucagguuccuguuuaucuuguagaaagucuaaaacauauuagguauuagaaauaguuucucauauuauauacaaaagccucggcauuuguuuacacgguugagaacuuucuuugcuguuucuccauuuugacuuuuagggccgagagacacccugugguugaauauauuugugagguuuuuguaaauaaauauaagagaaauguguuuuuguagauaaacaugagaauaaaacaugaguuguucucauggugggugacugagacaucucaaacaucaccguagcccuagucuugcaggcuugugacaucacuuauugguucuaacagcgcacaagagagaguaagaacuugauguugccuagaacuggguguuaugugagaugcccuuuucccucaugaacucaggaguucucaucuuugcuuucugccccucaaugagcuggcagguaaaguguaggcaccaugucuauguguaggugccaguagcacccuccuuguguauuuccccaggauggugucaugaugugacuucguacaugacuguugacguggcuguccaauggcaugagacuuuugaucucauugguacucaagagaauuugucucagauuugggcucuugugcuuuaagcagugguagaauagagauaagaggggcagagggcucaggcuggagcuuugggaucaucuuugcuaggguuucuguugcugugaugaagcacaugaccaaaaaccaacugaggaggaaaggguuuguugggccuauccuuccagcuugcuguucaucaucaaaugaagccaggacaggaaccuggaggcaggagcuaaugcagaggccauggacugaugcugccuacugccuugcucccauggccugcucagcuuuucuccucccccaauaacccaggaccacccacagggagcugagccuucaaccaugaaucaagaaaauguccugccaggcagugguggcauaugccuuuaaucccagcacuugggaggcagaggcaggcggaauucugaguucaaggccagccuggucuacagagugaguucccuaacagccagggcuacacagaaaaacccugccaugaaaaaccaaaaaaaaaaaaaaaaaaaaaaaaagaaagaaagaaagaaagaaagaaagaaaaagaaaaaagaaacuggcccacagcaggcuggcccacagccugaucucauguucuuaguugagguucucuccucuuagaugauguuagcuugugugacauaaaucucuccagcauaaaagcuaauugaagaauggaggggacaccucucggcauaaaaguguggguggcuguuaguuugggcugcuagauguugagugucuuaagugaccaucauucccuucuuauuuagaggcagagaaugccaggaugaaggcacugucagggucagaguuaggaagggccugcauucagguuuauggauacuucuugcuauauccugacauggcagagaggaaaaguaaaacacuuuucuucaucccuucuccaagggugugaauucaucacaagggcucgacucugcauuuccuucacaaugucccacuuccaaauacuauggcauuuuggcuuaggguucaaaaggauagauuuaggagugacacaagagacgaucugugguguaaccaaagcgaucagugguuuacacuccaagggaagguggcaagguugguucugagauacaaggagguguucugcagagaagggaggucuucagggguccaggauggauguggaggugaaggguugggagugggaaugggagaaggaacaguguugguagaggucaggaaucuagcacauaaccaaccagaacuggucacccaaagccaggagagcacugaagcugagaggugaccuugucuaggguguuugcuguuucucacaggccugcuacuugagaaguguuugcugguugagaguagcacuaugcucaagcaagugagauccagggucccguguuaguggcaggcggagagcaggaaagaaacuagcacagggucaguauuuguccaggcuugagugauuaguccagguauuguuaguaacagcgucuuugugcacucuuaaagcagugaugugaauguaguuguuaaauacagacacccagcgugcaugcacaugguugcagagagauacucauugcgugugugagugaagauuugucccacaggggcuucugugguguguugaccgucauuggagagaccugguuguucucuuugcauauuuacuguuugaauucuaaaagacacugugccuugugguucccugagcucucuucucuggguuuguuuuagaugacugucuguuugcucagcuaauauggaaacuugaguccagcauauugccaugauaucuguuauuguagcucuucuggauucucuuaggagacaguggucuuuucugggagcuccuaggagcuuaguaaaccccuuaagacauagcuggcuaggacuguauagaaaaggaggcaggggaaugcagaagaagaaggagaggacgcugaguucuuuuacuuuccagccuggugagaauugguuugggaagccuuauuuuccuugacuucugggaagguaggggugagggagugaggucagcgggaggagucugggguccucagaguugcuucuucaggcagaaagugccccaggcuuaugguacuuguggugcuucaagagugagguuuuuauuugagccguuuuauuugaaggcuaccauauguagauuauuaccaugcccgaggugucuuuguuuguggugcaaggggauggaagacccuggguccugaacgcugugggaugggaaagcguucccaugggacaugccuuucccaccgugggguuguuccugugcucacuugauuaugcauugagguuuuccaggucuggcuagaaacaggaaucuguuguuccaaucuuugaguccccuguagggcuuuccugcuuccugaaguugggcuccugacacugauguggcuguacucaggcggaugugggguuaucuccacgggggcugagugcgcuucagaacgcccugucuagcucacuccccucagcuggugcuugucggaagcugagaucugcaggaguagcugggaauuccuuuauaaggcggugucuccuuuuguguuucuaucauuuuuguuucacgcauccugaguccguuucccuaagggccgugacaccagcaggccucagggagaaagccucaucgugcucuuugaauggcaucucaaccauagcauccaagcuuggcuccuaaaagugucccacagggcugaaauucagaaggucuucuuagcaagagauggacuuggguuucuuuuccuucccucuguagcugcuucuagcugaacuuuuccuuuuuccuccaucugcuugauaacugcaagugagucucccgucuccacccacccuaucuugaugauuuggguggaguggugugucccuuuuuaaaaaacaaagcaagacaaaaacaaaacccuuaaaacacacuaaaacccagaagggcagcuggggagucgguagugugugcucagaaggugcacccguauccuguugucagagcucugcggucugucccgugguucugcacugcaugccccuuauuaguaacagguagacgcccugcagucuggggugcauauaucuggaucuuagugagaccccagcucucguuagccaaggggucuauccucacuucuuuucucuuuccagugcuuuaaguuaagacacggugugagaggauggaauuccacuguuuggguccaccuucugugucugcaguucaccaggcaaguaaaguaucuaucugccugaguuuguuuccuugcgaguagaauaggaauggugcccuugaguggguucacagcagugcagucacuugccccaugugcccguguagagaaagcacucaguaagacagcuggcaacauugcaggugcuuggcacugagagcauguaccacaaagcucuguucuugaacauaggcuugcccgcguguuuacuuucuagucauguccgagugagccuucuggaaacguuacaugcauuuauggggacagcacagcuaaggcacuuugaagcugagugguguguccaaucgacccaccccuccacauccagauucaauauucacaggauaauaacaguguuauuaauuucgaggacagagguuuauucuagugucccacaaccagaagagucacaaaggauccgccagcacuaagcuagaauugaaauggccaaccuggacagacaucugcugcaauuguaaacaguauggaaccuuacaguaugucuuauaccaaauggacaucauuuuaaaacacuuggcugguguggaaaccuucagggaugcaggaaguaggcgucccaggcacgucuaggugucuguauaaggcugcaucaaaagggaugucucuagacauuuucuagaagaguugguuucuaguggucugaggcuagaccugaggucuccacguauaagggugaguccaagucuggucuugcugcugcucuguccuuggccugguuuccacuaaugucccuucuuguacuugccuaggccuuuccuguucccuagcuaccucucuggaaaggccugcagaggccuuggucccucuucaccugcuuuguuucccguccucaaagcuuaucagguacauuguagacagugugugugugcuuguuauugcuggcccuuccaucuuguacgagcuugcucugugcacacaggcaugugguguguuuguccuuaauuuacuggagccuaagguguccuucagccuggggaaccuccucucaggcuagcuaaaguagcaggacaugggcucucuagcucuucaucccugaggauggcugaauacuccucugucucagugaguuugcagacggaaaggauauuuggggagauucugcagaauacguuauuuugagauccaucuuggucugaaguuaagauucugggagaagugaauugaaagccaggcauaaucuaugccuuuggccuuuaacagcuuuuuuaaaaauagaaauuaggaaaguagccauguguucauuguacuugcauuuguguguggaugaaugaaggauauugucugcacuguugcucuuuguucuuuagcuaagccaugugggaaauggcuucuacacccgugugcuaggaguuuuuuuccuuucccuagagaaaaauuggaugcuauuuuuuuuucuugcaaaugaaaaauauguaacuuuuugguucuggacaccaggaagcagguaauucaguuaacuuucagaccuggaaauuacauuauuccugacccacuuuguguauuggauccuuugacuuucuaauucuacuuuauuuauguacuuguauagcuaacuuaauuuauauguacaacucaacauuuauagugccauuaguuuucuugaaaaaauggcaaaacauuuaaaauaauuuuauguucuuacaugggacacugaggaugguccuucugucucucucuuucuuucuuccuuucuuucuuucuuucuuucuuucuuucuuucuuucuuucuuucuuucuuucuuuuccuuccuuccuuccuuccuuccuuccuuccucccuccccuccccccucccucccuccuucccucccucccuccucccuccuucccuucucucucucuuccuuucuuucuuucuuucuuucuuucuuucuuucuuucuuucuuucuuucuuccuuccuuccuuccuuccuuccuuucucucuuucucucuuucucucuuucucucuuucucucuuucucucuuucucucuuucucucuuucucucuuucucucucucuuucucucuuucucucucucucucucucucucucucucucucucuuucucucucucuuucucucucucuuucucucucucuuucucucucucuuucucucucucuuucucucucucuuucucucucucuuucucucuuucucucucucuuucucucucucuuucucucucucuuucucucuuccuuucuuucgguguagaugguauauaaaauguguguaugucugugugugcacauguguuuaugugggcaaaugugcagcacagugcccauguggaggucagggaacaaccuugggguuacuuguugaagacaggcucccauugucucuaauguguauuccaggcuagcugguuuuagguuucagaggauucucugccaucuugucgguggaucacugggacagacauaaacagaauagggcagaacugcaggugggcauagccgucagagcccauuccuaaugaccuccuagccucagcuuuauauguaugcuaaggauucacacugaacugagccaucucucaagcccugcagccaaauuucuuuuggagugagaccaccugacccagagccuugcccaugcugaguuauaucccuacuccuuaauguuuugcuauaagguauugaauuaauaauuaguuaauaaacccaaugcaggguugcuucccaccucagugguugauguucuggaacaaaacacacacacacacacacacacacacacacacacacacacacacagacacacacacacacacacacacacacacacacacacacacacacacacagccuuuacauuuuaacaugcccuaagcagaacaauagcugcuuaacugccuagccuccgugcugcuagacucuaccucccucagauaaucccgaguuacuacuuacuaguuucugucuuccaucuuggcugcucuuaacuccaauuugucagccuucugggccacguuuucuuaaagcagagucuggggugcucuccuggcuucuauaccccauggcagccucugugucuccucucuccuaaggugugguagaucuccuuccucuucuccugguccguaaaauccugccucugucuguccucuccagcuauuggcugcuggcaucuuuauuuaccauucagaaccaacugggggcagguucccagaagcuauacaaacccucuugugcaaacagguuuuuugggggggcgggaauaauuagcauuuguaauauaagcauguaauuaagguaaugauguauguauguauguauguauguauguuaaccugaaacauuugauccuccuguuucagucucccaaguacugggauuagcucaacuugaauuuaaaauuauguugcugcuguguguuuuacaucagagagagggucuggaauacagaacgccuguguuugcacagguaggcuuuguguuuguuuggcuuugcucuggauagcaguuuuaugguugucagguugaaugugguaguagaugcuggccaguaauccguucagcucucauggcuuuuacccgauuuauuccaaucgugagauucuuaguuacuuuccccuuugaaguuaaauauuuaauauuucagugcgguuagaaaccugccuucugaguacuauuaugauucuccgauuuugcuguuucuaggacuugagauuuucuccuuggugguguaguaccuucuguuucuggaaccccaccagaugcuguggccauuuacaaaugucagugugcauaaacuacuuaggagagagcugcacuuuaauugguccuuaaaguugugccaguggguaacuauuuuagcugaaaauuaaggaaagaauuuacaaaaauuaguuuacuuguuccuuugaguuuaaugcuugcuacaccauagacaucuucccgaugcuuguguugggggugcauucuuaugagaggccauggaaaugaauagacaauaacuuuauuuccacuguaauucugacucugucuuuggaugaguuacuuuucuuguuucugagauagacuaccugacaggaagcaguugcaagaggacaggugcuuuuggcucgcagcuucagagggauugcagcuugcucuggaguggugggagauacggugcccugggagaugagggugugauggugcccuugcuuugagagucacaaucacaagguccauauuuggugaccuacuuuccacagcuauuccucaaauuuaaaggcuucauaacguauccagauagucuuuccauuuggggagcgaauguccgagcaugugagcuggugcagaccauuucagacucaaacaguaguagccuuacgagaaaacauggggucgcguucuuagguuuugcuugaguuuaaaugaaaauguugugucuuuuuuggggagucuggccgagagaugauuacgugagugcagaugaaaucacugagcacacucuggacaguuuggauucuguuaccgucagcccucagcagugauuuaugaggcaggauacacagauauccuuuccugcccaguucuccucauuuuaaucucuucuacaauagucauaguugucuuuacugagaggugagugagagagcaagugugugugugccugagugcgggugcuacagagacaggaagaggguaucauaucuccuugggcuggauuuauaggcaguuaugagccuuccucacauaugugugcuaggaacugagcucugauccucugggauagcagcaagcccucuuaacggaugagccaucucuccaaucccaauaguuaaaauuucauuuuguaacaggaauucccaaaaugacuuuuuucuucuacaagaaaguauaguucguagcuuucuugccuucugaauggcuuccugaauggaaaauaaguccugcgggcugcugugguuuauuuuauaaacagggcuagaaagcgaacagccuggcaagcuccucaucucucagcaacucugagacggguuccgcgccccagugaagacuugucauauuuauaaaccauuauuauuucagaaucaucaaaggaaauguguagcgauggcagggaagcagcuugcuuauucuggaauuuucuucacuguauuuuuaacauugaagaaauuacuaggaaagcuuuggcaaagugaagacagaugcgcaaagaugagacugaguucguggacugcguuaaacuccugaguggggcaguaucuguaugacaugggacaagccgguuacccucuggagugucuugagggaagcugggggggaugcuucacauuaacaaaagcuuuagauuuagaaauggagacuuuaucauuuuacucugugacugcuccuuacuuuauucaauuuuagcauagaugucagcuuuaggacuauccaguugggaagaauuuugacuaggagccauucuuaaaugaguguaccucuuucaaaaaaaaaugguuuuaauuaacuguacuuccugaccugcuguggucacagaaaucuuaacuguccaaagauguuuaggagacaaaguggcucauuuucuuccggaguguuaugugaauagaaggcuguggauuaccaguauacauuuucuuuucuugaaaagcaaguuccuuuuuacccagcagggucaguguggaugugugcuuugauaagcacagguuauagcccgaguuuaaaggacucuauaucuggguucaagcagaaaucaugccgcugccauacugugagcugaagggcaaacacaguaggcagcauacauuucggaaagaaaauacuuucuaaaaaguuauauaguuuuaaacauuugauuuuuuauuuauguuuauaugugcaugugucugugugaguauuugucauguguggugccccuggagccacaagaggaugccauaucuuccagaguuauagaugguugugagccucccgccacccccaguauggcugcuaggagcagagcugggguccucuucuucuccuccaucccuggcuaccacuguucugucuucuuuauaaaugugaccacaugaagggcuuugcauuagugcagugguacaauauuuguuuuucaucuuacugcaccgagucuguuguucugaaguuucguccaggucauagcacgggucagauguuuucuuuuucugggugaaugauuucccauuguaugcagauagcucauuuugcuuguccauuuaccuggagcuggauauuuuugcaagguguguuagcaaucuacuuuaagacacaaaugcaggagaaaaugggugacauaaccacuaguauauuaugacacauagaugugggucuggguuaggaccuguuguuuucgagggggguugggaauggaucuugcugccuuugccuccugugcacugggauuacagguacaugccagcacucauggcuggagucccgggguaaaaugcuuccuuaccaucagggauugacugggaagugugcaucugugugaccugcuccuguggcugcuguuugccuggugucucaggugccacacaacaauuuuuuucugaguuuuuaugcuuuguagugaggcuuaguacagggugauauaaacacccaauauagaaaaucuagaagcucuggcuccuaccucguucuaugaaagaagcuguguuccaugaaagaggcuguguccaauucuuuauugauucuuuuggauaauuuacuuuuaugaacagcuuacggcaaaggccaacaaaaucuguuuucaugaaaggccaccaggaagcugcauugugaguauaggaugucauauuuccuuuccugcugugcacagauggggugcagaguaauguagacuagucugaucucugggauaaaauggaucuggacgcagacuuccugcuaccggcugguugugaccagauaugcacaaauuagaaagcaauuucuuuucuucuugcagaauuuaaaggaccauaggugacuuguguuaaaaguaaagauacauuggggaaauauaugauguaauauuauuaaaguaucacauaaucuauuucuuuuguuucauguaaauuuacggauauaguuacauacggcuuuuccuguggguuuaauaagugauuuauuugugguccuuauguuuuuccuucuaucucccguguuggucaguuuugaaucacuauaucacagucuguuaauuugauuuacugcaaagaguaaggccuuugucgucaugccaacuacuaucccccgagcgcacgcacgcacgcacgcacgcacacacacaucuccuaccaacccaacacuagucuguggguucuccucagaaugggcagauagcaaaagcaacaaaaaccauggcuugcuuuugagauacugaguaaguuuuauguaccaugcguuuauaacaagugguucauucuuacagagucagucaggaguacuuacauuaggaugccuaaggaaauuuuacccagccauuuguuauauaccagauaaaagacuuuugggggaaggguuauaauucaauuguguggguuggcaggggaguugagugaaugugauugaauucuguucucagugaacuggguuuuuaaauuuuguuuuguuuuucuacuuuauuauuauuuuuaacaagcacacugaaacugaaauuugcuagccaugucuugcagguuuuguaacaccuuucacauuggcagcugugcagugcgugcuguguggaggaggcugacguacagaaggaggcacagaucauuggcgcaguugcucuuuaaaaccccacauguccagugauaaacuugggaggaauaggagagaaucacacaggagccaggcagcauuguuugcaguuucuagggucucuaauggaacucugaaucccacagugcacugugagagcgagcagcauccuugggcaugcguggugacuguccuaguguuggguugguaggagauauagcucaagucuagucuucuccuugugauuggauccacaggaagaucuacauuuuuaagugagcugugaugucaugagcacaccauaaggcaugcauuucugauuugccccggagccugugcacuuuauaaugucagggugauauugcaaggcagaucugaagagccuucuguaguugggcagaguguuuauagguagucaggagugauugauucagcaugugccagauggugaagcagugugaauguuggcugaggguggcauccauccaggacugugaggaggucugacuuuuagcuacaaggcguauugucacagagugagggagcugcuucaucaagaacaaauguuugcuuuuguaacuagguuucaauuaacugacaaugaggcuauuuacuuuccaauagagaugagguuugcgcaucugacugaacuuuucuuguagugauggggauggugcauguaugcucugggucuccaaggauaguagcugcucuuggcuuggggacaguuugguuugcuucauuuguucuggucuuguguuguagaguuucugccuucugagaccuguauuugucgcucuucuugguuuccaguggcagaguguuccuucaaggugucagguccuuguucugagugccuuucuacgucacugucuuggcuuguccugugugcucuucuauucuguguucaugcuuucucuguucuugcuccaugcccacuucuguuccuguccuguggucagccagcucuuaccccaccucuguacgcucugcuuuuuggcagccugcagccuaggagagaauaccgugucucucacaccuagaggccuuuggucugaaaacaggaaauggagacccugcccuguagucagucuucugucucuggcucccuagaggcugaccuuagccauaugucuuguuagcccugguccucagucagcaugaacuggggacagaagccccaguuugguugugacugggguggcucugguauagugagucugugaccugaagacuuacuugcacaggacaugugacuuucagaacucacaucaagaugagugggacacccuucucucuaggaugccgcuccagggaucacugcucuaggucuuguuaguaacaacugcuucugguccaaacuucugagaucucacuguuggauggaauuuucugggcucccuuuaggaagggugaguccaggcugugcuggacucccucauaagccuccugcuguccucugcugcugcucucucccaugcguuggcucugcuguaucgaaugccccccaauggacacccuggcaucccuuccauccucauccucaccaccugcuccuguccguagauggcugagcccagccagagaaagucacucuguaacugagaaauccccccaccccccccacuccuccacccccccacccccccaucccccauccccuccccacccccccacccccccacccccgcuucggagggccucagggcagccuggaaauggaacccuuuccuccuuggcccacgcucugcacagugacuuugaauguuuucuaugcuuccccccccccccccguuaauuuauuaauucauuuucaaaccuggucaccacccccuccuccuccuagucacaccgucacaugaauucuggaguuucgcucucacaucucauucccauuucauucucuagucaguaauccucccaccacacacaagucagacagguaaaugcugauauugccgguucuuccugcugaccuuagauacuucugccugcugcuggaccccacccucaauuugcauacuuucuguucauaguugaagaacagucccucuuaauuccuacaaaucacaccacuagccuauuuuuauauccucauuugucaaaauaugaauguguuuaauaacaugcugaugucuguuuuauauacccuucuguguuuuccaauuuuauaugauuuaucauuuuuaaagucagagcaaaguuaaauguucuugguugaguguguguguguguguguguguguguguguguguguguguguguguguaugugguguguagcacacaugcccaauaagccuauuauucccuuaucuauggguuacauuauaaggaaaacacucugauuccaauugggacugaaauacucuucccccccgcccucaacuuuucuacugaacaggugaguguggccuuccuauggcugcccugagagucuagcuuuccuuuuauuuugguaguggcagcgagcguuuccgauguaagaagugaugugaggugagcuuagcacgcuggaacagcauugccuuugcucggcucuguucuggugcauguggaacuguuuccuugccugagagcacggcagaaggugucugucuguccuggggugagcacggcagagggugucugucuguccggggcugagcacggcagagggugucugucuguccuggggugagcacagcagaggaugucuguccuggguugagcacggcagaggaugucugucuguccuggggugagcacggcagaggaugucugucuguccuggggugaugaggacauuccuuuaugccugggaaaugaccugacacgagcuggcagccacuccacggguuagugccugggucauuugcagugacaaguguguuacuucacaguuuuguuuuuugaagacuuauuuauuuuuauguaugugaguacacuguagcugucuucagacacaccagaagagugcauggaccccauuacagaugguugugagccaccaugugcuugcugggaauugaacucaggcccucuggaagagcagucaguggucuuaacugcugagccaccucuccagccccacuuuacaguuuuauggcuggaaauugaagugguuucaacaacaugagggcucacucucugcuuacuacuggguuuggcaguaguuggcagcuguguggcugaggcagcauugucccaaaggagugcagauccuaggcuauuguccuaugcuggcaggaauccagaucugauggcagucacgcuccugaaaaugcagagguuuuucauguuuuccucuccuugauuuacaccuuuaugcuauaauuagugauuacuaagaugcuggaagacuccacacagcuuccacagagcaagaacaaagcagcuuugcaucugacaccugucauguuaaagccgagagugcaucaucacgugggcaacgcuugugugcugcugcgcuuugcugacgugucucccaggauguguugguggcuuuuuggccacuauggaaggcauggcucggugauggaaaacugcacgacguaauuuauauucuaauaauguuuucuaugaaaagaccauuugaaccucuacuuaaaacaaucauaaaugcuauacuugaccguauccuuacuaaucauuauccuuggaaacaggcuaauuuaccguccacccacuuuagcacagguucuggagaauagcaauguacucuaagaacgccucgugcugucuccucagaagcugaggcugcucuuuacuuucagcuccuucuugaguuuggagcugucuuaugaaguagaccuggccugaaaggauuuucagacuuugcggaucggaaggaggguuguuauuguauuaccauaaccacaacugaauggaccuuuacccuugccugccugugaugcugagaccacggaagaugcacgcuccccuccccaccacuaaccuagauccuggucacuuucccuacaugccucuagaacaguucccaucaugccuuguccuucugaaggaucugucaccacaggugucuguuacugaccgcaucacaggugaacugucuaggacucuagaacuuaugucaguggcuccucuccuuacucagccacauuuccugucacuaaccaagugaccucccugucagucacacugguuuugccccuuugugugcccagguccucuguaaagccguccugccaggaccggccacagccuguuuacagacgucagcagagcuuuccuucugacuacugucuuucccauugcucauggggccaacauuaggauugagccguccagucacccagucagaggcugugggacauuuaggggcacugaggacauccuauugauugaaugaauguguuguguacugcccagccugccuggugaaaugagcuuggauaggccaaacuauggacucaguuuucugaagacugcaaaacacuaaauccauagcugcauuuaguucaaccagggaugaaccuaagguauugaacgugcuagacagguacucuaccacuaaacuuugcuccaccccgaccccagugcuuuccuuuccagacaaaaucucaugcauuacccaggcuauccucaacauacuagaaacccaggcaagcugugaccuugugauccugaucugcucagccuccugaguagcugggauuagaggccugcauccccaggcccgauggcagugguauugaagucuccaugagccugcccuguuuacauggugauguuguagcgcauacccuguaguaguuauggccacggugauugauucacuuuuaauguccuuaugcuaacugguuugcauggcaauacagucagcauggccucuaagaguacagcucuguugaaccuuuacaacugagaaacugaccauuuucuauggcuuuuuucaugaaguaauugcccacccuuucuguuuagcuucugagaaggagaaucugaguuccucgaacacuaugugauucuacucagcaggguggauuaucagggugcugaugcauuuuggaaagggcagcagcccagccccgauggucugcuccacaggauagauguaccagacgccugcucagcguccuucccaccugaccuccaccuuugccauguucccugccugcagcagaggcagucaggauccacuuuacacucucagaaacagaggcagaaucacaggaaaaucaggcucaggaguucgcuagcuagcuggccucuaacaauauccccaucuacuucuggaaauuucuauccaacuuuguucauuuucuggcuucuuagaaauuuaaauuacauguuuacuaaaagcaagcagucuuuuguuaguuacagguuuuagcauuuguagcaaggccagaacauucccuuucauaucucagggugaaacauuucaauucugucagagcuagagagagguguuggaguuuuggaagggugacugacuguguuuagcuaagggaggugaguaauuauggguuuuguucugaauuccacaguguagaggugcauagcucagggauuucagggauaugagaggaugcugcagaucaagggaggaaagcuuugggaacugggaggggacucaaguggagggagcuuaaaugugaacuuugcccuuuuggaauuccaagcuucuugacuuuggguagguugcuaaucuccugauuucugcuacuccuccuacuccuccaucaguaaggacacaaauacuugcugcauagaacucccagggauuuuuagagaugagauccaaguguugcaaacaaugccuacaaugcuguaagcacucaaaaguucccugguaauagaguagugcuucagcgagccacuuguagaccaagccaugucacucauggaauuacuguuacaaguuucaaagaacugauaacaaaccuauuuuaagcacagcuuugcaguagugaacaggcccggccaagguggguauuucauaggaauaaauagagacuagaaauuaauguuuucuaagacccgugaaaacuccuucuauaucacuguccaccagaacaggauggaugaacgggcucacagauugugccuuuuuccauagcaaguuuacugagacacuucauccuguuaacagugacaauagagugcuguggggaugauuugguggguggguaaggcgcuaaccacacgggcacgaggaccugaguuugucuccccagaacccauggaaaagcuggacacuguagcacacaugcuugcaaucccggugcucgcacacggagggagaugggagaccuaaauugucagucaagcuagugagacccugccucaaacaaggugaaagaucacacaaggugaauggcggcuaggaccaacauaggagauucuccucugacccgaacauggcacacaugcacgcacgcacgcacgcaugcacguacgcacacaaacacaugaugaccacacauuugcuuucuguauauuuggagauacauccauguauaaguuagagguggccuguguucucaugucacugucagauaacaggugucacgaugggagaggcuccauuccagguuaggggugcuagguguacaagcggaguuugguagaguucucaaguuggccgaggggcagggccauggugaaacagugaaguguggggagcaggaugggcaggguggacagggagggcagggaguggcagguccugcucagaggacccacugggcagagcccuggcacacuauugggagaaagccaauuccugcuacagaaagugugacuguucccuuguguuguuggcuguuugcacagagcuaucaacgcugagugucuugggagguaacagugcagagguguguguguucucacccugcaguuacacuggaggcuguacuguuuucagcacaggcauggcugcuacugaagccaagcauggccuggauguuuccccgugugagucuccugugagaggagcaauagcgggaguacagcauaggcuucagucauguguggaucgaaagcggucacacacucuaguguccagagcagggcucgcacugcgucagggcuuuggcagaggacgacagugagaucuggguugaugcugacaggcuggaugcugacugguauguuuccauuuucaaccccugaggccuggccuggccaggaucaauuccggaacgcaguaucagcacuuguaauucuaagucuuuugugcaucccuuggaaggaaccacuugggaaaccuuaucaguugcagauucacaaccaaaucaguggccauugaagugcuugguucgaacaccaggaaggagagaacccuuuagauaaacacuuaaguuaagcguuguuagguaaagugugugagugugugugugugugugugugugugugugugugugagugugugugugugugugugugugugugugugugugugugacagaauuuugagaaaagaaugaaauauuuuaugucacauagaaauauucuaugcuuucuguauauuccugguccuuucuagguucugaggagcccaguacugguguggagcugcacugcaggcauaagccuuucuuuggauuccuguggaucacaggcauauuugcgugauagaugagaaaaaccagacuucucuugauucuccuuucuggagaggggaaagucugugucucugaaagaugucacauauagccuaauugaacugccugguguagcaaugcaauuguguaccugcaugugugcacucugugugugugugugugugugugugugugugugugugugugugugugcgcgcgcgcacgcguguuuguauguaaggguagguuacuuucucaggguacaggauccgaggggugacagcuacuuugugcugauguuucuuacccuugggccugugcucuuggaugaggucgugaaucugaguuaauguaagagaaauggcucuggagcagauguaaugagaaacacuaauggacaauucuuccaagucauuaaggugaauuuuuucuaucuuugcaaugaacaguuuaggagcaaaacuaaauucauuucuuucuaauagaauacaaauauaauuuauaguaaaagcuaaaaaugaggugagauaaagccaaaaaaaaaguuagucucacaaaagcaaagauuaaaaugcuuaaauuuuauauuacaaacacuagucucagauacccuguuuauuuuauaguuacucugauaucucugaggggaugaguccaaauucauauguguuaguacuuacaucaguaaauugaguuuuguuagauuuagcugacugugucuugugucauaguaauauuuacuucaaguuaaaagcaaacauuucuucaucuuauuaaguagauuuauaauaacuguguccuguuuucugaacacuuaaauauaggcuacaggugcauuuuuccaaaugaagaugaguacucuggguuaucauccucccuauuuugagauaaguagagauuucuuaauacuugagauggacuuuaaaaaauaguuaaugauauauguaaaagauaaaccagggagcuuuaugguuggugaugaucugcgcgugcgagcgugcacacacacacacacacacacacacacacacacacacacacacacacacuguagcuaugauaacauuuaaaauuuaaauuuauugguuuuacacgagugacugcuuaccauaauaaguuucccugaccacgguugagagcaucauacaucuaugcauauaaacauaaauaccuacaggaccguccugcauauuuagcauuuuagauauuguagauauuuagcaaaacaacaucacuagcuucucaccuuggaccuggaaccuuccguagcuaugguuuugaccauauguacuuuaccgugcauggauuuccuccuguggugcaggccucagauucagugaagaggguguuuguagccccauagagucuugcuucaguugaccagugggcacuuguagcauggaggguccaggacuggggaacaccucugaugccuucuacccugcagcccacauagcagcggccagcacugugagagcuagcccacaggacagggaguuuccuggucaguucaagggugauuucucugucuuuugcaaccaaggauagcauuuuaaaggucuaauguuuacaguuguuucccacaggaagaugucuuucauccacuuaguuuaaucuaguguauacacuuagccugcuuccaguuaauagucaagugucucucuauacccacuuucuugguaaaggauugaagacuugacuaaugguguagccaggaaagagaaaauguaacccuguuuggaaaagcccugucggaacuuauuagcaacucuccugguuuuuccucuuucccaaacccaaguucacgcaguccuacaccacacugagacuggacugcccggggcagaauucccggcauaguugaggccuuaccccuauuaauuucugccagauuccccaagccacaacuggcccaguccauuucacaccagcaaaauucgccuucaccuccucccugcccucuugcugacugugccaaaggcauuguuauguaaguaugccaagggccagugguuuugccagggcacucccauaccugguuggugucccagacuuuauggcuuucugcugccauugucuuggcuuugaauucagccugacaacuuugacuguuugacaaauguuagauaacccaccucccuuccuuuaguaaauauaccagugcuaaguauuauaugacuuguaccugauggaauaggcccuauuucucaaggccaguggaaggaauucgugggggagguaugcuugagggguggggcagugggaggguagaaggagaaaagauagagaagaagucaacugcugauuccagaacaggcaaagccggcuucucuggguagacacaacaagccuguguguggugacaaagcccagaggacaggccagagauggcaguccgcgcaacaaggcugaagggugacgguaaggagagcuccaagggcgguaggccagcacgaggguuuggagaugagccugggcuggagugcugcucuguucacugcagggacuugggcuugauggcucugcuucucagagggcagcucagccucaguacugccaaagcccugucugucugucuguccagcucccacugugcucggcaguguuuacucauuguuuagcuguaugcuuagcugaucuguggugcggcuggcuugacuugcucggaugcugagacuucuuaagcugguuucggugugugguguuaggcaucaaacccaggugcuuugugggcaagagcuauaccccugagguacacccgggcccauuuauuaaguucucucuuuugcuguuacuauguuacauuucuuuuugucagcaaggaaacacuuugucuccuaccaucuguuucucugcaacuguccacguggcaggaccuggguccugauguuuucuuucugacaccugagccuggggaaccccuuugcccuuugcugacugucuuaguggaacuuuuuuuuuuuuuuuuuuuuuuuuuuugaguuucuauaagugaguagccuggaaauguugcucaaguugugcuuuugccuagcauacugaacacuuuggguuccauucccagcaacgcacgcgcacacacacacacaccacaguuacacagauagaaguauuguuuugguauuaaacagaucuucguacugagggggggggcggggggggagccucaccugucaucucagcacuggggaagcugggacuagauuaccuugaguuucagggcagcuuggccuacagagugaguuggagaggcccauuuggacuacaugagagccugucuuaugaaaagaaaacagaaaugcggggcaggauucuuuuagcaacucguuguacuuuuaaaggcgcauggaaacuuccagcagagcugcuguuugcagagcaucaucucuuccgaaccgcaaaugcuugacuuuagcgauucugaucucgcagccaucagcuccacuaugcaaccguuaaacaacccccucucacagagcagucacagaugccuuuaucuguguguacaucagggaggggguuaaagauuaucgggagaauuauauuuguucauagugauauaggucuccucucucccugauggaagauggaaagcagacuggccgagagaauuuuguuguuuugcuuccauuuauuaagauguuuuccaaaagcagugucagaaauuuacuuauaaauaacaaaacagcuacaauaaaucaaauguucaaaaguaacuuuucagaguucuuaaaauauagugacucaacacaugcaaauuucuuuuuuaaaaauauuuauuuacuuauuaguuuaaguguguguguguguuggugucuguguguacaugugcaaugugccuaugcagugaagucacaccuuacauucuggauccccuuacuuccacuuucuuggcugucagugcagccauuugccccugagccuggcucuaccauucauguuuagguaagugagacaggaucuucugagcuucagguggguccucagucuuggagucaguuugggaggucacagugagcuuuuagaagcugaagcgaugggcaugucagaaugcgcagcagguaggagaaucaugagacggguccuuuggaaccuuaacuucaucuaauuguagggucuguccaugucacuguguauaguggcuuauacacagaaacauuugaaagucacugaucugggauaguguagguuuuacccaaguauuucagggugaauuuaauuaugcacaggggaagugcugguuacuaugucuuucuuagcucuuuuccacagcuaacugaguaggcucagagggagcguucuuuagaauuuaagaauuucugaguuggaggccagccuggucuuuuccaggacagccaggacuacauagagaaacccugucucaaaaaaaaaaagaagcuggugguuacgaugguguuguuuuacuguguccuccuuccuucacugucucccacuaagaucuuucaagucauugugagccacauucagcugaucccauugucacaugaagcaugacgcacggaggaggugaccacucagacuguaauuuccaaauuuaaguguauuuucuuuguucuacacuaaauauaauaguuccggauccuucaugauagaaucaagcuauguguccccaaaagcagaugucuuagaaggugagugugugucacgcacacacacacacacacgcacacacacacacaguggacaguaagggaaggcagacuaauucugugaggucaaauaagagaaacuaguaucccuucuaccgugaaggcuuugaaacguggggacuuuggagacuguggugguaagugaagguagaaaugagagcugcuguugaacugauaagucagagggugaaacggauuauuacuucaauacugaacauucauagaugaaauuaggauccuucccucccuaccucccucccuucuuuccuuccuucccacggagucuugcuauaaggcucaggcuggccuucaguucaugauccccuccccuuuucuucuuuuuuccuuuguggugcugaggauagaaccccuggccuuaugcagcuaggcaagcggggcaccagcccugauggacuuucuuccuaacagguuacaugcauucuguguuuaaguauuuucuaacuauaaaaugagguuuucucauauacuuggaaucuuauucaguaugauacuuauaagauugcaaaccagaauuuaguuccagguuuuguuccuuuauuugucuugaaaaaaaaaaaaacuuuuaaaagaauugcucauucuuuucccuuauauuuuuucuacauuuuacuuucagcauuugaucucuuuaagaagguagaaucauuuuuuuucacauuaguuuuuuuuuucccccacaagggaagucaugauacaugcgcccuuuguuagagaauuauuuuauaauuguucauccggaagcaauucacaaguuccuuuauagccaacuguaguaagggugaagcugguguugugacugugcagacgugucauuugucuguguccuucuuauuuacuuagucaccagucgucccuauguuuguauauuuaaagacagguuccuuuaaaaguaagcccugccucuugcgacaccaacugugagagaagucggagcugagggcaagucucugggugcugaguuacuggguaaugaacccuguggcagcaaaggacauggaaacgugugggacucgguuggcugcugggagggugauggauuuucauugcauuaggaagggcaugggguacagcucccacucuuuacuugcucacuguagcuguuaagaagguuuguuuaaggaagacauguugcacguaguugaaguugguguuuggcugcaguacuguccgacagucauagguugacagcugugccauggguugcuggagugagcaaguagauggggauguguugguuccuggggccagagcccuaauacccaguaaucagggugggccacagccucaguggugggagguugguguuuucacauacggugugggaggguggagcaccacggggaguugucuuagguacuguucuguggcucugaaaaggccgugacugaggcaacaccuaggaacgaagaaucgaaucaugggcuugcucuacagcuucagaaguuagucuguuaucaccaugguaaagagcaugccagcacacaggcagaaguagcugagaguucuacauccucaucuguaggcugggggcagaggggggcaggaacaggacuuuuaaacccccacagaauagauguggccuuguugugggaaguauuuggguucuggggaugugaacucagguuguuagguuuccaugcaaguauggguacucacugagcugucucucauucugaauuuugaaauuuuuuuuuuauucaguuuuggggauagaauuuggauacuugcauauucuaggcaagauucuaccacugagccagaaccccagugcuggaguguuuuguaggcagugagcauccuuccgauuccccuaaggauaaaggucauuaugccuugcagacaucauggcaccugagguguagccagcuuauucuagcuccucacugccuguguuccuuguuugcuaggaaggcaguugcuguuuuccucggucugauuugcagaguucccugugccagccuguggcuggauagccagcccggggcuuaaguugaaucagcuucuuaaguugaaucagcuucaggauuggguguguagggggcagguuacccaggccacuguuuauagcaaggcaguaguuucugggcgcugaggugcucuugucuuuguuugucuuguggcuccucagggcagccugugggaaaugggaaaguggaaaggccuggugucuuaggaagacaggccugcagagggagugaaauaaugugugggguucauucugagaaagaguugaaggaguugacaccccugcgguguuccugugcccacauugacuacaaaugugcuuacaucuggacaccugccaaaccuccuuccuauaaacggguguuuccacacagugaagcugaggcccaggaggcuucuauugaaaccuucccauccuuacugauuacagcuuuugcuauggagaugcugugggcucuaaauacuuagaagccauauauuguuucucauuuucccuuucagcuuuggagcugaggcccaggggcuccuuggccaggaggcugcuauguccacgaagacaggugaacuuaguaugaguugguuuguucagccaccagcgugaacugugacagacuggguggcuuguucagcaugucuuucuccucuucaguuccagaaggcugagauucagacacaagcuguguggggucucgcuguggcuugaccacugagccaucccuacagcucuuuguuccuuauaaggacacuaauccugucauaagucucgugguuuccuuuaaauccacguaccuuucaaagaacucaacuuaagaagcucucccuuugaggguggauuauagacuuagcuccuuugaauuuugggggaacauaauucauaacuguacauggaugaggcuggguuaauuuucaacugagagucauugcugcucccuucucacagacgcuaugcuggguccgcaagcccccgacuugcuuuguagcuagguuguucacacuguucuggacacugagaaaacaagcaaagccuaagggcuucggaaagucccucccugcaggugaagagccaguguggggcuuuuccugucuucccuccccuucccacugugucuacagagggugguagaggcaggguuggacauugcagagaacucaggacgccuaugaacucuaugccauuuuagugucagcuucagcuccuuguaggcauguuauuggaacccaagaguaucucacaguagacucuagaagggagaacuucaucuuccuggagcugacagaaaccaggagguugucucuaagaccuugucucuaagccucucuguauucucacucauagaacccauaccguugucucacuucagauuuccuugguguguuucucucagcuccuggacacucagggcccuguuuuacucaccgcagggcgucagggucugccucccagcccguguuuaggagagaaacaugaagaugaguaaaugcuugggcaagcucucccguucuggccucaggcuggcucuguuguuuucuuccuaccuugccuuugauguccuucauaacuaaguggcaacuuguuguucacagaaaaacccaugagguagccugaagagagguaagugggaaaacagacuuuaauuagcuguaucugagcuguguaaauaacuguucccgaggguuuaguuagagacaggcguccuccaaagaugcagacaaagauauaucccagucuccacacuguagaaacagaaaucaggucuaguuguuguacauucucuuacuaggaaacauuuuaagauguccagaaaaacacauaauugcaaccauuguuucuggcuugcaaauuucuucuugauaauuaugaaaagugaaccuuugaacuguugaguaugaagcaucguucuguaggauucacacugugguugcaaugcagacuuuucugacacggaaaccuggaaugugguagaaugagugacuauuguuuuaccaggaaggacacagguggcaaagguggcaaguuugggauuagguuccgggucuuucuuuaaggcuuucucuuguaccuuuuuacucauaacuuccugagcuggaaguaugugccacaccaucaguggaagcucccagugacacguaggaacuucuggaggaguggucucacugagcuuucauuagcagggccagccuagccagaaggaccuggguuguccuggaggggaaggucuggccuucugcugugcuguguggccugaaggagccacuugggaccugggcucuuggggucgaggcuggguuugaugguaagagcaucuucaggauuuauggaggaaguagagacugaguuuauucagggaggggauggaaguguggcuugugucccacuuuguaccuuccucagguccuggagauauacuggggucgagcgucacugaugcgguuucucgcuucucugggugucagugagacugacucucucuucccccacaaaugcaguugcugaugcuuuugaaaaggcaggugucagggggaucagauguaaaguagagauggcuuucucugagagaucacugacugaacaccguaguuacucagucuccaggggaaaggggggaagaugacugcugacuuccugcagucuugaaauuggguucuucuggaagcacacaaagcugccaugcuguuaucaaagugugcaucucauuuaaauagauuaccaaacauaccaucuaauuauugaccaugauagugcugguguuaguuacggugccagaauaacuccaaaucaggagaaaauagauuuggaaaaauugggagagcaaccgggagugagugaggugguguggugagguaaaaugugagcucagggcugaccuugggcuuccacucugucggccucaguuuccucuucugugacaacagggaagugguccaggucucucugcaaagguucagccauuagguccuuugaauguugagccucuuguuugaaucacuuugaugagcugagcccagucaugaauucucugcauuaguauucaguucuuaaaagcaggaguguuugaggcuuugaaaucgaguccagcaggaaauuucuucuggucuguaauuuccuuccacucaggagugacagggccccagucugccuccguccuccaucaggaguuugaggcagugggaugacuucugauucguuuucccucccaccuugacuucugugaauauaaauuggcauggcauaaauauuuaagcacugcauuaauguucagaugaaagaaucaugcagaaaccagaacaaucaaaguaaauuaguuaaaauuugcauaacguuaaauaugguagccuuugaggcuuguggacagugguuccuggccagccacugcaccauagcagguagcagagauaacuuaccugugcauuugguauuuaauuguuaaugaugugggcugggauauaauaacgggcacuuacuaauaaaucuaugugcaguccucaaaugugcugaugggguacccgucuaggcaugugacaguggagaugcuggcacuagggaauguuaguagcuuccuaaggaaggacugacacacgaggaaggaggagagggugccuugugcuccucaguuagggcaaagcacaggcaggcucccgaacgccagguacagagagacacgauuagugcagggugugugguuguagaacgcuuacucgauagcuugucgggcuaaaucuccagcugcacugggccucaguuuccccaugugcacagcauuacauuuaugaucccucagggguugugaggcgcacagcacacaggacgaagaugcggaaauugugauucagauuguguuggacagucuccuguguggcuucggcugcugcucuggggcuuaggugacugcaggucucugugcugagcuuuccugcacacagaugaacccaaaacaaaguucaggcuagcugggugguuuuuccuccacuuaauuaaucaugaauauuguccccuucauuauguuuucuagugauaucuaauuuuaugcugaauuauauuccauucuuagauauuuaaauaccauuucugcuauuucaauauuugaggucaugcuggaaucaauggucuuguuuauuuuuaagauuuuauuccugugauacacauagggauguguguguguagggggugguggugucuguacaucugagggcaucagauccccuggagcuggaguugaaggcaguuaugagcuauaaugugaguauuuucauuuucuccuucucggguccucugcaagagcagaaugcgcucuuaacaucuaagccaucucuccagccuccugaggucaacauucuuaucuggaugcuucugucaacaucugucuuuucucuagagcuggaauuacccaguuuaagaauguuaaugccuuuugcuauauauugccaacaacucuucagaaauggaguuguaaaauauaccuucucaaaaauagauuauuaagaguaaacucuaaauacagggaaugaggagggaaaagguuuguuuguuuguuuuaaugugucugggcuuaggugacaggggcaagaauagcaugcauuuuuagagaagguaaacacaagucaaggagagucagggagcagugcacaggcggggagcagugcacaggcuggucuguacuuuuuuuuuuucagagcagcuuuuaugguucaaauuugaaggaaagccaugaugcugugauauauacaauaucguauauauacuauaacauauaggcgacugugaaaagcaggguaggcccugaugagcucuucuugccacagaugguaaugugcugcugccacauggucacggccucucuuuugccucaguggaaagcugaggaaugagaugaugguguucgugggaucuuguucugcgugacuuaucccuuaguuaugcgugugaguguaugucuagaugcauguguguacauugaguacaguacccauagaggccagaagagggcgucagaucacccuggaacauggguuacauacaggugguugugagccauucauuguggauguugguaacugagcauggguccucuggaagagcaguaacuguuguaaacugccgagccaucacucuaccacaaaggaauugguguuuggauugaaugaaguguaaguucuuuguucucuuuggcccucucuagcccugggacucacugcuugacucugguagacagacauagagggaggauagauaggugaggaaaacugaaaacccgcucagaaggccuacucaguguggguguguaggaggggguccuaaggggcagaguggagguccuccuggggccucuguggaaucugaggggagcgcucucuauuggaugucagaugcucugcagcccucaacacuaugccaggcugguugagucaauggguaaguucaacuccucuuucaucaaaauguuuaacucucaaaggaccuccaggucaucuggcuuagcuuuuccuuuguacagauaaguacauuuucauuauucauuuguuuguuuagcaaugauggagaucaaacccaaggacccauacaugccaaacaggggccuuaccauugaguuauagccccaggaaacugauuauuuucaguugagcuucaccauguaaacaagugaaguuuauguugcuccuuuaaaaaauguauuuguuauuacgugcgugccugucuuuguguuggagggugucuguguguguaugcacaugcuguggagcucuuuggaggucagguaacagcucucaggaugaguucucuccuuccacuguggguccugggcaucaagugcaggucgucggcugagcuuauuuggcuuaucuuacuugcugagccaccucccagguccuguuucuuucuuccuccuccuuuucuuccuuggucuucucuuaauuuguggaaucaaagagccuaccuuggaguggaguuggaugcugagaguccucagcucucacacuaagauggcagaacuguagcgggcacaucugguacagacagcagagcugagagccagcuucacucuagucacuucuucggccugggguugugggcucaggucugccugcagugcugcugcucacagggguggcucuucuuccuguguggcucacugaugcuucugaguagucuuggacagagaauggcucucuccucuuuauguuuuagaaauuaucugcuaguuacuguauuguaauucaaaauaauuuuuuuucuuuuuccuuguagugacggaauaauggccagugcuuucuuuaggagagugccaguggcucugagcacaccuugugccuuuuaccacugggugacacucuuagaccagagugcuguaccaguggaacccagggcccuugaaccucagacuucuucaaaacacuuuaugcaggagaaagggacacucuuccaucuaaagugcauacuggccacucucagacaugauagguauuauguaucagucugaagcaauuuuuaaggccagugaguauugggcaaucaauuauuaacaggaucaucaauuaggcagccuuucaguugcuuggagguuuauuuagauucauguguugcauauuaacuagcuacuaauuauuucaggggaacauuuauaugaacuuauuauucuaguauuuauuuugcaccugacacaaaucuguguuaucuguugguggcuaaaaccuuggugauggcuugcacauacuaauggaugucacagcaaaccuuuggcagucagaagacaguaugaggaaguuguuucuguccuuuccucauguuaaauuugggaacugaacugaaguccucggggcuggcacacaugccuuuucugcugauccguucuccagcccaguccuguguauggacuuccacugagccaucuuaagaggaagcagagcaguuacuugggaaaaugaacacagguucccuguacagaucucuagcaaauagaacuugucuagaacuugugccaagcacuugagagcagguuagagaaggacuuugcucagagcgugugcuggccugccugcccuccuuguuucacggcuucuuuuguaaacccaaggcccaccgucuaggcuuggcaugaauagcuccuagucacauucagcggaacaacaugugguauuucucaggacaaggaauuuggaagagucaggucucuccucugcuggcuuaagaggagggaugacaaaaguuagaauuuuaggauccugacagaaguauuuacuguaucccauggggacagaaagaaaugacaguggcagagucagagaagaaagaaccuagugagguuagugacuccaguguauuuugaucccucaguaugugcauccuccaguuaguacauuguugggugacccuuagugugauacccagugcagggggugggugggcuguggcaagcaaagcaaugugaauggaguaagacuugaggcacagcaggucucaugggacucaaccaagggcacaaguaauugacagccccagauuucuaauagauggugucauggugugacugcuucugcuucauguggcuuaggcaagaggcauugugcuugaggugggaagaggugguggccagaggucuuucugcugugcuguuagaaucugucuuugcagagacacaccagagaugguguacuggcuaguuuugugucaacuugacacagcuggaguuaccacagagaaaggagcuucaguugaggaaaugccuccaugagauccagcuguaaggcauuuucucaauuagugaucaagggggaaaggccccuuguggguggggccaucccugggcugguagucuuggguucuauaagagaacaggcugagcaagccaggggaagcaaaccaguaaagaacaucccuccauggccucugcaucagcuccugcucccugaccuguuugaguuccugacuuccuuuggugaugaacagcagcauggaaguguaagcugaacaaacccuuuccuucccaacuugcuucuuggucaugauguuugugcaggaauagaaacccugacuaagacagaugguauggaaaguuagcuucuagggcagaggacuaaguguuaaguccuugggagcaggagagcgcuggguugaaucuuccacuucaguugagauaagagggagcuaucccauuuaggaauacuauguuguuuacaaacaagcuaggucuuugaaagauguauggaguuuucauuguucuggaggauggaauuauaugugggaggaaaaccauaagagaugggugugugugugugugugugugugugugugugugcucgcacgcgugugcgcauguguguguaaggcugcugugggagagcuggauccugauauuagaagucugccugacgaccugauuauggaaacaugggaaggaggccaggcagcugugcaccaucuccucgggugauggauagagaugcuuugcuucugggacuuugaucugauuagauuaguagcacauugguuugucuaagacaaggaaggauggucaggagaaauggagcccagagaggagcagguuggcaauuacuacuugggaugagaagugaagagggaaugaggcuccuggcgguggaagaggauggguuucaaauacauugauggacaagaauccaggauggauugguucuucauggaggcuuugagaggacgccacccaagaugggugugcaauaaggagguuagaaggacacaggauggcuucugccaaucggaggcuggcaugaaagguggcacaguggacaugugcauuagccuggguuugugugggugauugcugcugcaguggcagcuaguagggcgaggucugcuggccuguggccccucagucuguguaguguccaguacugcuguaaauaaagaaugaggugagguguggcuguacacuggucccgaggugggugcagaagcccacagucagcauguuagagcccaagcuagaaaagauggcgacggcccuuaggcuuacuguagaaauggcucauauggcaaugugaagggagaguuugcauuguuuucagaugcaauugugggggguuaggguguaaggcucuggaccuguucuuggacacccuugucacugagggcuaagaagcaauaagcuuuggugcagaccccaaagacuggcuuucuaaugcagcagaugggcaacagcuucaacuuggagaagaggcuaaggagacuguuaacuguagggaagccagaagccaauuaguccugagaacguuucuugauaggauagggaugggagcuggaacuugugcaguguuacugagcagcggaagaaccacauugcuguuuuuagugaugcauuuccugucuuggcugccuguggaccauacuucucaugcauggaccuugagggccaugaguacaggaccuuuuaucugaaagagccucugauuagcaaagagucacaaccugcccucagaggacgauugaggaggagggugugucuuaggguuucuguugcugugaugaaacaccaugaccaacaagcuaguuggggagaaaaggguuuauugggguuacauuuccauacuggcauuuacuggugaagggagucuggacaggaacucagaacaggguaggaaccuggaggcuagaacugaugcagaagcggggagcugauuauuggcuugcuucccauagccugcuuucuuauagagcacaggaccacuggcucagggauggcaccacccacaaugggcugaccccucccccauuuuccacuaauugagaaaaugccuuacagcuggaucucauggaggcauguccucgacugaggcuucuuccucucugaugacucuaguuugugucaaguugacacacaaaaccagccagugcaggauguuugcuaaggcuuuucccuuugugauauuuucucaagaguccucagacucagucauuugcuggccuaaucccuaauugauuccuggguuugauaacccaaucuguuguuaggaccucggaugauacuaagcagguauugggcucuggcuucuaucuucaucacacugcgcuguuuccacgucuucgagugggcuagcugucugguggccuugcauagaugugcuucugauugccagggccaaagaagcuuucucccacuauuauacacaccuuaaagaauuaaauaauauuaauaauauagcuuaucauggcauucuaaacucugcccuuaaaggaucugagacaccuaaacauugucucucauagccugccauguggagaguuuuuauguaugcauguauguauguguguguguauguauguguauuuauucugugauccugcccuggcuucuguaggcaagcucccugccucugagccauaucccagccuggcacuggugucuuuuuauuugccuugucuucagauuuguuucuaaaguugucugaauauucaccuuccuuucuaaaugggcuuauucaauaauuguccuuuacucuggcuuuccucauaauuggccaacuuuagacacgguguguuuuuggcagugcuggcuguugaauggcuagaagguagagggaauacaguuaguuguauuacccacuagcauucuuggaaagcagcccaaacuuuugcuugcugauuggcagcaucacacucuucugaugaagccacagugcaaucuagggugcuacccggacacaccauucuccuuccuguagccacgguacagacaugaacagcuugugguuaauuggcaguauaaauucacaguaacaccaaaacucgaucuuacacacacaggccuagugaacguucugucugaugucagcaacauggaauguagacuuguaaacuaucauaguggcugucagcucauugcuuaucugccugcgccuuugcauaggguuucauggagcauuauacaagcaaugcgucugugaggagcuccccucauuucuguuuccauccuuuuggaguuccaucaacuggugguuaauucauguuccacgagauaugugggggaguaaaugcauugcaaauguggacuggguguaccugcuuuucuauaagaccucugacauuuaugucacuggccuauguucaggacauauauuuaugcagagcagauuaccaaaaagcccaaugagagaggaggccacucaguugaagagaucggacugaaucaaggagauuggggaaguucuugaggguuucuaggccuuggcaggaugggauccacucagggccuggccucucggggauuuucuuucucuacuuuuucacuuucugucccuucucuuucacccuucugugucaagacuggaaaaaaaaaugaacagagccauugacuugguucauccauauuaacucauccugucagacuuguaggaugcagucaucauccauuuuccuggcaccuucauuaacggagagguagauguugagcugguauguuggggcacggaugggcacugcuggccucaggugggucccacaggacuucucaugcuuagaacaugccacagcuauuggauuguuggcucugauuuccaguuaagaaaguugagaugcagaguaagccauuuaauuaaacaaaaccacauaacuguugaaugaccuaagcaagggccuaucuagggucacugguccucaggccagcuccuucucauugugugcauacauggauggacauguaaugcaugcuuuauauaauagccaguggaaccuuauggaaaguauauaaagcagacagaauaaaaauguuccaagaugcaguauaguauuaacaugcauccauuuuauucuguuaaguuuagauguaggauuacuaugccuacauuucuaaugagaugugaggccaaauucuaauagcauuguaacaacaaagugauucuuaguugauagucucaacagcaguguuauauaaacuguguucacugagguguguuuauuaugccuacagagaagguauccacaagaaagugccaugugaugaucuguguaaccaaacugguauuauuagcacauggaacaccauacuguagaauugcccuccucccaccuuaugucuucccuucaccauccaugccuaagguaacaugauaucgaacaagggguuguuugacugcuauuuacuuaaauuagacacccagaugguucuuuuguacuacuggcaccugauuggcccugacacugguccaguuuaucauggcuauugguaugugcucugacuauuggguauuuuugauuccccuucauugugccuucaucuuucgccaucuucuaaauauaaaguaugcuccuuguuuaaaaauacauuggugggggaggggagcugaaaaaaaaacugaugagaaagugaguuuggacauuuucccaagaacgucauuaugugguguuuggacagcaacauauugggagcagaucaguugagauuauaucacuauuuuaaaugggccacuugggaauccuaggguccccucuaaccgucauagagcuuggcagaauaugaaaaaguaacacugcuguguuuaugcagauaaucccagaggagcgccuuuucccagccuuucuccuagcagauuuguguccacaaaggguccuucaaguauuugucaaaugcuuuuggguaucagacgauggcuccuugugguagagugaguuuguagguucaccucaaggccaggcuguccuaaacacuggcagaugaggccaguuccgcuggagagagagacuugcacuaacucauuuuccugucugucugggaauccaggggcagagggaggagauugcuauggauccaagaagccccuuccaguuuucaggcugauccacgccuaaguuugccagcuacugucuuaaguguuuuggggaucucagcuccuagcguuugccagucuucuggagccaguuuggggaauagguucucggaaagaaugucuugaaauacuuuuagcauucugggaguaguuguugcaguucaaaaguucaguuauuugggacugacugaauucugcuguauguguacgcaugcaucugguauauacauugccacguccugaugcuuccagauagaauuggauuuaaaaaaaaaauuggggcaaaugaaaauuggcauaaucucuaaauucugauuuucaaccacgaaagguuaguuuuuuugcauuuuguuuguuuuauguacagaugugcaaagauggaccaagaauaauagccugauggugcagcucagccacaauaaguguguguucucuuggcuugguggggaagguuuacauugggaaucauuaucuaacucagaaaagcacugucuguggccauuagaaugcaguguauuaccucgguaaugugguaggcaggccuuuuuaacucugccauaagggucuguguuuguagcuuugcugguagaacugugggaugcugggcuggggagagcacuuaauaguuaaagaugcuuauuguuaagcgugaggaccgaguaugaucccagcguccauagaaagcguugggcacguuggagugcacaggcaacuacagcacuggggaggcagagauggggcggcggcacuggcggcgcggcggugguggugguggugguggugguggugguggugguggugguggugaugguggugauggugguggugguggcaguguggaguucugugagcucacgagaggcccuguaucaaaaaacaagguaaaagccccugaggaaugacuguuggauuuauccucugcccuccacaccuaaaucucacacacacacacacacacacacacacacacacacacacacacacacagacacacacacacacacacacacacucauauacaacacacuaugcauccacauguacuuacuuacuguuacuaaugaggaaacuguauuauucauuugaauucaugauuagaagaaaauaugacccaaagaagauagauaucucuagauaaaauauguaauggugucggcuauagcuuggcuagcaacaccgccuacucaaguacucacucauauccuggguaauagcacauugcugccacauuauuucauucauuuucaaagacagcuggggaacugaagucauggaaguuacggcuugucuaaccacucaguugucuuucuuuaauuaagccagcacugauuuuucuucccuugacugauacuugauaaaaaccaaacagcagcagcagcaacauacauaaaaaacuuacuuuaugaaagaucguuaaaccauuauuucauaugcaaaucaucacuuacuuaaaauucaaauacuggucuaaaguuuaaggugauuuggauugcauuuguucccugauagaucagaaauaauuuaucuguuuucuuuucuccaagacagcaaagaaauauauaaagguuucacauuagucaauaaauauuggcugcugagguauuucauauucucauuucaaauaagauuaacuuaauaauuuauaauugacugagggcgaauuaaggagcuucaccuaagcagauguuuucauguaaagggaaaucaauccacgucucagguuacacacgagcccaccacuaaugugccauaaaaauaaaaccuagagggggcuuaagagugugacugccaauauuuccagagagaaagacauacuaaacacagugauaaauuauugcagucuuauguaacagaauugugccaauuucuaaucaauuacagauaacuuauuuuucaucaacuaaauguaacuuuagaaguuuaagcuuuuuuauuguuucauuguugagauucuauucuugguuguacuuccugccacugagaguugguaauagucaguuguauacuuuauauuuuuaucuggucuaaaucauugugcuagucuagauagcuuuccucuaaaauauguggaaauuucuagaauacugacuauguuaaaaaauaaaauaaaguugucuauuugaucacuuuaaagagguagaggaagaagggucauuguaagcuuaaagccagccagaucuacauagaaaguucuaagccagacauggcuagauugcaagacucucaaaacacaaacaaacaaacaaacagauuuaaaauguauaaaucugauacuuguuccauggcagccaugaugcuguuuuugaucucaauaagacucuguaagacagcaaaauaauuuccuagagaccuauuacuuucacauuggauaaaauauacuuaauauccuuucauuuucauguuucaaaggaagagucaaagaugauuaaagggcucuuugaagcggucagggcuuggucacuucacauucuguagucagggacugaaccauaguuacuuuuauaaauguauuaggaugugaagaacugacuauuaagucuaaaguagcuguauuaucaauaaagcaauacacugaguugggguauuguuuuuuaaauauguaauuauauuucuuuucaugaaaaaucauacauaaauuguuacguuuauuuaagaugaaauuguacagccgauaagagaagagagaauccacauuguagauuccuuuugugagggcaugaagaagucuguacacaauugagcauauuccauguuuaaaggaagaaaguaaauaaaugcaaacaacuccauaaaaaaaaaaaaaaaaaacuuacuuuaugguccaguuacuuggucaguaacaucaauaugaugagaauaucuuguguuaaugucaagaagaaaucccucauguaaggauacuuacuucuagacucccccccuuacuccuagacuuuucuaucacaucuuuauucucagccuucuugguugcuuaaugcucagugaagaaccccaccuugccucccugagcguauuuccaaaggccaaggaagucauguggcucaggagcgcccucuucuggcagcuaaccgcuaaccccugacuugguuacuucuuuuaaauacucuccauagaaccuccauagaauccuagguggcugaagaagaggaggaaaccagucuuugcaauaaagggauggaauguuucguguagauuucagugcagacuaaagagaggaggugauuccguaguugucggaggccagaguuuaauuacagucaggauguuaggaaaaucuuccugaaagacuuggccacguaucuguaucugauucggcuugguguaagguggauuagaaaggagcaucaugccugcuaggagcagcagcaauggcgagggccugcagguggaggaagggccaaggagagggaaggugcgguacauaguauuuaugccaguucagucagagcgugggcuuugugaggacacguccccacaugaucagaauucuguugucaggcuucaguaaccacggacaggauggcugacaggaaagagcaucagguaagaacgucacagagauggcuacuucuuugcuuuuguugugggugcagagugaaaagccaaggagaagugccccuauguagcucccagcuccugucccagccgcucugugguaaagccauccaggacacagggagacacuacuucccuuuccagaccccuuugcuguagucuggaggagcuguauugcacacaccuucugcuuggccugcagaagacucugagccugcgcaugggacuugggcugcggggcucuugugcccacccucugacuccaagacagagaaaaugaagacagugcuggcccugugcuuagaucagaacucaugcagguucacccuggguccugcccagggucuugucugguaggagacccccacuugggugcuucucaccgacuguuacugugggggagagguccuagaaacucuaaaagagaaaucacccacuugugccccagcauccuggccuacggcuccucuccccuguugcugacagcuaccccauucuuucccugccugccuccucccugaaacuuugaccuuuggagucccuccugcucugaaaagaugucauggcuuaggauagagaagcagguccuuuuauggaagcaggcagcauacuuugucuacugauuaaccagagugaaucugcucugggcucuuuuagacagguuaggcuguagagcggugccuugugcauuugagauuucaagcagacagcacagccccuuuagccagggagcaguggagcugaagucaggcuggcugugaugggcucccuuacucacuaugugcaagguuuguauuucucucucugauuaaggcugcaggaguucucaguuaaaauguccacaguguuuugggaauguguggguucucuguuauguuuuccucauuugguagcucugagccuucauauuauacaguguugccucaaauauuuaauuaugaugcaguuauagcugcuuuuauauuuuaauugacuuggucuuuagacauuuaguagcuuuauuuucauguuaauuaaaaaauuuuuuuuacaacacuugauguaaaaaagaaaaaggugggcauugcaguuuggcaaaccuggguuuggggauuaguggacggcaauuugguuuuagcacuauggcacuagcaguauaaguaccagcaugguauaaucuuguuucucugaguguugguguagagucugagucuuuuauuccuaugguuguugcuggaaucaguugggacccugcaucugcacgugccguucccaaggcacugauugauaguuguuggcugucaguuugccuagauuuggcuuugaugaacuguuagugacaguucagggcuucaugcugacaugguugcuucucuccggugucuacucuggagucuguggauagaugcccugcucucucucuucccucaacauccacguagccccacuccuccccauaacugucugcuggguggccuccgugggcagaaguuaaagguaggagcuagcauuggacuaagagcuugugcacagagaaacucuucucauucuucugaaggcagguuucaugccgucaauaguaauucaacaucuucuacuuaucugaaguggcugggauuagaacuggggcagaggugguccucccccuugcagagaauggacagaaaccuacagucaccccguaucccgguuuaucuuguggugucaauaccagggagguggcagugcagugcuaggcaugaauguuucaggugugacucuuccucccacacaguccccugcucucugacccacuguaucgccuacuaagugaggagguagccguaguuagcaaucggaauuguggacuuacagagaaagcaagguugcaguacucugguauagucaggcccuuaucugauuuugaguuugaaaaucaaagucucugaaccaggacaggcaaguaggaaucuccuguuaauuaucauggcaucuucaucugcuuuguucugagcacagggagcagggauggauggggucagcacuaagaaugaucuugguacgcaugguaaucauggcaauuacuggcaccaaccuuugccugucuucugccauggggucagcccugguccucuugcuucagucuccagagggauuuuucuucugucaugaaaugguacucgcauucacaggcguucacuacauguccacagcccuaguuaguuacagguguccaagaaaggagacuuucuuucuuuggagaggaagucugaggccagagggguuaagugaucgcccagcucugucagcacauugcucugcuguaguucaaagacauguucucuuuagccacccccacugccacucugcccaaaggggucuugcucaagcaaggucaccuaccuucccuuccucugcucucaguucuagcccugagaauagauggucagccggaagaggaaacagaccgcccguuuuccacguugacugcuggaaguuuugucucucugcaggcucaggcuuuacggugguaauguggacucauuugcugagguugaggaaaaagcuaguacccaaguguuucuugugagcuugcuuuugagaugugguggcaggagguauccuuugugacuugaacucagggugugauuggcacugacuggagucaggucagaagacucuuaccuugccccauugcuuucuaguccuuggaggauuaaucaguggcaucccugagguagacaccggaggauggcguguccugguaugacagaccagacauagcucuugggaccuugaccaucagugaaagaaguguugacagaauaggcugcaaaugaaugugccuucucuuuguguuucagacggcccccuugagaauauugaccccaaagacuccugucucauuccaagaaacaucauggcugagccagacuacauagaagaugacaauccugagcuaauuaggccccagaagcuuaucaacccugucaaaagcucccgaaaucaccaagaccuccacagagagcuucuuaugaaucagaaaaggugcgugguuucugggugguguuuccuuccuccaggaagcuuugggguggccagguuuccuuuuggguuuacaaaggcugcaauugcuuguuugccauguugaaggcauccuuuuaccaagcaugggggagcuguugucucugcaccaagcuccuagguacacuggcagggucugacacugucuccuuucaaaugcgugcucauuuuaaggagcacuugcauuucuuuugucugugccugugcucaggccuguggaggacaacuuggaggaauccguucucuccuuccaccacgugaggccuggggauugaacuacaagcagagcuuggcagcaagugccuucacuugcugagcccauaugugcauauuguaaaacuuggguagaagaggcugaguucgggguagaagagagugacucuuccuaugcagaagagaaagacuauuucuuaauuuuaagucucugacauuuugggaaguguaggaaucagauuugagcccugccugugcuaguguuuucuagcugcagagagacguuucuauaacuauuagaaaauaauaaacaacaauauucuuccuugugucuuuauuaguuucuuuucuguaauauuuuaaauguuauugucuuucuguuaaauuuuuaaagggaugcaaaauauucccugucuucuugugcagucaauccugucucuaccccaaauuacucuggguucugggacuugggccuacugcugcuugcuuacguguuuaaugccuguuguaugcaguguguguguuaaggcauguggagacaugagguggucucuccucagucaguuuccgccuuacuccauuuuagacaagaugucugacugaagcuagggcuuucuggcaggccagcaagccuccaguaccaucugucuccaucucucaguacuggggaaucucaggugcuugcuccggagaccaggauuguuugguguugauuguggauucaaggggauucaaacucagguacuuaugcacuacacagcagucacuccauccgacagaggcagcuuggccaggaucuuagggcaguucgaauucaacacggaaccagggaacucaaagugcacaaccuuuccacacugcaaugccugagcuaaugucagccuuugggaacagugagcuagggcugccugaagagucaccugugggccuggggagguggaucugugggugagaaccagaguuuagacucacauaaccuaucuaaaugccaggcaaauaugauggcccaccuguauaaucucagaacuugaaaagcagaggcaggggcuguggaacaagcuggcauugggccagcugaacugagaagcaguucccugaagugaaaugcugccucaacagagauggacagugaccaaggaagacacucagucaaccucuggcuuauacacacacacacacacacacacacacacacacacacacacacacacacacacucacacacacucacacacacauacucacacacacacacacucacacacacacacacacacacucacacacucacacacacucacacacauacacgcacacacacacacacacucacacacacacacacacaugugcaaacacacuguguguucaaguaggcaaagaaggaaugagcaaaaccagacagaaauacaaggcugcuucauucuuuggaaaugggagacagcuucuguugcucuaagaccuguuuagcaucaauaagauccaagcuacuaguaauauuuuagcagaauaguuuguuaccuauaaucuagaaaaauguaugcucaguagaauuaggauugacuuuugcuuuauucuuccuuuucacaaauuucuuuaaaacuuuucaguuaacaugcuucuuagagauuaacugaguagcccuucccccacuauucucuuuagaaaggaauagaggcuaagagcagacuggcuggucggaagaaugggaaccuccacaaagcugccccucaguuuggagacccccaaccccaccauuuccccagcacaaugcagacauaagcuaagcauuuacaaaagaugcauagacuuguguucagggcagcaagcagcaguccaaccacacacuugcuuguacuggggccaaacccagugauggcacagagaacuccuggguagggaguccccagggcuggcacaaaggcuguacucaggguggagaacugcccuaaaagugccucacagggccaggaaaaggcucggcgggugaaggcugcgcuuaguccuuacagucacauaguaaaaggagaaaggugacucuagcaaguuguccuuuggccuccauaugcauguugugugucagugaccacacaccacacacacacacacacacacacgcgcgcgugugugugcacauacacaaacccaaauauauguaauaaaaugauuuuagaaggcuuguaaucucccuuauuaaauuuaaauuaagauaauauauauucaacuacauuuaauuaguauuacauguaguuugaauuuaagauauauaaauucaaacuacaacaccuaccacaagacuacaguauaacuggugcuucugcagucuguuuaaaggggagagcuuggguuaggcauucaacuuuuaauuuuaugaguauugauauauuucauauauaaaauauguggccuaaaacccuagcccuaauuuuagaaacuggcuacacucuggcuggagaugugagaguuaagagcaugugcugcucuugcaaggacccaagcuuggauccugguccuuaucaggcaggucacagcuaucuguaacuccagcugcagaccuuacgucuguccuccuuaggcgccuguacucacaugcacacacagacaucuacacauacuuagcucagcucuuaggauugaucccuggacagucaugaagggguuggagagacuuaguaauguaggcaucagggcuuguaaggacccaccacuguacggcugcacugguauaacccagaaaauguuauuacuaguugaaguuacuuuugccggugaacuaugggagauaucugaacuuaaauuauucauauaacuaaauucuuaaucuuaaaauguaauugucugcaguuuuauauugagaccuuauguauucauaaaacugagaaagccuuaauucauuauuccuuagugaugcuuuuggguuuugagauggcauuuuacuauguagcccaggcuagcuuccugcuuuagccuucugagugcugagauuacagugugccuucacacccuccugguuaaugauaccaggaacucauaugggcuguaacuaugcugauuaaagauuugauuuccuugacacccugugugcaguuguguaucuguucauucuuaauaguugugaaauaaaucauaaaaucauaaaaguaaucucucuucuuucauaggacuuagaucaguuuucuucuaaucaacuuccugcuauugaaaauagggaaagagaaaguucauugugauuuuuaaaaaaguagguagaaaagaugccagaaucagugugugugugugugugugugugugugcgcgcgcgcacgcgcgcgcgcgugcaucuguauguuuguauaauuuuccaagaagcaugaaaugugggcuuguuuggguuuguagugacuuguauggcuguguuuaaagaggaggauuuaguauaacccaccuaugauaauaaaggauacacuguuaaaauaacacacauaucucuuuuuuuccuauuuuuauuagcaggauguugguuagaagaaaacugauguaagcucuaaugaagggagauuacguuuaugauuuuaugguucauuucacaguugucaagaaugaacaggcacaaaacugcacacaggagucaaggaaaucagaucuuuaauuggcauaguuaaaguccacaugaguucuguaagguuuugcuuuuuggaaaucauucuuuaauguguauucagcagugacuagcugauuaaucaguaugaguugauagaauccuuaggaaccauugucuccagagcagaucaauagucaucaccuaggcaagguaggcagcggugggaugggggugugaugaggguggaguaaagugugccuuguagacgagccgaugagugcacaguugugcauauaugcauagcgugaguguguauuuaauacauuuuaauaucaaauagauauuguuuauggaucaaugguguaaauaaggaagacagggaagagguaggcagguccaucuagaaucuuagaaaccuggggcuagauagcuccuaaaggaaagagaggugaauggcaugcaauuuagaauuccuaccagaaagcaugcuaacaggagucugacuguuggauugccccaagccuuucaucgggguucgucugcuugcguaugguuuuccccauguacuggcuguuuuugugugucaaccugacacagcugcaguuaucacagagaguggagcuucaguuggggaaaugccuccaugagauccagcugugggguauuuucucaauuagugaucaagggggaaaggccccuugugggugguuccaucucugggcugguagucuugguucuauaagagagcaggcugagcaagccaggagaagcaagccaguaaggaacaucccuccaugacuucugcaucagcuccugcucccugaccugauugaguuccaguccugacuuccuuuggugauaaacagcaguauggaaguguaagcugaauaaacccuuuccuccccaacugcuucuuggucaugauguuugugcaggaauagaaacccuggcuaaaacacuccauuugaagaaauggccaccuaguuuuucucugaggaauguagaguuucccugaagucugcucucuuguguaucucauuaagcacacucguggcgcucugugauagcuggcugcaguuaggaggaagccuacuccacuuccuuuguccuucaggacgcgcuuagccuuggauguuaucucuaaagguuugagagccuccuucaggucugaaagaugagaggagagagacuuccucagccauuuuucucaacugcugugccacuaaacugucuucagaacgugagauuagcggcugcagugugacuucagguggauuugccuccuguccuaggcaucuucaucucucuuuugaggaucugccccacccacuguguaagcauacugcugccugccuucccuacagcccuggccuuaaugugcuuuuauuggauucauggacucucucaacucuuuggaagaugccuuuggcuucucuuccaggcaguaagugucugagugcuauugaagaaccauuuggcuuagcaguagauacucuccucuggcuaauuucguuuccaucucuucugcagcucauaccuucaguuauauuucuuuuccugagagauacuuccagugagaugacaguuuuucaauccuuucuuugcccagaggucuugccccucagaauaaaccagaacugcagaaggugauggagaagagaagacgagaccaagugauaaagcagaaggaggaagaagcucagaagaagaaauccgaccuggaaauagaacuauuaaagcgacagcagaagcuggagcagguagggcuugaaaaaggggucugcucugagaggcagggaugcuggaugccaggcaagcagaauuccagcaggccagaugugcguguguguacccagagagagacaggagucgaaugcagugccagaugugugugugugcccugagagagacaggagucgaaugcaguggagggugugugugugugugugugugugugugugcgcucccugagagagacaggagucgaaugcaguggaggguguacaucccauucaaggcagacacucagguuccauuaggaaccuaaaagaggcaucagaggccaaagcaaacuagaggggcugggaaggugguucagugacuaaagcauuugguaacagcuggaccugauucagauccccagaaucuauguaaauguggggugguuguggcaugguggccagccuguaauuccaggacuuggaaauagacaagggaucccugaaguaaacaaacuagauagacuuugucauguugaccaacccugaauuaagccaagagacccugccuuaaaagaauaugguagauagugauugaagaagauuguccaggucaacuucagccuuucacauggauguuuacauacaugguggugcaugcaugcacauaugugugugugcaugugcacacacacacaaacacacaccgaaaaaaaguugaaguaucucuguacuccaaguguuagaauaaauuuguuugagaaagacuccagaacagcugugugugaacccaggauauucuuuuaauuguugucaccucuggguauaguuuauagcaacaaacaaaggguccaugcuucugcacagauuaaaauuccuaaaguuuauauacauauauauuuuuuugaaaguugagagucuuuugaaaagccauccaggacauaacuaauuuuuuguguuugacauucauucagcuugaacuugagaagcagaaauugcaagaagagcaagaaaaugccccagaguuugugaaggugaaaggcaaucucaggagaacaggccaagagguggcucaggcccaggaguccuaggcccaggcugugugugaccugauguguccccaccaucucuguaggagccccgucuagacaccucuacaguacuguucuugggccaaaguccugaggaagagaauccagacagcugagaauuuugacuaucaaaaaaggauugcguuugauuuaccauugugguagaugaguugucucugaugguugcaauucccauucgccaaaugaaagacaucgaccagcacacaagauaccauggaccuguguuuagaccaagaaagccacaaaaggagugaaaagaggcaggaagcgggcacuggaacacgcaagaggguuguacuacucggccuuucuuccauuccaaguuuagugggacacagagccuuccuuguuaagagaauuguuuggaaucccuccuuggguuaucuguuagauuguuuugauugcaucaaaauguauuucaucuguuacauccaguauuuguauuucauucugagaacccagauuuccccccaccaccaccacauuauaaauuaagaaaggaggcuauuacuguuuauguuuaauuauaccuauuacuuugguugacauugaaguucagaaacaggauaagacauuugaacaugucagcacccaucaugaacuaacuguaauucccuuagguucuuggcaugacaguaugccagauauugccuuuucacuucuaagaagguauauacagcuugucgauuccuuucucgccuugauaaccauagccuuucuguuccauuuuaguuugucauuucuugcucaacuauuccuuucaguugaagcaauuucucaguucuuuuucggaugaaaccagaguguguaacucaacuucugugucccauauagagagaccagcucuuuugaguucuccugagagcaguguagaggaguguauauuaggacuggugaugaggccuuuagagauuguauggaaugcaaauagagaucuguuucuaagagacuuuaggggaaggcuugauacuuuuuacauuuugaauauuuuagacuugagcuuugaacaucuccggcggauggucacaaguuucuuucccuuuuguuuccugugaagaugaccaucuuggcgcucuuggcaugaugcuguugguaggaugauccugacuacuguguugcaucucucaggaaaagcugaggugcugggcaaggcugcucaguucccucuugcuagcuagcaugcuguucaaagagacaucuaaguuacaaauaauaugaaaguucucaugcaaaauauauuuuguacuacaggcaugagauuuuuuuuggcuuuuuuuuucuuuuuuguauuuaguacuucuccauagagaugauuuaaccaguaauuucuacacugaagacuucuguuuccuuucaugaugcauagaauagcagauguagcgcuuuggaauccuugcuuagcacacuagaugcuaguuuucucugggaccacuucagucugguaguuuacaggcccacauucccuuccagucugcauaagaaguaagugggugauaauucacugcuagauaagaagccugagagcugaguacagcagagcggauucuugguccuaucagcaagugcuaucuaaauaaaauaugagacgcugaagauaaggugguuugcccuugaagauuggcucagugaccacuuugucaucuuccuuuccuuugagaaagaaaaguucauucacugauuguugaaauaagccucuccaugcacacugcuuagucuuucucuaugcauacagaauaaugacaucaggugguagggugacgagucggggcaauuagaccuuuuuaucuaccuggaagcuagcucuggagauguccugccacuuggcaggaucuucaagggccaucgcuagcucccauagaaggccugaugcuguucuacucuacaacacugggggaaaaguuagcuacaaacauguuugcuuccugguugcacucagaccggccaucauccuuggugguuagugcugcagggucuaucaaaagacgacuuguacauacaagaagugauggcuucugcuaggucucagagcauccggggagcagagcggggccuuuaggaaucugcugggaacucacugagaaugcugucagucacucauuucuugcacuuaacacugcacaaagccucaguccaaagccugaggacaggucaccaacugagcagugucgugcuuugagccacuaauaggggggaaaaggcuccauuuuuccacucuguaguuuucuuaaaauaguucuguguuuuguagucuccugcuaguaaaguaguauugcuuucuaagcuauaccaguugacuuuauucuucuacuccaagaaucuaaacccauuugaguguacauaauauauauaaagggagccuuaauggauuuguuuucauaauuuaauauuuuuuguauuugcucuuguauaauuguuuuuuuaauggaaaguauuacagaaucgagggugaaauucuuagaaccaaaguuauucuuaauaaaaaucaccaaugcuuggaccacgcagc

SEQ ID NO: 618 - RNA, 959 nt, Mus musculus
uucagggaccaaauguguccugaccugcagaacagugaauggugaacgaggacugggaaccaucuggaagagaaugggagaacaagaaacacaaagaaugccggcuugguggugcacaccuuuaaucccagaauuugggaggcagaggcaggcggauuucugaguucaaggccagccuggucuacaaagugaguuccaggacagccagggcuauacagagaaacccugucucgaaaaacaacaacaacaacaacaacaaacaaaacaaaaaacaaaaaaagaaagaaacacaaagaauggacagcaaguuacagaaaagucugaucaagcugacaaauuuuauuuuucccaggcccccccccuuuuuuuuuuuaaauuucugaaagcuuuuaauuuauucccucccaaaagaccaacugcaaucaaaggguuugaaaggucaagauuuuauugucuucauaacaaaaucggcuuagaacuggaucacuuggcccuuucucuucuuauuuauguauguauuuauuuauuuauauguaaguacacuguagcugucuucagacacuccagaagaaggagucagaucucguuacagaugguugugagccaccaugugguugcugggauuugaacucuuacugagccaucucaccagcccgcccuuucucuucuuguuuccucccaauucaaaaugcuugcaucucuuaauagcuagcauccucuuagaucugcaguugggcucaacgcacuccagugucagcacaaucuucuuuguaguuuuagccuuuuugcagaaaauagguuuaguuugcccaccauagccacuccguuuccugucauaacgucguuuucucugggcauacagagaauccuugcccuucuuguacugugucaccuugugggguuggugcuucccacauuucuugcagaaugucuggcgggucuuaggcauguucaccaug

SEQ ID NO: 619 - RNA, 359 nt, Mus musculus
aucuugcucuccgccagaucgcagccaucauggacacgagucgcgugcagcccaucaagcuggcuaggguaaccaaagugcugggcaggaccgguucgcagggacagugcacgcaggugcgaguggaauucauggaugacaccagccgcucuaucauccgaaaugucaaaggccccguucgagagggugacaugcucacccuauuggagucagaaagagaagcucgaagguugcguuaaucuugcagcuggugggggucuggauauccauuacuuagcccacggaaugaucugcaacuguuaaauaaagcauuuauauuaauaaauaaauaaauaaauaaauaaaucuuaaccucaaag

SEQ ID NO: 620 - RNA, 1061 nt, Mus musculus
ggaagcuccccauccuccgcccugugugacgcgcuuaguuucaaacucuguuucgcuuuuaagaacuuacgucugcucugguggugcauaccugaauuccuauauauuugguaggcuggggcagaaaaaccaugaguuuggguuauucugggcagaaaagacagcauaguaagacucuaugugaaauaaaaagaugaaagcaauauugugacaaaaugaacuuuuuauaauaaaaaaaaaucacacagaauguuacuuuuuauauuuuaaaaugagacuaguuucaaauuuggcugccaacacaguagauuaaguuaauuugcuuaagagcaaauucagagcgauuuggauacacugccuuccaaugcggaauuuguaacgggcuuucugugaacaggacucccuagcuguguuucucucuggcagccgugucggucauaccugugcugcaaagaacccugcaccaugagugcgucauccuggugaagcaguuccggcccccgaugggcagcuacugccuggaguuuccagcaggugaggcuuccacucgguccugagccugagagugagcaucgcaucaucuguccaaugagcuguaaauaaauaauacacauuccuaaggcuagggagaucgcuggauuugggucccgcgaauccugugugaaagccagguagguauggaggcuuaccuggaaggcagacaaaggggaccucuggagcaagcuggcuagugagacucgccauaucagugagcuguggguuugaccggaagaccuugggaagaagaguaauggaggaaaauucaccauuagugcuccacacgcauacacacaaacauauaagaagaaaacaccuguuucucugaugaggcuccuucaagccccuggccacaccccuuuccacaucgccuacuuacagagccucagcagagcucuccugagucucccaguacuugugcuauucauucaucaacgggucucgccaucugccacuagcaguccuucacucacaggaauuucacaguaguaaguacuucagacucuaaauugcagaagcuguaa

SEQ ID NO: 621 - RNA, 1061 nt, Mus musculus
uuacagcuucugcaauuuagagucugaaguacuuacuacugugaaauuccugugagugaaggacugcuaguggcagauggcgagacccguugaugaaugaauagcacaaguacugggagacucaggagagcucugcugaggcucuguaaguaggcgauguggaaagggguguggccaggggcuugaaggagccucaucagagaaacagguguuuucuucuuauauguuuguguguaugcguguggagcacuaauggugaauuuuccuccauuacucuucuucccaaggucuuccggucaaacccacagcucacugauauggcgagucucacuagccagcuugcuccagagguccccuuugucugccuuccagguaagccuccauaccuaccuggcuuucacacaggauucgcgggacccaaauccagcgaucucccuagccuuaggaauguguauuauuuauuuacagcucauuggacagaugaugcgaugcucacucucaggcucaggaccgaguggaagccucaccugcuggaaacuccaggcaguagcugcccaucgggggccggaacugcuucaccaggaugacgcacucauggugcaggguucuuugcagcacagguaugaccgacacggcugccagagagaaacacagcuagggaguccuguucacagaaagcccguuacaaauuccgcauuggaaggcaguguauccaaaucgcucugaauuugcucuuaagcaaauuaacuuaaucuacuguguuggcagccaaauuugaaacuagucucauuuuaaaauauaaaaaguaacauucugugugauuuuuuuuuauuauaaaaaguucauuuugucacaauauugcuuucaucuuuuuauuucacauagagucuuacuaugcugucuuuucugcccagaauaacccaaacucaugguuuuucugccccagccuaccaaauauauaggaauucagguaugcaccaccagagcagacguaaguucuuaaaagcgaaacagaguuugaaacuaagcgcgucacacagggcggaggauggggagcuucc

SEQ ID NO: 622 - RNA, 2224 nt, Mus musculus
cgagaaugagacggggcggaacucuaaggaggcauagaagaguggugggauaguagaauuacggggcgcugucgaggucaagguugguaacuuaguucuccgaagguugccugaugcgaacgugaggaacggguucaagaaggcaaacuuugauuggacuaauaccgaaagguugaagguuuaaaaaaucgaaaagcuaaagaacauggcuguugaggaagguagagguagaguagacuggugggggaauuuccagaaccgguuuaagguguuggacaugaaaaacagcuaaaauagagagcaaucaaggcuuuucccauuuggaaaauauagaaagcccucuauuguaaguauuauaacuuucacaguggaaugaaaucgccccguuuuuaaagggaugggguuacgaacuugaaccaaauugacugugaagugcauuaucagcugcucaaccuguuuucccaaguggauauaaugugcuucugaccuccgauucguguucagauuguggucugcuuagauguacauaugguucugcucugguuggcccauagccaaaggaacaaaggugcaaaacaagucuggauucaucaguguucaagcccguacaaugaucugcuaccaaccuuagugcuugagaugucuuugcccccuuuuuauucagccuuugcccauuugcuuucucccugcccacuucauuauuagcaaguaaauucucuuucaaauugugcaccuccuggguuaauuuuuucuuguucaaaacaaccaauaggucaaucacguaaagggcaccgaaggagggagaggugaaugcugccacucuaugccauugauaaguaauuaugagaagcuuuuuguuuuuuguuuuucgagacagaguuucucuguguagcccuggcuauccuggaacucacuuuguagaccaggcuggccucaaacucagaaauccgccugccucugccuccggaguacugggauuaaaggcgugcgccaccacgcccggcuuuuuuuauuuuuuaauauuuauuuauuauuauaccuaaguacacuguagcugucuucagaugcaccagaagagggugucagaucucauuacggaugguugugagccaccaugugguugcugggauuugaacucaggaccucuggaagagcagucagugcucuuaaccacugagccaucucuacagcccgagaagcuuuuucuauaacacacaacugaggaccacuuccaagucgcaggucuccuuuucuuauuuugucugucuuacccugcuccagaucuggugguguggugguucacaucuguaauucagcacaagaggauugcuacaaauuagaggccauccuagcacacagcaaaauccuaucucagaacaagaaaguauuuauuuccuggaucuagaauguaguuuacagcauugccuuaucuugcaugaagcccugggcucuaacucaggaccccacuuaaaaacugagaaaaacugggggcuggagagacggcccaagaguuaaaauuaccugcugcuguugcagauagcuggguucaguuccuagcacccacaugguagcucacaaccaaccaacuguauaacucuagacccaggcgcucugguacccucuacuggugucugcagugcacauguauacauacacacacccacacaguuuucuuuuaacuuuuaaaaaaggaagaaaaaagagaucuaucccuguauugaugaacaaguucucauccuaaacaagucaaccccugucuaagaacaccccagguguucuuaggaacucuugucaucacagggaacaaacaagaggaggcgcuaaggaucagcucaaugguagagcauuugcugagcaugcaaacaacccuggguuugcuccccagcacuaacucauaauauguuuaguacacuaaacacuaagccuguguuauccagcuagauacaaugaagugagcagaugagacaugggaaggaacucugcccgagaugaaaauuuaaucauugacuuaaacauuacaggugcugcuccauuuagaacagucuugcaucuucuuuacaccuguuuuaaauucaacccaaacugaaacuauuucagccaccuaaccuacuaaacaaccuagcucugcaguacagugugcuuagaguauuaguuauuaucucucaugagcacuuaacguagcuaacuagggccaugcaggccaauuuugcuaucacaaggcaaa

SEQ ID NO: 623 - RNA, 4790 nt, Mus musculus
uaucugcuuucccgcacaagaggacccaggacgccaugcaugaacagaggucuccaaacagguacacauuuuggcaagcaggauaaagugauccaaaccugauaacacgagaggacuauuuaggugucuaaguccagauuagagugguauuuggaacgcaagucuaauauggagucuccucagcuccuuuuucgaugauuauuccaugcagagugcauaauaaugaaagaggcuuagacauugcaaaggaaaagacgaaccaacagccagauucggaacccuuaaaacauccacuggcugcucauagguagcggggagcaaaugcauggucugcuuucaaaagacaacuaguacacacacaacucccucacagcaguccuucuccuuucucucccuggcuugcucgcucucccucccaaucucuuggucucaauuucauuucccucucucuguuuagauucuuuuuucucucucuuucucuucuaagauaaggaagcugcuugauucagggcaagauuggcgucuccaccagcucucaaaacuagaaaagccuauguuaaaaacaaaggacccaacaacauaccuuaaaagcagcuccucauuucucauaguaacagcggauuugggacagcgcaugcuuucuacacugauagucucaacaaaagccaguucagaagugcgcucaaacaucaaugccacagucgcuauucacuaaugcgcccccucuccucucucucucucucucucucucucucucucucucucucucucucucucucucucucucucccucucuccucucaaaugcugaauaguacagaaaagggcuccugcagacucacugggaagaaauaauccucuccgacaaguuauguuaucuaggcauguuuuugcacuggugugcugugucuucuagagagagcuuguuugcaugcacucaagccuggcauuggaucuccuaauuaccaucuuaaaaacugggaagauuuuaagcaacucagugacaugugauuucauauauauauauauguguguguguguguguguguguguguguguguguguguguguguguauguuagcaaaaccaaucucacagcacaguucacuaucaacuaucagcagagcaucccagaggacugagauuugaacaggucagugugcucaaaaggauuuuugccucucuuuucugggacacugcauucacaguuggauucaucuguuccucuccucuuguccuuagaaagagugacaaggucaagacccucagccucacccuggaccauagaugcagagaacagaggcuaagaaacugggaaguguuuuaacucucuguaugccagaguucuuauaaauuaagagcuucauucaccagaauccaggcaucaaagccagcaggcaacacaaagauuguuuggucgcacugaaugcguaauugacagauacagcagcuucauuccugaaaggcuaaugaguggcuuuuuuuccccaaaacaagaaaauuugcuacucugcuucacuauauucuugagccuuugaacauaaaguggaccagagaaaauacacauuccccuuucuguuucuuugaguaggaaucauuccauaaauaacuaggaagucaaacaguaaguuaagcacacacacacacacacacacacacacacacacacacacacacagagagagagagagagagagagagagagagagagagagagagagagagaacucuauggacugcacacauagucauccaaaagggcaaguucggacgucacuccaggggaugcacacugaccuuggaaguugggaaaacccucacuuucuauggaauaaccuagaacauuucaaaacagaccugagucaacaaagacuggugugaauccugaaugcucaccccauccuauaucggcacaaaguguaucuuuccuaguaaaauucuggacuugaaauauaaccgggacuaagagugaagaaaaugaugguggguuuuguucucccccauauuugaggaccuuaaauaauauacccaguaucuuguaagaucucugacuuuugaacuuggucuuauccacagucgggagaucuggggagaguguagagggaagaguuccucaggcucugcuacacaacauuccugacuggugcauccuagacuauggaaacaaagaaaggauagacaacugccauucccauuucuacacaucacuaagacauggcaaaccacuugacaaagaucaagucccaaaacaagagccucaucuuaaggacaacuccaucaucccaggucuuugcuucauuacacgauaugaaaaucaccaagugaacauaugagaaggaaugaccuugccagggaaggcuacuguaugaaaugcaacaugcuccuuugaagugggaaaaguucauguaaaugaacuuggaacuggagagaccuugaggaaauagacugugaccuucuuccccuuauggcuugugggagugucagagcagaaggcucuugaccucccuguagcucucuuugcccuguaguuaaauggagccaccaacugcuaauuuauuuuaaagcacgugaagagccugugaaacuggguguguuuggucagugcaaauauuaauaaaaagugaauggucgcauggacaucugcugugaguuugucugacagggaaaguagaacugugaggcuuaggcugcugcccugguauccaugcagcucuccugacauuucaaugaauuauggauccauaguaguaguggccagaauugaaccaaaccacuaaaucauuuauaucuauccacuuacuuuuuagucuugaggccuaaauaauaaggacacuacugauguaagggcuuauuacuuaucccaauucuacuacgaugaccgaggaccuuaugcccuccagcugcaugggcugaaugugggauuauagaaugagugaauagaacauguuugcuacuuguaauauuugcauaugguauaggaaguuugugauuucaaguguacacugaauuaaccucuguucuuccuuacacauccaauagaccaucuuucucucuguuugaguccucuuauugaauauugauccaaugaaaauuuguuaagaaacgaauucccuucuagccauugaaacaagguggggaaagggauuguauuuuccaagauacgcaguuucuuucacaaauaugagaaaaugcucccacuuuaggcaugaguuggcacagaugacaacucauaaauguuccuuccacacuauugugcucuaaauuucaaagucucuuuguauuuauccaucccacaacauugacagagguggcauaaugucacacucucaccuaaaaaguucaagugacuugccuacagagcugcaguaaugaccaagcuugggaacucugucuacugcacccuugacacagaguauggccgcuagacacacgaggcagggcguggccuuuaaggagcagucagugugcuguaucugacacucucuucaugugagaguagcagucagagaggaaggaugccaagguaauggaaacuugguuaaaagguuccuccucugauaccaguuuuacaucaauucauuucaaacuuuauuacaauugaagauuaaagccacacagacuaaguacucuugagggcaaauuauuacuugggucaucaacaauaguuaauuuuaauagucuugauuauuaaauuagguuuguaggggaauuuuguuugaaagaauuauagcagcaauuagcagggagcaacaauaaaaauauaaauugucucaguacccucuauauucaaagagacguuuuucacuucauaaauuaaaccuuuaacuaagaaugcaaauuuggcauaggacaaaguaggaacguguugugaugugggauuauuggugagagugagaaucagucagcuucuugaucuuucuugauuugaacuuccuaaaaguuuuuuuuugaaagguaaauuauaugugaguuuauuucugucacaauuuccagaaucagaagcuaaauuuucacaugccguauuaaugacuccaacuguuuuccaccuucugugccuugucuuugcauuuugacauuuacauugcagaaguaauaaaaaggcaccauuucaagaggaaugcauaauauaaugagugcugaggauggagggucucugcagaauuaaauccuccugugaugaaagguggcacacuacaaaacccuauccuaccuccgggguacacauccucaaaggacaguguugaaaugcaagagcaccaagaauaguaaauuuauuugguugucaguuucaaguguuaacaacuggugauuccugguauacaccugaaggaaucuaagccuguguacuacagauauccuuguacauaugaguccauugugauaccuuucacaauagucaagacaagaacuaggcuagaugucuaucaacagauggauacauaaagaaaguguagaauacgcacauaauggaguuuuauuuagguguaaaagaacacaaaaugauguuauuugcaagaaaauggacgaaacuagagaucacccuguuaagugaaauaagccacacuuagacaaauaaucuaguuuucucucaucugcugaaucuggauucaaaauauaugcaaguguauguaacacacacacauaugugagaguagaaaaggaauaacgugagggaaaaaugaagggagcauuauauaccgauguaauugggagcaacuaugaugauauauguggaugauaugucauaaauaaauccuuuauguuauaugcuuauuaaacaauuaaucua

SEQ ID NO: 624 - RNA, 1750 nt, Mus musculus
cuuuggcuugcucugcccagccagggucucuggcggucucguggacccaggaaaacaaacgcggauccaaaagguuccagcgccaagguggacucaccguggugggucggaggauaccucugcaccguagcccugacggaguuuccguaguaggacgggacgugguugccuugaccaucgauguuaaaaaguacguccaccucuuccgucagcggauacugagcuuccauguacgaauggccgaggcccggguggugcgugucugggugcugaccguugaggaccgcggggugaugguggcucacccagcgcggcugguccgcagucaccuccauguccucggcugugcucgcgcccucucgcccggcccggaacccucgcggguagagggagggcugucggccugggagguccgcggacuccugccgucggaggcccaggagaggggucguuuaaugguuuguuugcaguuaaggguauagaaaaggagagcaaaaaggaggguuuagggaggaaagaaaaaucuuugcgggauaguuuagcaaaagaaaggaagggaaagaagaaaaagaaaagaaugagggcgauccccccccccaaaaaaaaagcagacacggaggaauaaaggggucaaaaaaaaaaaaaaaaaaaggagggagagaggaauccgagugugaccacacugcacacugauuccuuggcgcucagagacgguugcucuuccgaucaccugcaagggagagaaagagagaccugaaugagguguaagaacuuuuaacaccugaaauucuggagggcacuaggucuucgcaagcuuccugcagggccgacucacccgggacgugcacacgcacgcgaagacccggagggaaagaagccaagcuccgcagcacaccuccgacagccaggcucgcaggagcccaggacugacuaagcaauuaaaacuuggggacaaguccucccuggaggacaccggccccaggaucuuuccaaccacuacaaauccuccaaaaggagaaagcugagcuuuuaguuuacaaaaaaccaaacaaacaaacccccaaacacacacacacaaacagucccuccaagaggagggagugauaucaaacuuaaaaaaaaaaaaaaagucacaagucacaauaccaaccugaguagcaaggagcguagaggaggaggaggaggcgugugaccugcccggucagauugcguagcucucuaugucucgcucucucagucucucucucuuucuccucucccucucucaguauuuuuuuuuuacagggaaugcauucuuucugaaacuaucaagacggcgccaggcagcucaguguucgcagacagcuguggcgcgacgcaacuuaaggagguucuagugucauccgcgccgagggggaggagccuggcgcuggcaggaggggacacgauccucagcacaaggaaacugcaacccaaacccgcuccaggacuucaccuccacccccaucccaucccccccacccaccccggcacaccgccgccccuccucccgccccucuacugaccggaaaggggcgccgccaagggccgccuagggcagaggggccgcgggcagggugggcgaggcccgcccgggcuuggggcagaggggacaggcaggagggaauucgcucucuggcccuuuaaauguagcaaagccgauucauucgggcucaguagauuauuccguacgagugaaacccggcugccccauucauaaagcuaauuucca

SEQ ID NO: 625 - RNA, 5524 nt, Mus musculus
agggaaaaagagaggagggggauaccggagagggagggccgaggucggcuccgagacccaccgggaagaagggggaagggaucgaguccggagaggcugcggcgcguggccugaggcggagagcuggacuccgggggucugggccaggacaggcgccggucugacccgccuugcucgcaaaugcaggccgggcuuccucuucccuuggcggguggugggggaggggagggggcuugaggccggagggaaagguggucccaauccuucaguuccagagagcuacaaagcugauccgggccucguuaagggacgucugggugcccccuuaaagaccuggggugccaccaccaccacaaccccaaggcacaccgggucuggcucgguguaccgcauuccccuucuuccccuggagcaucuggcggagcugggggaaaggcaagagaaagccaucaaggagaaugcuguugccgcugcugccuggagucuuuggcuccugcaguucaugaggccucucucuauaggguaaggggcugacgaacgcuacgguucccuggggacucagcaucuggagcggagcaggcaaaggcucagcuagaaccgggaucuggggcuguuguacuuggauagccggagucaauuuggccuaucugaaaacccaggccuugaggcugcugcuggaggcgucaaguugagcaggguaugugugcccucuuggggaaaggguaagaaauggaucugacuuacucuaugcguggaguaagcugagacaccccucaccccccuacacacacacacacacacacacacacacacacacacacacuugcccauccucaggucccucccacucgccuucacuagggcgaccccaucccucuagaaguagacacaaccgguccccuucagaauuuggaagcccugauugaaaaaaaagguuuagcgagugauugggccucaucacuuggggccauggacccagaagguagaaauccacccagagucaacaacccgaaccugacuccgagagagaccaggcgagcuccgcggggccgagaugcgaaaagaugcuacuuugggggucgcggggguggggggguuguugagcgcagcccuccagagagugaccugcaaagccaaaccccgggggucgaaguacuauaguuacuaauccugggcagggguagaaagcgugccucggaaugccuagggcugucauuugagcguguuuacuuagggacuuugcacgccgagcgcaagcggaauaguaggauucuccuagaggcagcaaauguuugcaggcuggaaaacgaagcggagcggggcgugcugccuugucccuccucccggagccaaggcgccggccugggcggaucugauggcgcgguuaccgacugaagugaagcccggaaccugaagggcugggaggucggggagaaagcagagcagcaccgaaggccagaaauuaaauucacagcccgggaccccgacgacccaaggacuagggaaaaagucacuucccauuccagcucgaucaaucuuccuuccaugcgauugauuaauagaaaacgaagugaaaagaccguggucgcugugcgucugggaaggaagcgaagggcagagguauccaggccggcgccgguacccccuuaccaccgguucacaacccggaggucuacaucgccucggacuagggaagcggggcgguggcgagaacccagggagaccgcgcgggaccuuuaauuggguguauccguuuuaacaguggccauuguugaagcaauuagcgagagacaauaaccaccgagaugcguuuaauucgauuccgugcacgcugcaauccccgcccgggcucugcgauaugcaggccugggauaacccggagggucugguugugaagguacggguuggguuccuugaucauuuugucuuaggcauggaaguuguaaaagaaaggcgggagggggagcuagaucugcccccaagcaagccacgguaggagacucauccuuggucaucccccggaccacuguucuuucuuggagcauggguuggagcugcggccgccuggucaauccacagugccuguuugagaggagaaaagccgggaagacugggacauggauccaagucucaaucuuacuuccccgccucgguuucucgaacuaaauccuaauugccuucccaauccggggaggagcaaagaagagacccugcuuaagucucacaacacacuuccucuccucuggagccagccccuguacccccuccuccguuuuaaccuccggauuaaguuacccaggccaggcgaggguuuuuuacuggauacgagaauaguacagguaaagcuguauaaauaguucgccagcugcggagcaggaggguuaugccggggacacagucccaaggcgccaccagucagccuggcuugagcuuacaaaacggcuggggaggccacuuugccucggcgacccggaccucauagguuaaacacauauuacguuaucaccuuagcuuucaccauguccucuuuucucuuuuuuccccgcaugagcugaaauacagagaagagagcaaaaucaaaccgcgguggaaaacgaagcaagcagcggggccaugcuggcugaggcuuccugcuccucaacggagacaccuuuccaauuaaaacaguagacaugggaacuuuagugauguaaagaaagaagguugcuaaaagucacuggccaggagaagaagcuggcuguagaagccuggggguggggggacccaugggaauuuaaaugaaaaggcuaugcacccgcagaucucccggcucccacgcccacccgccccgggucugggguccauuuuccaugcgaaaugagccacuguuuuggauauguguuuugauuuuuuuguuuguuuguuuacucaucuaucacaguuuaaaacaccggaggaaagcugcccaagccaggaggagcgagguaacgacguggaaacuaccagagaagagaagcgcugggcaauaacccaccucgcacuccgcccccgccccccccccagcccagcccucuccuucaucuucggaggauucuugcccucccucagccaauacuauuuuccccgcuugagaaaaccccugauuauaagagauuuuuuaaagggggggguagauaggggugaagcggaaaggggcaggcggacagggagaagaccggggauuucugguuucgaauugaacaaagcacaugcguuggagguggcgacuagggagcuuaagccuagggcaggaagagaaagaacuauuccagaaagaagagagugugcacuuucuagcuauccguggagggaccgugggaaagcggaagggaugagggugacccacugggaagugccggcuccaggagccgcuucccugcccuuuggcaucaaucuuuuucaguaggauauucgcugccucuagaccuggccugcucccagugaagccccaggccccaccuuugaagcaccuagaauugcuuacggcauccaagaaaaucccgagccaggugguugggguucgaccacuuaaacaaacacacaggccccuucaucuuaaagaaaaugcagugaaacugaggagagccagccuugcugaccucccagguucaaccuggccucuagguuccccgggcuagcuaaggcgcuccccaguccccagugccugccugcaucaucagccuacucucuucugaagcuuuggugguuucaaaaggagaaagugggcuuuaucuugucgaugugggacuuuugugucuccagauuagcuuaaggaauuggaauacugauuguggagagacaauccaccauagucgagggaugagggggcuucacagcaaagguagaaaagcgggaggagagcugcuucagauccugggacaagcagaggccgcuuugguuuuuguuuuuguuuuuguuuuuuuuuaaauaggaaucaucauuagugucauuggaugcgauggugagccuauagaaaagaucgugguuaugccuggcucagacuucccggcaucaugggcucuuugcccagagcuacuauuugccggccugccggccugccuggaacucuccgguccagguccgggcuuacugaggcacccuccacagccugcgaccccagcaaacugagcuccagccauuuguuacauaaaauaaagcaaccaccaagugcuuacccaucacuagcuccuggcagacccccuccucuggacaaacccggaccucugagagcaccuggcaaccggccugucaucauccaaguuaacuguacacgcauucaacaucacccuagccccuaucgaccaccaaaggaagcaaagggugcucucucccccacaguuaaugaaccuccuggguuauugggguuauuccaaccguugauggggaagggugaucagaacuauuguauugguacucaaaggcauaccuggaaagcaacacauauucaagugugaaauggcuuagccaucaagaauaaaacaacccucgggguagccaagagagagucaaaauagcccugggcuaaagaacagaagguuuccccuucgguccuacucacggggucagaauucuuauuucucuaucaaagucuucacugcagggcacacaaauugucaaaaaagauggaagccuuaggacuuccauacaccugcaacuuccuuggccuuucuguguggcuuugggcaauuggcaaacacacagaaggacacuaccuguccuaaggcuugcacccaucuuuucacuccaccuaugccugaaccccacuacacauuuucugcaagaaggcagagucaacauaggaaauaaaggaaaaugcagaucgccugcccugggcuuuggauuguaacagaagaggacuagagaaucuggggcugcuagcaaagaccaauuauguagaaggugaugucaaccacugccaugcaugcuauucucuaugcccuguugugucccagagccagaaaccuuaggccgcauugagccacuggcuugaaccuugaagcugggccuucugcuaaauccuaaugcuaaaucaaucaguaaacagaguucauugaugccugcaugagucuuguucuagcaggacagaaauuacaucuagaccuagugcaaacugauagagaacauuuuuguucucauuuuauaggaagcccucuuccccacauauagcgauuugggcagccaagcuucuuguuuagaaauaaccugccgcuggggggacagcccacuaccaccacugcggaagagugaggggcugcacaaaggguaccuucauuauuugucccccuucagaauucugggucucucaaacugugauuucaggguccugguguggucuauaaggggaggagaugucaaaaaauauggaacuacaccuacagcaagggguccagcgggcacagcuacuucauuccuauucuggauggaaucacaccugucaguuuguuacccugcucuauuaaagaaaucgccuuuaaaaaaaauaauaaagcaacggcucugcucauau

SEQ ID NO: 626 - RNA, 5524 nt, Mus musculus
auaugagcagagccguugcuuuauuauuuuuuuuaaaggcgauuucuuuaauagagcaggguaacaaacugacaggugugauuccauccagaauaggaaugaaguagcugugcccgcuggaccccuugcuguagguguaguuccauauuuuuugacaucuccuccccuuauagaccacaccaggacccugaaaucacaguuugagagacccagaauucugaagggggacaaauaaugaagguacccuuugugcagccccucacucuuccgcaguggugguagugggcuguccccccagcggcagguuauuucuaaacaagaagcuuggcugcccaaaucgcuauauguggggaagagggcuuccuauaaaaugagaacaaaaauguucucuaucaguuugcacuaggucuagauguaauuucuguccugcuagaacaagacucaugcaggcaucaaugaacucuguuuacugauugauuuagcauuaggauuuagcagaaggcccagcuucaagguucaagccaguggcucaaugcggccuaagguuucuggcucugggacacaacagggcauagagaauagcaugcauggcagugguugacaucaccuucuacauaauuggucuuugcuagcagccccagauucucuaguccucuucuguuacaauccaaagcccagggcaggcgaucugcauuuuccuuuauuuccuauguugacucugccuucuugcagaaaauguguagugggguucaggcauagguggagugaaaagaugggugcaagccuuaggacagguaguguccuucuguguguuugccaauugcccaaagccacacagaaaggccaaggaaguugcagguguauggaaguccuaaggcuuccaucuuuuuugacaauuugugugcccugcagugaagacuuugauagagaaauaagaauucugaccccgugaguaggaccgaaggggaaaccuucuguucuuuagcccagggcuauuuugacucucucuuggcuaccccgaggguuguuuuauucuugauggcuaagccauuucacacuugaauauguguugcuuuccagguaugccuuugaguaccaauacaauaguucugaucacccuuccccaucaacgguuggaauaaccccaauaacccaggagguucauuaacugugggggagagagcacccuuugcuuccuuugguggucgauaggggcuagggugauguugaaugcguguacaguuaacuuggaugaugacaggccgguugccaggugcucucagagguccggguuuguccagaggagggggucugccaggagcuagugauggguaagcacuuggugguugcuuuauuuuauguaacaaauggcuggagcucaguuugcuggggucgcaggcuguggagggugccucaguaagcccggaccuggaccggagaguuccaggcaggccggcaggccggcaaauaguagcucugggcaaagagcccaugaugccgggaagucugagccaggcauaaccacgaucuuuucuauaggcucaccaucgcauccaaugacacuaaugaugauuccuauuuaaaaaaaaacaaaaacaaaaacaaaaaccaaagcggccucugcuugucccaggaucugaagcagcucuccucccgcuuuucuaccuuugcugugaagcccccucaucccucgacuaugguggauugucucuccacaaucaguauuccaauuccuuaagcuaaucuggagacacaaaagucccacaucgacaagauaaagcccacuuucuccuuuugaaaccaccaaagcuucagaagagaguaggcugaugaugcaggcaggcacuggggacuggggagcgccuuagcuagcccggggaaccuagaggccagguugaaccugggaggucagcaaggcuggcucuccucaguuucacugcauuuucuuuaagaugaaggggccuguguguuuguuuaaguggucgaaccccaaccaccuggcucgggauuuucuuggaugccguaagcaauucuaggugcuucaaagguggggccuggggcuucacugggagcaggccaggucuagaggcagcgaauauccuacugaaaaagauugaugccaaagggcagggaagcggcuccuggagccggcacuucccagugggucacccucaucccuuccgcuuucccacggucccuccacggauagcuagaaagugcacacucucuucuuucuggaauaguucuuucucuuccugcccuaggcuuaagcucccuagucgccaccuccaacgcaugugcuuuguucaauucgaaaccagaaauccccggucuucucccuguccgccugccccuuuccgcuucaccccuaucuaccccccccuuuaaaaaaucucuuauaaucagggguuuucucaagcggggaaaauaguauuggcugagggagggcaagaauccuccgaagaugaaggagagggcugggcuggggggggggcgggggcggagugcgagguggguuauugcccagcgcuucucuucucugguaguuuccacgucguuaccucgcuccuccuggcuugggcagcuuuccuccgguguuuuaaacugugauagaugaguaaacaaacaaacaaaaaaaucaaaacacauauccaaaacaguggcucauuucgcauggaaaauggaccccagacccggggcgggugggcgugggagccgggagaucugcgggugcauagccuuuucauuuaaauucccauggguccccccacccccaggcuucuacagccagcuucuucuccuggccagugacuuuuagcaaccuucuuucuuuacaucacuaaaguucccaugucuacuguuuuaauuggaaaggugucuccguugaggagcaggaagccucagccagcauggccccgcugcuugcuucguuuuccaccgcgguuugauuuugcucucuucucuguauuucagcucaugcggggaaaaaagagaaaagaggacauggugaaagcuaaggugauaacguaauauguguuuaaccuaugagguccgggucgccgaggcaaaguggccuccccagccguuuuguaagcucaagccaggcugacugguggcgccuugggacuguguccccggcauaacccuccugcuccgcagcuggcgaacuauuuauacagcuuuaccuguacuauucucguauccaguaaaaaacccucgccuggccuggguaacuuaauccggagguuaaaacggaggaggggguacaggggcuggcuccagaggagaggaaguguguugugagacuuaagcagggucucuucuuugcuccuccccggauugggaaggcaauuaggauuuaguucgagaaaccgaggcggggaaguaagauugagacuuggauccaugucccagucuucccggcuuuucuccucucaaacaggcacuguggauugaccaggcggccgcagcuccaacccaugcuccaagaaagaacagugguccgggggaugaccaaggaugagucuccuaccguggcuugcuugggggcagaucuagcucccccucccgccuuucuuuuacaacuuccaugccuaagacaaaaugaucaaggaacccaacccguaccuucacaaccagacccuccggguuaucccaggccugcauaucgcagagcccgggcggggauugcagcgugcacggaaucgaauuaaacgcaucucggugguuauugucucucgcuaauugcuucaacaauggccacuguuaaaacggauacacccaauuaaaggucccgcgcggucucccuggguucucgccaccgccccgcuucccuaguccgaggcgauguagaccuccggguugugaaccggugguaaggggguaccggcgccggccuggauaccucugcccuucgcuuccuucccagacgcacagcgaccacggucuuuucacuucguuuucuauuaaucaaucgcauggaaggaagauugaucgagcuggaaugggaagugacuuuuucccuaguccuugggucgucggggucccgggcugugaauuuaauuucuggccuucggugcugcucugcuuucuccccgaccucccagcccuucagguuccgggcuucacuucagucgguaaccgcgccaucagauccgcccaggccggcgccuuggcuccgggaggagggacaaggcagcacgccccgcuccgcuucguuuuccagccugcaaacauuugcugccucuaggagaauccuacuauuccgcuugcgcucggcgugcaaagucccuaaguaaacacgcucaaaugacagcccuaggcauuccgaggcacgcuuucuaccccugcccaggauuaguaacuauaguacuucgacccccgggguuuggcuuugcaggucacucucuggagggcugcgcucaacaacccccccacccccgcgacccccaaaguagcaucuuuucgcaucucggccccgcggagcucgccuggucucucucggagucagguucggguuguugacucuggguggauuucuaccuucuggguccauggccccaagugaugaggcccaaucacucgcuaaaccuuuuuuuucaaucagggcuuccaaauucugaaggggaccgguugugucuacuucuagagggauggggucgcccuagugaaggcgagugggagggaccugaggaugggcaaguguguguguguguguguguguguguguguguguguguguaggggggugaggggugucucagcuuacuccacgcauagaguaagucagauccauuucuuacccuuuccccaagagggcacacauacccugcucaacuugacgccuccagcagcagccucaaggccuggguuuucagauaggccaaauugacuccggcuauccaaguacaacagccccagaucccgguucuagcugagccuuugccugcuccgcuccagaugcugaguccccagggaaccguagcguucgucagccccuuacccuauagagagaggccucaugaacugcaggagccaaagacuccaggcagcagcggcaacagcauucuccuugauggcuuucucuugccuuucccccagcuccgccagaugcuccaggggaagaaggggaaugcgguacaccgagccagacccggugugccuugggguugugguggugguggcaccccaggucuuuaagggggcacccagacgucccuuaacgaggcccggaucagcuuuguagcucucuggaacugaaggauugggaccaccuuucccuccggccucaagcccccuccccucccccaccacccgccaagggaagaggaagcccggccugcauuugcgagcaaggcgggucagaccggcgccuguccuggcccagacccccggaguccagcucuccgccucaggccacgcgccgcagccucuccggacucgaucccuucccccuucuucccggugggucucggagccgaccucggcccucccucuccgguaucccccuccucucuuuuucccu

SEQ ID NO: 627 - RNA, 1684 nt, Mus musculus
aguaguuugcgagcaagggaggcaaaagaccaaggugagcgagguggagagcauucuggggguggcucuggccgcagccgacccgagacaaugagagagaccgaagcacugguccaggagcagcaucggugagaggguguguggcugcgagccgggaccccgcuucccugccgguggcgggaaguuagcggaugaggaagaggcaccuaagggaugacuggaguucgcaggagacgguggaagccccccagacggucggagucugagaggauccccaugucgaagccggcuucggaacgccaccccugcaggggaugcccaaagggguccggaggggcaaaggugucacucgugaccggcuuggggcagcccucccgcaacccagccccaguacucacagaguucagaguaccgauggcagccccggcccagcugcugcagauagcgcugcaggacgucggugaggagguggcaggcgcugagcugcaccgagucccagcccagcgccuggcagaucugcgccaccgagacccucaacaacgaccuagaguaacucucgcacaucccgcugcguggacgccaccgcagcccuucgcugccacugcucuccagcccugccgccucgccucagcagagcccccgauucauucucugggggccccgcggcggggaaaucguccccccuccgacccggagcgaccaccucaaagccucagcagcacggagcgcgccagccugagagccgccauuuuggacucgcuccgccucccgcuggacggccgccggggcgaggcaguacgagcagaaggccgagagauaggcggcccaggcuccgcccagugggaggagagcgaucgucucgggaucgacucuagagccuggacgccggccggaagccgagugacugggcgcagguggagucugcgccucccugacaacaggugccggugucuuucucuccccgcugauggaaaaguaagaggugacccucgguguguucaggggcaaaccagggaggcaguggaauguuaaggacuuaacaucgauaauguugauagagauucaagugugaaacuagagaauugggaauauaagcuacuccgcagaacgcggauucgauuguuuuccuuuacuuaaaucuaaaaaaguaaaaacgaaauuaaaagaugaaagauaguauucagaaugaaauaguggccacuugggagguuugagugaaauccaagauguucacucaggaggcugaggcaaucauaagcuagaggccaacuagagucaccgaaaaaccgaaaaagacuccggcucuaaaaaaaacaaucagagcuaauaaacucauguuguucauugugucguucaaugcucuucauaauauggcugguuuuaaggaaaaaugccuacguguucaauuagugggaacugccccccucuuccccaguagugagcaagauauuauuuuagugcaguuuauagcuaguucuaguuugcgucuuacuagucacaauacguagucuauccaagacguggagaaugcaguucccuacagaggucgaauacucuguaaauccuugagacugguuuuguccagagaaugcuugcuugccuuucccagggcuucuuccagcccuaguugcauuuugccugacgguaacagaaacugugaugagaugauaaauagguuugguug

SEQ ID NO: 628 - RNA, 24486 nt, Mus musculus
cgcucacgagauuuagcgagaccgaggacgcaggcggagcgggccggggcgccugagcucccgcgcacgcgcacugagucccgucugcccgaccuucaaggcuccaccauguucucgcgggcgagcguugucgggcugucggccugcgccgugcagccgcaaugguaggaccacaucgggagggaugcgggggcucgggcuugcugcgaggcaggagggauggagcugcaugcucacuccuggcggaagaaggccccagcucaggccgcggggaugucugcagagcuggaagguugcgugccggaccccugguaggggucaaagagaacaaggucacggucugauccccugagacuggaacggccauccgggaccucgggacccggacgggauucggguugagcuuuggagccaucuggguuucgaucaacuccguacuuccgcuccguacccgggagcacagcuugcaaagucuuuagaaaggcccugaaggugaaggggcgaccggggaacguuugguuguaacuuuuggcuuugaagcccugugaaacacugcacgggggagcagcgugacccuuuaaggugugauggcuugcuugagcucuuugguaaggcauucacuguguagccauccgacucuuugcuggguacuggagaaacgaaggaacucaaaaucagcccccgccugaaccugcuggucgccuuggugcuaaagggguuuaaaaaaaucugccgaugaggaagagaaagacauugccauugucaucaugcccucguguugaaguacaaucucugcaaggucauaaaacugucccaaggucccucgguaggaggaggaggccuuaauacaguuacauuuguuagccuccauuugauaaagggauaccauaagguugggcgacuuuaaauacuaauccucugugcaaaauaaaauaguuguauauuagaaugcccagggaaggucagguaaaacgugacuuaugggugacguuguauaauaacaugaacuacuuugaagcuagacugcuagaagaacuggugcuaaggagauuguuaacuguggacaguguuuuagugguuccuuguuuuuaugguacagaggauuauuaaggcgcuccagcacugaacuaggguuuuguaaccuagguuagagaacugccaagaacuaguugaaauaguucuuucauuaagcaaagaauuuguagcaauaugcuaagacuccaaaguagugaggcaauuaaauacgauagauaugaacuauguauuggaagaauguugguggugcacaccuuugaucucagcaacucaggaugcagaggcaggugggugucugaguucugggccagccuagucugcaaaaggaguuccagagaauguguguguguguguguguguguguguguguguguguucguucagauguuguuagauuaaccuuggaagucagcuugaguuacuuauauggaggucaauaacaguugcauucucaguugugucuccuucagccaguagauauuuguggagugccugcccugcaccaguuggcacuucuuaggugauaagaugugaagggucuuuguuggcauccagugguccucagcaaacaucagcugucucccguguuuguguauacaaugugugaaaagacuauucuuuugucaaguguagugaggccacugucagaauuugauacgcuuccaauguuuucuugagaguuagcuagguauuagcugguuagguguucacuaguuagcuaguuggguguuuuccuuaacucuacacuauguagcaucacacacucccagcauuccuuccagacugcugauucguucauaggcaucaagucuaacuccuuccucuaccgacuugaagucuucaaauaacacuguaugaucaaagaagaugcugauacuuucucacaguccacuugcuucuccaucagcaugguggguagggcagguuucuguaccagccuccagaggaugagucgggacauggugcaguagcuucucagaguggaguucauuaaaguaaauuagcccuaaaggcucgagagguucacucuugccauccugagucuggcucuagcucccuggacaugcaauugaaggagagagccaaccucuaaaaguuggccuuugacucaguacuccauauuucuauuucccccauaauauuuuuaacauuugugagcagucagguaccucauggccauucagugauggagcugugguguagacaguugucuugagcuagaggaaggagaaccauaacugcucuuaaaguauacacugcacggagaguuagagggcgggugugcaacucagaaccgucugcauaacguuccaugggagccugugucaguccaagcgaagcuugugccuaaaaccagguuuucuagcuacauguggagcauuaaggaaaggaaaaaauagaaaaagaaacaaagcucaaaugguguugccuuuguugugccauuucuagaagggauuaauagaauggucucuguguccaauagcugguaugcugaaauaguuugucacauauuccaucuuugaucuuuucuauauuuuuacaaccaaaccuaguauuuucuauauacucuauuucuucuuauuuuucuuucucuaugccuaugcaaaucaaaaguuugauuuuggguuuuuuuuuuuuguuuguuugguuagcuuuuaauuuuuucuggugcuagagacucaccucaggguuugaacaugacaggcaaaggcuguaccccaguguugcacaccccaauuuauaagccaagagacgggacuuuuaaaacaacuguuuuugguuuuaagcuauauuauauuauucuuagauuuuuaaaugccuaacagcaauacugagauacaaagauccaucauucucuaaucugcauuugaaaauuauaauuaagaggaaaaacucauuuccagcguaguuuuagaauuguaugauauugaacauaaaguauggagaguucauauccgugcccaccacucagagccauuccccugccccgcuugauaccauguucuccucuugacauugacacugugcccugucaucucacauggcuuguauacaagaguguuuuugguuuuguuuugcuuuuaaaguuuagaggcuggagagauggcucggggcuacgagcacugccuaccugcucuucccgaggacucggguucaauuucccagcaauaugauggcucacagcuguguguaacugcagucccagaggcucugauguccucuguuacccucugcaagggcugcacagacaugauacacugacaacuuaaggcaaaaacucucauccagcuaaacaaaaauuuuaaaagaauuuugacgagguuuauauuuuauguauaaguauuaucaagagagauguuuugcaaagauuuuaauuuuauaaaauccauccucauuuuuuuuuuuuuuucuacugugguguuugccuuccagaagcuuugguccgagcucauuguuuagacaaaugucuguguguggcggucugaguggccgcuccuuguccacugcaauguuacagucuccggacagagcuucgcuccucuguucuucauucuugcucaugacuguggaccaugugcauucccacagagacuuuagcauaguuuacuccuggccgcagcagcuugugguugggauuguguugagucauauaucaaguugaagagaauuggguuuuggcaguguuuccguagcugugaaucuucauuuagcugcgaagucuucauuugugcagucuucauuuauuuaaaaauuuaauuucauuccucaauauuuuggcuuccuucauugcaggccuuauaugcauaccuacuuccauuuugggugcuuuucuauugaaaaauauacguaaaauguauuucuuaacuucuuaauugucuucuuaacuucaugcuggaacuguuugugcugggaugauuguccauccuuuuuugugacuuuacaacugaagauugagcauauuauuccacuucauauaugggacuugaacaccaaggguuuaguguccaaaaaaagggucuuaaaacuaaacccugugguugcugaggguauauauaaaagcaauuagcuuuuauguacauuaaccuccuaucugcuaccucgcuaaaaugacuauuucguguguguguguguguguguguguguguguguauguaugguguguacuaacucuauguuggaggaggacaacaggcauccugguugccuuaaaacagguucuugcacagaaccuggagcugggcugguggccaccaagccccgaugauccuccuguuaacacucccccugccugaucuguuauguagguauuagggauucgaacuccaauccucacuuuuguuguuguugcugaaugcauauauguauuuguauauguaaguguuguagagcugaagggaaaggcuuccccacagaaguguuacacacacacacacaccgcagaaguguuagacacacacacacacacacgcacgcacgcacgcaagcacgcacgcacgcacgcacgcacgcacgcacgcacgcacgcacgcacgcaugcaugcaugcacgcacgcacaccccuacuggggaagcuuuucccaauacagguguagcuugucuccugcaggaggagguuuccccagugaaagugcuacagcuuugcuccaagacauauccuggccaucaaaagccaaggacuacacaaaaguugcacugccugccccuagaggcguugcagguguggcuccugugucacaugucuguaaguggcugagaagagagaggcuaugucuacgcucaguguucugcacuauggacaucugaaugauuuguagucuaauguucucugaagaaaagcaagccugagcccaccacuagucagguggcagagggccuggacauagagcuagccugagacaaugagacaaauuagucuguugccaagcaagccuggacaggcucugaggaugggaagcaagcuggacacuagaagggcuccuagacagauggacacuugcuuggguggaccaccaggcuagggccauggggccuggaaagagcgcuagccugagguuggcaccauagugcacaggcagagcggagaacucccgagaucacuccugacaagacccacucaagagacccaggagccacuaagaugagcaaguaagagggagagaaauggagcagaaauagaaacaaaaggauguagguacagugaugagaggcagaauuggagacugaagguaguuaggaauggccugaugagaauagcuggugaggccaccugggaccaugaugggguucuggucugugcugacauggacccagaugaguccuuucacuagcagguauauguugucaccaaaggccagguggaugucccuggucugggcugccacuggagacauguuguuggcugagggcuguacagaacugaccccacccucaccugggcacggagggagagcugacacugcccauagccagcugcaguacugaggguuucugguugguuguaagccgccuguugccacacuaacuggguuccugagugggaggcaggagcuguaugggagagaaugacgagagaaauaauggaggcuauguuuaagaccccuaaaguuuacugagaguucgugcuuauaaagaggguagcccaucccccgccagcccauuauuggugccuggagccagccaguagggucuccgaaacgucucaaggaccuuucagcaggaagcagagucuuggagaagagcaaauagagccaucgaggucagaagguaaucuacccuagguaaucuccuuguuaguggcagcaaggucaaagucuggaucagccugcuugauugacaguuggccuuggccucccgaggaugagagcaugagagagggguccuaccacucaucucccugaguggcauggaugaacguccucacccuucaccaccuacaggcaggagaccuggccuggggucaugagaauaagagagccagcccugccucuugucugccauagugacaugucccccacccucgccccuugcuaccuaugguaggagagcuggccccgccccccaaucugcuacagcacaggauaacagccccuguaccuugccuagguugaauauuagagcuagucauggauuuggggguugcuucuugucugcugggagguggugcagauggaggagaggcacccuccucugauccugccucagauuaugagagugggagagcuggcucugguugcagcgguugugguaagccagucccaagggcaugagagcaugauggacugaccaucucugauaccucucaggccuacaugcauggcuuucagguggcccgcccaacaucuacccaucaaugaccuucugcgguacaugaaggggcaguccuacagauccaaaacucagaucucuuugacacaggacaacugaaaauccaagaggagucccagugagguucuaguauugauaagaacagcagaagcccggggccucauacuagaccaugagucauugcaauguucauuugaaagcaaagaacaaacaaaaggguuuacuguaauguaucacaccguguguuacacauuacagcuuccauuucugacuggggaguuggaaggaagguaagaggcaagggggaaaugaguggacuugggguauaugaugcgaaguucacaaagaacuaauaaaaaguguaaaaugauauuuuuuaaaaagucacaccacacaacaaaccucacacaagagauuuacuggaagggcaaaacccaggagugaggcuaccucugcucuggcaaggagcaacaacuaaauagaagguaggcuuuauguaggguuucuuggggguggggagggguggagcuuuccuggugaggcuuggugggauacuguuucuuggcccuggccuuaggccugguguucuuccccugacccuuuuacccuacaguauacacacacagucauacaaagagcuuguugaguuuaucuacuguuauuuguauguauguuuuuggggaugaccguuuggcacuggauaaccagaugguguguucuuccuuggggcugccucuugggcucccagguuacucaguggccuguaguucuuuguguaggguagcagccucaugagucagguccuuauucuuacauagcaauuucucuuacccccccacccccagccaucucuauaacgacaaagguuuguuuuuccacuccagauucuucaggaauuucuaaauagacaguugugccaucuaugagcaucuaugaguuuuucuuuuccguucuuuuuuuuuaacuugcugccuuagcuguccuuaggcuuggagguacuucuuagguuguucccagauuuggggggaaagcuuauaguuucucaccauaaaguuauaggcuuugccuaaggaaguuuccucccugguuuuccaaggcuguugugaaguaguguuagauuguguuugaugacccugcauugauggggucccucuuuggccgguuagcaucacacacugaaagacuccccaccuggucauggggcagaauuuuuaaacuauuuuugugccugaguucaugagagguguuagugucuguguuuuuauuugugcauuuacguaguuccagugcuagguuaauacuuucuuuguaaaauuggaaagcuucccucuacuuuuaccuacuguuacuggaugugcuuugcuuuaguugguuuuaguuuuuugaaucaacugcuaucucucucugguuuucuaauuuguaccuagacucucagaacugcucuuguuugcacuagacauuggcaguuagccucuagucuuucuaacuauguuuuacucaaaaaucagauccucccgagcgagagcuuaccuuuuccuccaggguccacggaaauccuuacguagagcccucccugcuuccuuuucuaaguauguggucuuggguagucuccugugugcuuugccuacaccacaugccagaguccaucccagccuccuugcuugcuguggacugccaucugaaauccaauuugugggcuuauaaacauuuuccuuaaccaucuacuuucugauuguuuuuuauucuuauuguauggcaggggcuucaccucugguacuguaaaccugggaauaagcuuuaguuggacagcugcuacuauugccuugcuaaacgggugugcuguuccuaccaaacugccuccuaaauacuuauauuuaugccuacagaugagugccgucagccuuuagcagagauucauacagcucgugagggugcucagaagacaugacuguagaugcucagcucuagaugggguaucuguauuacucccuccaaagcucaggggucguccccaacagauagaacgugucagaaccaucagguggcguguuguagaacccagccuucuggcauugcauggcuguggguggcauccuuuugugcacaguugugaugaccugcagacacugagcgcuucaucauggaggagagaggagucugggugagacuuuauuggcaguuaacaguugcuaggugggaggagcucucggguccaccccuuccugaggcucuggcaguuaaggguugcugagggaggaagagacauuuuuuucaguggugcgggcacuuguaaguugcucuugcuccucuaaauagccccuuauuccuacuccgguaaggagcccuaauuaaacucauugguucaccagaaaagggaccagggcugaggguaggaaaaaagacauggaguagaaggacgauugauugggaagaggaagugggagagaggaacgagaugggauuuauggugaugaaaauucauuacauacauguauguaaaugucauaaugaaaccuguuaauguguauaauuaauacaagcuccaaaaagucaaguuuggaacaaauucuaccagauguguagguuaggguggaguccauguaguguauagcuuugcauugugguucucugcccacuccuauaaugguagaaagcuaucauauuuuuccuaaaaccuaauuuaaaagaaagaaaaaacuuuaauggaaacaagaaggcuuuauugagaguggucuaaaccauccgcuuggacagaaacaugacaggagcaccccagcuauagcuguuggaacacugaaggccuggagccugcucuuaaacuuacuggguucuagaaaugguuuuaggucgugcacuagaaguggauucugugguagcauuuugaugggucuucgucaucguuccgcacugcccaucaccgccuuugcuccaaguaacucccauuguuuucaugcugugugugugugugcguguguguauguaaaacuccuaggccaucuauaagaaaaauuauuuaagauauuaaacacuuaauauucuagcacagccuguggcccucacuuccccaugacuuuauuuuacugcucccuaacaagacuuuguccuucagaaguguauucugaagaugcccuucuuggauccucucugcacagauaagcugauuuuuagcauagcuuugacuccugauauuaguagcauguauuaauccaaagauuaaaauguuuuguuuugguuuucuuuucgguuuuucaagacaagguuucucuguguaaccugacuguccuggaacuugcuuuguagaacaggcugguccccaacucagguauaucuaccugccucugccuccugagugcugggauuaaaggcgugcacuaccaugcucguuagaaguaaugguuaguaacaugcugucuuuccuccuaggauugagaucucaguuuaugggacauuuccuuuaagucuaaucauucuuacuuuuacguauuagcacucuaauuuuauuuauuuauuuauuuuuaaaaauaacauugggaagagauuuauuuauuauauauuaguacacuauagcugucuucagacacaccagaagagggcgucagaucucauuacagaugguugugagccaccaugugguugcugggauuugaacucaggaccuucagaagagcagucagugcucuuaaccacugagccaucucuccagccccagcacucuaauuuuaaaggugacaaauauuugauuacauuucugcaaauugaguuuuugugaaucuugucugaaauaauguucgaaggacauuuguucacuagccccaaauguaaaagcuuuaggaaauguuuauugauaagaaaaaauuguccucuggucuccaaguuaaaauaaauacuuggggucacuccagugugaaaguguugaguggaauuuuuguuguugguuuugucguguuuugaagacaggaucucacuauguagcucuggcugucccugaacucacucuauagacgaggcugaccuugaacucccagagauccaccugugucugccucagugcugggauuaaaggcguggguuacuuugucuggcuuggcuugaguauacuuuuuaauugcaucauaggagugggguugaauaucaguccuggauuuuaaguguaauuagacagccuaacaaaggggaagacuuuacugcuguggaaguagaaaucuagugucggggaaagcugucguggucagugcuuuaggguuugcuguucaugcuagagcgcgaaugugccaagaugucuguucacagacacugaguccaguccuuuaggcgguaaugugccuauguaguguauuaaaguaagcauuaacugaugacgcuuguguagcaaagcugcuguagaacaaaagaacuuaaguguuuuuuuaauucuuuauccucaggauccaaguucgaaacauggcaacucugaaagauaguaaguauguugucucuauauaugcaaauuaagacaaacuaaaguuuggccaauagaaauaauuuuauuucuauuuaaaguaugcuaguugggcaggcaauacaguguagcagauaaagguucuagccacaaagcuuaaggaggggccucauuggaaagagccaacuccuguaaguuguccuuugaucuucauauccacacugugguacuggcccacacgugcacgcaugcaaaauaacuguguauauauaauaugugugugaacauacauacauauauacauaguuaauauuauauacauaugcguauaugcuauguuagugucuuuuuaagaguugacaaauuaguuuagauuauguauauugggguuuuguuuuuuguuuuuuguuuuuuguuuuaaagaccauaugagcugggugugguggcgcacgccauuaaucccagcacuugggaggcagaggcaggcggauuucugaguucuaggccagccuggucuacagaaugaguuccaggacagccagggcgauacagagaaacccugucucgaaaaaaaaaagaaagaaaaaagaaagaccauaugagaugacacaaaagaauguuggucuguauugucugcacaauaauguaacuagugauuucaguguguuuguauuaaaacaacuaaaaauagugguaugaaguagguaaggccauuguuguccaauucaauaucauacauguauguaaugaucaugccauguccuaaguagcaagucuugcuucuugauggcuacugacuaguuugugcauuuagauuagguaagagcuagcugcuugccaucgaaggcuaaguacuaauuauucugcuuggcacuugaguagaaccccugaauucacagaugguaaugacgaugauguuguuguuguuguacuggugccuccuuugucuaacacgacacuucaauauuuuaguuaccaggagacugaaguccaucaaaaacauccagaaaauuaccaagucuaugaagaugguggcagcugcaaaguaugcccgggcugagcgggagcugaagccugcccgaguguaugggacagguucuuugggugaguuagggggcguucgcucgccugccgggcagagacgacaugcccacgggguucugugcuggcuaguucugucuucuuucaacagaaggaaucccagcuaagggauuguccccuuaaggcuagccugugggcaugugugugugugacaucuuccugacuguuaaguaggcugggccagcccugugcaggcagaccugagcuguagaaaaagugagcagagacagccuggaagcaaugaaccuccauggcuucuguuuuaguucuugccuccaggucccugccauggcucccuguguuguguuuuauaaaaugauggacggcaauguuggugugguggaagggaggugccugggcaggcucauacacaggcaucccucuggggaaucaagccaugagacaggcauaauacagaguuuauuggugaggagggaaagguggggcaagggagagagaauagaauagaauagaauagaauagaauagaauagaauagaauagaauagaauagaauagauggagagagagcaguuaugugguuguugcuagguaacugaggcagagccuacaguaccccucccccuccaggugaugaauuguugcuuggaaguguaaaauaaaccuuuccucaaguugguuccuuuuguauccacagagaccaccuaggaucccuggcaucauggucucaugcaugugaauuuauaugcacaugucauuucugcacgccagagucuagggacauggucacaugcaugaacaagagcccucuauguuuugcuacaaagccuguguacuagcauugucuaugacuguuaacuugaaauagcccagaaccuuuccugaguuacuacacugacagacugggaaauggcagucauccuguucauaaccgugggugccguauuaugauagcagggugaggacaguggcgggagggaaagcacaccagccaaggacucaaauguauauaaucuguucuugauugcuuuuccugcagagaaaaguggcaagaacuuagauuuugucuuuagaugauuuuguauugauuugauuauuugucuuagaggugagcaaaauuaaagagguaggaaacgucccaucuuaacugcaaucacauuauccaaauucuugcaguaucaugcugucuuauacuugauuaagcuguguccccugggccccucaaagaauccuuaacuuucuauggaaagugugagauggcagauuugaacgggaaggagaucauagcagguuagcagggugcccauuugcucugcccuucacagccuucuagcugguaccuugcuucugcucuucuucuauaguguucucucaccccaggcugcagugauuaccugugaaugacuucauucugucccugcaacucucauuacaguuaguguaguggccaguggcccucaagccucucugcaguucuguuccuauggcaccucccugcucacacugcugcugucuuucacucccaccccaguaucuuuccaugucacuuccuauacuuuauuccucaugucauuaugauaggguucucaguuuuuucaucuugaagaaaagaauuuaaugaagagacagaaaauauagacaacaguuuauuuagcaaagcacacugucccaagauuggagugggcugcccaugagggcaguagaacaguggcuuuuuuauuguggauuuugaagaaauguuuuugagguaggcugcauauuucaaagguaagagccaagguggaguuauguaagaaaaguaaauaauacuggggggggggguccugggucagagcaaugggugcucuuuacuauugagccaucuucccaggcugugcuucagcuuuugauguggcaagaaccauccuucuccaaucucaaggucauuuaaguauaaagggcauucugacagucacaagacagacacaagaagauccaauuacaggcuguuugaugaccuuguaucuaacugcuaugagauugcucaggguccauguuucuucuugugacuagcuauugauuuaugaacugaggcacugucaugaaugcugggacaagauuuuauaguaguaucuugggcuguacaaacagggucugugugcugucuuccagacucuugucgcuacucuaccauugagucggagauguggauaacuguguggauacuuugugugugucgaagccagaggaggaccgcagaugucuuccucagcugcaucucuaccuuguuucuugagucaggcucuuucacugaagcuggaacuugcaguuuugacuagucugacuagcccgugagcccagggcuggggagagggauccagccauuugucugcaucccagcacuggaguacagacgugcaccaacauuucugcuguuuccauggguacauuccuuaagcuuaaguccucauggcuguggggcaagcacuuaccaacugggccaucuccuccccacuccugugggggcaggguucuuuuuaaccuaacaauuauaacuugacccauuguguccuuguuuguuuuauuauuugaaugacugugcuagaauagaaacaucuuuccuguaggcccaacaccuaggacaauaaacacuugcuaaacauagaagggaaugagaguaaaaaagauggagagacuggagagguggcaagaacuccugcguuuccagaagacccauuaucccuucuggauccgaggccagccucacauguguacguacacagacacaaauacauacaggcacaugaagacagacagacagacagacaaggauugccacagauucagaagcguuaacuucaacugaaauuucacuuuccaaaugagcaugaucuguauauacaauagcauguaugcauuagauguggauugccuuugggauaaguucucuuccauuccuccaugucuuuuuuagcauacacuucauccuuccaaaggacauuuuacaugaagaaaaaaauagagcccagaacucagaugaauggcuuauuuuuaaaguacuuuauuuacagcuagugagcuacuucagccagugaaggcuuggacaccuaacuugcauaaagugugccauagugggcacugaauaaucuguacaggguggaacccagggccuuacacuacucuugagcauuugagcgacaccuuuggcucccuacagugugaacacuuacuuccuaguuugcucagucagaaauugaagcuaaguuaauguucggaaagaaaguaguucuuuucaaaucucgagcuuauuugucugaaaaggggagucacuuaaugguuaccuuucuugcuaaugaggaauccuuccuccaugucuccaaccacaaacucauuuacugugggcgaaauggcccgagaccugacagguuuauguaauggaggagucaggacagaagcuccuggcagcuucugaaguguuuaagcugaagaguccuacugacagacagccagacaguaaauggacauucauuuaaaacucagaacuggggcaggaguuuacgcugugauguaauaaaaucuaagagcugucuguguucuccauacucuguagacuuuguaguuuccuguucuuucagcuuggggaggggacaaguaggcauaaaaaugugagauuccugcucuaucaugaaaacagaaacgguuuucaggugagugcauguaguggcugugaagauguagagucugggcagcagcagcuacugcaagccacccuugggucugauggcucuucagccccaacuucuuguuuucugucacagguaauucacuuuguaagauccagguaucuuuaauccgacuucauuuucuucuuugccuguaccucuuagaaaaccagaccagggaaguugauaaaguaaugccaaaaauaaauucacacccauaacuugaguaucaacaauuuuauaacacaggagcucagugauguacagauuacaugaguggcucagucaacacuugcuuauuuuuuuagcuaugugcugggaauuuacauuguauagaaaucugauguuuagcuaagcaggugcuuuuguauucuauucuccuuuugguuguaucuaggcauuuuagucaauauuuaaaaaacaaaacaaaaaaacuggccaccaauugaucguuaggcaccuugguggugaccuuccugguuguacuagaauaaauacacaaaugccccggguuaugcucaucaggagccaccuaugagaugcagaguggaaauuaacugauucccuuugaaauuagagacugucacuacuucacuuacuauaaacuuuauuucaaugcucuucucauuuuguuuucuagcucuguaugagaaggcugauauuaaggcaccugaggacaagaagaagcaccucauuauugguguguccucagauagagggcuuuguggugcuauucacuccucaguggcuaaacagaugaagaaugaaguggcugcccucacagcagcugggaaagaaguuaugauuguuggaguuggugaaaaaaucaagggcauacuuuauagguaaaugagacaaguguuccauguucugaagaguggagacaugagugaauggaagacuuugauagagaaaagguuuucaugauacauugaaguguagauagauagauagauagauagauagauagauagauagauagauagauagauagauagauuguguguugcuguuuacauuguguguguacauguguguacacuucuuuaauaccaggaguggaauacaaugaagauuaccagagcuauugccauuacgcuaaagaaggacuccucaggguugucacagccuagaaauacuagaaaggaauguuaguccauuaagguuggacagaaggaauauaagacagccugacuuguaguucuuaguuuuuugcaggugacuuuaaaggaauagucauauguagaacaacuuaacucaaggcaacccaccaccaacaucccuaaaaaaaccuaugauaacuuuuuucuuuugcuauuuucuuacagcacagugucucauuaaccuacuuuauguaaucuccaggacucauucugaucaguuuuuggugucauucaaagaugugggacggaagccuccuacuuuuggagaugcaucagucauugcccuugaguuguuaaauucuggauaugaauuugaugaaggcucuaucauuuuuaaucaguucaaguaagaacauguagaauuccaagcucuuugauaugaaucucuccuuaguuuagaaauuacuuugcuauucacacgugcaucugucauuucaggucuguuaucuccuacaagacagaagagaagcccaucuucucucugaauaccauugcgacugcugguaagccacuuucacacggcagguguggugugugucaggagaccucaguacacugaggaaagccagugcuuguuggguugcuguguuauugucaaugucugaaguggagucaaugccauuaagcacucuccuguuuucagugacugaaaagccuugcuaaaaauuggcuugaugauguuugcaaacaacugcuguguaaucagauguugaagauggagauuucaaaugcucacaaaaacuaauuuuuauggcccacugaacucuaccaacuuauuauuggacagucaacuuugcucagugacaacauacugcagaaguaucuuccucuuguguauuguauuucaucuguggaguuuuacauuuguuuacuuugggagguuguguauaauugcauacccccuacccccaaccuacccccuuagacauggguacuuauuguuuuagcccagacuggucuccaaauauacaguccuucaccugaaugcugcuacuuccaggcagcuaggacuaggguauuaaagcccacauccacaaugauacaccuacucaacaaggccacaccuccuaguagugccacucccuacccccauaggcuuguucaaacauaucagucuacgggggccauaccuaaacauagcauaauaaaaaauacauuuaauccaacuuccagaguccccauagucuauagcagucuaacaauauuaaaaggucaaaguucaaggucucuuuugagauucaaucacuuaacuguaauccccaaaucaugacaggaaaccagcuuggcaaacucuaaagucugcaucuccaggucugaugucaaagcugucuucagaucuccaacuccuuuuucaucuuuguugacugcaacaaacuuauuucuccugggaggaguuccagucccuuuuagcagcuuuucucagcagauagcccauggcucuggcaucucaaacaucuuggggucuccaaggcaaugugagguauggcuggagucacuucugcagcucugcccucuguagcacucuaagcucagguugauccacuccacugcugcugcugcucuugguggucaucucaugguacuggcaucuccaauacacuggggucuucugcugcaacuaggcuucaccaauaggcucucuucauagugccaagcuucaaaucccccaaauacccaauggccuuccauggccucuguacuggcuaguuuugugucagcuugacacagcuggaguuaccacagagaaaggaguuucaguuaaggaaaugccuacauuagauacaacuguaaggcauuuucucaauuagugaucaagggggaaaggccccuugugggugggaccaucccugggcugguagucuuggguucuauaagagagcaggcugagcaagccaggggaagcaagccaguaaagaacaucccuccauggcucugcaucagcuccugcuuucugaccugcuugaguucuaguccugacuuccuuggugaugaacagcaguauagaaguguaagcugaauaaacccuuuccuccccaacuugcuucuuggucauggugguuaugcaggaauagaaacccugaauaagucagccucucacagugccgagccucagcugcucuacaugaccccuucaugccuucaaaacuaguaccaucugggugacucuuacacauuaaguccagccgcugcaggagguacagccuuagguaucucuggaacacagcuucuuugugcuuagcuucagcuaaccagcaucaguuguccuaguaaucucuuucuccucuugucucuaaagccagagccacaugacugaaccugcugaguucugcugcuugcugggccuggaacauagaccccuuguucuauuacauuaucaccaguuguuguuuuccaauuccuucacuaccuaagcuuggcuguccuggaucuugcuuuguagaaaucccaggacaccugucuccugggauuaaagguguauaucaccaugccuggauuuaagcuuuucuucaccuagaacuugcugucccaggcuggccuagaacucagagaucugcuuggcuuugucuccugggaugaaaggucugcaccaccaugccuggaucuaaacucaucuggguaggguuguuccccaaagucccacucccuuaauuuguuaucuccuugaacacaggauucagcuucauuucacuuccuggagcccccuuaauacuugaaccauauauuuuauauuuuucccuuuucaguuugcuacacuuguuugaauugcucuucaugagacuuaaccagagaacaaagucuaagauggguguuucugagacguccuuugucaaugcaauuaaucugaguuucuuccccuuaaccucagacagacucuucuggcaugggcaaguagccauauucuuacucaaaauaccacaaaaaagccgucucuaguccuauugaaauucuccacaggucugcacagcucagaucucucucagcaacaaagucuuccuacuaggauggcucauuaagccccuuguaaagcauuccacugcuuuccaaguccagucucaaaauccacauucuuccaaaaaaaaggccuaucacagcaauaccucagucccugacaccagcuucugucuuaguuuggguuuuacugcugugaauagacaccaggaccaagacaauuccuauaaggacaacauccauuaucaguccauuaucaucaagacaggagaaugguagcauccaggcaggcauggugcaggagggaggagcugagaguucuacaucuucaucugaaggcugcuagcagaauacucacuuucaggcagcuaggaguagggcauuaaagcccaugcccaccgugacauugcuacuccaacaaggccacaccucugguaccacucccuggccuaagcauuuacaaaccaucacagugagguuuugguuuuaggguauuugggggucgugauguuuuucaauaauacauaaaauaggaguuaauaccgccugagauuggugccgcacaauacuauuucagaaguugugaaugaauuugaaauaucuggcaaaugucuauauggaauccaaaacucaugucaguuucuaccuugugucagucucaguccucaugucuaucagacugacauuaauauuucuauaauaacuaaucauuuaguggauuuguauaacacuaauagauucagucuuugguuuuuuguuuuuuuuuuuaguuaaaaauauuacugaauaauguauaugugacaaacgcuuggcuagcugcuauucagagggcuuuacaaccgugaaaccuaagccccuacacccuauuccuauagcugagaauugaaccaagggccuuguacuggcuaggcaacacuucuuauugagcuaacuucccaaccccguaacuuugaaauuuagugcuuauuuuaaaugccagcuucuuaauuuuaaaguuaucucugagguaaaaagccuguugacacauauuuugcugauaauauacuauggaaauagaauuauuauuagaacagauucauuuaccucaagaugauuuguauaauugauagaaauuuuuauucauaagcuauuucugaugacugggucuucauuccucaaggaaacucuuggcuuguuuuaacagagaccaugagcaucuaugaugacauugaugcugaugugcugcagaauuaccaggaguacaaucuggccaaccucaucuacuacucccugaaggaguccaccaccagugagcagagugccaggaugaccgccauggacaacgccagcaagaacgcuuguaagcccaggaaacuagaaacaggagcacuuagaggauaacugcacgagagagagagagagagagagagagagagagagagagagagagagagagagagagagagagagagagagagaacgagaaccugugugugcgugugugugugagcuuugcucagaguagugccaaaaauguuaaaagaauauuuuguuuuguugagguguccaucuuacuugauagguagaggauuugcaagcaccaugaaaguaguuugugaaaaauaacuagauaaaagucuuaccaacccuagaggccguuuggggauccaaauugcagcagaauuuaauucaacucuuaauuacuuuaauuaaguagaaauugcuguuuucgaaccuuuauuuuguuaucuaucccuuuuguuugcagcugauaugauugacaaauugaccuugacuuucaaccgcacccgccaggcugucaucacaaaggaguugauugaaaucaucucuggggcugcugcucugugaguaauguagcuggugcuuacagaagguuuuguuuucucugcaugugggucagggagucucugguugcuugaguguuucuguucuauuacaaccaagaagacuggcugcagcaucuuguguccuuccaucaaaucccaauggaaagggcgucucugcuuaauucuuacuguuugagcugaaauguuaaagucuaauuucccaucuugagagauaccuuugugugcaguugacuuuccuaaagaauucggaagaaaguugugaauaauucaguaucaguuuggaaagucuguuuuuggaacucaguaguauuuauuauaagccaaacuuuaugaguuacaaaacuaguuuuagguuugauucuaauucucuuaauuagugaaugaugaaaauuuuaaguuacuauucuucauugguaccauaaaauagcauacuguuuuccuccagaaaauuucuggauuguugaaagauuaaaguggccaucaaccaugugcagucuaccgggcacaggguuguaaugacagaggaaauguaguaaaugcuuuuggcuugcuaaggcuuucuccuccugacuggucaccaaguucucugaguuuuaucuucuagaucccccuuuaaucuuuccuuuuuccucccauuucuaaauguaaaaggguuugcuguguuaccuaagcuauucccaaacucaaaggcucaagcuucccucucuaucuccucaguagcuggcaucaaggcuggccuggcaaaagaugugauuuguagaugccagauccucaagauggaguggaggcaguguuuguuuucagagaauuuacugucucugacagugcagaauuacggagauuacugagaaacugugguccaaggucauauuguaaaggguuauaaaaaaguguauauauagcccccaaggccuaaaaugcuuccuugcuggcuuuuuacagaagcagccugcaaaauacucuacuuuguuguaugugauccuguacucucuggccaucagcaaucuuucucauauaauauuuuagucacuuccuuggaccucggcuaccuggaccuucccaggucuuuaaacacaucaggcuguuucugauuucuaagaggguuuugcccgggcuuccauucuuccuucuucucugauugauugcucuguucagucuucaucugacaauucuucaccuuccuugguugggcaggaggaaucuuucuuccccaaaaaccuaacugaagugagguuucuuagcaucuggcuucgcuguccuuaagccuuggagggggcagagucuaaaacggauugagucaauggacaaugauaaaaguuagagccuuguuuucuccugggugagcauccugguccuaaacucuugcuuucugaacauaggacugcccaucucccagucuggccaucacuacccuguuagcaucacagcugccuugauguugggguuauaaacaugguuagguacucugucuaguuccugggacuuugucuccugugacaugagacuaauacuaggauuaagucauuaugacuuauggccaagugccaagcuggcauaucuuugaauguuaagugugacaugguuugagguaaagagcugacuucucaaaaucugagaguaguaugauaaccagagaacacugaguucuuuuuuugcuucuaaaaugggagauaguggguauaaacugugaggaucuaaauucuguagcuuaggacugggccuuuuuucuugcguaggggugugagaaacuucacuuacguuagcaaauuaagaagagggggauugagucucaacacggguucacguuuauuaauggguuugcaugcucuguaaccuauaaggaauuuuuuguucagauuuuaauacaaacacuggcuuuuaguguuaaaaguaaaagaaugauaaaucauauuuauauugucagcuuggucuuuucaacuguauguuauuuuuuuaaagauauaaaauuauuacauguugucuugccuauuuguaugaacauuuuuuuauuguuucuaacuacauugcacucuauggcauuuuauauugagugguuguuaaagauuguaacuauuugcauuguauguuuaggguaauaugcacaagcauggccuguaguuaacuaguguggauugcuuccuaaccugcuuguuuugugcucuuguuuuuccuaauauaauaaccagggauuaaugaaaaucaaguugcauccucagacaagagguaaaguucacacacucuuucccuaaguccucaacaaagaaguguagccagguauuaccaaaguuagcaguuccuaguuagcauuacuaguuugcauuaauaaagcugcuucccuaagucgggcuagcuggguaggcugauuuauagugcagccaacuuguggguguguuugggcaguaccagauaauaggcagagaguucaaugugggugcugcuagugaacuagccuugguguucuggaggguguagguauaaggaaauacauuuaggcauagagaccugaaucacuguagagaguuaaguguggcuucaugguucucgggccuaugguccugacuccugaugucuggcucacaggagaguccucuccgcucugcugcugucugaagccccuggagacacagucauuuccuucugaguaggaaugacacgggacagcauuauuaugaaacucgcuugcccucacaagucccagagagucccagaccagaacuggagaaccaccugcaucuuguguauaacugcaguucucugugccccacuuaagaaugggauauuuuuccauaagacauccuauuugacuccuguucuucuauacuguuuuucagguaaagaagaagaaugcgcaggcugauuuuaacugauugcugucuuugucagaagaaacuugguccacugaguuacaaagacagcaggauguuuguaaauuaucuuacaauaaacaacuuacaaugagaaaaucag

SEQ ID NO: 629 - RNA, 2184 nt, Mus musculus
agcgaggcucugccuccuaaaggcgcuacaacgccacagcgccgccaacuggggaccagguguucaaauaccucaacuuuggagaacuuuucuccguccaaaccuccuagaucuguuacauuuuauuaaaaacuccagaaaagauaagucuaggaguagagagaugccucaguaguuaagagcucugggugagccgggcaguggcagcacuugggaggcagaggcaggcggauuucugaguuccaggccagccuggucuacagagugaguucccggacagccagggcuacacagagaaacccucgaaaacaacaacaacaacaacaacaacaacaacaacaacaacaacaguucuggcuguucuuuguuugacucccagcauuuacacgguugcguacugucaucuguaacuccagugucacgggauaugaugccuauuuuuggucucugggggcaccaaguaugcacauggugcacacccaugcaugcagcaaaacacccauacacaugguauaaaaauaauaguuuauaaaaauuuuaaaguauagcugauaaggaaacaacauagggagaguugccugggagugaagguagggauagucggagaagagagggacgaugggaacccucccuuguuuauaucuccacaguguaaaagaugcauacaaaagcugggcgugguggcgcacgccuuuaaucccagcacucgggaggcagaggcaggcggauuucugaguucgaggccagccuggucuacaaagugaguuccaggacagccagggcuaaacagagaaacccugucuugaaaaacaaaacaacaaacaaacaaacaaacaaagaugcauacaagaugcccuuucaggggucuuauuuuuuuauuauuauuauaagcaaauuaccauuucaaccaagaaaccaaaacccuuaguguauaucauauucuauuaaauuaugucugaguaauauuacuuucugggcuaggaauaccauuacuucuguugagaacuauuuuuuaaaacagcagcaagaaauucaugucacauaagugagauguaauuucuucauuuuuucuuuuguuuuucuuuuuuuuuuuuuuuuuuuuuuuuugacaggguugcucuguguaugcuuggcuguccuggacucacccacucuguaaccagacuggccucaagcucacaaagauuucugucccugagugcugggauuaaaggugugugucaccacugcccagccugugacuucuuucuuuucuuuuuaaagauuuauuucauguaugugaguacacuguagcugucuucagagacaccagaagagagccucggaucccauuacagaugguugugagccaccaugugguugcugagauuugaacucaggaccucuggaagagaaguuggugcucuuaaccucugagccaucucuccagcauaaaguccuagguuaggugcccagcacaacaggaaaauauuaauucugaagccaacaaguauuaccuuggaccauguugcaagacccaggcaucacuugcagacauugucucccaggguuaugugguauuuauaucuugagaugauuuagccucaacagauauuuuuuauuguuagcuuucugggaagcaagacagaugggguuccauaguuucaaucggcaaaguuggugggugcuuaggaagccaggagcagugacaccaucugaauuuccaggacagugacuuaaaaagacaagugggcaaauggccaauauucucuccgaccuaauagcaggaaaagguguggccuucacccaggaaacacuacaaagcaccuucccagcagaaguauuuugaaacugaagagaaacaggaaaauuucaaccaaucccgggaggauuuucaagguaccaaggaaaacugaagaaguccccccccccacuugcuaagccugauuucccguuaaaaacacaguauguaucaacuuguaacacuguaagaauguuuuaaauucuugcuucuuaaucaucaaagguuugcauugcaacagguuuauucagaaagcaagaaguguuggcaaguccaccggucauuguuggcaaguccacccgucauucugaagcaguuaggcugccaagugaugugucaagucccccaccaugcaguaguggcuggaagaagaaucuccacuccgagaaagcuggaaaaagaaa

SEQ ID NO: 630 - RNA, 34761 nt, Mus musculus
uccacauuaaaaaauuuauuaacaucuguuucugaauaauaauuccaguaauagaugacuugccaagagagguccugcccaguggcuaugacuuuggcuucucuaagcuuggauuuggaucauuugggaaauuccucucuuucugaacuuugaccucuuccguuacuaguguuguacacguucagaagcaccuguuaaggaauggggaaagcgauagcucaguugguaaagggcuugcagcaaaagcauggggaccugaguucaagcccuagaaccuacauuaaaaacuaggcauggagguacaugcuuagaauccaggcacugggaagaugaaggggguggguccccaggacuuacuggccagccaucccagccacgagucuccaggcuagugcaaaaccucugccuccaaaacaagauaaaacacgacugaggaagacccgugagguuuauaucuagccacacacaugcacacccauagauacacgaacauguacacaugugcgagcauguacguacgcaugacacccacacguaaugcaucaauguacuuuuggcaugucaugccaucuuuggauagacuguagauauauacucauuuugugacaaauuucaucuuauucacugagauagagagagcaauggucacccagugaugccagaaauauccaacuguaaacugaaccuuagcaagaagcuauacuaugaccucacuauuuuuauuaaaaucgccaacaacauucccaagcaagcagggguaggcucugaccuugucagaaaagccacagacagcaucaugaugucucuggugcuccuguauuuaccuggugcacauguuuugacauaugucaaaacuugcuuugauauacaucaauucuuugcagcacagagcccugggcugggaacaccacucagaagagcuaguggcucaucuaaagguuaguguagccugagaaguggacagagaaggaccauuuauuaccaggugaaacagagaugccuuggcacagagccaacaggacuucaauuaggccaagacaaacaaaggaagaggaaaugaagaugccccgcauugccuuccuagaaacauauacacaaagcaaagccacuucagaccccacuugucuguucccagcccuguccugcagauacacagggagggacagaaacaguuagcuaaggacgugccucugcuguagaugaugaacuggcagccacaugccagggugaaauagauuuaggacagagacaaugaggcccccuugggugggggguucugguucuguuugcuugacuggguucaguguuugucuggcaaagaggaggaagcugcucuuugagacccgagcacugguuuuauaaaguccuauuuccucugugaugaaccaaugauuuuuaaucacagaauuguuaauuaaaugaaaaaggagggugugugauuucugaccauguugaccuuacacuguuucuuuaucauuucccuuuucuugaggcauauauaauauacuugugagccaguucaauagcaugugguucuaguccacaaguaaagaagugaaccugcaaugauaucuucagcuaugauguaauauauaacucugaagccugccacuuuaguauccaaaucauggguucuuccaggcucucauuuuaaggaauaauguaaagaggcaaggaagcccagauacucugauaaggugccuccauaguccaguuaaaugccccuucuauuucuauuggaaaauuuaacaaggagauacaacaaagucagaguuuagagcuagugagauggcucagugggaaaagaagccuacugccaagccggacgaccuaagcucaacacuuaggagccacgugguuggaagcagagaacggacucuugcaaguuguccucugaacuccacacuaugccuuuucacauacauuccuuuccccucacgggguuauguguacacacacacacacacacacacacacacacuaaguaaaagguacuuuuuaaaaaaugaaguacaaaaacauggaauuuuugagaguagaaauauuuaaaacaaaugccacauuaaacaauuaaaguaggcauagaguuuaaaauaacuaacuuucuauucuaggugauuggaugaguuauuuuuaaauuacuugucugcuccuaccacggccacuguucucuuugcagugugauaaauaaauuugcuuucuuucuauuaaaaacgcauuguuuucaaacguuacuuacucuguaguauggagaguuccugaaagcgacgguucugguucucgcgacaagaccggggaagcgcuuggaggguagaguccacagaugcuaggcgugcgaacaguuuguccugccccuggauccaccuuagccuuggaguucaccucacuuacgggucaucugacuuguuuguugaagggaguauuugucuucugaauuuucccucaggcuacggaagaaaauaaagaaucagacacuuaccccaggaaaccugcguugugggcgugcgcuuaguagacucuugguuucacccgcacggucuguuucucagggucucuacugaagcuucaguguugacgcacgagggcuggggagaugacugaguaaugaaagcguuugcugugcaagcagaaggcccugaguuuuaauaaguagagacgguggugcccacguguaauucuagcauuggggguggagcuagguggauccuuggggcucauuggcuagccaaccuuccagucuucgagcuccugaguugcaauauaagaaccagucucaaaaauaagaaagauggcucccgagggacagcacccgcaguugacuggcaucuguauguacccacauacauaaacacacacaugaaagugggacacaggaagguccuuucgauuucauuuugcggaucaugccaucuggcgcaucuccagauucauaauugcgaugccuacuggccauguuuacuugcuggacuugacucucaggcucccgucucuguaugugcuaagcuguuagcucucuccuucuucucaccucuccuccucuaccucacaaaucucagggcugcaaaccugagagugucaaguguagcuguagagcacugggugggaagacagcaucuuaacuuccaaacuuaggcuaguguuuccuuuuucuuuucuuucuuucuuuuucuuauuuuuguugguuuuuuuguuuguuuguuuguuugguuuuuguuuuguuuuuguuuuuuugaggcaggguuucccuguauagcccugacuguccuggaacucacucuuuugacuagacuguccuuaaacucagaaauccaccugccucugccugccaugugcugggaucaaaggugugcgccaccacugccugccauuuccuuuugagaaagcugaaugaacgagcuugucucacugccgggccugcagauuuggguagaaagcacaaucaacuguggccaaaucaaaucucuguucacagaacacaaaguuucacaucgggaggcaggauugucucuagugacguggcuuugaccacaccuacuauaccacagagcagaaagagagguuaauuugacccuuaacuagacagggaccagaucguauucaagcuuacauguugcuucuuacauugugacuguaauucuucucuauggaucugcuggcaggacuauugauuagacacaggaggcagauggauuguacccaguuggggucauauuucauaccccguuuauaacauauuacuauuuuacacguuacaggguuucagucugaagaguuuugguguguguguuguuuuuguuuguuuguuuguuuguuuuuuguagacucuggguaaaaaaaauauuauaugcagauaccugggggagagaauauuuuugugauuuugaauuugcuuuuaagugaaaauacaugugugucuguguguguguuguauaugugugcguuucaguguugguacaccugggugcauauggaggccaaaaguuggcaucaggugccuucccuaaccucucuccaucuuacuaguugaaauaagaucucucacaggaucuggaguucacuguaggcuggcuauccaaaggagucccagggagcugcaugucucugccuccuuggugcugggguuacagauguuucaaugccaccuggcuuucugugugcaugcugggaauccgaacucagcuccucgcugguguggugaccacuuuacuacccgagccaugucccagcccuugcuuucacuuuuaagcuacucauuucaaccacacucugucuucucacucccggaauggcgccgaccuuggacaggacauuauagauggaucucagauuuuguguaaguguuccaagaagcacgggugagcuagauacagcacaggugauuucaaagaagaucugacaugggaauugcaagaggaugugguggguuguguuugcuguggguuuuuuuccucucccuugcaguccuuucacuuucuggggaugcugcuaagagcagagacaguaaacugcacugguaaaaucugacagauuacuucagaacugggggcaaauagagggagccacccuacagucuccuuuugacguucuauucuaauuucauguuugucucauuuuacaacucuccccaucaccuccugccuccaaguuuuucuauacuuggaaggagugcuuuuccagaaagcauggguuuaggcgauguguuuagagagguagcagagaggucugagaguuguuaggggguaaagacagauccaggguuauaugaacugucucuaaguucacugcagaaaguuugccuaaaggggcuuuguugcuuauuucugaagaaggaggaggaggaggaagaggaagaagaagaggaggaggaggaggaggaggaggaggaggaggaggaggaggaggacaguuggagagauggcucagugguuaagagcacuaacugcucuuccagagguccagaguucaacuagcaaccacauggugucucauaaccauccaauggagucugaugcccucuucugguguguuugaagacagcuacaguguacucauauacauaaaauaaauagauuauuuuuuuuucgagacaggguuucucuguauagcccuggcuguccuggaacucacucuguagaccaggauggcuuugcacuuggaaaucugccugccucugccucccaaaugcugggauaaaaggcgugcgccaccacugcccagcaaauaaauaauucuuaaaaaagaagaagaaaagaguuuuggguguaugucuguacauaugaucucuugcucuguguaucuguacacauacuccucucucucucucucucucucucucucucucugugugugugugugugugugugugugugugugugugugugaacuugguuguguacaugccucaacaaggguguggaagucagagggacagcuuucggucuuaguccccaccuuccauguuaaaagaagagcucuuucugcucuaaucuggggucucagcuuuggggacuuuccuguccaucucccauguucuuguaggagccccugguuagagagacuuagguuaccgcacuugacuuuuaugugggcucuggggauuugaauuuugguucaaacuccuagcucuccgggcugcauuauguaguaacaggcaaagcgugaggauuuucugagucucggaauuuugguugcugacaugaaaacaagaaacaaacaaacuuagaaucacagcacuguaaagaaugucugguguggccaggcagugcuggcgcacgcuuuuaaucccagcacucuggagguaaugaguucaaggccaaccugauguaccaagcaaguuccaggacaguuagagcuacacagaaaaacucugucucaaaaaaaaaaaaaaaacaaaaaacaaaacaaaacaaaacaaaacaaaacaaccaaccaaacaaccaaccaaacaaaagccaaaauuaacuucucacaggauguguugcuccaguggcugucucuuucucugggcugcaacggcaggauuugaagagaagaucuguccaucuguaagauucuuggggccuaagaaauauggcauggucuaaacagcuuccuucucaguccuccuguauggacagcagagauagaugggaacaaauuaacacauaaacucuuacuucuuuggcuauuauuacaguccuugccaauauuucaagccagaggagaagaaggaggcgugggaggaagaagaggaagggaaggaggaggaagaagaggaggaggaggaagaggagggagggggaaggagaguggguaggggcaggggaaacauuuaugcacaccugccaagcucuacaaaaacuguacaguagucauagaaaaucuccaagcaagaaauuuccccauaagccauauaauucgucagggauuuuuuuuuuuaagagaaaauacgaucuuuacuugaaccaguugccaugucagaugccugccuucuucgcucagguuuauuaccaggcuaaauacagucuguuucgaugaaagccuuuuacagcguauaguaaaauggguucauuagucauuuuccucuuauuauaugucaauugcucucaguacugccgagaguggacgcuaggccccaguagccagaaugcaauacagagugcaaugaugaugauacucuaacccucuaaagcacacaguccugcaaaugcuuuccccugaucccuuagacuguguguccugaucacuaacuccauuuuauuuucuucuguaaaauagggacuuccccucuucucuuccauauuguaucucccucccauucugccauggucacaggcccuauucagguagcuuaaauaauguucccuacacacagagagguggggguggguggguaagggaggaagggagaguuuauggauccaaguauaauacugcuagaaauaacuggucagucacuaaaaacuucacucagacugacuucagacacuauguauaggcaccauuguuucuggaugacugucaauggcuacguuauaaucuaauccaaagaaagcugggugacaggcccacaccauguuuauuuauugcauggguuaugaccuuucaacaaaucacuuccuccagguagauuacagccccccucacuauaacacuguaucuugauccuuuguuguagcacaugaaaguuagaauccuugggcucuagaaaaguugccuuaggaaauaaacaacacugccuuugguaauuaauuuaagugaaugucacuucauccauagguuaaaauuuuuaaauuuuauuuauaaaaagcacaggaguuucucucugaaacagaaagcuauuuauaaaucacauggcuccuguggguugguaauacucauauucccaucacaaguugaauccucaucccugaguaacucacauaacuucuuugugguaccaccuccauguuggcuaaaugaguauauuucuagcuaguuuuccacauuguugaauacccauaaggugcucaccaaaggacuguauuagaaacucauaaaaaucagacuuuauggcuauacucacuauuguauggcauguacuuuuucuguuuaaauguauuuuuuuuugaugcugggauuaaauccuggguaccuuacacauguuaugcgcaugcucugccacugugccacacccccagccccaugauguaugcuuugauuuaccaucaauaucaguccuuguaacaugaugaagucacucuugguguuaauguuccggguccauguggggaaaucagugaagagaaguaacuaagcaacaacuuucacaucugccugucucgcccaugucggguuuucccauuauaacuugccuuguuuaagaguccaaguucugagaggggcacgagaaggcuuugcaccuccauuuguucccugucuuguugcugugaacaaugaccugacaaaggcaaggugaggaggcaaggcuuuaauucagucuguaguuuuacaaugccauccgcuauggcggagaaguuaagacaggcagagcauacagcugcugguccugcuccaucuguaguuggggagcagagaggugacagcuggagcucagcauacucucuccuuugagucauuccaugacuacagcccaaagcauggugccauccacaguuaggggcucaguuucccuuccucaguuaauccagucuagaaccaccucccaagaagcacgcuuguccccuaggugacucuagaucuagauugguagugaauauuaaccaucacagugcguaugcucuucauacugcuuaugacucuuaagccaccaaaggcaucccuuuaccccagccuugcccaugaagggcagaacuauucuauugagucuuuucauugccugggguuaugggagaggccuauucacuggugagcuauuucuuagugguugagcgaauaagaaacuugguguuugguucuaagagaaacacugucccauucugggggauuuauuaguacucgagguagucaagagguagauuaacagcaaaaggcccuuccuaugucacugcuguaaaugaucucaugcaacuggaaaaaaaaaggaacaaaaaauaucacuggggucuaccucagucucccaaaugaauuuggcuuuuuuugugauaaaagcugggcuucagaaaaaauguggucaggauuuaaaaugauugagacaccauuuccucagaaaguuggcuuccuguuucaaaaaguuaaccuagcuuugauuuucauccuugaaaaaauuaccaugugagagccuacuucuagaaaugaccacagaugagcaucauaucugcauagacaucuggaagccugaagguuuccagcauccucuagaaacuucgcccgucauuugaaagcaauucaguugggucugguggauuuucagcagcucugagaucaacugauguguaaagcagaaaagggaagaagaaauaggaggaacuguugggagaguuggucauguacuguaggugagacuccucccauuaccuccauucauucuccugaccaccuaaucugcucacauccuucuagucugccucggacccagcagcacacucugcucuguucuuguuucuccaccuccauccgucuuuugaaaucugccugucccaugggucucauaaacaugacugcuuugucggcccaaccagaugauacacacuucuacuguuucaaguuccaucccucaggcucaugcguuagccuuacggcaccuguguugcagccaaucuucucuuaaccagaaccugcaggguccaguuugaccuucuuugguuuaauauucauucaaguauauuaauucgucuccugccaacucacuguuacuucucucuauccugcagucccuccuuuucacuucaacauucaagccauucacuuucacuauuguagguuuccauagaaaaccuagggagcacaaaggagaagccaugauaguucucuuacugagucugaacuuguuuuccuaguaugauuaucuccaguugaaucccugaaaaugacaugacuccauucuuccuuguggggagcuggaauuugacuccuaaacucuuguauucuaucaguuagcaacuugaugcacaccuguguaugggagucauucagaauaaaaaauucacucuuaaaacuagacuccauucaaccagaaacugguuagacccuugcucaagaugcccaccucaucaacucucucucuguguuguguuuuacgguaccagcaacuuagcucaugggaaugggauacauuuguacugguguugcuaugacuugcaguuaggggaaaaaugcuucuaugaacaaauauauaauaaacccaaaauauacaaaugauuaagaacuggagagaaagaaucugaccuccaaggacccuuaaacuccaaagcgaaagaacucuaaaucccucuacacacuauucccauguccucaacccucacaacuguauucuugcuuccaaguuaauauaucauccuuagguaauuuuuuuacuucuauuuaacuggcuugucuuccugagaaaaugggagugaucaggaugguacuagcuuagccaauaaauguuaaaugacagucuuaacagaacacugagaaacuggaaugggugugugugugugugugaguguguguguguguguguguguguguguguucuugagguggcuaaugucgugucacugcuggguaucuugaaauuauccuuugcuucguugaugguagcauuuccacuuagauaccccaagaaggggaauagguggccauguaugcuguagccuccacucauguuuggucuugaaaacaucaugaacuuugucaucaagaugaguauuccuguagcaaagucuuugaugaggugugcugcuuugggucaauagcuaaaccccacuuacuaugugucuagaaccauauaaaugcagacaacgucuaccuccccagcuuuggaggagaaaguaauuaaagaaugauuauuacaccuucuagccuccacaaauagacaagaacuauguuguagguuuucaaggugguuuuggcuuucuucuuucaaaauucaauggaagagagauaaaugaauguuuacauucaugcaaauguaaucacaugcccaaagcucucuggagccaucccacaacaucgugcagacuggaguauagacauccauaggcaccucacuagcucaucagcaagggaaucuuggagauggaccaguuuuucuuugugaugucuuaaccaaaggggcucaugggaaagagaggaauagauuuuuuucuugagcauugcaggggcauggaaacaaaacagaauggauaggaagucaaaagaaacuaaaaauagccagauuacaaaccuguucgacuuacaguucucaaauuaaugaaccaaaauauuuuuuggaauugcuugcuucauuugugaacgagaagaauuauucauuugugaacgagaagaauuauuugugaaugagaagaauuauuuguaaaacacuuagggcccguuucuacuaaaggaagacuaagcuugcaacacuccauuuggcccugguguuuccauucuggcugcuggaugcuuucaauggggaaagcauuuguccucuccccaaacagacaucucugccuccucuaaguccccagccccacccccaccccugugcuccccucgcugagggcgcugguuucucuuuguuuaugcuaauguaauaaccuguccucugggaaugccacuaaacauaaccuuaacuagucaacaacauaaucaauuauuuucacugguggggaaccacuuguuuacuuaaucucuguuuuaaaaacagucauuucuagagaggcauuuaauaccuuaguuauuuugacagcaucaggaaacuccauuguuaaucagaagcauguuaaaucaaacagacauacauaaaagcaacagccgagaucugucagcugguuugacuuuuacagcauaaagcuguaaaaacauuuuauaagagggacaggccauuuagggucugggaaaugcucauugaaugacaaagcuuaguccagauaaguccaaaggcagaaacacacguugaauauccaaauucaucuuaauacacucuucuuguagaaagaaauuucauaaugaacaaauuggucgaaacaauaaaaugcugaguucugaaucaugaaguguauuggguugauuuauuuugacaggugccauuuaguuuuaaugauucaaauaacacuuucuaggauccuaaaagagucugccgcaggugauuuaugugcgcaguaauaaaaucuuggccguaugaauuuuauugugucuuaaugguuaaaucgucauuaaggaguuguuuuuuagguguguauauuggggaaaugguacaaugucugccuccucuacccaaagguuagaaguuuuuaaaaugacauuuauuuauuguguguguaugcauaugugucaugguacaugugcagaagucagaggagaacucauuagagucagcugggcuucugccauguucagcaaguuugucauccuuucuuguugagucaucucacugaccccgauuugagauuuuuuuuuaaaauuacaucacuuauuucaguuucauuuugaauagggagcacugagaauuuacucaaugugcaauuauccaaggacuggugccuuuuuuuuuuuuuuuuuuuuuuuuuuggugugacugucagccacagagcuuucuuacaucagcuguuuccccaaacugaaacauaaagacaauuaacaucuggaaggaucaccuucuaaaagaacucuucuugagagacaauguuauaccuugugagauagaagaacagauuucaaauacuauagaagauacugaaaauuuugaaaaaaaauagcaaagggauauaauuaucuccagaaagacacauaucacuagauagacuguaggguagugauuuuaaaaaguaguaauggccgggugugguggggcacgccuuuaaucccagcacucaggaggcagaggcaggcggauuucugaguucgaggccagccuggucuacaaagugaguuccaggacagccagggcuauacagagaaacccugucuugaaaaaccaaaaaaaaaaaaaagacuuuuguagaucuaaguauauuggcauuuuaacuaugauuaauguaacagagaaacccugucuugaaaaaucaaaucaaaucaaucaaucaaucaaucaaaaaguaguaaaaagacaguggaugaagcugugagggguuaugggcugccuauuugguuuugauuguucgauugagaagaaagccucaauugaggaauugccuagauccuguugguucaugggcaugccuguggcagacugccuugauuauuaauugaugcuggagggucuagccuacugugggcaguaccaccauugugagacaggggucccuggauugugucagagagacaguuuuguuuguuguuguuuuguuuuguuuuuaaagauuucuuuaucuguuuuauguauaugaguacacuguaguugucuucagacacaccagaagagggcaucagaucccguuacagauguuugugaaccauauaguugcugggaauugaacucacgaccuauggaagaauaguccgugcucuuaaccacugagccaucaucucuccugucccagagagacacaguuaagcaugaguccgugagucaggcagagagcaaaccagcaagcaacaguccuccacaggcucugcuucgaguuucugcuuaaguucuuagccugaguucccugggugguguacugugaccuggaaguguaagccaaaugaaccucuucuccccuaaguugcucucauucacaguauuuagcacagcaauguaaagcaaaccaggauggagccuuggccaucagcagagccccauauuggaauacuccaaaucaaauacgauccugaaaaccaaguaagaguagcucuugguaaguugaugccuagauugcaaggacccuggcaaucacuacuacuuuugggaacacucacauugucuccuugccucugaugccccuucuacguaucauucuugaugcuaacuugauucucaauucagaguacacuguucuaaccacccuuauauguccaugaauuccuuucucuaucaacugcccuaucucugguuagcagagaagcacuccaccugcuucaucuacaggaaaacuucgauuuccauggaacuucugccccuuuccaucaguuguguuugguuaagucuugcucacaaaaugacguggcauuuuuagaaacccacauucuuacaacccacuuagugaagaaagcaucuaacuuccugaagguauugggcaauacugugcuucaugcuacacaagaacaaauaaccaaagccaggcaauugaguuggucuguucuucaucucugugauacgaugucugacagaaaagccuuaguguuuugagggcucuauugagguccauuaagaaaaaucuauuuccuucuggucaaaagaauagauggagauagggcauucugaucugccuaaggacuggaacuacuacugucuucucucuuaaaagcuacuuucucugggccuacagaccaccucacuaggaaagcugauucaucuaaagccacacuaaagaggaauaauuaugcccuuaauuacauaaugcuuuuccuucuaagacacccuucccuuggugcaguggauuaggaagcugaugucaggcagucaugucugccugccucucugggcccugacuuacaggagacucuuuuuccuuuugcuccuucuccacugucuucuuuuggugacuucccaaagcuccaggggguuucucuggcacuuugagcuuucucauucucuuuuugaaagcuauucugcuuuuaucaugcaacugcuugcugcccuccauugaggagugagcaaaccuaagcuggacucccuccugggggcagcucuuuugaguuacuguuaucaugccuuauguuuuucuugucaacccuaguaaaaacauccuugaacuuuuucugaaucuguuuuauuuuuuuauauaaaaaucauguuuuucacguaugugacuguuucgccugaaugcacguaugugcaccccguguaccuuguauggggccugcagaggccagaagaaaggugucagauucccagcaccuugguuacaauguguggguguugggaacugaaagaguuccgcacuccucggugagugcucuuaacugcagagcuaacuuucaagccccccuccacccagguuguuuuuaaauccuuucauuagaaauuuaaaacucacacucagcucagcagguaaacacugacagaguaaucagugggagaaugagaaggaaagcuucaaaaacacuuuugcaucuuuugcaccgcaggaguccuguaagaaagagacucaugcugggagugguggcgcaggcaagccuuuaaucccagcacuugggaggcagaggcaggcagauuucugaguuugaggccagucuggucucagagugaguuccaggacagucagggcuacacagagaaacccugucuuaaaaaaaaggagagagagagagaaagagagagagagagagagagagagagagagagagagagagagagagagagacucaucacucauccguuggaaaguuaagauucuccagugaaauccucauauaaauucaggcuauuggaauuagguguuaucuauagaugcuguucucuucaaacucuuccuucauuuaaaugaauaaaugccucaguuuuuaauuccgcuguuguacucuuuaacugcccuuugguauucagaagugauucccacuuuuaaccuguuucuaaauacuaauuaaucaugagccccucccaagacuuuuaaaauagaggucagaaaaguuguuagaaucugugguugcuacacuuucccuaaagauucaaacauaaaugcuuuuucccuccaaaaguaaaacggaaaaaaaaaaaacaaaaaaaaaaccaaaccuccuaauaaauaccuggcugauuugaaaguggaaaaaaaucaauugagaaauuaaaaugauggauaaucacaccguggagcuaagauauuacauuaacauucauauuuuuagaagaggauuacauuuuaaauauggcaauaauuaucauaucauagagaagacagccuauauuuuuuuuauugaggcugcaccugaggacuucaggggagggaagcccugacacugggacaacuguccccagugagggacuguacguguugcccaagaaagacuacguguuuuuaggggucagaacauucagcugcuuacauggaaacuaaaauaacauccaucccagcaguacaaccacagagcaaacaccuucagcugccaguguccagcucauagucugaaacaguaacauacggguccaucccuagucuuccgcuuagauuuuguauuauuaucuguauugaaaagauguacuuuuuacaaauuuuaacaaaccuguauguuugguucuuucaaaacacuagguuuuauucccaccuauaaaacagagggauugagguggaacgcggauucucacgcucucguuugcauaugugugcgccacccugggaucuuguuaaugcugcaggucugaguucaggagguccgugaggucagcuuucccacucugcucuaaagugaagcuugugguacugaagugaggccugcauuuggggcaauggcggguuguguguuuccuuuuauuucuguaaggaacuucuucagaggccccaacaacuccuguucccauuaugcacugccuaaguuguucaaggagcuuagagcgucacuucucaucaugccuucccuguucuccccagaaaagguucggcuugggcucuguuuuuaaaaacuucuuuauagugaguggaccuucgggcgaacagauagacgccacugucaaguuuucauaaaagccacaggcuuggaaagggauuaauucugaaccagugagauaggucaguggguaacgaaauuugucauacaagccuggcagugugagcuugaucccuggaauucacguaagggcagaaggaaaggaagucccuccacgagcuuauccucugcccugugugugcgugauacucccuggccccucgcccuccacgcaucacgcacacagagauaacgaguggaaagaaauaaaagaaaggacugaaggaacaaacacauaaaaauauauaauauucacuuuaggugaagaucagacucaggcuuuuuuuuuucagcuuucucuccagccacaguucuugugaugugcugucugucugucugucugucugucugucugucucucucucucucuguguauucauguguacauguuugugggaugccaagagacaaccuuagauauaauuccucacaaacucuuuaaaaaaaacuuuaaaauucauuacauuuuuuagagauggagucucccucucucccccaagaugcaaagaagcaggcuauuuggcugggauaacaauuaaacaaauaucacacacacacacacacacacacacacacagagagagagagagagauaugcgugaguguguguguguaucauagguccuagggauuaaacucaggaccuuaugacugcaacacaggcguuuuacugaccgaggcaucuccucagucucccugugaugcuuuuuaauugucuuaaauauuuugugaacacucuacuaaugagaaauauucacuguauuuccuuccagcauccugcaccgcuagauggccagagaaaaggcugagaugaggcacuuuaaacucaucaggagaugucaagauaacucaaguacacagccucggcaacagaguaaagugcuacauuuguuccuacuuauccgucccaugguacucaaguucaaaucccagaguaagggacgcgcaagccuccugagcaggcacacccccuagucuucaaguuucuugucugucggaguucuggucuccuugacugucaaggagauugaguggcaucauugcagucaacuguugagacaccuggcacacagugaguggguagcaugcggggaccugcuuacacugcugugcaagugacaacuucuggauuucauuucagacugcguaugcauuuguuuauauagggaacauacccauaaucucuacuugcugcauauaaaguacauuuugcagccauaaccccugacaucaauaaaaccuuacccuuuacaaagucuugauaacuuauacauauuagaaauuaaaaaaaaauguagagccugcagacacuauggagaacacaagauuguguuguuaucagugugguaucaaaaauauauugucuagggcuggggauauagcucugugguagacugcuucucaggauauucauggcccuaaguuugauccucagcuuugaagaggaaagggagggggagaaagagaaagaggaguuggaggaggacacuauagccuaguagcauaugccuguaauuccagcacuuagaaauuagagucaagagaauaagggggaaguucaaggccaggcugaggggagaaaggacaucuucucauauaaauaaguguguggcacagcgguuaagagcaccgacugcucuuccagagguccugaguucaauucccagcagucacaugguggcucacaaccaucuguaaugagaucugauuacugagggcuucuagugugucugaagacagcuauguacucacauuaaagaaagaaagaaagaaagaaagaaagaaagaaaggaaggaaggaaggaaggaagaaagaaagagagagagggagagaaagaaagagagcuuuuaaaaauaagugugugcuuacuacauggcucacaucuguaaucccagcacucagcagguagagacuggaggaucaugaguuugaggcuagccugggcuacauaccaaauuccagucuaggauaccuagguagugccugucucaaacagacagacagacaugugaugaauggacggaauuuaauaaggagacacuauuuuuguuuguuuguuuucaagacagaguuucucuguguaacccuggcuguccuggaacucacuuuguaaaccaggcuggcguugaacgcagaaauccaccugccucugccucccaagugcuaggauuaaaggugugcgccaccagcuuaauuagacacuguuaaucaucauagaauugauaacaaauagauauuuuccccuacuguaugguaaaacaaauaagaaaauucaagucagggaauuacugcuuuuguucuuucauuuucuuuaacuucuaaagacugaauuuaaucuugcaaaaauuauucuuuucaaaguggccuaguguuauuguucuucugauuacaaaaguaagguagaaaggcagagccuaccucagggagaucagggaacacaggacugucauuaagaagggagcaauagucaccuucuggaauagaucuuggaagaaggucaccuuuacugucguugauuuuauucucuugucucauuuacauuuugaaugugugcaaauaacugaauuaaguacuccacauacaagguauaucuuauauauuacauaguagauagaguuaacguauaaaggauagacaguaaacauuuucauuuuacuaucauucaauuauuauuaucaucauguuuccaauuucugugagaagcuucaacuccaggcagaaguguaauuuuuaaaaccugagaucauaguauacaugcuauuuaaauauauccuccuccuccuccucuuccccccuccuucuucuucuuuuuugguuuuucgagacaggguuucucuguguagcccuggcuguccuggaacucacucuguagaccgggcuggccucgaacucagaaaucugcccgccugccucugccucccaagugcugggauuaaaggccgagaaccauaguuguuaaugccuguuuuggucuuugcauguaccucauugauucagucagcucucuugagaugagcauuuucaagaguugugugauaaauacaugugugcuuccggcauuguuucuuuucuuagacuagcuuccuagaaggccgacugacaggcaguuauacauguagggcugagacuugcugggcccacauaaugacuuagguaaagaugccugauuucugcuaagccuggcagccugaguccaaucucugacuccuacauggaagaaggugagggagggcucaggggauggcgggugagaauaaaccugcaagcuguucucugcccuucacuugcacaucuuggcaugcacaugcccacacauacaugccugcacauacccuaaauaaauaaauucaguuaaacagcuuuuuuaaaaaaaguaugguuuuguauguauuucuguuuucucucucaaucucucaaucucaaucucucucucucucucucucucucucucucucucucucucucucucucucucuccuucaagagacaggguuucuuuguguaacaguccuaguugucuuggaacucagucuguacaccaggcuggucucaggguuacagagauucacaccccucugccucccgagugcuggaaucaaacgcacgcacgcaccaccaccaccacccugcuuaaugcugagauuuaaacugauagcaggaguaaagaauugcugaguucgagcugggcgugguggcacaugccuuuaaucccagcacucgggaggcagaggcaggcagauuucuguguucgaggccagccuggucuacaaagugaguuccagaacagccagaguuacacagaaaaacccugucuugaaaaacuaaaaauuucugaguugucuauucagcaauucuuccaaaauaaaagagacgcuuugugauucaaagacagaguagaagaaauucaccugcucuucuucccauggacagagugugccugugugccaggcaggaaaaugcuaggggcagcguaggauacuggacauccucgguuggauuugcuuuuguuccucugcuuuccaaaaggaaagcccagguuuaaucuuugaagcaguuuagaguuaucuuugcuuacagucucaggaugaauucuugggacuggaguuacuguuaacuuaaugacaaaagguagaauuugcaggggaucaagacagcccuuguaaccgcucagucuugacaagcaucaagccaaguaggggagagaaauggacagguagauguacacaaguuuggucuuuuccccucuuuuuucaacuggaggauauuuaaacugaaagcaguaacucauuuguccaagauggaagcagaaugugaaacugaaaccaaacugugguuugggacuauuuguaccacaucaagcagguccaagugucugacagggaagaguuucuaaagacuaaagcuggcagagcuagccuuuccucugcuacuuuuauuaauguacuuaggagaucaguggugggccagucagugcuccugucucuccccuacuuacgcucaccuacaaagugaaaggagcagaguuuuucuaggacagggaugagaucuuuacaucugaacugaaugggagacaggguucuugcucuuucagucugugaguggccuaagugccugcuguugcagcgcucuggccucuaacucagccaguggagcccagggaagaucugaguuagcauccaucucuucuccacuaaccccugcugcuucuggcaguccuaauggagaggguagccucuuguagaucugcucucuacaagugacagccacuaagugcagcauuauauucugggagguaacagaugcaagcaugaggacugccuucagaauaacuggaaaucugcuagagagagagggagggaaagagggaaggaggaagacugagggagggaaggggagaggagauguggggaagggauggaggggagagaggcuaagagggugagaaagagaggggggagagaaagggagaaagagggagggacagagggagggagggaagggaggggagggaggaaggaaggaagggaaaaaggaaagaaaguaggauugcgaacacaaagacguuuaaagacuuuuuuggaacuauggaagcuuccagaaacaacaaaaaagagcaauuugaaacuuuuuaaaggaaagaaauaagugugcuuuuuucuuuacaaguccaaugguucguuuuccauggcacuuguguucagcccugcugaacuugaagucacagcugucaacgugaauaccagaugaccagagggucguugagcuuagaugugauccugcuucaugcacagagcagauccucagucuguacaacugaugugaaauguguucacccugguugugcuugggacacuuuuuuuuuuuuuuuuuuuuggauuuuuugaggcaggguuucucuguguagcccuggcuguccuggaacucacuuucuagaccagguuggccucgaacucagaaaucugccugccucugccucccgagugcugggauuaaaggggugcaccaccacgcccgguuucuugggacacuuuuauuugcaaaguauuuauuaagcaccugucagcuguguacuagggaugugugugaggugcagggacgguguacaucagucguguucuaagagaugaggauucagcuauaaaggugacgaacuuucuacucucuuggugugaucagagcccguaagaaauagcagugcagaacuaaugacggcuaaguacuucgagggagagcagugcauuguggggcucuggaggacacaguauuuuacaaugcaugauccaagagcaacacacuugagagaaauaaaggaagaaauaugcugggauauauagauagauagauagauagauagauagauagauagauagauagauagauagauaggaaggaaggaaggaaggaaggaaggaagaaagaaagaaagaaagaaagaaagaaagaaagaaagaaagaaagaaagaaagaaacugagcaaggguguuuccgacaaagauggcaggagaugcagaagcccugagacagggauauacucuagcugacacacaagguuacgaugagagugcucaacaccuaagggccaugcacucuugcuucugcaaagagagaaggcaaaagaguaggacuacuaauacugcucuguuuauuuguuccuugauuguauccuucauuagucaauuuuaauuaucaacuugacacaaccuagauucucuugcucagugaaaaacgcucuagaucagguuggccaguggaugugucuauggggaauucucuucgcuaccuuaauuaugugagaagacagccugaaaaggcagcuguaugaccugggcuugggaccccgaacugugugaacgaaugcgcugaacacuaagcaugcacgcguuauucucagucuauucucugcucuccguugugguugugagaugauuagcggucacaaaauccugccuuggugacuuuccacaggaaugcgcuaugaacugggaugcuaagcuaaaagaagcccuuccuccagcuagcugcuuuuuaucgggguauuuuaucacagcgguagaaaugaaauuaggauacaccucaaguaagugaugugaacauauacccagguggcuuucucccaugagcaauuacaaguuucuuucccaauguugcagcaggugaccuucuacauuaagauacaucagaagacaggucaaaaguagagaguccccaauaaacacgaugauaauggagugaaaaaugcuacccgugggccaaguaaagucauggcguuggggaggagagccuacaccuuggaaugguuuguuucuguuuagucggccuggcccagcaaacacucaauuaacaaugugcuaucuuaagaugucacuaucaaggcugcuuugugauggagcugcuacugagccagcaggauccuuucaacaggcucccaagaccaaggcucaagauaaaguaacagagauacuguugagagugacucacaguggggcaggaaccacagcucacaggaacccaguuaugcaggaaccugaagcagggugguucugaguucuaggucauucugaguugaaagccauucugagcaucuuagugagauugaucucaagauaaaaaaguaaggcucguucgguuggucugucggguaaguggcuuaguggauuagaugccugcccuaccaugugggaagaccuggguuccaucucuugcauuacaccacacacauuuaucccuagcagugggcagcugagccaggcagagcucugagucugaagcuagcccgguuuacacaaagagacucugucucaaaaacaaaacaaaacaaaacaaaacaaaacaguaaaaagugaaauaaaggggacgggggauauacuucagugguagaaagcuuacaaaagcugcuugcuucaauuucagaauaguaguauauaauaauaaugauaauaauaauaauaauaacaauaacaacaagcuauugugucaaccuguauuguucuuuguagccgaaagagaagaaagccgcccugagaaagaccugcgacugcugacuguuacuuccacaccuucuucuauccugagaaucucagaggccucugcuucaucuggauugcauacuguugcugacauucgguugauaaggcggcauucuuaggaaagguaccagcgucccauuacugucaccucccgcaggugggauucacccuuucuucuccaaugacacaacacaagucaagccucuucaagugcaaacccugccauuuacgggacccacaggucgcucggaagcuggguaaauaaauaaacuuugcuuccaaaaucucaaaacugaucuguggccuuucuuccaagaugggaaugcacaggacugaacaaucuccauacagucuucucagaagcgcuaacacuacacuuguuuacagacagaaggagucuaucagucuacagacgacguuccguccaaggucauauccuccaccucacguagcaaacguuuacugagucccuuuguggaacaaauuaccaagguaaacaucaggcucaagcagugaucuuuagacaugugggauuucacuacuaaaauguuaucuaggcagggggccuaugauucagcagguacaagcacuugaaacacaaauaugagauccccagaacccauguaaauuuguaaucccagcacugugagacaugagggaggagacaggaaugaucuaucucagggguuuacuuaguaccaacuuacccugugagagacccugacuuaagggaauaaggggagagugauggaucaggucugcuucucccucaugucucuuucucuccucucucucucccccccucucucucucucacacacgugcacgcacgugcacaacaucuaaaauaaaaaauauuauuuaugcuaaaauguuugcaguucucuucuaagagcccaaggcuuuuugaaagaugaguagaaauauguaagugggcuggugagauggcucggugguuaagagcacugacugcucuuccaaagguccugaguucaaauaccagcaaccacaugguggccaucaaccacccguaaugagaucugacauccuccucuggugagucugaagacagcuacaguguacuuauguguaauaauaaaugaaaaaaaaaaagagaaauaugugagugguaucuaacuaagcaauaugaauaguguugaaaauaacuuauuucaaucacagcaaacuuuauaaugcuccugagguaagaaaggguggagauaucuaucucuaggcgucauuuuuucccaaggaccagcuaggagaaaaauagauuguuugcucucauuuauagaacugaauauuaaauuuuaauuugggaauuuaaugaaacucuuccacuuguagauuccauaacaacguuuuucuaugauuuuauuugguucuggauaauuuaguuaauuauacagcuaaaaaggaagagcauuucaguugcuugccuaccgugcaggaaacuuuagguucaagccccaacaaaacagaugugcugauccacaucuguaagccuagcauuuguaaaguucuggaggcgggggauaguguugacuauauaauauaauaagcgcgcaucuuggguuguguaagacccgggcucaaaaaacaaauacaacaacaacaaaacaaacaagcaagcaagcaaacaaauaaaaacaagaaggaaggaagggacaaagggaagggaagaacacaggagugauaugugguuucucaugugucuucugaacaaagugcuuuguaguauagccgguuuaagcuuaucuccgaguagcguacaaauaagugagauucagaauaugguuacuuuauuuggcuuugacaauuaccaggguggaaucaccucuaauuacucuuuuaauuacuggccuggcuaccucccaagggcuguaucccagauacuugcuguuucuccuggccaugugcucaugguuccucuccccuaauggcggcuuccuccuccucucuuccauguucuuccuccuucuuucccggucucuccuccuccaaucaggucacuccaaacccaccuaccucuaaucccucugaugauuggcuauagccaauuuuguuuaaccaauaguuuuaaaccaaugagaacaagguuugcacaacggaauguuacaaccguaagaagccauuuguagcgcuagaucuucccguauuaaaauuuuagcaucagaauaccuagcaauagaguaaaccucaacauugcuuaauccagcugguaaaauuaacacuuuaugcucauauguuugaacaaauaccauccaacuuuuauauaauucuucuuuucaaaaaaaccagccaagauagccccaggucaucuguggccacggcuccuaccacacuuugucccagguuucaauuccggagccuucucccauauaaaaugccuuguuacuuucucugcuuucucuuuuccauuuugugagcuccacguggcaccuugugggauugcuuacaguugauuuccccuuaauggaauuuaaguagacacaggacaaugucuaggacauugggagucuucaguaaguguucgugacugaguaggugugagugugugcuguugcuggcuguuugagguacugggaccugagcccugggccuggugcaugcuaagugacuauugcagggucacaacuggagccuugucuuuaguuuucaggucuucgagaguuuucagaucuaacuauaaauacugaccuccucaauaaacuggcuuaggaaacuuuggaagaguucuuucaagacaugaacacaagguuggcaccuccaagaacuuaacaugauaaucacaaauauuaaaaaaaacaaaacaaaacaaaaaaaacaaaacccucuuaaauggcugauaaaauaguacucccucaaagaacuaguuuaaaugauucauuuugaaaauuggaaacaauuuuacuuuucaaagaacaucugaguacuuuauacaccuaacacuuaaaaggaugcaugauuugauaggauuauuucagcucuguaugcacagaguuguuggcucacuaucuuacauuaaacccagucagacccacgucuucccuuacuacugaugccuguauuugccaauguucuuucuauuacaaacaaacaaacaaacaaacaauaacaaaaagacuaauuuuaaauuuuucuaaggcaagucaguauuugcuuccaguagauggcacugcagagcaagccuuuauagauguaguaauuugucccuuugaucaugaaaaucauuauuuauucuguuaugaggucauauaaagagcuuacacggugacaccaaacacauaagggacuuuguacuguguucugucacugacaucucaucuguacaccuuagcugggcacuugccaauauaguggacucccuguugcugaagugacccaccauguaugaaaccacuuuuugauauuggauuuuaccugcuuguuuuaauuugguuggcuuauuuuauauguucagugggacugcauacauuuucacggugucaaauuugaccucauucagguuuguuaacacacacaggggaaggauaguucuagaaccagaaacaauaucccugaccuguaugugcacacacacacacacacacacacacacacacacacacacacacaguguuucagguacagggacuuaguuggaucucagauuguguaucaaaugucaacaauguuucuuaaaaccauuuaaaaggaaugucauacaugauauuggcugguaguuauuaaaugcuaucauauauaaaaacauaccuagaagagugucugggguaaauuagguauaaaauauccaccuuggagcuggggauauggcuuaguugguagugugcuugccuaagaugcaaaagacccuggguuugaucacaaggaccucauuaaaaucagauguggugcuguuugccagcacugaucauccuuugguauauaagugagcuuaagguuagcccaggcuauaagaaauccuaucucaaaguaaaagccccucuuuuuuucuccucagagaguagaggaauacaaagggccagaagcagaaagcgagcaucuauaucuuuccacuuaauaguacuuaccaaauaaucuuaguaaucuuucuggauuccagcucucaaaauggcuggaccugagccuucaggacagggaacaaguuuuccaagagaaaacauugugaaguaugauguaugcgucacugucauccuccgguguucaagccaauagcugugaaaauccuaagugaucuuuguccgaaggauuuucagacugacacucuauaagcaagcucuuagcuuuuucagcaaguugucccaugacuuucuaggaaccauguacuuuuaaaacauuucguuuaugcuugccccuucuuucuuucuuucuuucuuucuuucuuucuuucuuucuuucuuucuuucucucucucucucucucucucucucucucucucucucucucucucucccucccucccucccucccucccucccuuccuucccccuuuuucuuuuuuuaaaaacucuugucaaaggaaacagaaaugucuccccccccccccccccaagacaggguuucucuguauagcccuggcuguccuagaacucacucuguuaaccaggcuggccucaaacucagaaauccgccugucucugccuccggagugcugggauuaaaggugugcgccaccauacccgguucagaaaugucuugaaaucacacaaguagccauagcaguaaggaaucucuaaaauuucuacaaauauaugagauuauaugcaaauauaugaggugguuauauuuuguggacaucacuauaaugaaugcauuaauaauucuuuaucuaugugaggaugcucucugucuccagguauuuuucaaaaaucaccuucaugacugguacucucaccucaccccuggacaugcuagaggcaagguaaaacuuacacagucaugguaacaauaggagggaaguccagaaagaaagacauaugauccaaagaauaacuucccaggauagucaggugaagaagagccuauagaucuguucacuugauuuuucuuuucucucuuucuguggccccggaguuuaugcuuugcccaacuguguggaacugguagugauagugucagaauauuacagaaagcaauuuguggcuaugggguaaagcagaccacuagauaaucuuuggagucauaaaagacuuuuaggaacauccaacccuaacccgguguguuuauuuuaacuacagggggaaacgcaguuagagagagaagccgcuggacucccagagguaacacagauaaguaaugauaaagcagggaccaaggucucuugauuccuaguacuuuggccaagaacuguaauguugacaaaggacugaaaaaggagagagagagagagagagagaaagagagagagagagagagagagagagagagagagagagagagagagagagagagagagagagaagaggagagaauguagacuuggugaguuagaaggcuaauagaguguucucuuauguggucuaagaggaaacaaguuuugggguaaagguccuuggaaagagaagauugcacacauuugucaaauauugguuuuggcuguuagcucuccugcuuguauguaagcuuccaugaccugcaucuuuaagaaauauuuagauacaaagagucuguggaaaguggauucuuccuugcuuuugaaggaaaugagcauguaaaaaaaaaugacuacaugcggcucaacaaauacacaacacuuauuuauuacuuauaacgcaacaagauuuaaaccacuacaugccucuaauauaaauauaaacacacaguuuuuuuuuuuaaccuuguaaguucucaugacaugauucuuaggaauuuacagaauauaaaggagaaacuuuuccucugugaacuuuucuaauuuuuuucugugacauuagagaaauggaagagcauauacauaucuuacaguuaacaaaacuaauuuaauuacuuuuuaacacaguggugaaaugaauggcuuagccagaauuuaggaaugcaagagcauauauagucagugcuaucagagacuuauuugaagggagauuuuucagaaaguguuaauuauuuuuuagugaaucacuuaguacuauuaaucgugagacugaacaugacuucuccugaguuggagugcauuuugucuuuggaaaggcagucucugcuuucucuacuucuuuauuucuuggcagugguuacuguuuuauugauuuggagugggucccgcauuuggagucacacaucccuaaagggucugguugugaaaugaaaguggaaauuagacggcauuggaacgggacgaaggaguaccuuuaacuucggagggaaccugcuagccacuuuucauugccuuuugggugcccugggauaaaagugggagguggguuaaaaagaaacaaaaaacaaaacaacaacagcagcaggagcaacgaucacaaagaaaagccaaaggacauaagaaaagccaugugccaagagugaauuaaaaguaaaggauauugaacuuggagaccguuugcuguagacaucauuggaguaauuuguguaaacagugcggccacuacgugcagugacagcgcaauguuuuuuauuucuuaaucaugacagguagauagauaaauacacaaaugaaugaaugaaugaauggguggguggaacuccgcgccauuugcuauagauccuugggcagaauuacauaaugugggucugaauaucaaccauauagagauugcuuaauuacuuugucgaaucagguaagauaaucagguguguguuuaaaaauuuugauggaacaacguucagugggcaaucguaacuuuaaaccaggaaauagacccgcaacccuuaccgcguugguagguuacaacucaagccucguggcugguggacugauaaaauucuauuuccuuccaaaggggagcugcccggaaguccugguagggaagcugggagcuaggugggcggucuaggacgcacaaaggaguucugcugccuaaggcguccaacgcaaccacaaccugaggcuuuggagaguuggguuggacaaccuagugugaguugagagcuauuccggucuaagagugcuuugcgcuugguuauuggggggaggagggagggaagggggaaggacaggacccugaccacuccccuggacggaagcgcagguugggucuugugggucuaagccucuaaaggugacuuugagccucuuucccaccucuuucugaaggaucagcugcgaguugaaggagugagaagagguaaguugggacuuugagaccuaaaccuggacauacacucuggaauccucggauucuucaccugagaccaccuuggguuaauaaaagaagcaguugcggguguagaugggaugaauaauguucagggacgggauuaauuuauuuuugagaaguuucugccgucaggagucuccgaccuuaaggaugaugagcucaaaaaauacauugguguuccuaagaguuggacaccgggaagcuagcuucgggaguggcaaacuccggcgggugauaaaagugugaaccucagagaauacugauaagcgaaugacuggggccuucagggucuuagauggcucuguacuaaacggagguguaugggcaaggcgagacgcuuuagagcuaaagaauucucuaaaaugugaaggaaauauucucagacuggcagggcucagucuuuuguaacuuccaccacgcuuuccgaaucucugacuuucgcccaccauucccucccaccccccaccccugaggcccaauaauggcgagagccauuucugcgcuucucccuucuagauucuuccagaugaccuaaagccucauaguuggugaugucucccgcgcaaaguuagccucuggccccgucacucuauuggcgguuccuagcccucaccacucccuagggaaccacgugugggaauuucgcugggauguuaggaucagggagggugacuaaaaaucucaguauguaguuguuuuuucggagagugguguaagggauaggugggcaauagaagacuacggaguggaagauuuuuuuuuuuuuuugaagucgggguuguaaaggcaaagaccuugagcaauugugucuucuguuuccuagucgauagaaccagcucuauauucgcucuacugcuucccagcuucauaaacggugaguuuugucuaccugggcaucuccagcuuuucuguauaggggacauuucguuuguguuccguaccaccauugcgcccaaggcccgggaagcucauuagcccuugcgccacgcccgugaaaaagugcggguagaccccgcagaucagauugggcggaucuuccgcuccauuccuauagaucaugaaggaccugguuuuucuugauaugggccagggaaaccccacccuacgggaaccuguccuggccaggugucccaccagaagcccagcgagcuucgucacucgcauuccuguagauugcagcugguagauccccggcaguccaaacuuaacucccagcauuuuugggugugguacgggcccaaagaaaaccucuucuucucucccccaagaacagauuuuuuuuuuuuugagagucuucauauaaaagcacaauuaaaguacagggugggguagaccagacgggaccuucgauuuuguuuuuagggucccccauucuccucacuucaaaaacucuuggacggguaaagcacgagauuaugcucuagguagaccaggggauugcaaaccuagaaaacaaacaacagcugagaaauuggggugugaguccaguugucggggcaaauggguguucggguacgcuugcggugugaacuuucuacggaucacuuguggagggaguugaaggaaaggagggaagggaaccgccccagggguccucguggcgagguccgugcucacugggggaggugucuaccuaugccugggcggggggaggggggagaggcggggggaggcgggggggggcggugggcggggggagagugucaccuugugggcgggagaaggagucuaccacgaagagcaggcuaauuggcucgagacauuuugcgagcauuggaaaaaggucguugaaggaguucgcucuacagagaaagagagaaaucuuaaaaaagagugccgggcaugcgcauagagaggaugccauauuggaaugaggcuguagugggagcuggaggacccgagcgggcgcgcuagggaggcggcggguagagagcgagcgagcaagagagggcgggugagccggacccgcgcccacuccggucgcccccgggggccagguuccaccauuccuggcaggacaaacuuaaucagguaggacgccgccccagacacgguccccucguccaacccggcccgcgagcagaucucuggcccgcagguugagugugccgaaaggcgucuuuuuuuuuuuuuuuuuuuuuuucccaguuuaguuuuuuuuuuuuaaagaaggaagcucgagccagucuggguggaggggggaggcgggggguuggggaggaaggaggagaaaaaccgaagcgcagaggcuggagaggaaaugagaagcacuugagcgaagccucuaacuccucucugcgcucuggguugucauuuuuucucauuccccacccccuuccccccgacucccggcucugaaaagccaggccuugcgggagucuguccggaguugcaaagugaccucguccuccuccgggugcagucuguucccuccccgccgcccaccuuccucguuuaugcacucgcuuuagcggcgcagccuccucugccaccuaccccggguucccgcgucuccucggagccggggucucccucuuuuggugugcauugggggggggggggggcuaggagguuguagagaggaaagugauggcguggagagaauuggaaagcagcaagggugggguaggggcuguucccaaaaaucgcgcagacguuuggaaucgccggauuggaaacauuugccuugugcagcggaauugaaauugucaauaguaguuucggagcgagcucuagcaaggacgaccuuuuuguucauuuuuaucacccuuugaaguaauauccugucacuuggggcuuucuuguguacacucauccugccccuuuucagaaugucuaacaggaucgagcucuggaguuuauuuauuuauuuuuaugugcgugugucuuggugaaauccucuuuaaaaaaaaaaagcaacggcaggaacugcuggauguguuguuuuuuuuuuuuuuuuaaauuuuuaccuggagcggcugaacgggauuaggcugggaaagggagaacauuugaggggugggaagcgauugguuuucuguggccggacacagguccccagcccagucaauacuuguguuuucuuggaagcgcuacagcagcggggaaggagucuuuagacaccgugccaguuccaauauggcgggcuaagguggcuuuuaaaaacugaaaauaaagguuuugaggugggaaaaaacccaacugaaguggccacgccuuaguuucuacucucuuugguuacuccaggagcugcuuuagcgaauuaaauaggaaaaaagagguggggcgagguauuccaguuuuuuccgugguuuaucuguacgaaguccauugcuagaggaucuaggguggaggguugccucgggccagaacgaggguauccaagcgcaacugccuggugugugugcuuguggggucguguacaaacucugcacgugcagucggucgcuagggugug

SEQ ID NO: 631 - RNA, 2473 nt, Mus musculus
uaagaauuauuuauuugcugggcagugguggcgcacgccuuuuaucccagcauuugggaggcagaggcaggcagauuuccaagugcaaagccauccuggucuacagagugaguuccaggacagccagggcuauacagagaaacccugucucgaaaaaaaaauaaucuauuuauuuuauguauaugaguacacuguagcugucuucaaacacaccagaagagggcaucagacuccauuggaugguuaugagacaccaugugguugcuaguugaacucuggaccucuggaagagcaguuagugcucuuaaccacugagccaucucuccaacuguccuccuccuccuccuccuccuccuccuccuccuccuccuccuccucuucuucuuccucuuccuccuccuccuccuucuucagaaauaagcaacaaagccccuuuaggcaaacuuucugcagugaacuuagagacaguucauauaacccuggaucugucuuuacccccuaacaacucucagaccucucugcuaccucucuaaacacaucgccuaaacccaugcuuucuggaaaagcacuccuuccaaguauagaaaaacuuggaggcaggaggugauggggagaguuguaaaaugagacaaacaugaaauuagaauagaacgucaaaaggagacuguaggguggcucccucuauuugcccccaguucugaaguaaucugucagauuuuaccagugcaguuuacugucucugcucuuagcagcauccccagaaagugaaaggacugcaagggagaggaaaaaaacccacagcaaacacaacccaccacauccucuugcaauucccaugucagaucuucuuugaaaucaccugugcuguaucuagcucacccgugcuucuuggaacacuuacacaaaaucugagauccaucuauaauguccuguccaaggucggcgccauuccgggagugagaagacagagugugguugaaaugaguagcuuaaaagugaaagcaagggcugggacauggcucggguaguaaaguggucaccacaccagcgaggagcugaguucggauucccagcaugcacacagaaagccagguggcauugaaacaucuguaaccccagcaccaaggaggcagagacaugcagcucccugggacuccuuuggauagccagccuacagugaacuccagauccugugagagaucuuauuucaacuaguaagauggagagagguuagggaaggcaccugaugccaacuuuuggccuccauaugcacccagguguaccaacacugaaacgcacacauauacaacacacacacagacacacauguauuuucacuuaaaagcaaauucaaaaucacaaaaauauucucucccccagguaucugcauauaauauuuuuuuuacccagagucuacaaaaaacaaacaaacaaacaaacaaaaacaacacacacaccaaaacucuucagacugaaacccuguaacguguaaaauaguaauauguuauaaacgggguaugaaauaugaccccaacuggguacaauccaucugccuccugugucuaaucaauaguccugccagcagauccauagagaagaauuacagucacaauguaagaagcaacauguaagcuugaauacgaucuggucccugucuaguuaagggucaaauuaaccucucuuucugcucugugguauaguagguguggucaaagccacgucacuagagacaauccugccucccgaugugaaacuuuguguucugugaacagagauuugauuuggccacaguugauugugcuuucuacccaaaucugcaggcccggcagugagacaagcucguucauucagcuuucucaaaaggaaauggcaggcagugguggcgcacaccuuugaucccagcacauggcaggcagaggcagguggauuucugaguuuaaggacagucuagucaaaagagugaguuccaggacagucagggcuauacagggaaacccugccucaaaaaaacaaaaacaaaacaaaaaccaaacaaacaaacaaacaaaaaaaccaacaaaaauaagaaaaagaaagaaagaaaagaaaaaggaaacacuagccuaaguuuggaaguuaagaugcugucuucccacccagugcucuacagcuacacuugacacucucagguuugcagcccugagauuugugagguagaggaggagaggugagaagaaggagagagcuaacagcuuagcacauacagagacgggagccugagagucaaguccagcaaguaaacauggccaguaggcaucgcaauuaugaaucuggagaugcgccagauggcaugauccgcaaaaugaaaucgaaaggaccuuccugugucccacuuucauguguguguuuauguauguggguacauacagaugccagucaacugcgggugcugucccucgggagccaucuuucuuauuuuugagacugguucuua

SEQ ID NO: 632 - RNA, 890 nt, Mus musculus
uccuuaggugcagacuuugaaucagaaggcucguuuguguugcuugccuccagcuauugauggggccuugggcugcaucauccugggcuagccuggcagccagugcccuggagccagcacagggccccuucauucucuuucuuuuucuuuggcacagagagugucuugcgacagguugaauaagcagccugaagguuugccagcgucaugagaugaggaagcacagcaagagaaaaagcgggaggcugggcuguaggggaggggcagcggaagcuugccaucaugugguuuaaauggcucaaacgcgauuaaaggcgggcaucagugcaagcccuuuagccuuccaggaagccuggcccuucccuuggguuguuuguuuagcauggucuggugggcugguuugguuacuuccccaaacucaugagcaaagaguguucuagguagagcggggauguggucauuccagccacggaggcaacugaauuuaggguaccugcaucugaacuuaaaaacucuagguccaaucaaauugucacugugaaaaaugucugacacagaggggaccauaccgaguagagauggagggagaaguaagugcuagaguuuuguguucuuuuuucugccgcuaguauguggaaacaaauuugagcgcacaucucgugaggugcacaugagacuggagagaaaaagcagcguugaaguuauuaggccagcagaaggaaccgggguuggaucgcugcauuagaucugagcugaguuagugaccacauggagaugucccucauaacucucuuccuaaauuuucucaccaaaacacccaaauccuucugcccuggcuuuccuuaauuuacaacaugacccccuuuuagugcccuacgcaguuagcuaca

SEQ ID NO: 633 - RNA, 9132 nt, Mus musculus
uuugagacagggucucuauguagcccuggaggucuuguaauuauguguguauccuaggcuguccuagaacucacaguucauuugccacauccucugaguuuugauauuaggggaaugugccagccuuauccuuaacucaucuuucuaagucuguucuuuuucauacguggguuugucauguacacacaugcaguaccacacgcauucauaauaguaagcaucuuaguggagguaguaauuuguuauuagccaagauuagcuccuccuauucaaagcagggaugggauagcagagagcaagccagcacuuccugagcuggaaugcguggaaauugucaacuauuucaguggcaaauuguuaugcuauggaucuggcuggagcccagaguucuguaguuggaaggaugacucagaaagcgugagcugggcaccuuugccucuguggcagugucugagucacugagggaaacccgaaaaccacuaggugucagggacagaugcugugccgucugcuggaacaccgagguccuggauuugagaucgcaaggaagucccugcuugcucacucagugaagucaucggcacauuugcugggacuguucccaucaaggaagugugguaaauuucccaaccuuggcuugcaucaugguccagauggcuucuguggcccacuucagcagaggggaaggggcugaugcagccaaaagaaucaaacuuugcuucagguugaggaaggagguaggcaugggcugugcuuggaguagaagcaguucugggccuugcucucccucccuccugcaggaucaacaucaaggcuugagaagaaaguaggaugcccacuaauuccuaaggcaccaacguucugugaaucuacaaccguuguuucuuugaauccaggaagcaaggguucuuuguuacaccuuugcaaugauagugagacgcugaauccuuaaguguuaucuaacagcugauaguguugugugacaaaacuuuuccuggagagauaaaacacagucaucaacucaccccagaaaggaaacccaugacagaccaaaguauggaugccaccauaguccacccuggugaaccaagaguucuaucaugguuacuuacagaagcguuggugagggguugcuuacaggagcagaaguuacucaaagacagcugcaucaacagagcccaccccagcucacaaagacugauagaccuggagcacacugcacaggcagcucaacagaucagaggguguccuuuccaggugccacgguugcucuaaaucuccaggugucugggcuggcuucugauucuuccaggcaguaagucuggucugggagucuccuuuguagcucggcucugcuuucucuggcauggugggcccuagugaaucaggucaguuuucaagaguuuuuaauuuguuucccucucugcuuuaagagcucaauguuucaauaucagaggcaacuguuaacucccagaccuguaaucucaucaugcaagaggcagagacaggagaaacucaagaacaggcuugguuuuacaucuuacucaaagccaauuuggguaugacuuuauugccaguguuugggaggcagaggcagaugugaggcuagccuggucucuagcaaguuccaggcuagucagaacuacagagugagaccccguaucaugaacaaauaaaaaacaaaaacuccaacaaaaccagggcuggggauauagcuccguugguagagucuuuaaaaaacaagcacgaagcuuuggguucuauuuccagcaguaaagugagcaaagcaaccggggacuguaucuaagagucaggauguggaggugauacgaccagaagcucagggucagcguugucuauaacgugaguuugaggccagccuggcuacaugagauacuguucucucauaaaaaagaaagaaagaaagaaaggaagaaagaaagaaaggaaggaaggaaggaaggaaggaaggaaggaaggaaggaaggaaggaagagaaagaaagaaaaaagaaaacaaacuguguaugggagggaggcggggcuggguguaguuggaguuauccuugagaagaccugcccugaccuaccacagggccucaggccuuucuccucuccucucuuucuggccuggagaagcacucugacaucccagaugacccuucgagauaaagagaaacuugugaaguuccaagggauuuacugauaaagcgucuuaucucaguguggcuucuacuggaagcugcaggucugagaaagccaagcaccuucagugccucucuuuuaucccuugcaucccgaggucucccagguuagcucauccuggaugugggugaugugacucuccccuucuguguuuacaucauccagguguuucccuagugaaacaucuggaugucccagugccaugcccugucaccagcagaccugacagagccucugccaacagguuucucaguucccucaagacacccaggagucagugggaauggguuccuuuguggucaaguccugagaaacccaauuuccagcacacugaaugggagcauacaccaugggucaccuguucagacaucaaaccauuagcaacucuuuuaaagucuccuuguaaccuguggggaacagaaugaaaacacucauucauccaaaaaagcugaggugggggcugggagagagauaacucacuuuguaucugucuaguuagcugugaguuccauacccagcauugaauaaacaugucuaugaccucagcacuuggaaaguagaggcaggaggaucaauguuuaagguuagggucuuagucacuguucuacugcugugaagagacaccaugaccaaggcuuugguuuuucgagacaggguuucucuguauagcccuggcuguccuggaacucacucuguagaccaggcuggccuugaacucagaaauccgccugccucugccucccaagugcugggaucaaaggcgugcaccaccaccacucggcggcaacucuuuauuuuauuuuacuuuuugcuauuuuuuuuuauugaauauuuucuuuauuugcauuucaaauguuuuucccuuuccauguguccccuucagaaccucccuauuccaucccccauuccccugccucuaugagggugcuccccuacucacccacucccaucuuuucuuccugccauucuacacuggggcaucaaacacccucaggcccaagggccucuccucccacugauguccaacaaggccauccaucuucugccacauauguggcuggaaccaaggguccuuccauguauauucuuugguuggugguccagucccagggagcuccagugggggggggggucuggcugguugacacuguugcucccccuacggggcugcaaacccccucagcuccuucaguuccuucuuuaacuccuccgucagggacccccauacaaaguccaaugguuggcugcaagcaucccccucuguauuugucaggcucuggcagagccucucaggagacagccauauuaggcuccugucagcaaguacuucccagcauccacaauagugucuggguuuggugucuguauaugggauggauuccccagguggggcagucucuggauggccuuuccuucagucucugcuccacacuccauauuuccuccugugaguauuuguucccccuuuauuuauuuuuuuuaaaaagcauuuaacuggggacuugcuuacaguuucagaaguuuaacucauuauccucauggcagggagcguggcaguacauggggagcuggagcaguaccggaguauccugauccacaagcagacagacagacagacagacagacaggcacugggcuuggcauaggcuuuugaaacuucggaguucccgaaguccaagcuuccuaagaccauuuucagcccuauccccuccuucucuuccugucucccugggccuagguuaggcauuuaaggucugggagccugagcuggaaugauugugaguucaacuccagccugggcuucaaagugaggcuuuuuuuuuuaaagagaaagaaagaaagaaagagagagagagagagagagagagagagagagagagagagagagaaagaaagaaagaaagaaagaaagaaagaaagaaagaaagaaagaaagaaagaaagaaaaucaguguggagacagccaaacacagauacuuuaaaaaggaaauuuauaagcuaagauuuggugacauaaaggaaguuacagaaaaaguuagccucagaugugaccagguugaccuuucucugaagcucccguauuucuagugaccucuguuaucuucauaugcucauucgaaaccugaaacguucgugugguucaugcuggucuaacacaucucagucagauccuuuuacugaccuaggccuguuuacaagaagaaacugacacuucgcugaccggcccgccagccagcccaucucccuuuaacuuguuucuuaauccagccucagaguucuuagaaaugucauuggucaguaaacaauaaacaaguccauuucccucugccucacaauguugggugcaccuggcugaggacaucauaccacacaggcaggggccaccggcauccagcucagguucugcuggauaagccugggauccucucccggguccauuggccuagagcuguccuggacuugccagcuaaggcccuggccuuguugggcuuguuuuuuaaccuaggauguuggaugcccugcugacuuggacaagagcagaagccugaagcuggaugugguggcucaggcgugugauccacacuugggacucaggcaggaaaccugcugugaguucaaggucagucugcaacaaagugacauucugucucaguucguuccaaaauaaacaagaaaacaacaaacaaaucaaggauaaaagcaaacagcaacaaagaaacaaauagaaaugagacagggccugguggugucuuccugcaauccugacggugggaaguggaagcagggggguuaggaauuugaggauaaccuuggcucagcaucucugugugcucugugcacacaccagcugcaucucuuuuguuucuaggcauaauauaaacgaguaucuagagaggagagaaauacaagcuguucuuuuuuuuuuuuuuuuuuuuuugguuuuuuucaagacaggauuucucuguguagcccuagcuguccuggaacucacuuuguagaccaggcuggccucgaacucagaaauccgccugccucugccucccaagugcugggauuaaaggcgugcgccaccaccgaccagccuacaagcuguucuuuacaugguuauaauuccuagaaaauagaggcauuucauucccuagccgccaaccccccccccccuuucugguuuaggacaguuucuuuuuucucauucuucauugguucuaugauaauuuuacacauacaauuuugaucauauucacccuucccuacuccucucagauccacccauaucucucuuacucauccauccaacuuuguauccucugucucuccuccuccccuuccccuccccucuacuuccccuccccuuccccucccuuccccuccucuccucuccuccccauccccuucccccucccucccccuccuccuccccucccucuccaaacacauugaguauagcugccacuacccauguucucuugcauacauagccuuccacuggagcaugguugaccauccaggagcccugcacucaaagaaaaugaacuuucccucucccgcagcuaccguuuguccaguagaucuuuaucuggggguuugauuacacgcccccauucuuucuacaugcuggggaagcugggcuugagcuugugcaggucuuaugcaagccgucucaacuacuguaaaguuguaugugcaauugccccugcugugucccacagccacuuuccugguagucaacagcugccucuggcucacacagccuuucucaccccuguuuugcaauuguccccaacccuugggaggcggugaaugaugagacauuuaggggugagcagccuauagucuccuauuaccugaaccuaagaagccucugacggcaguugggagaugguuaucuaugagaauaaggaugccuaauuagggauugguuuaauacuaugccuguuuaccagaauucuccccaggggccugggaccugucuagccauagguucuuugacccgauaacagugccagauacagguuuuauauuguagaucagucuagacaggauuucucucuguggcucagguuggucuugagcucauggcagaacuccugccucagccucccaagugcaagaugacauuggugagccacugcacgagauucuaucucgcagucauaguacauccauaugcgguguuaaccccgucuccaucacaacaauuucagccacuuccaguugcuaugcccacaucccaugugccuagagucgccuacaauuguugcaauugaagaggggacugaguacugaaugcgggaacucccucaagugcagaggaaugcuagugugguuggcaucgucuuauuuuagggaugcgaacaugccuaauaacuuagugauagggagaugguggcagaaagagcuguaggagggcagugccagccagccuuguccuuucuuuaagaaaaacaaagacaaccuagcuuucugaugugcaucagugagauuuguucccuuuugugcucaaacacucccgucuauaagagaaggagcuaagggaaggaaaugcugggaagucccuaguaaguccccagagaacaaauaggagaagcacggggacagaguguuucaaucaguggggacaguuaaaaagcagcugagaagaccagcaaaguguaggagagagggagaagagaaagaaccaaguccccucagacguucagucugcacuccgcagaggcagacaaaggaggagcacaggcagugagagagacaggcagagauacugucgucugagcacguagaaagcaggccagcagggcuggucauauagcucaguugguuagagugcuugccuagcguacaugaaggcuucaguucagucccaagaacugcaauacccgggcagagugacggacacacuugucaucucagcauucagcaggcagagguaggaggagcagaaagucagccauguagaauauagacacacacacacacacacacacacacacacacacacacacacacacacacucugcaggcuuccagaacagagaggcucacuuuucucuacacuaaagcagcucagggccaaucaaaggugcuggcuucgaaggcagagugcucaaacccaguaaacgguguucuaguuuuauaaguccugggaugacggcuaagugacuggagugaacuaggcaagugacugucucaagagaaugagguauguaggaauuccagcugcuaggaauucugggaaacacucugaaggcccuggguuccauuccuagaacugugugugcaugcacauguguguggggugggggcugggaucaaccuuuugauguucaagccauuuuaauugcucagccuuuaaaaaucacugcauuggcaugcuggugaaugguauguuugucuuugauccuggcucuugggaaggaggcaggaugcaggaggccagacuugaauauguggguuucaccaguugcuuuucucagugcugugaucagagacaaaagcaauaugugcaagaaaaggcuuauucgugcucauguuagaggauugaaggccauggcugaaggcgugugagccagucacauuucaucguagucagaaaacaaagagagagaugguuaucaacuagcuuugcuacuucaagacccuagcccauggagaggagccacucacacucaggaugguccuccuccccuguuaaaccuuuggggaaacauggugucuccauagugauuucaacaccagucaaauugauaaagaaccuacccaucacagcaggccuagaaggggucaggggaagggaguagggugggaauuuuagaguuuaggggacacaauuucaauuggggaauaggaaaaguuccagagaugggugguggaggugguuguugcagaaaaaugugaauauacccaacaccacugggcuauggguuuaaugauaguuacaacaauaauguuaugccuguauauucucccauaacaacacaagaauuacaggaaaaugaaagaugaguguugguaugcugauguccuauaauagcagcacucgggcaacagaggcagggggauugccacaaauucuaccucagccuggucuauauaguuuauuccaggccagccaggguuuaacagagagauccugucuuaagcaaaugaacaaaccaaccaagcaagcagucuucacuccuuuuucccucaucucugcauuccccuacucccaacaaauaugcacugcuacccccaccaccaacgucccccauaggccgaggcugaggccuguaaacagaaagacauaagggucccaacaucuguaguguagccucagguaggacagagccaagccucauggugaagaaagaaagacacagccaauggucagaaacaagcugcuuuguaucugaugcugguccaggagcaggguggauuaggaugguacagcgagcugccugucuaucuuauugcuuuagcaaagauaauuaggagucuucuuuauaaaggccagaccucaccugcucagguucucccaggcugcgacucugcgccauggcucuguguucuacuuggaagcacaacggguaggguagggcagggcagcaacugccagccuggagcucagccuucgcugugugaugcaaguuguaguccaucugggccugcuccuccucucuguuucugcuccagcaggccaaaagggagagccuugguuugggggagaaaugucagucugacucagcuggauccugcccagguuggggugaaguuugccgucaggucagaagucuggcuggggucaggguaugaggacagagggggcagcuggugcuaugcuuuucccaacucugcagggacuccacuugcuucauagcagaugcaucgcgugcacaauggauucucauggacccgcucuguggucucagguucuaaguguggagucaca

SEQ ID NO: 634 - RNA, 19326 nt, Mus musculus
guacagaauucuuccaccuuuauuauuuaaccgaaacucacacaauauguacuuugaucauaaaacucaucuuagguuuuauucaugucuuuguaugcauucuuccauucauuugugugugcaccaaguuucagauuguguugguauauucccaaaguagcugguguacacgcuuauaagcaccuucuggguuugagcuaacugauguuuuuaauccauucuagaaugauuuccauacccauauauuucauaaucccauagcaaacccuguagucuggcuuaaaccgcaaacagcucaagccaggucacuugggcuccugccuccucaaucacaauucacgcuaagagguuuucccgcccagucgugugcgagccuucucuacuagagaaagcaagcgucuucaccucaggcagaagccaagaugacuucguaucacgacgcaugcagcuacagcuccguaaugugaaggcuuucucaggaaggaggaaaggaggacugaacacgcacgccuucuaacuagaccuuguagugcccgaccuguggcguggcacaaaucccagcagaaacaaucaacagaagcaguggagagaaacaaccagagagcacacagauuuuuaaaggauuuuuauacuauauuaaaaaaaacacaaaauaaaaaagggauccaucaacauauauuuuagaaguccauccaagaguuucaguguccaccagccauggacacaacagccaugccugugucauuguucagucuguagcucauguaaggaucaaggaggugacuuuaaguuacaaucaaacuugcucugcuagauccaagacccugaauuuauccaaauuguagaaacaugcuuuuaccacccguccaccaaaauaccucccauucagauccaccacagcugaaaggcaaacaaaacaacggucaguuaauacagggaucuugaaagacauggagacaaauaguaacuuuaauauuugcuaaauucuuuaauaguacaacaaaccuuuaauugcugauucgacucucucaaauucuaaaaauauccguacugcuucaucaucaggggcaccaggaaucuagaauggaaaggaauguaggaauaaaguuguuugugcacacacucuaauuucaauuauuaacauauauguauauucguguacacauacucgacaaaagcggucagccaucaaggaaauaaacugcucauaucauaaacuguguuuuugagguucuguguuagggggcugagaccacauaccuaaagcuaaguaaugcagucuguaaucgaguguuauacagucagcagacacagggugaagcagcagcagcaacagcuacacagcuguccucacaggucuacauuuucacuagcuuuguuuagagguccaagcuuucuacaauauggcuucauggcauguauguaagcaugaguccagcuaguucccaggaguccucacccagcccaaagccccuuccucugccaccccccccacacucuauucaaagccuggcucacaugugacaguaauaaggccuucuucauuuguuucggcugacagcauucucaagaucucagugccaauacuccuaggucuacuaauuuuguauuuccugguuguuaugugcugucucuucaucugaacauauccuugaaaaugcaacacguuuuuggugucuuaaauguucucaguacagaaugggcuccaugagaggcaugaaauacuugcaaauguaaaauguuuccauuauacuacuaaauaaacucuacuuuuguuuuuacauuuaacacuaccagacagcugggaguagugaugaugccuuuaguccuggcacuuaggaggcagagacaggaaaucuccgugagcucaaggucagccugccuacaaaggagaccuuguccuacaagcagaacaaacacaaaucacccagucuaagugaaauguguuggcuuuuauagggagacaauguuacuagaucaacgccacuuguagagggggacuuauaauccaccaauugcaagagaaaaaucuccguaccucaaauaucacacauuucccaacuuugccauauuuuucacauucuuccuugguuucaacuuccaagucuucaucgaccucuccugcaccaaccauguucuauauacagagaagcaaacacaggcguaauuuacaaaugucugcagcuuucagaaauaacacuuucuuucauaaaggcaaauguucucuccccucuacucagccagaacuagaacuuugcacacacugggaagugcuccaacacugagucccauccuagaugugggauauguucuaaucccaaaagacagaauggaaaauucugccucuaagguacuagagcuggcauuucugcaaacagagagcaagcucugaaaaguguuauaacaguaucuguguaccaaagaggauguuucagaauugucuaaccauuuuaacuaauuagucgcugcagucucauguaacauuuuacugagaggauaaccuaaaacccaucuguaaggaucuacccaaagguauuauuuguaaaaguaucauuuucaacaaucuuuucaaaaauguauuuuuuaaaaaaaauguaugggcguuuugcuugaauguaugucuguguaccauuugagugccuggugcccucaagaggccagaagaggguagauccccgggaacuggaguuauggacagcuguggaccaucaugugguugcugggaaacaaacucggguccucuggaagagcaucgcaugcucuucccacugagccauugcuccagcccauauucucaguauuuuauaggcuaccagugggacuuugugaaagccuguaaagacagguagacgggugacauaggagcaaggacaaguuucuuuuacuucuuacccucagcaagaccacuuuaguagggcacuuaagaauuucaguuaauggauuugaauccgacuucuuggaugcaucuguaucaaaacaugagacacuaugaucguuaguuuuaauuuuccuaaucuagacauguaaaaucuagacauaauuaaaucuagaggucuagaaaggucugugagaaugccugugagacaguaucuuaguuauauuuacugaaaugggaggaacccugaaguuugggggcccagaccaaacaaggaugggaaaaggaaaccaaggacuaguuaguaugcauucacucaucacucucugcucccaacuacaugcuacgugacuagcugcuucauguuccuggugccucgacugccccuuaguaacagauuguaaccuggauuuggaucgagccaaauaaacacuuccucucauaguugcuuuugucagguuauuuuaccacagcaacaggaaauggaacugagggaacaggaaguguuacugagucccagcccaagacuaauucaaucacaugccaacuucaucacuguguccuagagucaucuaugcaccaggcccugccguaaaagcaugcuccucuuugcuauaugcauuuauaguauuaucugaaaguuucuagcuuuuacccaccaucuuuugcucauuucacuuccugaagggcuggcagagcacaguuuauaauauuuacugauaaucuuugucuuggaauaccaguuuaagguugcuggcaaagacaauuaucuaguuacuagcuacacugacuuuagauccuacuguaaacugagauaagucuguuuuuaacuagcagcuagcagugaggcgacuggcugcggcugaggcugugcaccaacaggauugucaguggacuuguuaccagaaguaaaccagaaccacaucuauacugaaaggaaaaaagccugagacccagggaaggcgcggagaaagcaaacacaaucuuuaagcauuauaucaagcucuaaagauacuuugccuaaucaaagcagcugggaaauuuugcucccacaaacauauuucaugucugccuugguucugaaacauaaagacaagucugagacuucuugguuucauaauacagaaguggaaagcaugucacagcagcaggagcagucacugcuccccgaggaggaugcaccaucccucuggaaugaaggacccacacgcucugugaacuuacccugagccucgcccuucucugucgcaucccccacaaugaucuugccgccacgcuugcuggucuucuccacagacaaugcaguacucagcccuugcucguguuuccccagucccugaccuucccggaagccauacuucugcauaaucuuaugagccacugugccacugugagggaaggaagaggauccuuagagcuaacgccacugauaccagaacacacuggacacacucuggccacaaagaaagcauuugaaaaaccuuuucccguguuaagagcacuaauagaauuagauucuuggucugcugcuuucaagagggcagcaauuuacucccggugucaaaggucucaaggguguccccgucgacucggcuuugcacccaagcucagcucccacuagaccugcaccuacuuauauucugcaguuccuuucagagauccuuuugaacaaacuauuucagggcaaaggaaacuccuacaaaggcuaaacuauucuguauuggagcuuucuuaaguacaaguuaaaaauccaauuccuguuuaaaugaaaaccaaacaaagcgacaauuuuuauggugagcaggaaggacuagacccagaagcuuucccugcccucuuccccuccagugcagcgcggucaaugaccgggcacuguccucuaagacagugugcuggaaccacaccaacagaugcagucuccauuagcagcugcugagacagugugacugaagaaagaacucccauuauuugaaaaguccuccugcugcucaugaguccagcugucuacuccagcuuucuuuaguaccuccugaggguucucagaaccuagacuacaagcagcacucuguuuaacagcacggaacaaaaaaaauagggcgaugccaccugagcagucuuucacagcaucagaacagaaaugaaauauaguggcaccgcacuccugcaauccuaacaucguuacuccagagacugaggcagguggucaaagaauagucaguuugaggccaaccugcgcuauaaggagacaaaaauaaauaaauagauagauagauagauaaucaaauccacuagucucauucaaaugucaaucuuaaauuugauuuuuuuucaccacacuaugacaaauacuauaguuagacugacagagguguugucuguccgggggagugguuaggcacagagcgcagcauccgagcaagggccagugcacagcagcaaaccuuccaccacugagcccaucuccagccuacaguuucuuagaagcaaagguguaaaagcacagucuaaggcaaacaacccauuuccucaggaaaacccagugccccucauccuuuggagagaacaugaagcaucuccaauuccuagagcaacuuuaucugcauauuaugagaaaugauaucaucaacagaaacuucuccugcggagcacaauguguuuagauuaucccugacuuauauagaaggcugcuuuguacaaacccucacuguuuuggaaaacacucagcaugguaugaaacacuaauccuuuauagagcaacauaugaccaaacaaguauugcucuagaaauccaaguggauucauuuucaaaagaguuccaccuauugaaaaaaaucagcaaacacuucacaggcuagccuaaaacucaagacuccuucugcccccaucuucagggugcugugacugcaggacugagccacacccccaaccucagagucuuaaggcacuucaacauucucucggcuagacaggacacuuagcacucaccccauguuagcaaggaaggaguugcuggggccuguuggagaucuuggucuguccggcuccucauacacggggggaggaauagcagcuuuggaagacugugaucucggucuugaguccucuucauaaggaaaaucgcgggguacuguugaagaaaagcaaagcaggcucacucagcucugcgaaaaccccagaagguucacuggcuuccacucucaaccgugaaugacauaaccuaccuuucuguuauguucuuucuuuccuagagaacagcgucccuaucucauaguuuugguuuacaggaucuguguagcguuuucaaaaccagaaguggaaggggauucuccguucuacugggcauaugcucccaaguguccuuuuucacaucuuucugaaaugcugcucaccuguucaagcccuuacuuaaaggacaucucuuucuagacuguaagaucucugugugcuccaaggagaugcaguguaacaacucucaagagccccauagcauaagcguugcucuagacacuauuuuagcuagccgcaaugacaauuaaaacccaucuuuaaagucaggaccauaaggaccguauuacccacuugugcauuagcaucaacaggaagcugucaagacaucagauacaugggcccugucggcagaaacugguuuauuguuugucagguguuuuguuuguacaauauauauuuaaucauauucuuaaauuaucuuccuuuaaaacauaauaguauaaugcauauuaaagaauauuggggcugaaauagugguucaaugguuaagagcacuggcuaucauacaguguauaucauaucauacacuggcuaucauacugaccagguucaguucccagcaccacacaguggcucauaaccuacauaaauccugcuccaggagauacaaugcucuauucuaaccuccacagguaccaggcacaaugcaggcaaaacacucauacacauaaaauuacaauaaaauaaauaucuucaaaagauuauugaugacucuguacuggcugguuuugugugucaacuugacacaagcuaguguuaucacagagaaaggagccucccucgaggaaaugccuccaugagauccagcuguaaggcauuuucucaaucaguggucaagggugggaggcccauugugguggugccaucccugggcugcuaguccuggguucuauaaguaagcaggcugagcaagccagaggaagcaagccaguacguaacaucccuccauggccucugcaucagcuccuauauccugcccugugugaguuccagaccugacuuccuuggugaugagcagcaguauggaaguguaaucuaaauaaacccuuuccuccccaacuuguuucuuggucaugauguuuugugcaggaauagaaacccuaagacaggcuuuacuuuuauuuauuuuuguuuuagguauaugaguguuucugcugcauguauaccuauguaccgugugcaugcguguguggugcccaugaaggacagaggaaggugacagauucccuagaacuggagucaacagauggcugucauccacucugugagugcuaggaauugaaccggggucuucuggaagaguagcgagugcucuuaacugcugagcuaucucugcaggcccagccauuuauuuuuauaaguuuaggcacagcuccguacaaaacauggggcaaagcccaaccguaacuucugaguuuuagaggagcuccaggagaccugacaguggguggucauguuuauaaguagacgaaugcugcucagucacacucucaaucucaguuacaaaaucugcuaugggcaaaaccacucaugcacacaaaauuaaaauaaauaauaaauauuuucaaaagauuauugauggcuuuuaguuuuguuucaauuacuuuauuuuuguuuuaugugcaugaguguauugccugcauauauucaucgagcauaagcuagccuggaacaucacuauagagcacaggcuaccccugaauuugaacacuuccugcugcuguccuucaugcuagucaaggggcguuagcuacuauuuauuauugcucuaauuuacuucaaaugaaccuauugcaaacaugaaaccuugauggaaauaacaauaaaaaugaaguuaucuucuuguauaaaaaucuccacuucaggcugggcacuuaaucucagcaaccaggaggcagaggcagggagaucucuaaguucaacaccagucugguguacaaacuaaguuccaggacagacaaggcuauacagagaaacccugucuugaaccuuacccugcaaaggaaaaacaaaaacaaaaacaaaccaaaagaacaagaacaaaaauaaaacccaagaacaacaaaaaaacccaaaccaacucuguauuucugagucugguauuaaaaagucccaagugaagccgggcgugguggcgcacuccuuuaaucccagcacucaggaggcagaggcaggcagauuucugaguucgaggccagccuggucuacaaagugagcuccaggacagccagagcuauacagagaaacccugucaaagcaucccagguauagcaggaagcaaggccacugugacuucagggaugaaaaccaggcuauucugcucuaaacucaggacacaagagagucaagcuuaggaucuucacuguccacaaauaccugugugagaauagguaauaaaagaaagcgaggcacauacacucuuugucuuucucuacaagagacgucgguggggcgauggcagcuccucccauaccugugaagacacaaggauugugauuagcaguauauuuuaaggaauaagccaaauuagcauaccaauuuggcacuuguguaguaaguaauuacagcuuccuguuuccaauugagcaaacagagaugaaucugaagaaguggaauaaauccaguucccugugauaccaaagccaaugccccagcaagcacagcuggaucagggacaaugccccagcaagcacagcuggaucagggacaaugccccagcaagcacagcuggaucagggacaaugccccagcaagcacagcuggaucagggacaaugccccagcaagcacagcuggaacagggacaaugccccagcaagcacagcuggaacagggacaaugccccagcaagcacagcuggaacagggacaaugccccagcaagcacagcuggaucagggacaaugccccagcaagcacagcuggaucagggacaaugccccagcaagcacagcuggaucagggacaaugccccagcaagcacagcuggaucagggacaaugccccagcaagcacagcuggaucagggacaaugccccagcaagcacagcuggaucagggacaaugccccagcaagcacagcuggaacagggacaaugccccagcaagcacagcuggaucagggacaaugccccagcaagcacagcuggaacagggacaaugccccagcaagcacagcuggaucagggacaaugccccagcaagcacagcuggaucagggacgccucuggggaguaugaguccuagcucuuaggaacacguuaggcagugccaccauuccugcccaugucugcuggucagauaacaugaacacaaacugaaagacaugacaacuaggauaucaugaacagacuguaaggaacucuucauuacaugaaucccaaaauacacaguguccuggccauaccucuagcauuagcaaucugggaggucaccgagagcugucacuuccagcaccagaaggagacccugugucaagcgucucacccagauguauugugacuuuaaucaguggaauaguaagaccaauugaaauugguuauaaaaccaugcuguaucaaucagccuaaaagguuucacaaaagaaaugaaggccaguagagaugcacuaugaugaacagagcgggugaugaugaacagagcggguggugaugaacagagcagguggugcacauuaacuagaaauauaacccuaaagaaaggaggcugacauuucacuucuuaagacauauuuguaacagacauuuaaaacguuauuuucuguuuuguucaugcagaccggccuugagcuugugcuccuguuucuauuaaagugccaggacuacaggcacacaccacugugcccacugaggagaacccaagcuauagauuuagcauaguaagacgggaugguucacagccccagugccgcggacucugaucgcccugcuuaggcagcaggugaacaugaaagaggcuccguggaugcucggaugcagcggagucaucagcaaaugugccccggauguggggucuccuccuacauccagggcuggccagaaaugcucuggguuggagaagaggcaaaagaugaccaggccucaauuaaggagaagcgcagaaguagaccuaaugcuguuucaaagcagguguuucgccauguuaguaaaguucacaguagagaagauauuaaacagcauaaagcaaagcugcuacggaauguggacuggugagaaucuagggcacuggcccagccccccaauuacucaaaccaaugugaaauacaccauguucacgggaaagggaaagcaaagccgggacagugcugagucuagggcgagcuuguccacgcucacgccuuacuucuuuuccuccgcucucgcucauaaucuucauccucaucagaaucagggucuggucgucuugaaaacccacuggcuucgugucugucuuuacgccuccuguaaugacaaaguaacaaauggccaucccugauacauuaggacagagcccaaauaaagcuuaacugucauuaugacuuccucuuggcaaaacaagacgaagaaacaaacaaaaaacccaaagagaaagaaagaaaaauguucacugaauauaauuaauucuuuuuuuuuuuuugaggggggaggguuucgagacaggguuucucuguguagcccuggcugcucuggaacucacuuuguagacuaggcuggccucgaacucagaaaucugccugccuuugccucccgagugcugggauuaaaggcgugcgccaccacuccuggcuuaaauaguuaauucuuauauguauucugggaauggauucaauagaaaaauuuaaaagaaaaaaaaugaacaacuuuaauggauacaugggcauaauucauagggaaaaaauuuugacaucuaacuuuggauaauauggcauaugauuucaggagcugggaggggagagggagaaaaaaacuacagucaggauuuaauauaugagagaauaaauuaaauuaaauaauaaaauuaagaaauaaucccauuaccuauaauuuuaaauuauaaguauuauauaaguacauuauaaguaaauuaaaaaaaaauacauguaauuucaccuggcucaaaaguaggaaaggaagccagguauaguggcccaagccuuuaaccccagcacccgggagacagaggaagguagaguucuugaguuugaggcgaggcaggucuacagagugauuuccaggacagccagagcuacacagagaagccuugugucaaaaaaaccaaaaccaaaauacaguaaaggaauagcauugaaauacucuaaaugugguucuagcagucacaaaccagggaaaaauggcaacaauggagucugcuguuuugauucugaaacagggcuggccuugaacacuacaugggugggauuacaggcaugcaccaccacaccuggauaccaguggguuuucaaaguuauuuuucuaauucaugcaaagucuauacuuuagguuuucugagucuauaaauaaauuuucucaagugugccaucaauguggguaaacccuuguugacugaaaccauaaccucaggccuagagacaacaauaaaauucacucacuguaacacacauugacagaagacauuugcucccaaaucaaaaggaaacuuacuuuucucuuuccucuauuuccuucugucuuuccagcucccgcugccucugccgcucuucucucuggcgcuucaccacuuucucauagucauuggggaacauagggucauauucaucagcuaaggggaucagaacuuccccugcagaaaacccacugggcacaggguccugaggaaguaaaaagcccuaagugagugccaugucacauccugcagguuucucacagaagccaaggucacaggaugaggcaagagaggccuuccagauuaucuaaggauccucuguuuccuggugagucaacaagugcccaggaggccuccccucagcagauggcagcacaaccuggcaguuaagccaaagcuuauuuacagaaaagcacugacaaacauagcaucucuuaaaugaggcuuaaacagucacacucgucaucugaauggcaucuguacaaacauacaugugaaaguggauuaucauuucccagacuuuccuugcucccuccagacagugucucacagagccacacacuagacacacagccaaggaugacuugaacaccucccagccuucugcgucccuggagccgguccuaucaaugacaugcagcacuaugcccacuuuuuacuuuuaaugcuuuccucuaaaauaguuccaauacuguuaacauacaauuagaaauaaccuuguaguguacguuagaaggauuaaguuacagguaauccacuggaggcaauccacugaaaccauuaagaugaccauacaggagcuggagacacacaucaauaauuaagugcacugagugcuuuucuaggacucagguuucacugucccaccucuauccuagggaugcaccgcacaggcaacaggcacacguguggugcacggaagcaugcaggccaagcacucacaaacagaaaaauguuuacacgaccacguaguuuuauaguuuucaccaugauggauagacagucaguaaaaacaaauuagagagcagaaggcagagaaguuacagaaagauauucuaacauuguauaauuuuauaaugcccggggguauguacgauugaaaggacaagcuuuccuuuuuuacccaccuuucccuccugacauuuccauaaucaacuauauuagguaacaaagguuuugauggugauuaaguaagccuuggguugaaaacaauaaauacuacugaagagaccuuguguggggcuggggcugcucagagguuaacagugcucacugcuccauccgaggacaguugggaggcugacucucagcacccacacaggguucacaaaugccuaucgccagccuccauguguacacacacauacacacacacaugcacaaauaaaaaugagguaagucuuauaaaaagagcaacauccuugcagaauagagaaaaacagugggugcaggcaggcuuaccuucagcccagcugccacgugagguggugugucugcaaucugccggucaucugaggagccgccucgcuuuaggucgaugaccggagcaagcacuguacuuugcuugguccuuuggcucugacaucagaaacaagaaaaacacaccaaacuuucaaauuaaaauucaugcuacuugcaacaaagucaccuuuucuggucucuguaacaaauuuuuggcuaugauaaaaugagccuuaaacaguagaagucuaauacaaucaguguuuugacuauuuucugagggucuuauagaacccaggcuagccuccagugcccuacauagcugaugcugaacuuggaugccugaccucuucccucauacugcugaguguuguucaucaccagacccaguuuacgcacaggggauuuaacagaggacuuccugaaaacuaggcaaacacucuaccaacugagcugccucuucaucccccuuuuccccuuuuuuaaaagcacagauuuccucuacuuuucuauaaagucuacagugcaugugaccacuuuauggcuagccuuaagauccaccucucugucuccagagggugaguucuacccuacuucguuuagaaugauuaccccaaccaaauaaaaauuauuuaauauguauguaugcaugcaugauuggguaagcauacaucugugugaggccugggucucucuccuuccaccaugggguucuagggaucaaacucaggucaucagccuucacucaccgagccauuucaccaccccugccaguuuccuaaauguacuucugauuucuccaucuucagcagucccccuucucugauaccaucuccauuuucucugggacacuguuauuacaaaugcugcuuauucuacaugucuccuuaacuuauaccucuauguucucgcauauccaaaaccuguucagauuaagguuaaagcuuauagacaagaauaucccagccgggugugguggugcacgccauuaaucccagcaccggggaggcggaggcaggcagauaucugaguuggaggccagccuggucuacagagugaguuccagggcagccaggacuacacagagaaacugucuagaaaaacaaaacaacaaaaaacuuaaaaaaaaaaaaaaaaaaagaauaucucagcaagcuggugagcaacaccaaauucucagguugcuaagaugccauggccauccguguggacuagagguugucaugaaaguuuaaauucucaguauuuaaaggguacaaacuuucacucuuaucaggaagucugagcucucuggacuuuaacggugcuuuaagcaaacaacauaucauccaggaaucauaaaaaaaaaaaaaaaucacaauauaaacccuaacuucccacaguaggguuaugacaaucacuuauuugcucauuuuaaaauuuaauuuguaguuucaaaaaugaaauacaaaugaaaccauaccuucaccuuucagauacagguacauuuucucuaccaaguauuuuuacaagcguggcuaguacucugagaaaggcacugaagagcccaagagaaccaauacagugcaacuucacuuccucauaagaaucaaccacauagagaagccucaagauucaggucagaagguuagcagaugaauucuaaaguaaugguccauuuugacaaauuaaaaucuacuugcuggccaggcgugguggcacacgccuuuuaucccagcacuucagaggcagaggcaggcagauuucugaguucgaggccacccuggucuacaaagugaguuccaggacagccagggcuaaacagagaaacccugucucaacaaccccacccccacaaaaucuauuugcaaucucaagauauuugcuaauagcugacauuaaaauauacgcauaguuggguggggugauauucccagcacuugguaggcagagacaggcagaccucugugaaacuggggccaccuuggucgacacagacaguucaaagccacauacugaaaucuuauguugaaaacaaacagaaacaaagaaaaagaaaaagcugcacugucuccaagacaaugccaagucuaacagguauacaacacagcaauucccaccuauaacuauauauccuggguauguucacaaacaucagagccuuucauaguguacacgauuauuaacccaaccaaauaaaauuuacuuaacauguauguauauauguuuguaugcauguugggguggcucugauuauucugcaaagcucaauuccaaacuucuuacaauaaacuagcugggacccagccuaggccagaagucccagacuauuaggacuagggguaugaaaacagcaucuguaaacaguuugcagucagucucaggcaugcuccagucuaaagccagucucauggcuuuuuuuaauucccacuccaugaaugguccugcuguuuccaagagccaggagaggcaaucagcucuccaccccucgcccacccacucuuuucuacguauccagcaagggggcaaagagcaagcuuaaaggaacucagcggacuugcccucuccugcccugggccuguucuuaccuuggccugagugagcgccgccuucuucaccuggagcugggacugcaggagcuugaaguuuuuggaccagccuucaguuuuugagucacuggucuccacucccaggucaucauauagggacaucuuuuugguuuaaugcugaaagacaagcagggacagagauuaaaagaugcaaagcagaagcaaguuaugaaugucucuguguuaaaacagcugcaccauggacccuccugucacaaaugcaggguucuuucuaaucugcaaaacuauacuuaggcacuaguuuaaaaacaguccucagccuggcgugguggcacgcgccuuuaaacccagcacuugggaggcagaggcaggcggauuucugaggccagccuggucuacaaagugaguuccaggacagucagaacuauacagagaaacccucucaaaaaacuaaaaaagaaaaaacaaacaaacaaaaguccucagggcucucauguagcucaggcuggccuugaacuuaucacaaagacgagguuggcuuugaacuugugacucuuuccuacaccucuugagugcugggauaugccacuauguccagccuagaauuaauucucaaucuaaaagacuauggugaacugacuuaugagucaaauccuucaguuauagaacugauaauggaguaagacggaagcucucuauguggggcauuauuaacuauaaaguuccaggugccaaagagauggcucaguggguaggaguacugguugcucuuccagagguccugaguucaguuuccaacaaccaccuguaaugguggcucagaaccaucgaugagucccaggagggccagggcuguuacaaaaagaaacccuguccauaaauaaauaaaaucccucacaggugaaacccuguccauaaauaaauaaaaaucccucacagguguggccagccauuggguuuuaguagauuccagauguagcuaaccaagaguaaccaucacaagucuaaaagucuaccucuguuagcuugauccacaccacaaucauaucuuauacucaggacuuaaugauguuuuaccgaaucauuuauacccuuccguguguagcuaugccaucucugauaguucacauuucccauccguauuaccaagauaccauuggccagggacuguuaaaaacaaacuaaccagaguaacuaaagcaaacagcgcagcagauuucucuacuguucugaaagacuuguagaaugaccuacuagagggaacucuucccuguuggaaagaugugugaaaaauuuaugcgggggacagguggugggggggaggagguacauaauaacaaaucagggggucaacaagaacccauaugguaggagaaaaaugacgccuguaggaaaucacacaugugauuuccacguguggcuuguccucggaacucuuaaucuccugccugcaccuuccaagcacuggaauuccagacauauugccacccugggcuccauuacucauauuuacuaaaauuuguuaucucgaaauguuuacagcucagcccaguauaaauguguccccaugauuuaaaagagccaccuguugcagagagacaggccucaccuauucccagaacaagcagaauuauaacaagaacuuaugucaaugguccccccuuccugacuucucaaaggaaggucugacugaucacccuucuaagucccucuucauccucugucacagccuuaaacugcagaauacucuacagcgcuucucugcucuugcuuucccucuuccucauaggugcagccuuuccacuuguaauaaaacuccucuuccaggucuuuccagcuuguaaucugguucuucggaucaauccaggccuggguuuuccaacgagcuucuuagagaucuaaccccuggagaagcaccuuacugagcuugcagcacucauucagagcacaacugguccaagcagaagaagcucgaaagcuagcggagggacaugaacgcuaaaacuccccuuagcgcaggccugagcaugccggggguuacaacagacacucucugucccggugagacaacggccucaaccuucacuucaggugcucuggaaggaaacaaguuuugggguuuguguuuuggcuucuccauuccugaggcccgacgcagucuggguuacugcggucuugcgacccaacaacuuggucugggcaugggccaugaagaggagaaagguacuuucuucacugucaagaggaucgggacuggugaaggggggaucuagguggcccgguggaacguggcaggcugaaggagcccaacguggagggcugggaaccccccgggcagcucggggugccccgcccgcauccccgcgccccucacggcgcggccuagagccgcggccucgcguccagcgcauccgugaaggcgcgcacacccgagucuacguuccggaucagaccgccugccagggccgccgcggcgccacucacccggccuuccgagacgauugugcccaugggccacggcggcggcagcgcggagcccggccgcccugcgcggaagcccgcccaccgccggaguccgccgcagcgccgagccuccacggaguccgcaaagggaugcaccgcgcgggguaagagagcggaggcugccgggaguccacgucugcgccugcgugugacucgcggaagcaaagcugcacucuccggcucgcacugcacccugcugacgggaggacuacauugcaucuccucucugccggccaagagauggcgccauuggcacaagguuucgagauucaugugccuucugaccuuggaguaggagccgaauccccuacuaggcuccagguauucacucccaacuauucccuuauauacuaaaugguggaaauaaauuugcaggcgagauguugcagaaucuaauagcauuaaaaacacacacugagcuaggucuucagagaaagaauguaaacacuauaaaccuugcucgcuuggaauaaaaaugcagcaaauggcaaaagaaaggucagagaaaccagggcuuuguguaaauauguuuuccccauauuuuugguugcauguaaaaauuauuucaagcuauagcuggacaguugugacccaugccuuuaaucucagcccuugagaggcagagacagagauuucugaguucaaagccugccuggucuauauagugaguuccaggacagccaggacuacacagaaacccuauuuugaaaaacagcaacaauaacaacaacccccccccccccccgcaaagggugguggugguggugaauucaagcugaaaaauguaucagucaggguucucuauagucagaggaccuauagacugucuauauauauuaaaugaauuuauugcaaugauuuacacucugcaguccaacuaaccugacaaugggcagcugugaaugggaaacccaagaaucuaguaguugcucugucccacgaaguagguuguuucaucuggucuucugucuaagcuacaaucugaagaaaucgguuccaacagagaugcugucaaguaagugcaagaaggu

SEQ ID NO: 635 - RNA, 1762 nt, Mus musculus
cugaaggguagcagacuuuuccacagccgccgaccugcagcuugaguguccugcaccgccuuucguggaagucugagugggcuguacagcuuuccuccuuguuccugcagccauguccacgaacgagaaugcuaacauaccagcugcccgacuuaacagauucaagaacaaggcgaaggacaguacagaaaugcgucgccgccgaauagaaguuaauguggaacucaggaaagcuaaaaaagauuaauagaugcugaaaaggagaaacgucagcuccuuuccugaugaugcuacuucuccgcuacaggaaaaccggaacaaccaggguacuguaaauuggucuguugaggacaguguuaaaggcauaaacaguaacaauuuggaaagccagcuccaagcuacucaagcugcucugaaauugcuuucuagagagaaacagccucuuauagacaacaucaucugggcugguuugaucccaaaauuuauguccuucuugggcaaaacuguaguccuauucaguuugagucugcuugggcacucaccaacauugcuucuggaacaucugaacagaccaaagcugugguggauggaggugcuaucccagcguuuauuucucucuuggcaucuccccgugcccacaucagcgagcaagcuguuugggcucuuggaaacauugcugguuuaguuaucaaacacggugcaauugacccacuguuggcacuucuugcaguuccugaucugucuaccuuggcaugugguuacuuacguaaucuuaccuggacgcuuucaaaccuuugucaaaacaagaacccugcaccucccuuagacgcuguugagcagauucuuccuacguuaguucgacuccugcaccacaaugauccagaaguacuagcagauuccugcugggccaauuccuaccugacugaugguccaaaugagcgcauugagaugguugugaagaaaggaguuguuccccaacuugugaagcuucuaggagcuacugaacugcccacugugacucccgcacuaagagccauagggaauauugucacuggaacagaugagcagacucagaaagugaucgaugcaggagcacuugcagucuuucccagccugcuaacaaaccccaaacgaauauucagaaggagccacauggacaaugucgaacauuacagcuggacgccaggaucagauacagcaaguugugaaucacggcuacuuuaagacucagaaggaggucucgugggcuauaaccaacuauaccagugguaggacuguugagcagauugugcucaguauaaugauugaagaguguggaggcuuggauaaaauugaagcacuacagagccaugaaaacgagucuguauacaaggccucauugaacuuaauggagaaguccuucucaguggaggaagaggaagaucaaaaugucgugccagaaacuaccucugaaggcuuugccuuccaaguucaggagggagcucccgggaucuuuaacuucuaauguccagccaaggcacaaaguuguuagcuaugugcugugcuauucuguauucucauagauuugucuuacuguuucucuacuaagaacucuuuuuaaaugugguuuguuauuguagcacuuuuuacaaaagaaacuauacuugaacuauacauacucuauacauacucuauaaagcuguucucugaauuuauuucuaugugaaauuucguacccuguccuguccuguaaauaaagauuaaaguuccauucuuuaaaaau

SEQ ID NO: 636 - RNA, 72209 nt, Mus musculus
cggaagucaggccgcuuccggcaggggaaacuccuaguugccgcuucgcccggcuugacaggcggucugugccggcagugugcugcccucacccaucucgaccucccguucgcguccgaccgcugccgucccgcugcccuuuucucgagccuccccuucccuauguuccgggaccggaguccgagaagcaaagacccacuucuuguccaguucccaucauguccgaagugaccaaagagcugcuggagcugguguggggcaccaagagcagucccggacugucggacaccaucuucugccgcuggacgcaagguaccaaggcagggcuccguuccagccgcucagcuugggcuccgggagucgggccaggacgccucuuucggucccauuacccccgcuccaccaucucgccccgaccccaucaccucggguaccuggcgcuuggccccaaugcccauucuucaccaguacccgugcuuggucccaguaaccacgcuuuaggcacucggggcacccgcguucugucccaguagcuccagccccuccgguccccucacuccuucccugugcucgcgcuuaguaucccggcuucagucccucuaguauccgcacucuuuccccguaccagcccuuggucccaguaccccagcugcggcugcucggcuucccgcacucgcuuucuuucccuguaccggcgcuugguacuaguacaacucuaaucuuccgguacucgcacucuuuccuacagaguuugaucccaguaccccugcucugaccacuuucgggacucugcgcucaguucuagaucccggacuugauuccaauaacccggcucagacaccucggguacucuguguuagguucuauugccauugcucuggccuguuggauacccagagcuaguaccccugcuccaauuagugguucucagccauccuaauguugugacccuuuuaugcagcuccucauguugugguaaccccuaauuauaaaaguauuuuguauaaaaguacuucauaacuguaauuuugcuacgguuacguaguaauauaaauaucuaauaugcgacucccagggggucgcgacccacagguugagaaccauugcucuaaauggcuuuugaugaggaagaguuugagugagagaguguuuaccaaagaacgcaagugccucugccacucugggcuaaccugcugcaggagugaaaggggaggggcccugggacugcaaugugugauacaaagagggugccacuguuaagaucauuacaucuccagccuucgagugagcuuuaaguuaucgucaguguuuggaauguuuuuuggauggguggugggaggguggagaucuaggugaguaauacgggaaagcaguuucauguuguaauuaaugugguuagguguggugcucugaauggaaacacaguguugcuugcugcuagauuguucccuugucuucaaguaucccugauuuugugauggcaucugauauuguugguuacauucuuuaaaggaauauggaucacagcccuuccucugcuagucuaaugaugcucagagcuacucuuagagggcagugauaaauguugcugucgauagucuuuugggauuaugggaguagucauagggcacggacuuccugcauuaguaaaguggcuugauuuuuguggucgauaacugcauugaauugacagcuguaaccucagucuucggaaaauaagaugcagguauaaaaugguuuguagagcaaagguacacucagagaguuugcauuugugaaguuacauuuguaaagcuacuauguugcuuugcuuugcuuguuaaaauaagccaacccaauaacacauaguuguuaguuuuucauugauggacgguuucaguuaacucuuuggaaauucacuucagcuaaagaaguaugcauuuuggguuauuucugagcaauucuuauuuaaguauuugcuuuaauuuuuuacuuaaaaucauauguauaugaauguuuugcuucuuuguauacaugugcaccacgugcauaccuugugccuacagaggccaaaagagggcacuggagucccuggaacugaaguuauguaugguugugagccugcauauggauguugggaauagaaccaggguccaauucacaagcagucagugcuuuuagccacugugccaucucuccagaucuccaauuuuguuuaaaaucaauaaucccuuuaauaaaaggcuugaauugaaguuauuuuugcuuuuuaauaaggucuuaccauguagcuuugucuggccuugaacucacagagaucuaccugcuuugaccuccugggugcugggauaaaagacagugccaugucuugcagcuccaaacugacgcuuuuuaguuugacaauuugguuuuuuguuuccguuuuccccugguuugccuaccuugugaaaaugaguuuucacuuuuucaguucauuggcagcacuugcucuuuuccuguaaaacacacugguguccugaguccuggccgccaaagccugggcuggcagagcagacgucaagcaccugcaaugguuauuaggugaagggacagagaguccuggaaacacuugagucccuggagggagccauguagguaucugaagaaaguguuccauacgcagggccucaccccuguacaaaucuuggugucuaauguuccuuggacuuuugguucaguguggcuggggggaggggcgcagugggaagggggcaggaauaaacauucuaaaaguaauauggucauucauauaagccauuaaaagggcauugacccacauucugaaugaaauaagaauuucacugaaagguuuggagcaaaagagacagagguucuggauucagguugguuugguugcuguggucgagaguugcagaggugagaugguaauuaaucagauggucccugcuguagcccccgagggaagguggagcagaucuggauguuagcauuggagauaguagaaaguggucauguugaccaugucccagcagaacccaaacuggugucuucugucugacagaaguaguauugcucauacauuggacguacuaagaguucaguuuucagugcugacuguguaacuugguguucgguagacucccugucagggacuuugcucuuucuagguuuuccucuggugacgcacaaaagcugcccugcuucuuaacacaucguuuaagaagccuuugaggccugugcuuuccuggccuuaacuuagcucuucgcagagcucagaaagcacacugucccuuccuccaaacuucuuguuuuauuguuucaccugaagcuguggugggaaagagguacuggcuauaacagcuuaacgugggaauauugguuuguuuuguuuuguuuuuuguuuugugaugaggcaggccaucuugauuaaaauuagauugggggagggguucaggaauaagagacagucuuuauuacauaauaugaaaaauaaaauuuuuauguuagugaaaaguugagggaucauuaaaaaauauaaaauggccagcaagauaggucgguaaggaaagguacuuguugccaagccugacccugaguuuaacccucaguacuucuaggcuugaaagagaaagauaacuucugcaagcuguccucucacagcgguacaccacacacacacauauacacuuuucauuacuagaucauuugggucaaaguuugagcuuagguuuuccuuucauuuagcauaacuaaauuguaauucaccuaacaagcgauuuuuuuaaaagccacaauguuccuaccacaggagaggauuaauuauuugguacuuuaaauauguaguauagucucguuaauucaaagauuuuaaaugucugccauaugauguuaugcuguccaggguucacaaucuucaaagacaacagaggguaaaugugucuagucuaacacuauuagcuaaggaaaauggggccccauucagauacuugacuuaacccagaccauguggcuuauaguagucgaaccaagucugugcuguugguuuuacaccggcuacuaagacuuuagagcccuuaguugcccuguugguuggaaggauguguggguacaguggaggcuugagaguaaagagugaaaauuugcaaaaagguucaugggccacauuuaaauuagguguuauaaaaugugauacugaggacagagucacugucuucauugugucacaauauguuacagauguuacaaaacucucugucaaaucaguuauuagaugaguaauuuuagauuuaaucagaaauuguuguuuuuguaauaaacaaauuucuuuuaaaucuaggaaauaaugugagugaaaaaacauuugacaagaaaaguagccuuacauuaacaaacucauguucaagggcacaaauaaaacaacucucuaucgugugauuguaacuguaagcaaccuuccauggauccugauagaugcauuauaauagacuuuuuacuaauguuuuuacuucuucuuugaauauugguggacuccuuagggaaggcuaacuugguguuuauuacauggacugaaagucuguagacucucaauccuccuccgcacuaacacgcaguaccgggacuccucucuuaaucuucuuggacaaacagugaagucucuuggcuguaacucugcuacccaagugcuggaaaggcccagcccagcuuagcggaagagaaggugugggacagguggauucggaugguguggcccagauucuuggcuuugcuucucaguccuaggucggaccugacauuugauugucuuaaugugauaaccagcacuuuuaguugucacuuuccauguuuuccuauccgucuuauccauuuccuguucucaggagcuccaggguguuguggauaaaccugucuugcaucagcagacaguaguuacaccuuagcugaguguccccgcuuccacucaucaucccugugaucgugguccaucuccgcuccuggcagccucucuucucugccccuuuucuccuuccuucccagucucuccugagauccucaguucccaccucucuuucuaccucccaaucacaggcucuaggcuuuuuagccaacugauuuuaauuagggagcuagguucauacaacaaaggcauagggauuugcucaacuuggggcaaccagaucuugcgguacagaauuuaucauuugaugcauaacagcaccagaacaauccccaacaagcuguccuucuacaucucagaaucagcauccagacaggaccugaguucuucccuucuucauuccccugacuccagccaguagcuuugcuucucuuuguuuuagaaauuuucuaagauuuauaucugugcagucaccagcuuucaaguuuucugagcucaggaucccaucacacccuucaaaauuaaggaacuuaacaugaaggucuugauaguguugugaaaacaacuuuaacuuuaacuuuaacuuuaggugggucccuugcacuaucucaaguacuguaagucuguagagguuggggggggggcacagcugacaaccucuaugugguugggagucaccccugcugugcugcacugucucagaccuuguaagacaaggucuccaauuuccuuuucccguaucagucgcugcaucagcccccacuuaucucuuucuauuugucugucugucugucuaucaucuauucauucacuuuguuuuguuuuuuuguuuguuuugagauaggggugccacuauguagcccuagcugccuggaacucacuacauagacccagguuaggcucaaacucugauuucaccuggcucugccuccccagugcugggauuaaaagcauaugccucucucucucucucucucucucucucucucucucacacacacacacacacacacacacacacacacacacacauauccuuaaugacauccuuagucauuaagcaucaaaauaauucuccauccugccauccucuuuucuucucugaaacuuguucaagaauuagcuugcuucugcuguuucuccugucauuuaaagucuggcuguucccuagcucugaguuucuuuugcaguacugguggcacgcuugauccagcacuuaugucuuagcacaugccgcagcugacuacucuuguaccuaauugaucuuuucuagaaccucugcugcuaugucccugucuuaccugugucucuaagcugauacccugccuugcugaccuugccucugcucacuuuuuaauguucuuagcuucaucaucuuugcagugcaugcuggcacucacugggcugacuguuccagauaauugcauuucuaucuguagucccaaagcuuguccugagguccaguauccccgcuucuacgugguagugacggcuccuuuacauauuugaaacugauguauuuuacuucguggaaaccaacacccccaauugucuucccucucagaacuugaacagacauuaacaugcaguggguauacagcauaugguggaaacagccacggauaccuguguaauaaacuaacauaaauauagauuaggauaaaugcugguccugugaggcaugggagaguacuuauggucuuccaggaagucucucuaaggagcucacaucucacuugaauccugaagacuaugaagaccagaguggaagcauuucaucgagagagaagagcagcauuacuauggacuucuuagccgaucaaaguaaagguaaaauggagguccauugaauuggcgaccucaccaugucuucagaucagaaaagggaguuaagguucuauuucgcuugcacugagaggcuauagaacuauuuucagcagguugugaccaagucuguuuuccauuucugcaguacucuccaggcaguacagaugacuaagggguaagaagaugagcagcugggcaguguggcuggaagccuuuaucaguccugcaggggacagggcaagcugucugaacuauaaguugaugagauacaggacacauuugagauauguuuuggagcccugagccaaaaggaaggaagaagccuaaaagaugagucagaguuucuucagaaagggcaagcauguguuucaggcagaaggagcauuauguacaaaggcgugguggaacauaccugugaucccagcacuugagagguggagacaggaaugucugaagaccuggaagaaucucaccagugggacugaagucacugugcagggccacaagagaacuucagauucggugucuggucuguauuuggggauuucuugguuacagucaguaauggaaauugugggaguagacaaaauuauuagggguaaguaaaauucugcauacuaccagaaagaacauacagagaggaaaaagccuaaucccaaggccaaggccugggaaaugugguguuuaagaggaacugcagugacauggaggauaaacuggcuaacaugcaacaaaagaccagaaugcaggaggccagugagcauggagagagugagcugcugcagccagggauugauagugaacucaucugcagagacugcacugagaaagcugggcuguagcauagagauggcugggauagggcugagaggccaggagacagggugugggguggacuucuuaguggaaucacugauuuuuuaaaaacuaugugaaacaguuaaaugcuggaagaaaggguaaaggagagacaugggaggaagcucuggaucaucagccuuuuguuuuuccguguuuuuugucuguagaaacuucagaggcaacucuuguuucgucuauaucaagcaugcuccauuuacauauaguaaucaagcuuuaacuucauuuuauaaauaccauuugaaaauagcucuuccucucccuaggaaaguagcuuugauuaggccaguuacaucucuacugugcucuuaaaagagucuuccuauuuucauccuuuacaaaagaagcaaacuuuauaguugugcaagaaccagagcuuccucaggcucacacaggucuguguagcaugugccucuucuuuucccuuuugccuguucacacuucuuucugccucuaaccagcccuucagcugcauuaaauuucccuuugauccaccagcguuuccugcuccuauagcccugcucccuucaguacugaugcucggcaugcuugaacauuauuugccuacccuuguuucccagccaaaugcccugccauauuccuccuccaggucaucuguuaauguuugacuuaggcagaguaaguacacuguuccuuuuugcacccaggagacccuucauucuucugucacauuaacuuagucuuuuaguauuaccuaucuacaugucucuucaacuggaugaucagcuccugcagaccagggacuuuagcagucuuguauauauucugaguugcacauauaagaucugguauuuaugaaauauaagcaaacccaguguguugucuggguuacugaauuuaaccaauacugaaauucaguagagcccuaguguaguggaacugaaagugaacauuuuaaaaauaaaacaacugcggcucagggagauagugugauuauuuccccccccccauccccauccccccccaacccccccccccccgugguuucuaguggauuuuccugccuucugucccaaggccaucugcaucccuguagcugcuaucaguuaaugcugauuaggaguauuuaaacuaagacagagccagccugugaacacuuacuaucuaucaugccauuuaguucuuaaguuacagaaugugacucaaguauuggaaugaaguagauaacuaggcaaguauucuagcuaccaccuagcccacugcucccuuacagugagugcucucaguaauuauccuuaauggggggauggaggaggacgaagugaacagcaacaaaaacacugguguuuauauuuccagucuuccuucaagcauaugaaaguagggaaaagugagauuuaagauguuguagggguggcuuagggcugacucugugcuuggcaugcaugagcuaauuuuauucauuagaccaagaauuaaauaaaagucagacuuauuguccuuuccauuaaaguccacuuuaccuuuccugggugugaaauugugugugugaaauugugugugugugugugugugugugugugagggagagagagagagagagagagagagagagagagagagagagagagggagggagggagggagggagggagggagggaggaggaggcugggagagggacagagacagauagagaguccucuugguuuuuugaaagaccaagcauucucuccaauaacuguagauauuuucuguugugaaacaugagcucaaagcaaaguauaggaacaauucuuuauagcugcucccggaacucuuuuuaauccuuguuauugcuuuuauuuuuaggguuuguguuuagugaaucagagggaucugcauuagagcaguuugaagguggccccugugcuguuauugcaccuguccagguaacauagacuacuuuaccaacuccuuagacaagggacauguuccaaacuuugggcuugccucuguuuucugaugucuguacucuacagaacaaccagagauggccuucuaacaacucguacaccuagaguucuaacuaucaagauaaagauaaguucuuuauuuuggagcaugagugaguccuuacaauaguagcauuuucaagggaaaguaagagguguacccugaguuuuagaagauuuggaguuagagauaagaucuguuguguaauauaaugagccuuuugauacuauaaaaucuauacauuuaaaggguauagucauaacaauuaggccuuuaucauuuauuccaucuacaaagaugucucuagaaaguuacagaugagugcaugcuuucauggccuaaguuuuauauauuauuuugagcuaaagauuggccuuucuaaguaaguugcaaccaauuacaaacacaauuuaaagaauuuuuuuuucuuuguacaaaagaguuuuguuuucaggauggccuuguuuugacucugaauguuuuugaauuuaagaacugacuaguaccauaaacuguuaaguugcuagaacuaacagcuucuggguuacucuuagaagugugacuaugagugucaccucaaagcuguucauacuuuaaaauguuuauuuaauuagaaaugaugcaaauuauccacuggggaugaaggauacauuucuaaacucuugguuauguaagacauuaguucccaacauuaucuuucauaugcuaacaucacucaguuaaaaggaagagguucuuuugccuucucaggaauggagagaugcucagugcuuuagaacacuuguugcucuugccaaggacccagacacacaugauguacauacaaaaaugcaggccaacauccauacacauaaaauaaaucuaagaaauuaaaaaagaaaagcagucugaguuauuccaaaauacaccucuauagaucaucuuguuuuuauuucuucaaagaauaaaacuaauuguuuucauauugauaaaauuauuauugcuucaaagucgcuaaguguauaaaguagaaauuuaaauauaauaauuauagaauauuuaaauauuuugugugauuacauauauuuuuaugaaaauauaguacuacuaauuauuauuauaucuauuuuccugaaucuacugaggcagcuuucauguaccaauaggaaucucgucugaaucugaagacccuugcucuaucguguguauuacauucagaaauagucucuguggucaguaauagugcuaaagaauuggaggucugcgaauauacuuaaacacaagguagaucacaggcauuuaaaaaccaguguguaucaaaaauaaacaagggauaacuuuaacauuaaaauuuugacugcauguuacagaccuuuaacacaguggguuugcuuugagaacaugccaauauuuucaaucaauaaacuuacuuuauacacacacacacguauauuuguguguguguauaaauauauauauauaauauauauguguguguuucugcuuaagcaucaaaauuaaaucauuaaaguaaugagagaauuuaguaaguuaaaauauuaacaguaacauuucaaacuauuaaguuuagacuaugacacuucuagaauauguacauaggaauagcauuaaacagauaauucauuuauuaaauaagaauuuaccaagauuuauuaauacugugauaaaggaacucuaaucaguggugaaauaaauugaaauuuuauaaauacuaccaauaugagaggcagauugagaggcaaaugauuuucggucaucuucuaucaugugccaaauauauccuuaggaaaccaaaacauuaauguaccagugcucuaagaaaaagaacuacuuuaagcucagaaaaaaauuucaauaaauauuauuauuaagugauauugccuauguuuagcagugaauuaguacaaauuggauaagauacaauucauccccacaggucaaaugggcaucaccaagugguuuuuuaacagguacacugaugcuagacaagaaaagaauaaagacauuugcugagugcaugccaguaaaaaucaagcaacagcuugauucuuuuuccuuuuuauuuuuuuuuuaacucucuagauaaaaaauugucaacacuuauguugguagaguaguacugacacucuggaauauuguugucuaguucagauuuaacuaagauucugugaaguuguuguagaauauggucagaguuauauagauucuuaaugaauaauguacuucugagaaacccucuuuaaaaauaacccuucauauagaaaaaguuuucuucaugaagaaauucauuuauaguagcaaaagcuacaaccaacucaauguauuuuaacaaaguuuaaauguggacauaacagguaaaucuuggaacuucauagaaguauugauuauggcuguuauuucugggaaaacuaaaaaacauacugcuuacuguaugcauuauaauuccuucuucuaaaagcaguuaugaagagaugaugaagguaauguuauaugccgacagcaguagaguuagugguaggauaaacaccccuguuuuaccuucaaaguuuguucuguaaguaguuacacagaauaguucauuuauguugauugcugaucauagcauagacuuaaguauaguguuuguuucaugucuauuuaaguacaguaggacuuuauuguugggguggucacauucuuugaauugguggccuguugggugccaggcaguaugcugagugccuggcauacauuuucucauauaauccuuacggaaaucuuucagaguuuguccuagcacuuuugauugacuaggaaaucaagacucaagcuuagguccuucugacuaaaagcaaucuccaugcugcuuucuaauagcauguaaagaguuuuauaauacccccauuucuuagacuuguccuacagagauucauagucaauauuggagcccaggaauccacauuuaaacaagucaacugacugugccuuaaggaggcacuguccuguauccugcagcuuucuacgacguagccaguagaagacuagagaucaguuccuuuuucuuugaaaccauauaauuugaugacucauuucaugaaguuaugaguucuugugagaaugugauuacucuaauagugagauucuuacuuccuuccucucccucccucccccaccucucucccccucccucccccaccucucccccucccuccuccuccuccuccuccuccuccuccuccuccuccuccuccuccuccuccuccucguccuccucguccuccuccuccuccuccuccuccuccuucuucuuucucucucucucucucccucccucccccaccucucucccccucccuccuccuccucguccuccuccuccuccuucuucuucuucuucuucuucuucuucuucuucuucuucuucuucuucuucucucucucucucucucucucucucucucucucucucucucucucucucucgucuuaccauaguacugggcaucuagcacauaaucucaccaugguaggcaaguguuguaguaccgaguuucauccacagugcuuuugucuuuuagcuuaauacagggcccugcuaaauuucugcagaugaccaguagugguauucucuguauaacagaucagagcuauaggaaagaauggaccauuguuguauuuagauaccuccuauccuagaaauccaagagaaauguagagguauuucuguaaaccuucacuaugugaacagauugcuagguuucuauaaauuccaauuaccuaucugcuaugggaauugauucucuacuuacuagaauguauguaucugagauggguaaucuguaaaucuggggcaaaguugauaguaguauguucuaaguaaauaucuuuauacccugucuuuugacuguggggaaagacuuugaauaaaacuacucaggagaucaggaagauggcauugaguguuccucguuuuuaaagaaagagcugcgcgagcugugacuaccaugcauucuaacugucgcuuuaauuguguaaaggcguuucuuuugaagaagcuucuguucuccuccgagaagucguccuggcgggauugcucagguaugcuagcugccuucaaacucucuccucccuccggcuucucuuuuacaccucaucuaagucacacuuauugcuaguaauucauuuucuuaaaagucugucuucacuggggaacaauugauggaauauuauuucucagauguuucaaaaaguuuaauaaaacagacuuuguuuuaaaauguucuuuuucagauuuuucuuaauaagggacagaagacagaguauuauaguaauaaggccucuugcuuaaauggcuguuucucuuaaccuuuagaugauuauauauccauaauuaaaaccucuuugcucugguguuugugugacaggaacucacuauauaacaaggcuagccuggcacgcacuguguaggccaggcuagccccagccuugcgauccuucuaguuuaacuacuuguugcuaggauuaccuucugcaccaccaugccuguguguugcugguggcuuccuaccccaucccuccuguuuucuuuuuuugccuuauugaguugugaugaagagcucagcauucuuguuuuacucuuuuaucuuuuauuauaaugcauuauuaaaugggaacacugaaaguuugcagaauaaacuaucagaguuucugcagcuugaguaauacugauacgggaugccaccugaugacaaacauuugcauuccacuuggcaguuuacaaagaccuuccucaguugcagaauuccuugugagccucacagucacuucuagaagaaggcaggagauuacagugccagcuuuguguguaagaacauaauagcuuuccuucuaacccaugaccauagaaucuccucaagauucugaacugaggaguuaacggaauucuggucauauauuuaguaugaauaucuaauucacgaguucaguaaagaaacuuugagagucuauuaucaccaugacuuuuaauugcugaaaacauuucuuccucaaaaauacagucucuuugacaaauuugaaaaacauucucauaaggucaugaaggcugugaugucaagugacuggaaccauugcugacuguaacaugugauguaggauguguuacacuaguuucauuuggaagugugagugugauagugcacuggaaagcgggcacugcuugaaagagggcggagggcugcccagguucuggaggaaauggccuuguuugugccuuugaaaagagcaccagugcucggcauacuguggagugguguaaggcuccugcuuuaugcagcauagaggugguugcuucugcucaguaauggccugugguuugugugcugauggugucuugucgccuugcuguuauuccuguaagcuggucaggcggaauucagcagaugaggagaacaggucccgggggcccuguugcuccuuucuuuggacucugcaguagagggagcugagugcugagugcugaaggugagaugaugauuucucaugauguuaauuaaguucugcacuuuucagucuucuucuaacuggugccaggauuuaaggugauaacauuuuaaucuuuaggcacauuguucuucuaaagaguaauuuccagucuucuggucauauggguuuuccuuauucucagaaaacacuugauuuucauuauuaagccgaggccuucuuacuguuucucaugacucgauuuucuuuuccagacaaagcauuguaacucauacuuugguuauuuuuagaggaagagcagaaggagcuccuuugucacaccuugugugauauuguagagagugcuuaugacagcucuggaucauacugcuugguuucaugguugagaggaaggacccccgaggaagcggcuaggauuucugggaguccugcacagucuaguugccaaguggaacauucuuguaagauacguuuuuauuucaugaaguaauuucuuguucuuuuguuuuaauaaaucuauugaaaauuuugaagaaaaaauauuuuauguuuugauaacacuuucucuaaguuaauauuuucuaucucuuuuccauuauuuuauuuaguguaagacagugcauuuuuacaaaaggaguuacaucugucucuuaagcauuuuaaaaauaauuguagcuaacuucugcuugaugaaaucuuuuaguauuacaacuuugauuuuaaaagucugugggaaauacaucugcaugcaguaguucaggugcacaguguucuuuagaugagaggagcuuucucaccaucaaugcuuaaauauccucagcucuguuuuagaacaacaguggagauauuuucuuaauuaaacacuguuauuuuguuccugauccuuuugaacauuguuauauauuuggacuaaaguaguuuuaguuucguuuuacuuauguuuuaaguucuccacaucuugacugcaguuucuuuauuuuaaauaauacaaauaauaccuacucucauucauaaaaauuacacacuugaacauucuuaaaaguggccuaaacacugccaaaaugaacgaguaaauuaacgacuucuggugguagggaaaauagaaggaguugcucuuugguuugcuuuggaggacuaaucuugcuaguuaggugacuuuggggaauuauuaguucccaaguguacuuuauuccauauauacuggaacauacucacuaccuucuauaucaaauugauucuguaaaagacagauacuaggcauuaggaaguaaauauugauuguguguguuauguaucacuauccauauagaacugucuacugacaguguugccuccccugagcugaaaugucuguguucacuguccauuuuuuccccuuccucuacaauuagaacagcuugugcuuggcaaauuuuaauaacacauuugccagaaauaauuuuaaaaauuuaaacaguuguguaguguuucuuuucagaccuuuaaaauauugccuuucgaaaagaauucauuuuggaauugauaaugacauuuaaagacaaauggaagcuauucaaaagaaugauaauaaagcaucauuuagacucauuuuuaaauguuuguaaauuguacuguguggcuuguaagcaugcuauuaacuccuuuugagauacuacauauugagaaagggacacuuaaaccauucaaaguguuuacacucauuuagcauuuuacauucguguuauauuuagcauuaccuuagcacaugcauaccauaugcuuacucuggagugguggugcauuucugugcuaacacguuggcaagcucuaggaggaagggcgucauagcacacuguuagcuaugugggcaugauagauugagcccuccuccaaaacaaagugauguaggauuuucuaguuuacuuagugccucauuuuaaaaauacacaugacauaaaaccauacuugaaauauguuuuuaacuucauauauaguuaaaacauuuuauuaacugagaaucuaggaauuuaucuuagauacuaacaguugaacugaacuuacauugaaauauuuauuccauauaacaaucuguuuuaccugucuuucuuuauucccagcugugguccuccucuugucuuuauuccccaccaucucugacuguuaagccauacauauauauuuguuuuguauuuuuuuuugccagccucuugaaaguauucucuuuaugucagcuuuacagugaagcauaagcaguuuaugaaacaguauaacuuggaugagguuagauagaauuauuuuauccucaacauuuaaaugugaaaccuuuccccucucauuguuacucauguguacagcauuaucuccauuggcuuuugugguguaaauauuuuuugcuuguuaguaaugcacacuuguuugcaguagugaauucuuggguucaauuucaguuuguuucccacauaaaccaaaagauaaauuaaacaauuuggacuucuaaagauuuuagaaagucauuugaaacauugaaaaguuaaaaucaggcuuuauaaagcuaauauaaugugauauuuuaaauuguacagaaaaguuuuaauucugauuucauaaucauguuuuaaucacuagugaaaaugugugacuuucuauaauuugcuucaugaaauuguucauugcaagaaaguagucauuuugauuagccauuuuuaaagacaucuucuggaagccaagaccgagucuacauuucagugcugguuagagcuuggugcucuuaggauuccucuguggaucucagcucccucuuuuacaaguaaagaggaugaggccaugacaacuaacuaagugagggaggccugugcucucaagagugcccagcacucaguaaggccuuaguaaaugaacaguugcugauugcaugaaugaaugaggaaacaaacuuaaaucuguccuugaaccugugguuucagugcuaugccuaguauaugcauuuaauuaaugagcccuaagccuaaggguuuuauauugaaaaagauuagcccugauaguuacugcuaucuguaaacuagggcauuauuuuaaauucaagacacaugacaaugugugacagaaggcaguagucccuccuauuuugcauguucuccuagcugugacugaauuguacagagauguucguuacuuaguaacccuucuguguucucaguacuauauccauuuuaguuauaaccauaguaacuaagaugaugaacuauaaauucauguuguuauaaaguucagaguaaacugagacuuauaagggaauaagaaauagggaauguuuugauugcuugaaaguauuuacagccugcuguguguaucuugugucauuuauuugccauguguagugcugaaaagugucuuuuauguauagcugccuuggcugucgaagagcuuggcuuugagcgauuucaugcauuaauucaguaaguaacauugaaacauuuaaaauacuuaccuuguggacacauugccauuuuaaguauguucauucuguggaaagaucccuagauauacauagcacuucuuaacuuagacacgaguuuaaaauaccuuguuugagcacuuaauugauuucaaauuuaaaaauaauaucuacaugauauaugcuucuaaguccuaaaguaacuaucuaaguacauuuuuaaaaacacgaaaucaaauaugucuucaucauuaucaguggaaacaaucauuuuaucauguuuuucuguucugaaugaauguaaauccauuuguagugagcuaaauacuagcaucauuuuccugccaaaauaugcuuccugugauuuucauuaaaaguauccacacuucaucagaacacucaaaguuuuuauuauaaagucaaagggaggcugcuauguugacagaauuauagguggcauuuaaaauuuaacauuaauuucuuuuagaagaaggcccaaaugcaugcuguaguuuuauccuucagauguuuguugaagagcuugcauguuuuaauaaucguuucugguuguugagcaccucucugaagagguccagucuguggucuaaauaacugcauagauggaaggacugggggcagcuacuacaccuaggacaacuggaggcucccgacggugcucagacugucucaggagacuggguuauguauaguaggagcugucagcaguaguuuuuguuuuccauggcuaaauuuuacuuuuuagaacuugaagauacuuaguaaaaaucucuuguuuguauauaguaaugugcaagaauuugaaacucuuuuccauuugugaauggaguaaucgggauauuaauacuuaauucuucuucccccccccagaaaaagaucauucagaacuguaucagaauuaaaagaugcugucuuggaccaguauucaauguggggaaacaaauuuggagucuugcuuuuucucuauucuguauuacugacaaagguuuguuuaagacgauuuacuuucuuagcucagugcuguuuuccuguuugcuguuagaaccuguguggccuauguuuguacaucaggguaagaauauuguggcuuguaaggacuuuguuccugccucuacucauucuuuaaccacguccacacucuccuccccucugcccuuacuuacugacuacagaggugacugauaauguucuaaucagaauguugucaggucuucuugauuuugguuucuuugaucuuagcaauaucucuggcauuuaaccuuuuagccccuguagagacucuuucugaccccuacuuuuaauggauuucuuuguuaauuguuaugcuaguuucucagagagugucucauauuuaaaaaaaaaaaagaagcauuuucuuuaaucauuuuguuuucuucuuuauguguccuuucacuuguuuucuccuucugaaauuuagaauuccagaagagucuuuuccuggguccuguguaauuguucguauuuuucuucuauggauagcuauuucuuucggcucaccucucugcaccuaacuccacaugcacaccucugguccugucuucuuugcaaauguaaauuucaauugcuuguggccuugcacucacacuuggaaugucuccugauuauaccuugucugaaaucagcauuuuuuuuuuucuuaugcuuuuugagcauugacucuguaugauaggucugugacauccguuuuuuaaauaaagguuuucuauuuuucauuauaaaaauagcauauuaauaauucuauuauggucaugauuugggguguuaguuuuuagauuuauuuuauuuauuacaugcaaaagaguuuuugaaaaaauagaagcuaugacucaaguuuguugacaggacucaagagcaaauucugcguaguaaggaccauuuggugcauguagagccuuuauagaugagaagaguuuuacaagcaguaggagaagcaagucuaaaggagaaagggauugggguauaacacagguuuggggcucauaaauacuucaagccuacggcaguggguauaccuagggacaaccgugaaaggugacauucacaccuuuuauauaagaggucucuugugaauugugcaaaaaauacuuaagguuucauaucaucagaauuggaacacaauacaauguuuaauauggaaaugacaagaucuuauugugugguuagaagaugccugaauuggaaugagaguuugugaugaagagauuugguaaguggaaaccuagagacaaggauacugaaguaguauuguaguagaagcugaaauaaaacaggauggugaccauagaauggaagagaaaagggaagguauuuaguaucaauaccuuaauaauauuauauauuauacuaauauauaauauauaauaauauauaauaagaaaaaucagccaaauacuugaaugaggucaggugguuaggguagcgguagugguaggggcuaagguauuguacccucaugaacuaacuguucauucucgaccaauguuuaugcuccccuuaucucugaccuuugaccuuugaccuguaucccagccaugugucagauguucccugggauuccuuugacccuuugcucucuaaagugauucccccuucugcccaccaacugugccuuuuucccacagagcaucuugacauugucauagccugcuuuguuuuguucuguaggaugacaagucaagauccccuagcucucuguuuuccccugugguacuuagacagucuuuuaacacuuugauugcugguugucuauuccacucuuagcuuuggccucuuguauagcagucagugguucaaauuaagugaacacugcuguggaugucacuuccccgcucucccugugcuucuccagccucccuucuguaagaaaaagcaucaggagguggugguuaagaaaugagaaacugccuguucucauaacugauacuuuauuuuguuacuuuauauuugaguuaccuauuuggggaagaauuauagucauauguaaacuuuccauuuucuucuucuuauaacucucauguauuuaacuguauaccucugucuaaacucaaaagucuauggcuuuauuauaaaguuuucuuuuuucaugaccuaaacuaaauuuaguuuucucaguagguauauuagauuuuaauuuaauuuauccugaaguuaaauaaauacuaacuuuuguauuaaaugaguuccucuucucucuugaaaauuguuaucucugucccauuaaccaacacuagacauaauaccucugaguccuuuaguguccuucauagagcccaugagugagaauggaaaggaaucuuugggggcuacuucuuaccaucucaaauacaagucugggucauuugaacaguguuuuauuaacauauaguccaaacuggucaucuuuuguauuaaaugaaguuaauaaaauuuugguuucuuuagggcauugaaaacauaaagaauucaauugaagaugcaaaugagccuuugauagacccuguguacgggcauggcagguaaugucuguagucugcugugucuuacuaaaucuaggcauuaggagcaggaggcucucugaugaauguguugguagcagacgucuauggucuugacugacccugugccaccauguauuauugcacuguuuuagucagugcgugcuguguguguguggccagugaugacauccaauuucagguuguuuacacaugacucuuaugaugacaaguaucuuguuuacauuaguaauggcaauauauguuaacaaaguguuguuuauauccauuuauggccuuuaaaaaugucuaaauuuacccacauuaacuuagaaauaaauauuuucuuaccuaucuggguuaguuucuucuagaguugaaacaauucuuaucuaguuuuuucuuuuuuugcuuauauugcccaaaucaauagaauagaaaaauucaucuauucucacacaaguccuuccuuuugcacgugucuaccuuagcuguuaagaaucguuuaccuuccaucaaagauugcauaugaaauauaauuguaauggucugcaucuguugcaaagagaagugucuuuggugagggguaagaauugcauuuaaauguuguuaaggguuaugcugguuuauuaaaguggcuuuuguagauucuuccucaagacccaugacuucacuagccagguaggaagguuuccaaugccaguugauucuuuaggaccaaguccuagaauuaugcucaugcaaguaacauuauguaaagugagcaguuucuauuuauucaagaguauguaucgauguguguguauauauauacauauauguauauguauauaugugugugucuauauuuagguguauauagcaacaaguaaaggaaaagaggcaauuaauugaagagcaaggaggugcauggaaaggguugaagagaggaaaaggaagagggaaaguaauauaaguaauauaauuauaaauucaaaagugauuacauauaaaacuaaauguaacacuaagugaaaugaauuuuuauucauuuaaauauggcaucuuaaagcuguuaggcuucugagaccgcagggacacggaugcaggucagcacuguagcucucacuaaggccggacaugggaaagggaagccaaggguuccacuuauuuugauuuaacauaauuuaauguaaaaagucauuuaaaauuguagaaauuacuugaagaacuagcuuugugccuauuuuaacugauauuuaauuuucauugauagccaaagcuuaauuaaccuccuacugacggggcaugcaguaucuaauguaugggauggugauagagagugcucaggaaugcguaaguaucuucuuugcuguguucuugaaugauuaauaauuuagugaaauaugaaagauuuaucuuuauuuaauggcucuacauuauguggaugcuaagguaagugcuuucuauugcaagaaccccuuacgguuucuaagaugccauaauacuaagugcagguuuuuggaagccaucuuggguuucaaaucuaugagcuuuagucaggcuugauccucaagguuuugguuuucucugguuuguugcugggacuguggagcuaacuagagagaugguaauuuaccucucaguggguguaacauacggguacuuauucagaggcaguacugcaugcagugcuggaaguuaugggaaauuauaaagucccugaauuccuuguucuuacaagauccgugcguuuauuaucacguugaaucuacucguuacaugcugggcugaugugaugauuucugagacugcauccacucaccugaauucagucagcauuaccuuguaauggugccuugucgcagacaucaagggaugcacacuggccaggacauucgcucgcucagacagcuguugugcggcuaugaggaaagcuccuucauuuguuacugggcaaucuaaacuccuuugcucagucauucaccuuuuacagaggaagugcaauaagccucguacuaaaaugucgaucaugggaugugaagcuucacagcuuguguucagaggcaaauuuauacucucucucucucucucucucucccucucucucucucucucucucucucucucucucucuccauauauauauauugaguuuuucaagacuggguuucucuguguagcccugacuguccuagaacucacuuuguagaccagauuggccuugcacucagaaauccgccugccucugccacccaagugcugggaucaaaggugugcgcuaccaccgcccagcucacugaauauauuuuguuugaagaaaauguuacuaauacuuuucauucccaaaugaaugauuuucaacuuuuaauuuaaauuuuccucaaauuuuagaaauuuguauagcaaauucacagaaagaauccaauguuaggaaaauuuugaguuaaaaucacagaauuccagaauuuaccgagcgcaauacaaccuuucacugugcuguuuggaaauuaaagucugacuuccuacacuagagugcaguguaauugacuuaguaagagccuggcuuugcugacugcauagauacagaaguccccagagugcucugucuuguucugcucucuguguccagcacauccuaagggcucuccauucugauguagauguaaaagcccaugagaacuggccagccaaagugcuagucucuuacguaaugugggguaucuuagauuucgcccugcucaccuucucccuccucccaaagcugcuggucucugagaaaucugcuguaaucaggagaacuagagaagaagcugcagcuuaaggccaccguccaccugggcucuaacacugcugcuuccugcugcugcuaugcccacaacuguuaacucuuuuauucauuacuaaguuaucuugguccaguguccuguguacccuacaguuucucucagguuauccuauuauaaaacccauauggccugcacuccugccucccuaggugcauaggcucuucucauuuugagggucuuaccucaguuacagaauuuguucaucacuuauauaagcuuugguuccucguauaugcaaauucauucauuucugauucuugaaguacugccauucaaggcaaagacugucauuuuacuauggaugguuuaaaguacaauuuagagauugaaacuaaauaauggcuagaagauagaguuuucuucagaaaaagaauugccugaguguauuuaaaguuucucuucagucauuuggaauguugacuugaacuuaauucuguguccagauguuuaagcauaaaauaaaauccguacauaauuuucagcguuugcuguguauauuucugguuuauacaagauaguaggaaauguggaacauaaaugacaaguuauacaguaguuuucaaacaaugaggcaaguuacuucucuugcuuuaauuuccuuuuuuuuuuuuuuugaaaguaaugccuucuucaaauggcuauuguaaauacuaagaguucugucaugucugcaaggacucaaaggaagagcucaauucucugucaaaugcacauagaugauaugauaugugcugaaaugagaugcguugaaauaaggaccauagacaugcugaggaagagggaaccuuuuuccgcaguguuuauauuggcauaaauagacacaggaauuuuaaugugaacauaguaugcgcaagagggcuuugggggaaacauacacauuauguuuagacagggagacagacagauguaacaguaguguacauuauuuugagaccuuaaaaucaugaauauucaggccccagcugagaacaguuaaggguagaauuuuuagguauuggaacauggccuuaagacuugugggugauucugcugugugugcagcccgguuugagaagcaguacauuugugaugagcacugguaagggaaugcggcagcaugggcuuggauggaaacaugcaggcugcccagugcuguaccacuguaagcacugaacggagaaauagcacaguaggaucuagggggaggaaggaugcuguccguguguagccguacuggagaggaaucacaauuuguaagcuguggcacauagcauagacaaggagagagguacaggacagugacagacaggcacaggagggaaaagauauggccuauuuauuuccuuccuauaagcaauauacuuuggauauguguuuuuaacagguaugguuaagaaacuaagacuuggggcuggagagauggcucagugguuaagagcacugacugcucuucugaagguccugaguucaaaucccagcaaccacaugguggcucagaucucauaaugagaucugaugcccucuucuggugcaucugaagacagcuacaguguacuuagauauaauaauaaaucuuaaaaaaaaauaaacuaagacuuggaugauuauuaauuugcucaaagugaagcaucagaaaguaaacuaccaggauaucugaccaugguaaagccucugcuuauucuguauagaacaucuucugugguagagucuacaggagguagaacuuguaggacuuuucguuuuagaggugagggugaagugaggauaauuagcaggauuuuaaacugcauuuaguacugcauuaacacacaaagcacgagaaagcccuaacagguguguauauuuugacaauguuugauccuuccaauaugcugccauuguguacuacauuucagugcuagacagccuagcauugaagacaagggaaaggagacaguuuuauaggagcaacaggacacaggaacaugagcaugaaguagccuuggcaguagacguuccuuugaagaaaugauaugcaagggagaaaaagcaacagguuucauucaacugaggacacucauggaaguuuaccgauggucuaagugaguguaguaaaugugcagaaguaaagaggagagaugugaguccguugcucuaaggagcaaagcguccaugaguuuccaugagaagagggcagugggaggggccuggagcagaucccacuuguaaggcucuuagguuuggggguuguuuguugccguugucuguuuuguuucauuaaccuagcaacgaucacuccucuggcggugaggagaacuuggauuuuaggugugaccugggaauguugaguggaguauggacaaggcaucuuuccaccuuuauuuauuaacguugcuugguguuugaaccaucauguguaucuuuugccuugagcauuuuaccuuggugagcauguggguaguuuccaguuugacuucuaucagacagaccuguaagaaacacugugugaggcaagccuacucaauguucaugcacgauugacuugcuaaaguagauguguuuuaaggaacuuuuucuuaguaauaacuuuauugaaaucucuucuauauacuaugcaugccacucaguugaaauguagaauaaaucaaaacuuaaauaguuuucuaacuuuauaaagaaauccuggucucaucagcuccccuuacuuccauccgcuccaugccaacaacucauauaaauagaauuauauggcacugguguuuguaucaaauuucccucacuuugaacaguguuuuccuauaccaguucuuuccuuauauugaugagcaagugauauugcaggguauggugagccauacaucuuuaucaaucaucaauugcuggacauuugaaauagcuaccugacuguuaggaguaaugcugucagggacaccuacgugcaagguuuugugaaagcauguguuuuuaauccuggauaauacuuuaacucagaagauuuaccauuuuuaggaauaucuguuuaacaauuuauggcaacuuugucccuaaaauaucaauauaucuuucugacuguagacuuguguuuucucuguauccuggugaugacugaacacuguccaucuuuaaaaguuagucagcuuuugacaagggauuacacauucuaauugacauuuguucugcguccuaaugaaccugagcucaggccuuugcucacguguaagccugcagcugugcuguccucugggaacugccucugcucaucaucugcuguuguaggcggagggcuggcuuaccacagugucugaggcucuggaaguccuuuaguucuuuacaauucagggcaucucucccaaccuuuucuuuuuuuuuuuuuuucucucucucucucuuuuuauuagguauuucccucguuuacacuuccaaugcuaucccaaaagucccccauacccacccccccacccccuaucccaaccuuuucuuaaguaaauuuuguuuagugauaucuuuucuucccaaggguuucacuucuauaauauucaaucauuugaacuuuuuugucaguuaggauuugguugcucuucccccauaucaacuccccagauaaaacuaauacuuucuaguauuuucuucaaaugucuaauauuuucuuaugucuuguccauucaucauuuuuauacauuuauuugaugauucauuguaagcaauaguugauggucauuagcuuaaagauaaguggaaaauauggaaauguaaacucuaaggaauaugaucauuucuauaacuaaguaauaucauuuuaaauuaugauuuaucagaacuaguaaaucagaaaugcugcuguccugaaauuguacuacuucuacaacacauuagcuagagccagauuguuagguaaaguuaguauccuaguuaaauccacauuugagauaaucggucauucuguaguguaagugugcauguaugcuuaacuugaacaggauuguauauuucaaacaacauccagaauauaaauguaaaugauaugcugguuaguuuuuauugucagcuugacacaaccuagccucaccuaggaagagacaacuuugguuaacuaaggaacaguccaaaucagguuggcuuacaugauaguuuaagugaggaugacccucaggcucagagauuagcuuguuuagcuaccagcuggugaacgguuugagagggaguagaaggauuaggagcuguggccuuguuggaguugguguggccuuggaggaaaauuucaguaaaaaguaacaaguuuaagaagucuauuguaaaacugacuguagguaaugacuagucucuacuugaaaacuaccgagaauagacuaaguauugucgucucucaaauauguauaugaggcaaaaaguuuucaaauaucuacaaugauccauuuaaaauaugcuacuaaauucaggaaaugaggcuccaucugucuuggugaugaagugcacagaucuggucaagaaccacgcucaaguaucuggcuuaggugauauuucuuucucucucuuucucuuuucuccugguuuuuugaaaaagaugaauauuucagguuauguuguauaguauauauacaacguuuauuuugaauuauagauaaaauuguauauuaccuuuugguaaaaaaaaaaguuuuauuucuuugccaucaaacuaaauaguagccgggcgugguggcgcacgccuuuaaucccagcacuugggaggcaaggcagaagcaggcagauuucugaguucgaggucagccugaucuacaaagugaguuccgggacagccaggacuacacagagcaacccugucucgaaaaaccaaaaccaaaccaaaccaaacaaacaaacaaaaagacaaaaaaaaaacaaauaaacaacaaaaaaaaucaaaccaguaguuugaaaauucaauuggaaauuuggauacucuucauuucucuguuaugagauaauauaggcaauggcaagauagucauaaaauugccaauuucuuguaagcaaaaaguaaagacugagacuuuuaaagaaaauccaauguaaguaaguucuguaaaugauaugaaaauauuguuucacaacuugguauaaaaauuauuagauuuaguuuuacuguugugcuuaaucuaagaugauaauaauauuaaguuuauauucugcuugaggguaugagaauaaugcauuuugaaauauuaucauccagugcuagucauaguaguauucuccauguggaagaaguagaagaucaggaguucaagggccaccaucuucagcuacauaguauucugaggcagcucguaguaaaaguaauaucuaagccagauaugagcaugugauucuccaccagaucugaauacuucaucacuaagauagauggaggucuaauuuucuguauuuaguagcaugauauuuuaaaccaaccauuguagacacuugacuaaccccauggaaauccaugguguaauaucuggcuguaacacuagguggugguaaugcauuuuagacuguggacccugguucucaacauaaugugcuuuucuuuaacaggaagauuugccucugcucacaguuuagaggaaaggaaacaggcuguuugcuaaccauagaauaucauuucuacccuaucugcuauuugcuguacuccuaaacccugguggcugcaacccaaggacucaaauguuuuuauuuuauacuauuaauccuccuaaaguuuauggacaauuccaaagagguuuuccuuguagauaguagauauacuugugauaguaauguuuuucauauuugaaguugaauugagaaaagcuuuuuaaucuauguuuaugguccuacuuacuuacuuacuacuuacauuagcuuuaagugucaguauacggaaagccuuccugccagcccaggugagugccagccugugagugcguagugucuguaucagaaccuacugugcugcgucagcugcaggguuacuacuugcuugaccuuacgucagugagucuagccuucugcugguggcccauuaguguucaccaggcuggcccagccugugcuucugagcucuacugccagcugcuugucuccaguuagaaguccccaaaguagcucagucacaguuugcauaaaagugaagucaugcucagccuucacacaaauccagaauaucuuucuugaagucuuccuuccaguuaaucacuguuuaucguguuugccaugguuauggguuuaaggaacugaauguggugucacacaccugugguuccagguacagaggagccuaaggugaaaggacccuugaagucaaggguuuggagcuguccugugcaacacuguaaagccccauguugaaaaaccaggaaucucaggcagauuuucauuccuuaccugaguauguuaauuuucauucuuucuuaucuuuggguuuacauuuuucuucuugucuucucuggucuuagaauuuucuacauauaccaucagauuaaauucagauguugccauucuucccugacauggaaacauguucugccacacucuacucugugugaguguguguauguacauauguagagagcuuguaucauuucucuuugcccuucgucagcucuuuauaaggcagagacuaugucuuagucaucacuguuucacagccuuaagcacacuggcugcuuucacuuagaauagaaaggaguagcuugaaguauccauguuuugccagacaguggugguguacaccuuuagucccagcacuugggaagaaagagacaaauggaucucugaguuugaggccagacuguucuacagagcaaguuugagaacagcugggacuacacagaaaaacccuguguuuaaaaacaacaaacaaaaauacaaagaaaaaaaaaacaaacaaaaaggaaggaagagagcgagaaaaaggaaggaagaagaaagaaagaagcaaaaauuauguuuuaagugcuauuuaguuauggucaccauuaucccauaauaaauacuaauacuuaugauuuaacaagcaagcucuuuuuuuuuagaaaauaagggucagucaaguuaccucuuuuuauggagguguguguguguguguguguguguguauacguggauauauauauuacguggauauauauauauauauauauauauauauauauccauguccuauacauauauauauauauagagagagagagagacacauguguguguguguguguguguguauguggauauauauauauauccuauacauauauauauagacauauauagauaucuauauauacuauacauauauauguguguguauauauauauauauauacacacauacauacauacauacauacacauauguguguguauguauauauguuuguauauguguauguauguccacacacauauacauauauauacacacacacaugugaauaugaguguguguguguauuuguguguguguguguguguguguguguguguguguguguguaugugugugugugucuuuggguuaccaagugauuuuuuucuuaacuaaaaaauuaacauuaaauacuuuuauaaauaguuuuaaucuacauuugaaccauuacauuuacccaguacaaagcuaccugguaucauuuuauaauaaauagugauaacaugauuauuugauuuaacuuuuuuauuguuuuauuuacuacaucccaaccacaguuuccucuccuucccuaccccuucaaucucuccccuucaacuccccuuuccaucagauccacguccccauccacuuucccucagaaaagagcaggacucccagggacaucaaccaaacacagcauaacaaggaccaggaacauacuaucauugauuugacaucuuaguaaauacgugcagagguuuaaagauaguuuuaggugaaagaaacauuuugccaugguuugaauauaaauauauuuaugcacauauauauaugcacacacaugacucagacuuacauauacuaaugcaguguugaauuugguuuuguuuauuuuauuuuauuuuuuuuuuuuuugcagaacuucucgguauccaugaacaagcagcuguaggauucuuaacacuaauggaagcuuuacgauauuguaagguaaacugucuugagggguuugaauaugcccacacuguggacaguauuuucacucugauggucauuaacuucagcuccuggcugucaccacucaucacugucuuacuuccuugcugagcucccaacccaaacuaaguguuaagaaaugaaggcggcuaguuguacuugcuuuccugugaagggagugagugacagagcaaagaacaaaauacuauauaaaguagaaauauacaugguucacuauaaauaugcuauuaagcuguuucgccuugaaccuucauuguuguaauugaggugccuaccugugcaguccucaauggcuauuaaauauugcaauauuuuacaugaagcucacaucaguuuucucacuuaaaagaugccauauucuuagacaaaggaugauguagauuuguagauuuuuuuuuccauuuuagaauguuuauaucauauagugguucugaugacagugacaauuuuuaguaacauuaacaagugucuuggcuggguggugguuguacacagcuuucaucccagcaaaagcagguggaucucugaguucaaagccagccugguccacagagcaagucccagggcagccagagcugcccagagaaacccugucuugaaaccucccucccacggcccucccuccuugccucaaacaaaacaaaacaaaacacccccccaaaacaaaacaaacaccaaucuaaagaagcauuuucuccuuuguguguguggggagaggcacaugugcaugcacacacauuacuguuucuguuauugucugucagacaucauuccuuccucaugacaucuucugccauaaacagagauguaagagcaguacaggaucucuucugaccuuguaaguagugacuaugcacaacaguaauaccucccuuuucagagauuuuuaauucuauaaauuaaugcuauucuaagacagccuggcaaucagagacuuaaacugagauuccucuuucuaguacauacacaugcucaucuauccuggagaagaguaugcaccuaugcgcgcgugcuggcucucucucucucucucucucucucucucucucucucucucucucacacacacacacacacacacacacacacacacacacacacacuuuacuugucaccaaguuacagauuuuuaaaggauuuuuccauuuacuuuuuuuuguugcucugauaaaauaaccugaccaaagaaacuagagaaggaagaauuuauuuugacuuauagcuccagaggguuagaguccaucaugucagggacuacacucuauggugggaagaauaggaagcagagagagaacaggaagugggccaaagguuauaaccucuaaaucucgcuuccagugauguacauccuucagcaauguucuaccuccuaagauuugauaaacucccagacagcaccccugacugggggccaggugcucagauauguguacucagggggcugguucucuuuuaaaccccauagccauguuguguaaaucuucaacuggauccuaucuucucagucaguguuguucccuccauugccccguuccagccacauugggggucugccauuucccagucucccaucucguuacauaaaugguugacuugucccuuggguugauuuuaaguugugucagaagaaguauuuccugacauuuccucaguuacucuccagauuugguugugagccuagccuuugagggcugagccaucucugcagccugccccagcuccucuuucacauuauuugugaggaaugacuccucuauggugacucuuuuuuuuuaaaucucuuccccaaugguauuagacuuuuacaggauuauucuaaugcucugaugcaagguugcuuauaaaugagagauaaagagagcugacaaucaaaccaccaauggcuuucacuugggaacuggguaccagcaaauuggagcugcaggcacagauucuacauggcaagagggguggaacuagcuugguucccuaggcugucaugaugugcugauuugaauaauuccagugggcucugugccauaagacuguaaccaugucugguaccugacauaugggcaaauagacugaucuggaguaugaggagcaugaagagaaugaauugguaucaguuuuaucagcuauccuuaaaggagacugacuaguuuauaaccuggacaucaaacccaauagucggugucuaaaaugcuauagguaaccucagcaguaugcaaguucucagccaacacguauuuacuuacguuucaccagauaauuaggggaauggcacaaagggaaugaauuauguuugaauaaauguuauaaaucuaaacauuucuccauucucugagaguggaacagauugcuuucuaauaaugacacuaucauuuaauuuauuuucagcauauauauuuagguacauaaaugaagcaauaccuauuuauaaccuuucuacacacacaugcacacaccaauaaagaaugaugcuuuuagcgguguguuuaaaaauaagaaagcauaacuuauaucucauaaagaucaccauuuuggauguauaugguucuguggauguugcuauauuuguaaagcugugcaaccaucguccuuaccuaguucuggaagguuuuccucacauacacacaccccacucccccaagaguaggucuaaccgggcagccacuccuucuuccucacaccagaaaucacaguucaacuuucuggcucuguggguuccuucaccuguguauuaguaauuucuuucuuucuauguugagaccacucuuguuuuauaguguaucaaucuguuuccacccauuaacucauagauguuucaaacuauacauuaaaaaaaaaacaaaauccuguuccuauuguaaaacuuuaaauguaauuuguccugaagaauagaguagcuagagucuucucuauucauucucucucucucucucucucucucucucucucucugccuuuauaaggaggcuuuaucauuaauuauuuaccuuaguagucucaggaagaagaacagauuagccuagucuaacaugauuugcagaagcaauuguucugauugcuaagaacuuaauuuggguguuuuuaauacuuagccaucuaacccuuugaacauaauucagaacuaugcaucagccucuccuuuucccuuuacggccacaccuaccucccuucauuauggaaauaucuucaugauucauauuuaagacuucagagugauaauuuccaauuuuagcuguuauaaauacugcuacugugaacauuuguccacauauuauuuuuauagccauauguuuuuacauuaugguguacucaggauuaaauugccuggccacacgguaauucuauucagcuauuagagcacuuugauuuccaaaauaaggacaauguuguguacuguggugacugauuuuaugaucaaaugcaccauuaguucagcgguuucaacuauaacauuuuacaccccccuuuuaaaccucuaccuuaagugaagcacacuugccuuuucuaagagaaauuaagcagcagcuagaauguccagucugugacucagucuaggugcccgggcaacuguuugugauucuagcucugcaguuggugcuuaaguucagccaggcccugccugccaccaugcaccucucuguacucucucaagcgaggucucuuguugcucagcuccacagccacaucgacuaacugagcagcugcccuuuccucacucauuuccucuccacugcccucaaaggagccuuccuauuuggugggcauucuguugcauguuagcgcagcugacucaucccugcuuucauagggcaagggaacuaaguuuucugccaugaauacaagaguuccuguuuuccaccucauggugagaguaaauucccaagggcuguugugcugcuaaaauaggggcugcuggcuaaauagaaaaggauaaugugcccugagugcuguaggucauuucuuacaguuucccagucugaggaggaaaagcaaaggagauugcgaagauucauuguuuucaaaggaaguguccucauggaaguguagagucaguugguguaaacaugauaggcuguguaaaucugucuuaugugcucaaaauuaaacuuuuucucagucacaaaugaagugcuuagaagcuuuguggcacaaucuuauauaggauuucuugaucuaaaguccucauuuccagcugugacacauguguauguaagaucugcauugcagugucugguuuaaagaugcaguauaagcuuagacacagguccugucugcacuuaccaucuaaccucugugguaagaaguguuaaugaacgccuguuauguuucacauauuucugcacaaauauuuaagggacagcauaaaaucuuucauuuauuuguuuuacuuugcugaauuuauucuagguugguucuuacuugaaaucuccaaaauucccuauuuggauuguuggcagcgaaacucaccucaccguauuuuuugccaagguaugcuuauaggggacuuuuuuuuuuccacaaugauauuagccaaacaaguaauauugugaguccauauuuaguuugaucuuugugcagaugaaaauccagccaguaauaaauggaauguuucccagaaaucuuaucaguucacacuacagaaaacacuguugcuuugcucugggguuggagucaccucagugaaguccuuccugacuccauuacaugucuuuaucucugcugacucaagagcucuggcuuuugauuuuguuuagaaguugcugagauguggaagaaaccauuuuaguuuuauuuuagauucuuacauaaaaugguuucuaaaucuuucuuuuuaacaagacguaauauuuuccacaguggggugguaaaagcuuuggcaucaaacaccuucauuuaaacccuaguuucuuugcaacaucucuugggcucuuuuccucuguguuuacaguagggcuuuuuaacaguaccuaggucuuagaagugcugucagccuuaaaucuaagauauuuaguggugucuagcacaagacaagugcucauuacucuaugaaaaguuuuccaaugucucugaugcuguuaagaacaaagugucagagcguggacugaugcgggcaauguaaaaguguguccuugagguuccuuacuccaagagacucugggaguacgcguuucccaggguaaggucccgucucuaagaauucuaucacuuucacugaacugguaaccucauuuuuauuuuauuuucuuccugcuuuuauuguguuagccagcguccagcuuacagcuacagaguaagguacauguuacuuuuccuuaaccuggaaacuguauaaaaguacaggccaccaugauacaugagcguuguuguucauuucccuuucaaauuagggaggauaaaaucaaacucagaagcaggaaacauauaauuccgaacaaauauuucacuauauauuucuagaaaagauaaucaguuuaaauuuacauggauaguguauuuuuaaaacaauuacuuuauguccaacccuauucuuuagcauuaggaaaacugauaugaaacuauacaaguguauuuguggagggggcacuugaaauuuuggggaagggcucuuauuauauagccagggcugauacuguacaagaaucuuccugcaucaauggaaaaauuacauaaauaguaaaugaaacuauuaacauucauuugaguucaauuuaaaauauuuuaaaauauaaagucuuuguauacucuucauuacauagaaaauacuagaagcuuugcuguucuuauaauuauaaaaggaacuauucauuauuaguuugaccuuuugagcauucagaauuuuccuauaucaaaauacuuuauuuugagcauucacauuuaccuauauuuucgcuguuauuuuuuguaguuuguuuugauuuuugucuguuacuuugugauuaauuuauucacucuauaugcccuauggccucaaagaaacauaaguugaaucccccaucuuuuauuagaaauaaacuaucauauuacaugaaauugaccuguaaggucauuuccacagacugcucugugugccguguucuugguuuuuacuggauggaguuaggccccuuuguucugugcucacagguuucagcagccuauaaggaagcauuguuucuugucugcaaaugguuggagaccugaugcacuguacagaggcugcagcuguguuccuuuauuccuaugcuugguuaucagaugguuucucgggauaguuuaugccuggaguuaugccaggugcugugaaugcaguguuaaacaaacauagacauuguuccugcucuugcagaaguauguaucugaauggaggaggccauggcugaugcucagaaguuuccaagagugauaagucuugacaaagcuuaggucuauaauaccacaaggauucuucugagcuuuggaaagcugugauguuuccuagaggaguugauaucugaagugagcacugagguagcaguggacuuaaacuagggaggagaggaaagcaggagcuacuaaggaaguaguuggagcaaacgaaccuccucagaaggagagccaccugaaagaaaagagcuggacacccagaagcagggaggcaggaggcagggaaugcugggucgagaguguuccauguuacuccguagccugagcggacagacucauagccacugcacuuggcaagaaucucagggauucaguucagggacuguaagaagaacaagccuaaauuugcauuuugaaaaggucauuauggcuaauugcagaaaacagacauguugaaaaauaacccaggugauccguaaaacagauuuuuaucauuuuuaugggaagugguauaauuguuauaauucaguccaggguaauuuuuuuauuauccuuugauaauuucauguaugcauauaaugcaucuuuguuaucacacucccccauuccuuccucuaacuucuucugaauggauccccuaccgcucuaccccaucucccaauuuuuuucuuaauaauuaagugaggccagucugagcugcgcauaugugaaugguugugggcguccacauggucugucuacugcagagcacacgacaccucaccuccacccaacagucugcagcucugcccaguagcuucucagcuggggcugagccgguacaguuguauugggucaagugcuggagcaggagucucaguuauuuacaggagcagaaaugacucaaaaacaucugcuucgcccaaagcaggugucaccaagauggaugacaccacaaccugagugacagcuccugaaaguuggaaaccuggaguuuacuguauaacuuauagguagcuuuuaauagggcauguuguuguuguuuuguuucagguaacugugcuggucucugccucucccaggcagcuugucugaucucuccuuuccaggcagcccagcuggucuggaagugucucucagcagucuuugcugcuucuguaaucuggggaguaaagggccuagugcauauggccaggucaguuuagggacuuucugaagcuucagaaugcuuauggaaucuuuacacuucucccuuuagaaucuccugaguguugaggagcuuccuucuaaaauggaaacgauuucagaaaguuacugcaggguaucugagaccucuucccagccauggagucuaggucagauuuacaguauuaggcauccauuucuucucauggagcagcccuuaaaucuaauaaggaagcuguugcuuaccccuauaacauuugugccgcaauuguacuaugggcuuaucuuuucaagcugguuaucauuguagcucacaguauuugcaguugcaugcgauugcgaaugacuuuucucucccagaagccuacuucgauucuuccaguaagcacuaugagagcuagccaucagggaaaacauuguuuucccacuaccugcuugauuucucccugcacugugaccagaguauauaguauguucagcaauggccuaucacugucaaguucugaugagcuaccuagagcacugccaauaaucugucuugaugggguaggggagcuccgugauccuucuaacaacuggauggaaggcaccccucauuuggcauuaggaaaauaauaaaaauuuggcacucuagugcuucugggaagagcauuaucuccuauguagagaaaugugaauuuaaacccuuaaggguguguguguguguguguguguguguguguguguuuaggaagcuuauaaaauagguuuucauauggcuuuuaauuauuccccuuccuauagccuccuauguacuagccuucugugggucuccccacucuuguagauaguugaccaaggcaaaggaagcagggauauggaauuggaaggugggaugggugggggagggggagggggauuggaagcccugugaauauguauaguuaauaaccacaccaggaucaacuaucaggaggcagaucaacuuuacuuaaacucacaguuuauaaaguuuugggggaccuagaguaggagcauccaggaugggcaaaagucaugggcuagggcuuaggggaccugaaaugccucauuagcauggggaacuguucaggaaucucaggcacuggcugaagagguuuuaacaggagaaaggaaauugauccuguaaucugauugaggcuaugugacauucuacauauguagaggcauaugcaacagcuuagaauuccccagacaaggucagagaaggagaagcccugcuaaugaagggagucucccauguugugccaagcccagaggcuauccagucaugguggacuuugaccuuaauuagcagaguuuacccacuucucccccagauuuauuuuuuaauggagaaaugucauuaaaguauucaacccccuauauuggggacagcuugguauugaacuagaacccaauuagcaguaacuuuuacaaugcuguuuuaaaaaguggauaaggcagagugugaacaucaaaaucaaacaaagcauaaaccagcagggaauugaggggugggagccaggaagacaaggguuuacugaaccaacuuaauugcucgguggacugaaaucuugagagcaagucuguacagagguuuuuguuauuuuggguucuuucgguuuuuuguuuguuuguuuuugaggguguaagcauugaacucaaacaauauuugauucauuuacauagacauaacauuuuuuuuuucucaguacuaugcaaguccccccaaguuuaguagccauuaggccccagcaagauccaaggcuguuaacuguggaugucagugccugcuugucuuaagucuccagucagcaagugugucuagacaaagaccccaggcaagugggaggaagauggcgggucagucucagucuggccugcagaggcagugcugcuuucuuuuccugagagagagaaaccuguagugaucauaacaggguuguagaacccugguggggguuaucuguacaaggguucuauacuguuuucuuuucuuacaccaaaagaagagaggggauaaugaaugcacacauuaaaugguauacuuugauugucagcacaucaggcaucccuugcucuaaacccauuagcaguuuaauggguguuaaaggaauuuuaauccuggaagugggaaguuacauuagggaaaacagagggaagggcugggauuuauugaucuuaucuuuuuaagguagcugugaaggaaaacuccauguuaauuauagaugugaaaugaacaguaaccgauugucugugaaaaauaaauuggcuuuaauagacauuaauugaagauuaaguaauaguuguuaauguaguuccuuugaccugugagagguagaucuaaggugauccucugaagccuaaaagaauuuuuaaguuuacaaaaagagauaaauuguauuuauguccauauuaccaucauuuguaaucuaaaaacaauuuugggauaaaaguaugaacauucuuuuagguaguccucuugcuagggaaaaacaaacauuuaaacaaaauuucuuuagacaaagaagcaugaaaauucuaaguuuggggugagcugcuguuguuccaagcuauauuaucuccaucugcaaaagcaaaacucuacccuucauuccugggaugcaggcuuacagacagagaccacuuguagucugccugcucagaggauuugacguggcaguggguccagcugugccagugaucuggcuaguccuuccugcuccuggucucgggaggaaacugacuuugccauugccaguuaauugcuuuggcugucgucuuuggggcccuggccauaggcuaggucuuacccuauaagggauggaacaguacuccuggcagaguguucccccacccugccauccuauuuccuacuuaaacgcuuccccuaucauucccccuuucaaaugucuucuaagguaauucucuaccuuuaagaucuauuuuccuccuauucuuccucuucugccaucuuuuuuucccuucgccaaagcaggcccuuucugaagugccucagaguaauaguguagagucagauaaaguacaugagugagaaaugugcuccugagguaaaauggcaggacuuggagaugcuuuggguuuuuguagacaagauguagaaaugucuaaugagauauguguguaaugauuagaguugaagggacucaauggcaugugcuuaacagcuaugcuauuuuaaaauuuuuuauccaauuuuuuuauccaauugaaaccuugucucaacuccccaacccaccccacccccaaaaaaacaaaaaccaaaaaaaaaaccaaacaaacaaaaacagagaacacaguggaagauggugauuucaauuuaguugcugaacuuagugcucaccuuguuguauaggagaugcccagugaccuagaacuuaaccuuucaagcuguugguaucucuuucugaccuacaaagagaaaucaucuuuauaagauuguaagaaaauuuuaucagcuauugguuccaucaguaagaagaauauuaccauuuuuugaacauauuagaggaccauacugaaaauguauuacauauuuuaugaaauuuucucugauuuuaaauuugaacuuuucacuguguuuguagauuaucuuuucugauagacuaguguuuuuuuguuuuguuuuguuuuuuugguuuuuagagacaggguuucucuguguaacccuggcuguccuagaacucacucuauagaccagguugaccucgaacucagaaaugcaccaggcucugccucccaagugcugggauuaaaggcgugcgccaccaccgaccagcuacuacuggucuuuuuaaagcucuaacuaaacauuagccuguguuaaaagcaaaguugguauugcucucgcugacacaguauccuaaggagucugcuagacaaacucauaaaagcugcccuaugcugauucuugucuuaagggaaggucacagaaucucccuguggagccuuauggaaauggcagaguagucaagccgcagaguucccacaggaccuucuaauagggaugcaggcaggcaggaugcaguaaguaaauggacccuuccuuucaagaaggaaacugaacuccuauuaaguugaguagggaauguuucaugcuggcuaucugagcuuuggcagaacaaaaaguuuauucugccaaagggaauaugcccugugggcaugagucugcaggaaucccucugugguaccucugaugguguagggaacuugcaaacucacugcacaagaaaaagaguccuugugcaguagucuuucaaaguugauccuuaaagaguuuagcacucaaacuuacuuugucuuuuuaagucuuucccuugacuaucagaagaugaagcuaguucuuauuaaauaaggccucacuggaugaguguguucuucguggaaggagcugcauccacaugucccuagucagugaacuucucaaagucgcacgugccugcaugagacaugcuugcacacuuaaaggcugcagugugacaggcuccugcugugugacaggcucuugccgugugacaggcucaguguuugggucguuguccucuuagcuuguucuccuccaaccaugauuuucaccugggacucucugccucuuuuuguuaauggguuuaggaauuaauugccuggaauacuuuguucuuugagaacuuuacauuugaaaauaauacuuuagauauuauuggauggucaucuuauugugcauuuuagccuaacuguggguuagucauugcuaaaccaacauuuuaaaaaauuguuacuaaccuaaacaacucaaggaguuuugguuucaaaagaacaaggucuaaauucuugucaaagucauuucaaguuuccuuuugauguugaugugauauuuguagccuugauuuuguccuauuuuggagcuguaaaaucucauuuucauauauucucucucccucucucuccuuucucucuguacgugugcauucacacgugcaugcacacacauucacacauacauguaugcacaguaucaucuuugaucuuuccuauaauaaagugcauuuccucucagguaagagcauaugaauacacauuaucauuuaaacagaaauuacauaaagaagcuuaauuuaguguaaaggagaaacacaguauacagugcaccguauuucugugauugcagugcagagcaggcuacucuguguggugacccauuuaccaccacagugaaguaagagggagugagauccuuucuuuagguccuuucaaacuucucaguucuguuguaguggaaaauaaauggaauguuuuauagucuuuaauguuuaguauucugaggaaaaauagcccuuauguaucuuuaauuauuggauaaaacucuugagaauuaaaauacguaauuccugagcauucuggaauaauuuacuucuguaucuuagugaagcuaaucaucuuauccgucugucuuagaucuuacuauuucugcuaauguuuauauuuuauaacagacacgacaggagaagaauagauuuaagaaacuaaaguauuuauuuuagauuaaaucauaauuuguguaacuuaacauguuuuccaaaauaaauauaacaaauaauuuuaccuaaaauauuugaaaguuugauaagaagucuauacaaauuagucauuuucaauuauuuuggucuuaaaaacaugaaguuuuaacuauaagcuuuccuaagcuuagcauauuuuaggcuaauuuauuaauuuaagauucuguugaugauuuguaucaccaccaaagaagggaaccuuucuguuuuugaugacuuuagcaggacuguggaguagacugucaguguccugccuggacuuaagcauuccuuguccuguuguccucucugcugugcucuggcugagugcauuaucugcugugguuaacugugacccuccaucacaguggauugucugcuguggauaacugcagccuuccucugccucagugucccugcuuccaggaagcagggccugccccccuugucuguugcaauagagaaucaaaugauugccuaaagaagauagagcauccugggcggggggccuuaaagcuguucugucuugauaaagccugguuuucuuuagccggugguugaguccacagcuuuagcuauuuaauugaaggaaaagacuguagucaguagaguuuauuacuggaaguagcuuuuauuuuauauaaauauuauauacuuaauauaugaucauuccuaaaugugcuuacugaaaucuuggucuacaguuuuggucuagccuugacaucuuugacaaugugauugcuaacucuugcuuuguuuuuaauucuuacugaauuaucuauauaaaauagggaaauugaaagaguauuuucuaaauugcucuaaaggcagaccaaauauaguagcagucuugauacauuacaaaguagguacccagaagcauugggcaugaagcaucuggccggauuaaaaagauaguuacacauguggguuucacauguacagcaauggagagagggcuacucauuucucuuagugacguuaaugauuauagugcaggaauuucuuauugcccuuacagacauugccucccauugcugugugcuuuuacuaugcauguagagcuuagaguuguguggacgaacaaucucaaaggcuuuuucuaugcugaugacuuggguuuugcucuuacaacaggaaaaguaccacauagcauggcuacuguggagguagccuggggcuucugcauguuuuuuaaaacugaaaacuuaaaaaaaaaaaaaaaaaaaaaaaagacugcuacuuaccuagcuuuaaaugauacuauguguuuugagaacauuuaaugguuaacuaaaaaauauuucuuaaaaaaaacaaaaacaaaaacaaaaaaaauauuucuugguaguucccaaaugauuuuuuguauaauuaacaagaccaagucaggaugaaguagauuaugaaguggcuuuagauuuuacuuaaaaucaaaagucaguuacauuucucuucugguuuggagggacucuuaauggcaauauaaacugucugcagguuaaaauagcguuuuuguagcugcacuugcugcacuggguaacuaaccugcucgagguucuuugauuacaaccacagauucuucuugaugguggagaaaggugugaugagcagauuuuaaagaccuccucaguuacccugcugguaccuagccagcacgggccugcauuucaauacacauuaagaagagguaaaguuacaacauuguaaaaagacugugugcaggcgaauaauuaugcugauaggacacagaaugcugcaugaaacagagacauggcucagauuccugacuguggcauauuggguaugcccuuuguaucucaguuccugcuucucugccucagaacagcacuaguuaacaggaaugaagcuggcuggucuugaaggcugugguguucuccagcagucccuguugaccucuaaaugagcuaaagacagaugacucauccuaagagcgccauggccaaagcacugauugugucaugcgaauauauagaggucauuuuaggacaaaaauaauuuugaagguaacucuaacugaacacauuugacuuuuguguuuaagauguuuucuucccaagagaauuugaaagccaggcgugguggcgcacaccuuuaaucccagcacucaggaggcagaggcaggcagauuucugagaucgaggccagccuggucuacagagugaguuccaggacagccagggcuacacagagaaacccugucucgaaaagagagagagagagagagagagagagagaauauuugaguuucggaugcuuuaaccuuuugcagcucuuuccuaagugguuagaguagagaugaagaaaaggcaaguaacucugacaaugugagugacuuagaaguacaucaucaaggccucuucaguuagaacucagugcugggugcgagauuggaggcugagugguaucuauuugaacaucacauuauaagguaauuuuguuaagaucacuauaaugaaaauguuguaaguacugugacaugaagugcaaagauaaagucuuucuuuacagacuaauaggugagccaaagugaggaagagcuagucgaggagaaggagaaacuauggauguguguauuggaagacuggcaaugugcuaaaugggaaugaagugugagaguucuuacugucuuagaaguagaaacucugaaggagagaguccucuucauacucacacaauuauucaugaaaguuuuaguuuauuuccucgauguaaaauaggaaauuugagaauuaugaugcccucacugaaguauucugcuuuaggauuauaaaacacuccagggggcuggugagaugggucagugguuaagagcgccgacuacucuucucaagguccugaguucaaaucccagcaaccacaugguggcucacaaccauccauaaugagaucugaugcccucuucuggagugucugaacccagcucuaguauacuacauauaauaaauaaauaaaucuuuaaaaaaaaaacacuccaaauuaagaaggaguuauauuucugguuaaauuugguacacaaauacauugaauaugcagccaaauuugccacauggaucccgcagccauggcucuuuaugcuaggaacuuugcuucuccccagcauccugacagagcaagguggccagcagaaccaagagaacaaugugcucuuuuguucaagucucauaucuugcuggguuagcauggaacaugcuuuuaucuuuugaugcuuggaauuuagacacaaggcaccuuuaaguucuuucuugugagucuguguuugagacacuucugcuggggauguuaauguaacccuucuuguuccaguggaaauggcagugucucuucccucaacuuuacaaacaaaaguacauuucccaaaguucacuuaagaauaguaacauaacgcuuuguuuauauuaucggccaacucauuccccuaaauggaguaauuugcuucuguucuuacacagaauacuacuguaguucuuuauuacaaauuguaaauguauagguauaaauuuguggaguguaaagaaauauuuuaacucaugaacucacuauggaaguaaguuaguguccauuaccuccaacccuuaggauauuuggggagaauacuuaagauuuaccaucuaaacaguuuugagguguagucaccuacugucuguacuucucauaguauguacuagaacugaaagggaaaaccuuccuucagucgcccuauuccucuuaugccccaucuucuguaaucaccauucugaucuaugcuugugaauucaguugcuuuagaguuuacacaucagugagaagaagaaccacuuacccuucugugccuggcucauccugcaaucguuuccaguucuggggcugguaguggaaaugaccauaguucuuuuuguuaagacugaggagcguuccauuguaugcugcuuuuguuaauucauucaucuauuaugagacauuugauuuguuucuaugacuugacagugcaccugacuucaaaucuuuaggguuaucccaaaguuuugggauugcuggauuuuacaguaguucuuucagagaauuuccacacgguuuuuucaaaauggcugggcuguuguacauuaauuccuaaccaccauggcaacagcuauuuuaacuuucuugcugacauuugucuuuucugacaguaacaaggaaauuucauauuuuuugccauaacuugcauuucccagagucccaauacugagcuuuuucauuuguuuguuuucaguuaauuauguggcauuuugugugucuugagaaaugucuagucauguaccuccccacuuuuuaaauuggauuuuuguuuucuuaauauuaaauuugggcuccuuauauauuugagauaguaacucuuuaugacaugguuuacaaguauggguuuuaaauuuggcuguugcuggcuuuaguccugggauuuggagugagacccuggaaucacugccauggccagugucauuugguuuuucccuauuguuuucuucuguaguuauagaguucuuuuucguacguugaaguugugauccauuuugaaaugaugcucauaucugaugugaacuacgaguccaauuccauugcuuuugauguggaaauccauucuuccuuacaguguaaagacaccucucucugccuauuaaucuauuuuuaauaauuauuacucuguauguaugugcacaaacaugcacacacagaagucagagaaagacuuucaggaauuuuccuuccacuauaugauuaacaggauugaauucaaguugucagccuuggcagcaagcaccuuccucacugggccaucucgaugguguuauuuaagcucaauugcaugccaagauuaauuucugggcuguguguucuguacugauagucagcaugcaacacggcuuuaucagcacacucuuuaucagcaccauacucuuguucccuuuuguucuuugugcuugucacugcuugccuauugaaguccuuugguggcucuuuuguggaauuuuaagauucuuuucucuauuucuaugaaaaagauauuaaaauuuuaguagauacugcauugaaucuacaaaucacucugggcaguaugaacauuuuacagugguaauccuucugcuccaugguuaugagagaccacaaugaauaauuacauaccaaaaaauaaccuaagaaaauuaauuucuuugacaaguacaacuaucuaauuauauuuaaaaaguaauuuaagaaaaugagaggaaggaguacuuuggacucuggauccagcacugcacugacaccuaaaguagacaguggcuacacaaggcaggucaggcaggguugggauacucaugugaucacagcacacaggaggcuuggggagaggagaagcacggguuacacaacaggaagacaaaauggcaggaaaggagggaagccagcauccuugauggucacagacacaaaauucagcaaaugugagcacauggaauucagcaccauauaaaacagauaguguaaauggaauuuuuaaauguuauuuaauaacuauuauuacuaauaugacccagcaagcccucccaauaauugaagcagaguccuauggaauuuuuaaaaucagcuuuagcacaauuacugggugaauuuuccuuaaucuauuuuucuauacacuucacuguuaauucucuagcuucguuccccaaguauuugccauuugagucuugccuggcuuauuucugcucuaccagucuguccucacugggccaaguguuccuggucuaugacaucuaaggaagacccccugcuccccauaucauauuucuccuucuccccuuuccccuuuucccuucucccuucucccuuccuccuccuccuccuccuccuccuccuccuccuccuccuccuccucuuccucuucuuccucuuuuuaguggucccuacaugcuacucccagcccaggaacuuaaguucugucuacgucuauucuccaugguaauugacuguagcuauuuuuauuuaaccaguagcuuuaaauuggggaacaaggcuuauacaacaucauuugguguacaugaggaucugcuugcagaggcaaccaagucuugggggccaauauuuagcauuugaguacaaagcagcaccaauccaaccaaaucauccacacccaggauugcguuacuggcauauggggauguuccaagauaccaaucaauacguaugacacagcacgccaaaagaacgaaggauacuagcuuuaugauuagcuuacuggaugggggagggcaaaagcauaugacaggauucaguauguuuagaugaguaaaacuccaccaagauuuuuauagaaggcauucaccucagcacaguaaagacuuuaugcaagaagccuacagauucucaacagugaaauacugaaagcuuuuccucugagcucuggaagaggacaaaaacuucuacacucaguccuuauguuugcaauuguguugaauguccuucccagagcagucaggaguagaagaaacaaacucaccuggugauggugggaucuuccauaggaaaugcuacagcuugaaaacacuguugaaacuaccaaaauguagugaagagugugucagccuccauuuauaauagcuacaaaaaguaccaaggaauaacuaagacaaggacuugaacgaucuacacucugaaaauggugagccaccagugacuaaaauuaaaggaacauauacaugggaagaugccuuuagucaugaaaugggcaaaggaagaggcuugguuuuuaaacaagaaaagccugauuuuuuuccuucccuucuauaguuuuaagugauguuuagaaacucugugaaauuuuuaaaguguauuaaacucaucuucucauugcuaauugauaauacagaagggaggguaaacagacagauaggaaaaaugagcauccauuugcacacaguugaaaccucugcucucaagcugcugccggccagcacuguacauguagucauccacuggcucccacaaaccuacagaagagaacugagggagagagggagggagggacggagggagggagggagggagggagggagggagggagggagggagggagggagggagaaaggauggauuauuaauaguuaaaggggcuaaugcuuauacuagaauaaacguagaauauagauagcuaaggaauaauacuaucuccaauguuaacaguugcuccaagacucuugagaacugggugacaauccuagcuuuagcccagaaauacacugaaggcuauguuggugaugugauuuuuaagaagcgcuguucaagaaacuuguuauguucuuaguagaauacuuaccuaggguaggugaaguccuggauucuaucuccacaucuuauaaccuggagagaagugcauauauauuauuucaacacucacuggacaggugucagaaaucagaaguucaaauaaucuuuaccuucauaaugaguuuauggccaaccugcuauaugugagacucuguccaaaaacaaaacaauguuugaaauaaguaggcaaacaugauuuacagcucucuagugccuaccauaauugcaaauuauucuuccuaugauccagcaacccacaguagaucucucccacaaauacaauuaagccugcauaaggcuauuccuucacauuucuuugaugcguuguuuaugauggcaaaagauuagacagagcccacgaaaucagcaaguagggaagugaaucacaaauucagaacagcauugaaaauuaaaccaaagacgacagugcuuggcauaugcagaguaacacugaguauguaggcagggucuuugggguggaaagcaugagauaacauccacaacugaaucacguaaaacagcaaggccuuucacucuucuuugauggaguacauaaaaguacguaagucuggugugauugcauugcuucgguucccaguccugaguuucauaagaacaguacaugcccuuccacccugaggaaggugguccaggagcagguaagaccuccugucacugguucuuuuuguuccuuccuucauaaaugagauauggguggguaaggcuacaaguuagaguaucuuucuuugaaauuugcccauaaaacauuuuaaauuuuaacauuuauaccucaaagcuguuguguuuuguuuucuguguuugauuugguuugagaugaucuugcuguguagcccugauugagguuugagauggugugaaaggaugccuguucuuugaugaggugugucucaccgaacacaaauauaauugaaagcucagacagaggcuacaaccagucaucaacacagggcccucaauucugcuuucuugucaucagaaguaggaugucgcagaggcuuagauaugagcaaugggguuguauagagaagcaauagcaacagggugcugugagucugcugcaguuuugaugagcagugauacccacuguggugaagaaacucaaucuaugaaggaucuauaacccugcuauaauaacucuuuggaagcuaaauuggacauacagaacuugauacauguguuacauugcucuuuucuagugugguaacuggcauuacaguccuaugugugauugcacuuuagucuuugcuauuagaaaaaucucauaguuuugauuccuugcaaacuauagaguguuaugucauauauuuuuugucauuggaaauuagaggauauuuuaagcuauguauuucuuuacauaaacaguaguauauaauacacuuacaggucauggguuuucugaauuuuaaauuuuauauuaauugcuuuuauaauguuagcaugaaauccuuuuaguuuucuguggcuuaagucuuauuuccauccuuggaaaguaaagcugggcacuggagagaguuggugauuucucugccuacucuccuaugcugcauuuauucugucuacaaaugccaucauuuuuccaccccaugugagcguucacuguugauaccacaguguugcaucugguugauaguauucauuugauuuuuaggauauggcuuuaguugccccugaagcgccuucggaacaagccagaagaguuuuccaaaccuaugauccggaagguaagcauuugucaauacauuguauggcucuauaucagaaauaucaaaacucggguuguauucaaaagaugaauuggauuauuaaauggaaaauagguggaaguucuuuuaaagaaaaaaaaaaaaaaaacuuaggagaagcagcaaaaauggaaaucaaagagaccaagcagcaaagcuagcagaccauggcucccaucaaauucuaccgcugagugaauguguuucuucagauccugacuucuacuuacacuacgugucaaaggucaggauucacguauguaauagucuuucuuaguuccugaucuuaacaaacauugaaugaccagaucagggccuagagagauggcucagcaguuagagcauugcucugcucuuauagaagauccaaaugugguuccuaguacccauagguaggcucaccugcaaguccugcuccaggacaucggauacuuauggccuacacacacacacacacaaacacacacacacacacacacacacacacuaaaaaguaauugaacaaaaaaauuucaugugaaagaauaucauccugaucauuuaccuucugaucucauauuuacucuaccaaagugaguuuugaaaauggcacauuuauaucauuuauauguccuccgaggaguuuugauggccuuuucuuucuguacugaguuaaagacuaugccuuaaccuuguaucugccucccuuaaagucaccuuauucugacauaagccaucacauugaaaccaaaguuguuaggucaggggaguccuuuggagcucugaaaaccucaguuguuccuguguccccugucuucagcaggaagcucuuuacucuugacaccguccuuccccuuagcaaggcugcuuuacucuugacaccguccuuccccuuagcaaggcugcuuucuaaggguucugcgcucacugccuggucauggagcagcauuguugaugaguaacagaaaaggcggaaaaugaaaagucauugcaggacuaagccuagagguugcuuggccgggggcauugaugagaaaagaccucccuaagguagaucauuuuaggaagcgguauuauucgagggugaagaacacguuuugcuugcuuacuucuuauuuaauauuuugguuuacauagccuugcuuuacuaacacacaugcaaauuuggagaugaaaaucuuuuuccuuaauacuuuuucccucuaguagaagcaugaauuauauuguuuaaauuauauuacauuccccaccaugacaauagaauaaaugaaugggcuuguacuggccaccaccaguagcacuuuuucagggacaccacaucuuauaccugcuuuguuuuauuuuuuuaagauuuacuuuuauuuuguauauguguauuguguaugccaagcaugggguuagguaauaccacauguacgcagguacucucugaggccagagaggguaucagguacccugaagcuagaaauuaaaagugguugugaggcacccaaugugaauccuggcauuuucugcaaaagcagcgaguguuccuaacuacugagcugucucggccccuacguaucccauauuagaaacauaauggugacugguauuuguguggaacauuacaacuuagaaaacguuuuaccuccaugaauauauuaaagccaugucaugcuuuaauuuaguguuaaacuuuuaauuuaauauuuauuuaacacuaauauuaauuuuaauaucaauuuaauaaacuaguuuauuauuacuauuaucgcuauuaauaauugauauuaucaacuacuagugauuuaauauuaauuuaauaguaaagccaccuguauguggcuggugauaugggucagugaggaaguauuugcuaugcuggcauaaagaauuaaauuuagcuucccaaaacccacauaaagguagccagccauguuggugugugcuugugauugcacugcugaggacacggagacaggaagagcucugaaccucacaggcuggccagcuagccaagcuaaaucaucgagcucugggcucagugagagaccugccucaauaauaagguggaaaggaagugaggaaaacacccaacauccaccucucaccugcacacacauaagugcgcacacacuuaugaauacacauagacacccacagugacacacacacaaucuuugccaugaaucuacgagauagauacuaucaccuuuuuuucccaguguuuguauguuuaacuuucaaagguacguacguauuuuuaagaaccaagaguagcuucuagauguucuagaccaagaaaucucaaccccuccgagauaaccaaugucuguguuaggacugaagucauaaagaugcucaagccgcucugaacuuguuggcauuagacugcugcuaagaauuugguauugacucuccauuugcuugagcaauuagaauaguauguauuuuagauucuucaaaauucuagaaaucugcuacuuauuuggaugucaaacaaaguuaugagaucaaagguguauuuuuuaaauugcuaauuucucauuuggaauauuaucaaaaguuuaauuuuagcaaugccuuauuauaccauuuuaauuacuuggcaggguuucaugacuaaaucacagauuaaaagauggcaauaauaagcagcugcucagaacauaguuggaacaguuuaucaggcagcauacccucauguacaaaccuuuaagcacauccacaguuuuaucuguugaucauuucauggaggaaaguauuuggaucugggcuuugcucucagguaauugcuauaauaggaauuuuucuugaguagcaaugaaguuaaaagaaugaaugaagcuagacugacugaaguguccagacaaaggcagcagaggcauuuucuauugugcuuccuaagaugcugaaugucaggucgagaucugugauggccaauaagcagggggacuuuuccagauuaguguuccugucuguugauggccaaauaaaaucuguuugacauuuagaggcucugggcuuuuagcugugacuuaacuaagcaaaaauauuuuuuuucuaucuuuccaauucaucaaagcaagcuuaugggcuugaaugucuuugaaagugcuuucaaacaaauuauuuuauucuuuagaccucaaauuauuuguagcuggacaaguuguaguuacacuaacccuucacguuaaaaucugugcacuuuuaauuaucacaaaugaucuggagccuuuaaagcaaggucagucugucuugaaaagggugacuucugauaguccuggccugccugggccuauaaaaugaggcaucccaggugagcaacugcuuccuuuauucuguaguuuguuguaggacuuuuagacacauuuuuuagaaaauuacccaacccuugaaaaaaaacauaauguugguugcuaauggaaaguagaggcagucuccuggaaugagugauugugccuugugcauggaagggaauaagccagugacaguucagaaucgcugccguccagagccuuuugugucaauguauuuuucacaucagcagaguuggggccacuuucuaggcuguuuuguguauauacagccaccauuuuuguugucaacacuuaacuucuucauaaguuuucaaauguaaauacaacauuuccaugucaugccucuaguucucccaugugccuucuugcucucucaaauucuuguccucuuuuuuaaucaaauguuacauauguauguguauguauuccuugaucauaauuacaaccugccuagucuguauaauuaguuauuuguauguaugugaccucagggcugaccauuuguggauaccgaacugaagggcucuuccccaaagaaggcuguauucccauucuuagcacuuguucguugccuggagugcguugucuaggguggaguaccuaagauuuccucuuucccugguacuguguuuauuguuaucuguguucagggcuuguuuagacagacaugcuguugagacuucauggauguaguuucccuggcaugucuaggagaugaacucucucagagacuuuggcucauacaguuuuucuguccccucuugaaccauguucccugagccuuacguacaguuguuguguugcaaauacguuugggagcucuuacguguaacaugucaucagcaaauagggauaguguaauuucuuuuucugcuuacacuccuuuaauuucucucucucgccuuacugcuucagauugugcuucaagcgccauauugaaaaggaguggagacagugagcagacuugucuuguuuccggucucaguggggucgcugccaguuucugucaucuuaggaugaaguuaccuauggguuucucauauauaacuuuaguauguugagugucuuaguuaagguuuuacugcugugaacagacaccaugagcaaagcaacucuuucuuuuucuuuuuucuuuuuugguuuuucgagacaggguuucucuguguagcccuggcuguccuggaacucacucuguagaccaggcuggccucgaacucagaaaucugccugccucugccucccaagugcugggauuaaaggcgugcgccaccaccaccaccacccagcuuacaaagcaacucuuauaaggacaauauuugauuggggcuggcuuaccuguucagaggugcaguccauuaucaucaaggcauggcaguguccaggcaggcaugcuguaugaggagccgagaguucuauaucuucaucugaagacugcuagcagaauacuggcuuccagacagcgaggaugagggucuuaaagcccaccacccacagugcacacuuacuccaaugaggcuaaaucuccuaauagugccacucccugagccaaacauauucaaaccaccauauucuacucccuggcccccauaggcuuguucaaacacaugagucucugcaucuccgugucuugacggcaaagcagucuucagaucucuacuccuuuuucaucuuuguugacugcacaaacuuuucuccugugcucauuccauuccccauuaguagcuuuccucagcagguaucccaugguucuagcaucuuuuaaaucuuggggucuccaagugaacuucaacuucacagcuucuuuuuccagugucuggaauccacacaugaucuucugggcuccuccaaagggcuugcauuauuucuccagcucugcccucuguaguacucuaggcucugauugauuccacuccaaugcugcugcuauucuugguggugaucccaugguacggacauuucuaauacacuggggucuuuagcugcaacuaggcuucaccaauagccucucauaggcucucuucauggcaccaagccucaacuucuuugcaugaccccuucaauccuggcccaucgucugcaacuaaggcugcaccuuccuucaccagugacauucccuggucucucagugucccagccucagcugcucaccacaagcccuucgugccuucaaaaccaguaucacuuaaauaauucuuacacauuaccaagucgagcugcaccaggagguacaaucuuggcaaucucuggaacacagcuucuuugugcucucagaaaacacuucccagauuucacaucagugaugcugaucucuucuuaaacaccacuaauuucuuuucuccagcuaaccagcaucaacuaucccaguaauugcuucuauucuuuacucuacagcuggagucacauggccgaagcugcauaguucugcugcuugccagggcuggaacauguccccauauuauacuauauuauauuauguuauauuauauuauauuaucgccagcuuucuguuuuccaacuuucacucccuaagcuuggcuguccuggaacuugcucuguagauugaccuugaacucagauaucugcaugccugucuucuaagugcugggauuaaaggugugguuuaccacauagagguuuuuuuuucuaucuaaaacuugcugugucucaggcuggccuugaaaucagagaucugcuugccucugucucuuaaaauuaaagguguguaccaccuugccugagccuaagcuuuucauggccauuguuccuuaagauccagaaaaaaaaaaaaagaaaguccaagugaaaaaauuauccaaauaacaauaaugccuaacaugauauaacuauuccuuguccaauggcaaacacacaaacaauaagcuuggcugggugggauuaugcccuuacucuguuuaucuccuugaauacaggauucagcuccauuucacuucguggugucuguuuauuacuugaaccauacauuuuauauuuuuccuuucuaaguuugcuaugcuuguucaaaauguucuuccugagacuuaaccagagaacaaagucucuguuggacuuucuugagacuuccauugucaaugcaauuaauauaaaucucuuuaccuuagccucagguacacucuucaggcuuagguagaaugaagucagaugaacuccugggggccggauuggcacacagaaugugaauucuggugaauaucuugaauaugaaggcagaucugagauugggagagguauauggagcagacagaccaucagauagaguucccggcuagacgcugguacaagauggauaagauuuagcugggcagagagauuagauacagagaggaaggagccugcagacuguaagcagguggcaugcuccuauguugagccuggaauuugcggacagcacauuugccuccacuacauuucagcuuuagcuuuuuuaugcagguguguuggugauauuuugucauguuuaguuggaauguuuuuuuuaacugaaucuguagcuauuaguuaaugugaagccuauuucaagauuuuuuuucuuaguuuuacaccaucaguuaucuaaauagaacuggaucacuccauuuaguaaaaugaaacuguaacaaacagaauuugugcugggugguggugauucaugccuuuaaucccaucagucuguaggcagagacaggcauaaguuugagaccagcuaggucuacagaacauguuccagaacagccaaagauacacagagaaacucugauuuaaaaacaaacaaacaaacaaaagaauuuguuguaaauaauucuguucacuugauuucuucaugacaauuuaaagauuuagcuaauaccugagugauguuguuauuuuaaguggaaagaguuuuuacccauuugcagguuugucaagcuccucuauuaaaaaauagguuaaccuuaaaguuuaauuggaguucauaagucgauuuuuuuuccucccuugaagauaaaucuuugauuauaugucuaagaaaauucaucugagcaaguaccuaggagcaaugagcuuuacugcaaaaaaaaaaaaaaaaaaaguucuucaacucuuuguauuccuaugaaguccuccgcuccuccccaggaccugaucagaaauguucguauuccaacuucucuuuaauauguuuuucagauaauggauucauagcugacucccuucuagaagaugucaugaaagccuuggaccuuguuucagaucccgaguagugagugcaacuggaaguguuauuuugaucuaucaaaaaaagauucuaucaaguugaaacauuauauacauuuuuacgcuauauauaacaaaacaauaaaaauguauggaaaaagaccuaauccaaucugaggacagaaguuaaucugccuguauuauacauacuguugcuucuugacucuauguuggguugucuugcuuuuuaaaauaagucuuucacuauaauuugaauuuuuucuaucuaaaaagacuuugguuuugaggcuuucuauauuuauauauauaucaauugaaaauagugacauugccuuugccucagaucacaaucuaauggccuuccucagacccucugaauccuuugcauggagcaggcagaugauaccagaagauaccaaggcuaugguagucaugcucuagcaucuccuagagcagaggccacaugucacugaaccuggcuagagaccucacacagauguaacuuucauaagacauauuuuaaaaguuuuaccccugaacacaucgcucaaguuccauuucuaauaaacaaaaacccuugaacucacuuaguccaaacaaguagaggaagggagaaacagacagauacccgccgagcucugggaccuucccaggaagggaauccuuaaacccuuuugucuggcuccuguuccaguccuucucagcugucuguugguaaagagccugagccacagacuccccugagcaaguugaucagccacaaugccucauaacccccaaauauggcucucugcuuguuacauagugggcuaaguuuaacuuggcauuuagaguuugaaauagcacugggggaaaaccucuacauagacagaccguugaugguuucacccuuugaacuucacucuccuuuucccugccuccuagagcugcucacucucgacacucuccaccagccuccauuacaccugauuggcaggagcuggaccacaagggcaauggcacucacugcaguuuccuagacucaagcuuuuaugucuguguccuucaaguuagguuguccacagauguuaagcaucugucucaucuaguucuuaacguaacauucugaaaggcaugcucuucuuaucugauuuaccauugccucuuggcuugcucuaacuccuggagccuaaaauaguuuuuuugagaaguaaaugcucuauuugauuguugaauuuaguacuuaggaagcaaagagacucugucuuugggagguuguacccugaguuuauaaaccuugguuuuuaaauuauuuuaccuaauaaggaacaauauucuaaagucaucgucauaauuuaaauuuuaaauaguaacagauuacucugauuuaaaaauagccaaauuuuggcaaauuaagugucauuccuguguauuugucauuaaaguucuaaaaagaacagcucuuaggauuuuggcauccaaaaguguagcaccagaaauuuaaucaugaaagagcaaaauaguuuugugguguuuugucuuuuuugguauucacuguuuuucucuuucuuuuuuucucccuauaguauaaaucucaugaagaauaaauuagauccagaaggacuaggaaucauauuguuggguccauuucuucaagaauuuuuuccugaucagguaacauauuccacagaauauauugacucauuuguucuguugagaugaucaucugugaacaagauuguuuuccccuaaaguguagauaugagacuaagaaaaagaucuauuauauaaaggccuuuccaugcagagguuaggaagauaggagcccauaugcuguguagugcucagaaaacacacgugucuguacacugauauagugccuggggugaggugggugucucaguggugccaacacauugauacaguucucagagggcaacuuuguauucuauuacagugcugcggugcucugauguguaaguacugguacagugauagaguguaugucagcacagugguacaacgcacaaagugauucugcaagugugcacgugcguguguguguguguguguguguguguguguguguguauguguguauuaguguaugugugguguguguguguguguguguguuagcaacuuaccccccucaucucaucggguauaugcuguauauggaucuguguccugguacaauuguauagaccucagaguauguaugucaguacagugauacaugugugguauguguguucauggagccauacacuccucuaauuuggaggcuuuaugucacuacagugcuacaauucucugaggcuaucagugugccaguacauuauuuaguacucagaauucugauggguggcagagaaugguauaagacuaaaaaagggucaagccagaugugcauauaauagaaacaucacacugcuuccucugaaccugugcucacacucucagggccugccgauuagcaugcaucuuagaacacugccaaagaagggaaggguaggggcuucuaguaaugagcccgagugcuagaagaaaagggugaacagaguggcuuuguuuguaguggaguagcacugacuccucuaaggacaagucuuccauugggcuuugaugcuucaguuauccggcucuguucucacacccuuggguugugccugcguugguggcagacuacuucuauaucaugcacaggucuuugucuuuggucuacaugaaacuuguuuuaccacugagcuagucagcguaauaaucauggucacaucauaucagcaguuuaaauuguuccaauagaaaaugccaauuuuguguaacuauguaguuauuuaauagugaugugcuugcuaauuugauaucuugggaacaaaucagacuggaccagaguaauuggcauugguggcauuuggucuuuuuuaguagagaacauagguuccuguuggugauuaugaauaauggaagugaguaguacaauucagaaagcaaccaauacucuaacagcauaggaaauugagcuguucaaacuuuggcaaauaauuuguggaaaaaaaaagacagaacaaauauuuuuuuucuaacauugaacggguacuguuagauuauaauguucaauguauucccauugggcuuuccugaaaguuccuuuuuagagucuaaaauacuucagaugugucaguggauggucaguuauaggauaauaaagguuugaagcaauauuugaagcugugguuuuuaucccaagaaggcugaugccagggcauuauuggaaauacugaauacuauguuuuaaguaugaagcgcaucuguauggggugggguugaaaacugcuugugcagagucagacaguuacagguuccuucgaccgcgugugugcucauuacauaaugaugauuaacauuaaugacuuauuaguucaaggaauugguaguuuuauguuuugugaauuuuuuugcauauacauuucuuuuucuuuuuucuuugauaaaaugcuuuauuagauauuuucuguauuuacauuucaaauguuauucccuuuccucauuuccccuccgaaaauccuccuaucccauccccaccaccaccaccaccacuaacccacccacuccugcuucccuguccuggcauucccauacacugaggaaucgauccuucacaggaccaagggccucucuucccauugaugucucacaaggccuuccucugcuacauaugugguuggagccuugagucccuccauguguacucuuugauuggugguuuagucccagggagcucuagaguuacugguuaguucauauuguuguuccacuuguggggcugcaaagcccuucagcugcuuggguccuuucucuagcucuuucauugggggacccugugcuccguccaauggaugacugaucauccauuucuguauuucucaguucuuugaggaugcacauaaugaacguggucauuucuuccccagggacgugugcccuuuucguuugaucuaguagcccauugacuccagugaggguaacugccuuuguggcaguguuccuugaggugguagaagaauguacuaguucccugcuacuccacaggaaaugucuccccauggacuagugaaucaggagcugcggggacagagcacagcaguguugcagcaccugcacaugacucuaauggauuuccaccuuagcacauuagcacagcugccuaccucacaggagacuuucccacuucuaccuauuuccauugugugggaacuaagacccuugugucacacuugccuucccauguaagcaauaccacugguguccuaucuauacucagugcacgccagcacugucccucacaccaccagcguccugccuaacagaugaguagaagggcugcucagcaagcauguuuggguagcgaagagugcauaaaggaaaugacagaaacagguuaaaauugcaacgaggaaaagaguuaagucagucagcuuuccuaagcacgcuucagcuagcuacagugggaggguuugugguguuaggagagagaacagcagaagcagcugucuucauugagcauauccuguaugccuuauaaauggaguacaguucuccccucaguuuugguagugaagaugagaaaauguauagaaagguuugaugucauucagcugguaccuggcugaccugagaguccaucacuucucccucccccagaaggaaaagugccugcagcaacuacagccuuugugguguuuccaugugccaccugauugauuaguuauucccuagagaauacaaauaguacucaaggaaggaaaauguuuaauuuauaaguuaaaauaaauugucaaaaugaagaaccaagucacugucaucuaaguaaugacagugaucaugaguacaauuaaggaaacagucaccuacaugaugaaagcuuagauuuuagcugggaaguguuaaagcgaauguaaaauguaaagucuuccagaauaacagcccaaugauguaaagucacuauucucaaacuaauugagaaagcuuugacuuacagcuuccagaggaguaagaugaccagcuuguauguucaggaaaaaaaacaaaaaacuuuacaggaaagaugugggaugggucuuagaaaaugcagaaggggcauuuuagaaaggaaugugucauucuuguuugaagcggaacucaaaagcugcucccagagccugaagccuagaggaagcccuaacccuucccagagcucuccaccuuccucacucucucagcaaagcugcauccuuuuaacccaucuuuugcucggugcuaaagcaagaguugccagcagcucacuucccaccaaguagaaaagcucucuggagggccuguggcccagcuggguucauauaaaaucuuucuuacgucaggaauggccagggagacaggcuggagagcaggaaauggucuacaggaaaucagccgagggccaggcacuuugggugggaauaaagucuuguuaagcaugauauguuuugauuucugugaaaugguauuguuuaaugagaacuugugauucacuauugugggcugaauugaagcuguuggugaauguggauuugugguuuaaauagaggugguguugcuugguucuccagugaggagcaaauguuuugcaggaugcauuuuaggagauacuuguuaggcacuuguccuuuuuuaauguaaugcacacaucuacuuaagggacgagccagugcaaaggagcucaugcugggcagggagggcuucccuguccaguggcaacuucccucucucaacccuucuggcagcuaacucuauacacgcugucuuuaucaagugaguucccaaucacaauaaagauuaauagauuuucaucuuuauaucuguugcucauuagaaauugcuugauaaaaagauauaacuuaaaguuuuaauaguccuuuauuuauaauagggcuccagugguccagaaucuuuuacugucuaccacuacaauggauugaagcagucaaauuauaaugaaaagguaugagaauucacauaguaguuugucuucagcuggguugaugaacuaagugggcaugacugugucugaguccccugcauuugaaacuucaggaugacguuccaggagacucccugcugcagcacauguguaagagcuggcuguauucaguuugacuaagcuguaaccugccuucaagcucugcauggaucuauggagcauuuauuucacugugacaaaauaacuauauguuuacucuguacacacuguuacucuggacuguggcuuuacuuccaagucagcaguucucgguaauccaaagaagguuguuauucauccauuuaaaugcagaaguaaauaacgcugacuuguuuugaugcugcuuuuguuuuauuuaccaaauggcuguagugggcguuuaccuagucuuuaguugcacaccacugucugaggucaguguugucuguauguggcucuuugcagagaggacucaacacagggaagcagcuguccagggccaggagagggcagagcugggaccgaggcugucaaauguuccgagccugugguuuuccucacuuugcuccgcuccucuccuuucuaagucuuggacgaaggcacauggaugccugcgucuggcuguaccagccugccugucugagcacuucccucuuuugaaugaaaugccaguuuuuguguucuaguggcaagucuguuguguuuacauuuauucuggaaaaagccacagucuuuuauuaggaguuaggccuuuucaauuugaucucaugcuguuuggaggauggcaacagaaacuacaucauaauguaaauuacauacuucacuaaaaccaaacuaaaaggcuaaauuuuacuuuuauuuucauaacaaaauauaaaccaaaaccuuucauauucccaaaaaucauuuccugaguuuauugacaucuguaauauuguacaaucaguaagagccccugggugcuguuucuuauuguguauuaaugaaugcucgccuaguuguugaaguuugccuagcuucgucaucacgaaauauuaauucacugccacaaucccugcaagguagucaaauauuauccauauuuuacagaugaggccucugagacagggagauuaagugacucacccagagucacacagcaagucauugacagagcagggauuggaacugaguuccugauucccaauccuguccuuggucuucuuggccacgcugccuguauauaguaagucuucaaaucaugcuugugacaagcaucugacauacuaacacaagaucagaaauuaagauauauggaaaauuaacaugacauacuauguaacaaccauaaaagcaacgcaugcaucucauuuauacaaaaguauaagguccugaaguuaugcaggggcuagaaacaggccugagugcucagucaagucccacucaagauagcaggcuaaacaaaacaaacaaacaaacaaaccaagaggggucugcuaguccaggcugcagccaccaggccaggcagcagccacuguggaaagcacagacuagaucccacugcuuugcagagggguuccugcucugauacagugagcaacuggggaaccaggcccaguccugacuuauaucccuuuagacaacucuuuagaaaguagcacuuuuguucugagguugaaaacucuugaguuguaauuuaaauaugaaauuguauuucaccguaaugccuuuggacuucccuaaaaaaagccaaauuuugugaccuaguaguguagcauucuuugccuaggcagcuguguuuuuaagggaacucuugcugaaggcugauaagcuuguuucuuuuggcuccuuggucgcauagcuuauggcuuucauguuaaaacagaauugcaaucauguguaucagacacugaguggguaaaaauagcuacacauacucuggaaaagggcaguucauagccaccccuuucaauuacauauuuaauauaaaauuaacauaacuugaauucuugauagugaguuaggguucuacugguaugucaaauaauuucaaguauuuucuuugaaaaaaaauaagcaaaauaauguuuucugguaucuucccaacaaauuauaucaaauaugauuauuuccacagguuaguuuacucugucauccuuccaugacucuugugucuguccucacaucuuugugauuuuuuuuucuuccaugauugucauacaauguaaaauacacucaagaacugcauuucaaaaaccauucauuccagagacagcagauuccauuagcaugcaugcacgucaucuuucaaucugaagugcacagaagugcaagucagagggcauagcaacucucuguugaguagcaggagcaacugauugccuugguagcccagccagaggaaacacagcaugccauguggacagcaggggaagacaugcccuggugucuaucauuugaagaaugauuugucaucuaaaaguguaugcuuaugauucaccuauuuuuuuuuugucuugaucuggaauuaucaguuuuaccaguuaacuaacaauuaaaauguauguuaccaucucauucacaaguuuguuuugcaguugcucuaguuggguauaauuccuacgaaaagaguuagaugugaagcucuacguaacuugcuuuuagaaaugcacuugccugugacguugucuguagcuacggagaacuggcuacgaacauuaacugaccuccuggcuuuuccucucggcagguaauguauguggaagggacugcagugguuauggguuuugaagaccccaugcuacagacagacgacacuccuauuaaacgcugucugcaaaccaaauggccauacauugaguuacuguggaccacagaccgcuguccuucgcucaacugaguugccugaguauuuguaaggaagauugucaaaccagguguugaaagggggauucaugacuggcuacauaaagcuaaacacugguauuguuaauuaacuauaaauaacaauuaaaaacacauuuuucaguguuuaagauacguuuaaauuauuuguucuaaagcuuuauguuaaagguuauccuauuuuacuccuuucugugaaauuuacuaacaaaauuaagcuuuaauuaaaguucaucgcuucugcagucagggaacugguuguuaccagauuauaaacacaauauuauagcauuuuuauaaauggaaucagucacaaaaaccugccuggaauaucacuucauucauuucauuuuacuguauuauuuuagcagccuccauaucaaaaugcagaagucaauuuuuguuaauuuuguuuuucaucagaaauacuaauaaaucacaaauuauagacccuggcuauuugguaacuaauuuaacuauagcauguuuaccaaaaaagaaaauaaaauaaaaauuuuuuuaaaaaggcuacuaugugggaacuucuauuuguucacaggugcacaggaaugugguuuuuacaacgauaggggaagaaucuguuugcuuugugggcuuacuauucucacuuucacuguauugcuaaguacacucuccugcaagccagcuuucuuguauauuuauaagugugguaaugcaugagaaucucuacuguuacauuagcauauugcauuauuuauuauggccccagcuaauaccguaaauaaagacuuuucuuuaacuacac

SEQ ID NO: 637 - RNA, 2603 nt, Mus musculus
ucgcaaauaccacuugcuuuauuguaagaccuucaaaggccuuuggacaagggaugacuucuccugcacgcugcauuuuuaagcaaaugcaacuucaaguccaaugauggugucuccugaagggcucugcaacuggaagccucugagucaaaugcacaugcaugcucaagcccuuggcacuugugaaaagaaccagcccuccuccuuuugggcggugggcaaguucauuuaaaucaagaaauguccuuugguuuuuaaguacacgucacuguucucaucuuauuucaucuagaaggcuauggaagcaaaugcuaagguuaaaaaaaaaagcacgcacaucuacugucuggaaaauuggagagagcccuccuuauguuaaaaguggcauuuugaaaaacaccugaagcacugauuguggaugagccagaggagaaauguugucaucaaaccucccuccuuucaaccuucacuuccaccuccaacaagagcuguuggcacuggggaaauagauuuaggugugacccuugaguccugagagcaguugcgcagcugucucccucccccuaguaugaccagcuagggcgcugccaucgucugggcuagacaaggaaguauucaggguuucacuguucaucccuugcugagaggggggagaggccgaaaaaaaaaaaucccacauugucagaguaaugccaaacucugugugagugggaugagcagagcagaugcugcagagagaugccaaagcggcuccccuuccucugugccuuggguuccuauaaauugcuccggcgcgcguuugucagccuccucuucuccuggcaggugguacccaggcagaauucugcguucagcucucucguucagcuuuucggcggcgaggcucucgaugcugcuggcuagcuccuaucuccucugucccugagcuucucugagccgcggauccugcgaauugccauugcuccgcgcaucucaggggccucccgaccccaagcaaccgcagcccucuaggguuggggggugcguuucuguuggaguugcaggagaaaaagaaagaaagaaagaaagaaaaaaaaaagagacaaggacagacgaaccaagccaacaaaagaaaagcaagaagcagaaaaaaaaaaaagggcaacuucagacagaaaguuggugagaacuggcgcagucugcaaaaaaggaaaagucgaucacgggcagcagcggcauaaaagugugagcugcuccggacgagcgcagcaggcggcagcuggcuuugcccuccggguggccgcuccggcacccgccgcagccacaggugcgaaggggcuggcaggaggcgagagggcgcccugagcaccccuccccccaacccccacccccagcucgggacuucaguucaagucacuuggcgccccagcucccucccuagccgcagccucagcgggggggagcaggagccggucaagagcgaccggcgcgcgcccgcccaggggaguugggguucgaagggggauuguuuucggcucugaagagguccccgcccaaccuucaaaauuuuguccaaaagcagacaagaggaucggcccgcgcugagccggcucgugggcagcaggaggcgccugaucgccgccggggcgcuggggguggugauggugcuucugcuggucauccucaucccggugcuggugagcucggccggcacgucggcucacuacgagaugcugggcaccugccgcauggucugcgaccccuaugggggcaccaaggcucccagcaccgccgccacuccggaccggggccuuaugcagucccugcccacuuucauccagggucccaaaggcgaggccgguaggccggggaaggcaggcccgcgugggcccccgggagagcccggaccgccgggccccguggggcccccgggcgagaagggagagccgggucgccaaggcuugcccggcccgccuggggcgcccggccugaacgcggccggggcuaucagugcagccaccuauagcacggugcccaagaucgccuuuuacgcuggccucaaacggcagcacgaaggcuacgaggugcucaaguucgacgacgugguaaccaaucucggaaaccacuaugaucccaccacgggcaaguucaccugcuccauaccggguaucuacuucuucaccuaccacguccugaugcgcggaggggacggcaccagcaugugggcugaucucugcaaaaacaaccaggugagcgcgggcaggcaguggggagggcggagaaggugcugacaagagggaggagaccccggaaaugggggugggagcccgcggaggaagggugcggcaacccggcuccccgggcuaaagcgagggggacucugugacaugcuggaaaggcgggggucauacgcagaggagagcgccuugcagcccagacaagguaguuuuagggugccagaaccgugcucggcgcgugcaauugagagcauaacccucgaggggcgagaaacugggaucuuggccccggggccaacucgugaacuugcagcaacugucuuacagcaggccgggaaucccuggucuguggcauuaucugcaguuuagagucgcuuccagccuuuu

SEQ ID NO: 638 - RNA, 8904 nt, Mus musculus
cgccccuccuaccagcgcgccuagucccacgccccuuuggcccagugccagggaucgcuuuacucaacuuuccagagccccccuuccuucccccaugaauccuucccgcgaucccuucuuucucagcacccaagggugaguagagaguucgggugaucaccaggaaagccccugaaaggccuagcacuuccaauuaguaacaggacugugcuugauacccuacagcccuggaggaaggcucgaggggagcucccucccccaccccccuuccucacuucuuuccggguccccauuggcuggcucgcucggcggcuaggauggcagugggaggggacccucuuuccuaacaguguuauaaaagcagcgcccuuggcguuguccaguccucugccacucuugcuccgggaccccagagaccccagcgcuccuacgauucacagccaccgcgcccucauucccuuguugcaguuuuuccagccgcagcaagccagcccaccuucgaagccaugucuaccaggucuguguccucguccuccuaccgcaggauguucgguggcuccggcacaucgagccggcccagcuccaaccggagcuaugugaccacguccacacgcaccuacagucugggcagcgcacugcgccccagcacuagccgcagccucuauuccucaucccccgguggcgccuaugugacccgguccucggcagugcgccugcggagcagcgugccgggcgugcggcugcuucaagacucgguggacuucucgcuggccgacgccaucaacacugaguucaagaacacccgcaccaacgagaagguagaacugcaggagcugaaugaccgcuuugccaacuacaucgacaaggugcgcuuccucgagcagcagaacaaaauccugcuggcugagcucgagcagcucaagggccagggcaagucgcgccugggcgaccuguacgaggaggagaugcgggagcugcgccggcagguggaucagcucaccaacgacaaggcccgugucgagguggagcgggacaaccuggccgaggacaucaugcggcugcgagagaaguaaggccugaccuacgcgagugguggggugugggagggaggggaguccugggccuugcacuggggcugccacgcccuuggggauguggcugggguggcgguugucuggaggauagcagaggaagcgggccccacccugaaccuaaacuuugcagugaacauuucucuuuucgccucacucaagcacuuccauugaacuuuuuagaaaguuucuuagguccuucuucugggcuuacaguuaccagacaggaggaaagaaugggugugaaggguuccagacaaagagauggcaaaggcaucugggauauugggacaggggauuggcuguaauuguaagggaagggcagugauugucuuuuccagugugccccaacuccagcuaacaccugcagagagcugccaccucgacaaguugcaguaacuacuguggguggaggugucacagcagcucuggacucaaggcuuggcggcauuugugguuggguguggccgccccgccccuggcgguuuuccaguuccccuuugauuaaugugcugcugcuucagauugcaggaggagaugcuccagagagaggaagccgaaagcacccugcagucauucagacagguuuguagacuucuuuuucacaugcagccagcagcccaauggagccaacccgcgagcgguucuaaaaguuacuucccuuagguuuuaaaaggugcagaacuucacgucugcuuguaaagcccccuggcggcggaaagcgcacagauugaaaaacuccacuauuuagggcagucuuuggaacaugaaggcuuuauuuucugcuucguuuccagauuuuucugaucccccacacccccgaaacauuucuccuuucguuuuuugaaacauaucgacauucggauauugaaugguuacaauuugauuacauuguggauugugaaggugaaauuggcuaacuuucacaaggucauaaaaaccacaguugcuuccuccaguuggaaauguagaauacucuggaggaugagaaaguuuaacuggaauuaagccaaguucccuuucuuccuucgaaguucggcacugcgugaaaguuagcagaagagucauugcacaaccauuuuugaaaucuaacaagggugaaaagaagccaucuguucccguagcucaaggguguuaaagguuucuaugggcuucacuauggaauguagauagggacguucuggcaaaugcgguggcucuggacagaaagaauaggggccuuuguguucccagagcagcuuugcaacaggcuacauucuuauugaauauguaaugauguaaccacaguuccaauuggacacaaguauuugcuaacauccauuaucuugugucugggccaggcuugugagguaugccguguacaaaguucuuaaagcuaaaguccucccucacauuuggaaaggcccccuuuuagggggguuuguagacucauuagcacccuccacaaacaaaauuaaacccuaaacugaagaauggaguauuuuauggagggaggauuuguuuguuuguguuuguuccaggguuaggcauuaccuuagcaucccgaaguggacagauggccaguucagucuuguuuggaacacuuguuaggaucaacagccaaacucuccagaugaauguucuaagguagcauucugaaggcauuugcauccuuaauggcaguagacgaauaugcagccccuuucagucacugggcauuuucagucaucaccaaaggaauguuuucuacaaagcacugaguuaauacacaccaucucuuauuuguggacuaaaaauuguuucauucauucauuuaaaugaaaugacacauuuagcugaacuuuuucgagaagguuaguccaauaucauuuauauauuuuuugauggcuuagcagaagucagaaaugaaugauacuacuauuuaaguucuuauauucuuuuuuaaauuaguauuuucuuugggacugauagaguaacucaacauuauaguuauaaacuauacugcaaauacaguugcuuacaagggaaguuuccaaacauuuccuugaaaggaaacaacauuucacaugcaagauugaacagucugucuuaaaauagaucacuuuauaaaaacucugcagagaaguuuaaguauaguuucauuguaaguguuuugaucugucauccuaaaacagacaaagucauugaaauaacacugugacagcugggacaggcagaaauacccuauaggcugagccaggguguuuuacacauuaaaaaaauuagagaaggcaaaacaauauaguucaggauuauauuucuuuuccuucuugcccgaggagcauaucucugcaaaugcaagaccuggauuuugaacaaugaauuacuacuugauacgaggcuagccugggaaccuggaugccagauaacugagugcuuauucuaaauuccaaagauaagcaucugaagguuugaauacaggaaacaaaaaagagcaugcauauauguuaacccuucugagcucaauuuuaaaugauuuuuaaaaaauauguaauguguuugugucugugugaguguauaggacauuucugcaggcuugcaugaggccagaagagggcaccugaugcccuggaguuggaaucauaaaccuucaugaacugcuccaugugggugcugggaaccaaacuaaaauccucugaaagaacagcauucuuuacuacuaagccucacuuuagaaaacauuuuaauuuuauuuuugaagcucucauuuuuauauuacguguacucaagcaaacaugaaguuggacaaucucaucaacuacuaucaucacaaaauuacagacuuauuaaaugugacagagguuuaaaacugaaaaugaauuuuuccauauaguucaccauaccaugucauugugcauauacauguguuuauuuuuaacuugucuacuaguuagcuucaauacaaccaaaugguuuccuauucauuuuuaaagcuaagaaugaauauuggaaugugacccuaaaugauuuauaaauuuaucaagggucaugaaauuuucagcaccuuuucuacaauaaggagaauggguuuacaugguuaauuuuugaacaaauaaauaaauaaauaaauaaauaaauaaauaaauaaauaaggggcuguagagacaggucaaugguuaaaagcacuggcuacucuuuuagggcaccuggaauucaauuugcagaacccacagggcugcccacacucuucuccaguuccagggcaucuuuugcucucuuauugcuuuuguggauaccacaugcucguggcauacuuauauacaugcaggcaaaacaccuuuauacacaacauaaagugaaaaagggauuaauauaaauaaguuagauaaaggacagacuuuaucacccuccacaucaucuuuucucuuuucgaaauaggauguugacaaugcuucucuggcacgucuugaccuugaacggaaaguggaauccuugcaggaagaaauugccuuuuugaagaaacugcacgaugaaguaagugacaccaauuucugugggugaacaaagcugcgaccguguagucuacgaccucucugugucuguucuuucuccaggagauccaggagcugcaggcccagauucaggaacagcauguccagaucgauguggacguuuccaagccugaccucacugcugcccugcgugaugugcgccagcaguaugaaagcguggcugccaagaaccuccaggaggccgaggaaugguacaaguccaagguaugaaaugagccagaguggcaagaaccucuagcucucagacacgugccucuaauuccauuaguaaccuccagcucuacucagaagcuggcuuaaagcuuggaccgccauuguuguuucacagcaccccuucccccucaucuccauucacaguuuccuuuaguauggcagacucccuuuccacucauugucuucccugacuucaaagaauaccuuacucucaugcucuugacugccaccacuuggaaagcauugcaguagagcaaauacuguuugaaaacgcaaugcugguguucugcuucucuuucccugguuuuccaaaagacguucagacaaauucuaggaaacacacaggcaggaugaagaugccucuuuguucuaagugagugaaaacucauggaagugaacaaucucuacuucuuuucuuuucuuuucuuuucuuuucuuuucuuuucuuuucuuuucuuuucuuuucuuucuccuccuccuccuccuucuccuccuccuccuccuccuccucuucuucuucuucuacuucuucuucuucuucuucuucuucuucuucuucuucuucuucuucuucuucuucuucuucuucuucuucuucuucuucuucuucgacuaagcucacaaccaaaaacaaccucuauuucugauuccuucuugacaguuugcugaccucucugaggcugccaaccggaacaacgaugcccugcgccaggccaagcaggagucaaacgaguaccggagacaggugcagucacucaccugugaaguggaugcccuuaaaggcacugugaguacuacagcagcaaagggggggaaauaccgugcucaguacuauucugcugacuagguuaacaaugagaccuguacaaauaaauuaaacacacacggacacacacacacacacuuauccaaagagaaugaauuaucaagauaguuuuaaggauuauuuaaugaguaccuugaaagucuuaguuuacauauguuauugauuguaauaagagggguuuuagagguuacuccuguaaccucaucacucuggagaaugaggcagggggauuauaaauucacaguuaagcuaggcugcauguaaaaguguuauuucaucaaagcaaaacauggaacugggugcuuguguucucuguucaaagcuagugggcaccuaccauuaaaagaauuacuguaccuuauuuaugaauauuuugggggacagccggguuuucugggaaaucacaugagaagccauuuuugcuuucugcagaacgagucccuggagcgccagaugcgugagauggaagagaauuuugcccuugaagcugcuaacuaccaggacacuauuggccgccugcaggaugagauccaaaacaugaaggaagagauggcucgucaccuucgugaauaccaagaucugcucaauguuaagauggcccuggacauugagaucgccaccuacaggaagcugcuggaaggcgaggagagcagguauagaaggcaaacgugcaugugugaacuaacucacagucgucuuucuaggaagaucucauuuaacccagacaccauauauaugaggaacuuaacguugcagagaguaacuugcuguggucagagauaauuaauagcagaguagauuugaacucacagccaugcaaaagacaauacguucucccucuauaaauucuucugguucauguuucuguguggaaaaaaauaucuuccgaaauuuaaaugggccaaugagaccaagcauggguagaaaguucuuaaacaagucacuaacagcaauagauuuucauuugguggaaacaagaacugcgaaaacuuguuccugcuucuugaagugcuuuguucucaaguuuuuuguguguuucuuucucuuuuuauaggauuucucugccucugccaaccuuuucuucccugaaccugagagguaaguacauuguuucaucuuaugggaaaaaaaugucacaaggcugucaccagucacucugccuguagcauagcuuccacauuuuuaaaaauauuuuuuauuacguauuuuccucaauuacauuuccaaugcuaucccaaaagucccccauacccucccccccacuccucuacccacccacucccacaguaauucuugauugaacugugcuuuuccaaagaaaauucaaugaaacaugauuucucuuuuauaaauacauguguauagccauuuuauuuucugaauauuucuuuugggcuucugagguucugauagaguuaagucacuuucucgcuuccguuucuucucucgaaaccuuccauguacugcccccugacauauauggcugucuuuucaguucauggcuuccuuuuguuuaaaugcuguuacacacacacacacacacacacacacacacacacacacacacacuguguauucuuacauacaugaguacaauggcucauucuguauaauauuacuuacauguaugcuuucaggcucgaccaucuggucccuuuuuuauuauaguucucaugacugcuggagaccaaacccagggcaaucagcuaagcuaaacccacagagcuccaccccuagccugauacccucaguuucaaacucgaguacauucuugccuuugcuacccuguuaaguauagacucagucuacuuccugcuaauggcaaagucagugaacuacuaccucagccugaaugaaggagcccuuaggugcuguguacucaaauggauagugcuauguaggauuauguaugaguagcacuuuaaauaaccauaaaaauaaagucaugaugcuuuggguaaaaugguaauguuuuaaacuuuuucuuauguuacugccuuuuuuuuuuuuuuuuuuuuuuaauucagaaacuaaccuggagucacuuccucugguugacacccacucaaaaagaacacuccugauuaagacgguugagaccagagauggacaggucaguauuuuuuaguuaaaauaugggaaaguuuaaaagaaggaaugaugaauaaacuauacaaccacuuuaaauauguguugguccccuuuaagucagcaagcagauauaucagauauggcagcuaacuuaaggaguccccguggauacuggaugaauagcccccaauuccaccaaugcaagaaccaacagucuauuuggucuugauuaggacaguaaacuuccugcacaccauagucugugcacuaaacaggaguaaaacacccuuaaggcaucucuuacauuggcugcauuaaagugugucacuuaaugacauccgugauaucagggauaguuugacauuggacauacaguucucucucagugauugucaccugcuuauauaguacgaggacccauauguggucaaucacuuucuuguugccacuccaugccagggaagacauaguuacaaugaguuauaauuauaaaagcucagccuugcaugaggauauaaaauacauuugccauaccucuacauaugccuuaguugcuuuuaagcuuuguuuggaauugcaaaggccaacuuccuaaacacaguuucaaaguauucuuuugucacaccuuuccacuggauacuuguauugucugcaggaagaggccacccugccuaugcuucuccuuagggccucguucugcagagucagcauaaacucccagucugcucaaccaauucugucugauuagggccauaucuccuuaccaugaguugauuuuuguuucuuuuuugagcaggugaucaaugagacuucucagcaucacgaugaccuugaauaaaaauugcacacacuuggugcaacagugcaguaccagcaagaaggaaaaaaaaaucguaucuuaggaaaacagcuuucaagugccuuuacugcaguuuuucaggagcgcaagauagauuuggaauagaaagaagcucagcacuuaacaacugacaccccaaaagacguagaaaagguuuacaaaauaaucuaguuuacgaagaaaucuugugcuagaauacuuuuuaaaguauuuuugaauaccauuaaaacugcuuuuuuccaguaaauaucugaccaacuuguuacugcuucaauaaaucuucaaaaauacugu

SEQ ID NO: 639 - RNA, 8904 nt, Mus musculus
acaguauuuuugaagauuuauugaagcaguaacaaguuggucagauauuuacuggaaaaaagcaguuuuaaugguauucaaaaauacuuuaaaaaguauucuagcacaagauuucuucguaaacuagauuauuuuguaaaccuuuucuacgucuuuuggggugucaguuguuaagugcugagcuucuuucuauuccaaaucuaucuugcgcuccugaaaaacugcaguaaaggcacuugaaagcuguuuuccuaagauacgauuuuuuuuuccuucuugcugguacugcacuguugcaccaagugugugcaauuuuuauucaaggucaucgugaugcugagaagucucauugaucaccugcucaaaaaagaaacaaaaaucaacucaugguaaggagauauggcccuaaucagacagaauugguugagcagacugggaguuuaugcugacucugcagaacgaggcccuaaggagaagcauaggcaggguggccucuuccugcagacaauacaaguauccaguggaaaggugugacaaaagaauacuuugaaacuguguuuaggaaguuggccuuugcaauuccaaacaaagcuuaaaagcaacuaaggcauauguagagguauggcaaauguauuuuauauccucaugcaaggcugagcuuuuauaauuauaacucauuguaacuaugucuucccuggcauggaguggcaacaagaaagugauugaccacauauggguccucguacuauauaagcaggugacaaucacugagagagaacuguauguccaaugucaaacuaucccugauaucacggaugucauuaagugacacacuuuaaugcagccaauguaagagaugccuuaaggguguuuuacuccuguuuagugcacagacuauggugugcaggaaguuuacuguccuaaucaagaccaaauagacuguugguucuugcauugguggaauugggggcuauucauccaguauccacggggacuccuuaaguuagcugccauaucugauauaucugcuugcugacuuaaaggggaccaacacauauuuaaagugguuguauaguuuauucaucauuccuucuuuuaaacuuucccauauuuuaacuaaaaaauacugaccuguccaucucuggucucaaccgucuuaaucaggaguguucuuuuugagugggugucaaccagaggaagugacuccagguuaguuucugaauuaaaaaaaaaaaaaaaaaaaaaaggcaguaacauaagaaaaaguuuaaaacauuaccauuuuacccaaagcaucaugacuuuauuuuuaugguuauuuaaagugcuacucauacauaauccuacauagcacuauccauuugaguacacagcaccuaagggcuccuucauucaggcugagguaguaguucacugacuuugccauuagcaggaaguagacugagucuauacuuaacaggguagcaaaggcaagaauguacucgaguuugaaacugaggguaucaggcuagggguggagcucuguggguuuagcuuagcugauugcccuggguuuggucuccagcagucaugagaacuauaauaaaaaagggaccagauggucgagccugaaagcauacauguaaguaauauuauacagaaugagccauuguacucauguauguaagaauacacaguguguguguguguguguguguguguguguguguguguguguguaacagcauuuaaacaaaaggaagccaugaacugaaaagacagccauauaugucagggggcaguacauggaagguuucgagagaagaaacggaagcgagaaagugacuuaacucuaucagaaccucagaagcccaaaagaaauauucagaaaauaaaauggcuauacacauguauuuauaaaagagaaaucauguuucauugaauuuucuuuggaaaagcacaguucaaucaagaauuacugugggaguggguggguagaggagugggggggaggguaugggggacuuuugggauagcauuggaaauguaauugaggaaaauacguaauaaaaaauauuuuuaaaaauguggaagcuaugcuacaggcagagugacuggugacagccuugugacauuuuuuucccauaagaugaaacaauguacuuaccucucagguucagggaagaaaagguuggcagaggcagagaaauccuauaaaaagagaaagaaacacacaaaaaacuugagaacaaagcacuucaagaagcaggaacaaguuuucgcaguucuuguuuccaccaaaugaaaaucuauugcuguuagugacuuguuuaagaacuuucuacccaugcuuggucucauuggcccauuuaaauuucggaagauauuuuuuuccacacagaaacaugaaccagaagaauuuauagagggagaacguauugucuuuugcauggcugugaguucaaaucuacucugcuauuaauuaucucugaccacagcaaguuacucucugcaacguuaaguuccucauauauauggugucuggguuaaaugagaucuuccuagaaagacgacugugaguuaguucacacaugcacguuugccuucuauaccugcucuccucgccuuccagcagcuuccuguagguggcgaucucaauguccagggccaucuuaacauugagcagaucuugguauucacgaaggugacgagccaucucuuccuucauguuuuggaucucauccugcaggcggccaauaguguccugguaguuagcagcuucaagggcaaaauucucuuccaucucacgcaucuggcgcuccagggacucguucugcagaaagcaaaaauggcuucucaugugauuucccagaaaacccggcugucccccaaaauauucauaaauaagguacaguaauucuuuuaaugguaggugcccacuagcuuugaacagagaacacaagcacccaguuccauguuuugcuuugaugaaauaacacuuuuacaugcagccuagcuuaacugugaauuuauaaucccccugccucauucuccagagugaugagguuacaggaguaaccucuaaaaccccucuuauuacaaucaauaacauauguaaacuaagacuuucaagguacucauuaaauaauccuuaaaacuaucuugauaauucauucucuuuggauaaguguguguguguguguccguguguguuuaauuuauuuguacaggucucauuguuaaccuagucagcagaauaguacugagcacgguauuucccccccuuugcugcuguaguacucacagugccuuuaagggcauccacuucacaggugagugacugcaccugucuccgguacucguuugacuccugcuuggccuggcgcagggcaucguuguuccgguuggcagccucagagaggucagcaaacugucaagaaggaaucagaaauagagguuguuuuugguugugagcuuagucgaagaagaagaagaagaagaagaagaagaagaagaagaagaagaagaagaagaagaagaagaagaagaagaagaagaagaagaaguagaagaagaagaagaggaggaggaggaggaggaggagaaggaggaggaggaggagaaagaaaagaaaagaaaagaaaagaaaagaaaagaaaagaaaagaaaagaaaagaaaagaaguagagauuguucacuuccaugaguuuucacucacuuagaacaaagaggcaucuucauccugccuguguguuuccuagaauuugucugaacgucuuuuggaaaaccagggaaagagaagcagaacaccagcauugcguuuucaaacaguauuugcucuacugcaaugcuuuccaagugguggcagucaagagcaugagaguaagguauucuuugaagucagggaagacaaugaguggaaagggagucugccauacuaaaggaaacugugaauggagaugagggggaaggggugcugugaaacaacaauggcgguccaagcuuuaagccagcuucugaguagagcuggagguuacuaauggaauuagaggcacgugucugagagcuagagguucuugccacucuggcucauuucauaccuuggacuuguaccauuccucggccuccuggagguucuuggcagccacgcuuucauacugcuggcgcacaucacgcagggcagcagugaggucaggcuuggaaacguccacaucgaucuggacaugcuguuccugaaucugggccugcagcuccuggaucuccuggagaaagaacagacacagagaggucguagacuacacggucgcagcuuuguucacccacagaaauuggugucacuuacuucaucgugcaguuucuucaaaaaggcaauuucuuccugcaaggauuccacuuuccguucaaggucaagacgugccagagaagcauugucaacauccuauuucgaaaagagaaaagaugauguggagggugauaaagucuguccuuuaucuaacuuauuuauauuaaucccuuuuucacuuuauguuguguauaaagguguuuugccugcauguauauaaguaugccacgagcaugugguauccacaaaagcaauaagagagcaaaagaugcccuggaacuggagaagagugugggcagcccuguggguucugcaaauugaauuccaggugcccuaaaagaguagccagugcuuuuaaccauugaccugucucuacagccccuuauuuauuuauuuauuuauuuauuuauuuauuuauuuauuuguucaaaaauuaaccauguaaacccauucuccuuauuguagaaaaggugcugaaaauuucaugacccuugauaaauuuauaaaucauuuagggucacauuccaauauucauucuuagcuuuaaaaaugaauaggaaaccauuugguuguauugaagcuaacuaguagacaaguuaaaaauaaacacauguauaugcacaaugacaugguauggugaacuauauggaaaaauucauuuucaguuuuaaaccucugucacauuuaauaagucuguaauuuugugaugauaguaguugaugagauuguccaacuucauguuugcuugaguacacguaauauaaaaaugagagcuucaaaaauaaaauuaaaauguuuucuaaagugaggcuuaguaguaaagaaugcuguucuuucagaggauuuuaguuugguucccagcacccacauggagcaguucaugaagguuuaugauuccaacuccagggcaucaggugcccucuucuggccucaugcaagccugcagaaauguccuauacacucacacagacacaaacacauuacauauuuuuuaaaaaucauuuaaaauugagcucagaaggguuaacauauaugcaugcucuuuuuuguuuccuguauucaaaccuucagaugcuuaucuuuggaauuuagaauaagcacucaguuaucuggcauccagguucccaggcuagccucguaucaaguaguaauucauuguucaaaauccaggucuugcauuugcagagauaugcuccucgggcaagaaggaaaagaaauauaauccugaacuauauuguuuugccuucucuaauuuuuuuaauguguaaaacacccuggcucagccuauaggguauuucugccugucccagcugucacaguguuauuucaaugacuuugucuguuuuaggaugacagaucaaaacacuuacaaugaaacuauacuuaaacuucucugcagaguuuuuauaaagugaucuauuuuaagacagacuguucaaucuugcaugugaaauguuguuuccuuucaaggaaauguuuggaaacuucccuuguaagcaacuguauuugcaguauaguuuauaacuauaauguugaguuacucuaucagucccaaagaaaauacuaauuuaaaaaagaauauaagaacuuaaauaguaguaucauucauuucugacuucugcuaagccaucaaaaaauauauaaaugauauuggacuaaccuucucgaaaaaguucagcuaaaugugucauuucauuuaaaugaaugaaugaaacaauuuuuaguccacaaauaagagaugguguguauuaacucagugcuuuguagaaaacauuccuuuggugaugacugaaaaugcccagugacugaaaggggcugcauauucgucuacugccauuaaggaugcaaaugccuucagaaugcuaccuuagaacauucaucuggagaguuuggcuguugauccuaacaaguguuccaaacaagacugaacuggccaucuguccacuucgggaugcuaagguaaugccuaacccuggaacaaacacaaacaaacaaauccucccuccauaaaauacuccauucuucaguuuaggguuuaauuuuguuuguggagggugcuaaugagucuacaaaccccccuaaaagggggccuuuccaaaugugagggaggacuuuagcuuuaagaacuuuguacacggcauaccucacaagccuggcccagacacaagauaauggauguuagcaaauacuuguguccaauuggaacugugguuacaucauuacauauucaauaagaauguagccuguugcaaagcugcucugggaacacaaaggccccuauucuuucuguccagagccaccgcauuugccagaacgucccuaucuacauuccauagugaagcccauagaaaccuuuaacacccuugagcuacgggaacagauggcuucuuuucacccuuguuagauuucaaaaaugguugugcaaugacucuucugcuaacuuucacgcagugccgaacuucgaaggaagaaagggaacuuggcuuaauuccaguuaaacuuucucauccuccagaguauucuacauuuccaacuggaggaagcaacugugguuuuuaugaccuugugaaaguuagccaauuucaccuucacaauccacaauguaaucaaauuguaaccauucaauauccgaaugucgauauguuucaaaaaacgaaaggagaaauguuucgggggugugggggaucagaaaaaucuggaaacgaagcagaaaauaaagccuucauguuccaaagacugcccuaaauaguggaguuuuucaaucugugcgcuuuccgccgccagggggcuuuacaagcagacgugaaguucugcaccuuuuaaaaccuaagggaaguaacuuuuagaaccgcucgcggguuggcuccauugggcugcuggcugcaugugaaaaagaagucuacaaaccugucugaaugacugcagggugcuuucggcuuccucucucuggagcaucuccuccugcaaucugaagcagcagcacauuaaucaaaggggaacuggaaaaccgccaggggcggggcggccacacccaaccacaaaugccgccaagccuugaguccagagcugcugugacaccuccacccacaguaguuacugcaacuugucgagguggcagcucucugcagguguuagcuggaguuggggcacacuggaaaagacaaucacugcccuucccuuacaauuacagccaauccccugucccaauaucccagaugccuuugccaucucuuugucuggaacccuucacacccauucuuuccuccugucugguaacuguaagcccagaagaaggaccuaagaaacuuucuaaaaaguucaauggaagugcuugagugaggcgaaaagagaaauguucacugcaaaguuuagguucaggguggggcccgcuuccucugcuauccuccagacaaccgccaccccagccacauccccaagggcguggcagccccagugcaaggcccaggacuccccucccucccacaccccaccacucgcguaggucaggccuuacuucucucgcagccgcaugauguccucggccagguugucccgcuccaccucgacacgggccuugucguuggugagcugauccaccugccggcgcagcucccgcaucuccuccucguacaggucgcccaggcgcgacuugcccuggcccuugagcugcucgagcucagccagcaggauuuuguucugcugcucgaggaagcgcaccuugucgauguaguuggcaaagcggucauucagcuccugcaguucuaccuucucguuggugcggguguucuugaacucaguguugauggcgucggccagcgagaaguccaccgagucuugaagcagccgcacgcccggcacgcugcuccgcaggcgcacugccgaggaccgggucacauaggcgccaccgggggaugaggaauagaggcugcggcuagugcuggggcgcagugcgcugcccagacuguaggugcguguggacguggucacauagcuccgguuggagcugggccggcucgaugugccggagccaccgaacauccugcgguaggaggacgaggacacagaccugguagacauggcuucgaaggugggcuggcuugcugcggcuggaaaaacugcaacaagggaaugagggcgcgguggcugugaaucguaggagcgcuggggucucuggggucccggagcaagaguggcagaggacuggacaacgccaagggcgcugcuuuuauaacacuguuaggaaagaggguccccucccacugccauccuagccgccgagcgagccagccaauggggacccggaaagaagugaggaaggggggugggggagggagcuccccucgagccuuccuccagggcuguaggguaucaagcacaguccuguuacuaauuggaagugcuaggccuuucaggggcuuuccuggugaucacccgaacucucuacucacccuugggugcugagaaagaagggaucgcgggaaggauucaugggggaaggaaggggggcucuggaaaguugaguaaagcgaucccuggcacugggccaaaggggcgugggacuaggcgcgcugguaggaggggcg

SEQ ID NO: 640 - RNA, 687 nt, Mus musculus
uucugaagauauguccaucagauacugggaccuggggagcuucaccaacacugugcuguaucagggacaugccuacccugugugggacguggacaucagccccuucagccuguacuuugccaguggaucccaugaccguaccgccaggcuguggucuuuugaucggacguacccgcugaggauauaugcaggacaccuggcagauguggacugugucaaauuccaccccaacucaaacuacuuagcuacaggguccacugacaaaacuguucggcuauggagugcccagcaggggaacucggugcggcucuucacaggucaccgaggccccgugcucucccucuccuuuucucccaaugguaaguacuuggcaucugcuggugaggaccagcgguuaaaguugugggacuuggccucugggacacuuuuuaaagaacugagaggccacacggacagcaucaccagucuggccuuuagcccggacagcggucugauugcuucugccuccauggacaacuccgugcgugucugggacaucagaagcaugugcugcaacacaccugcugacggcucuucaggugagcuugugggcguguacacugggcagaugagcaacguccugaguguacaguucauggcuugcaaccuucuccuggugacuggaaucacacaagagaaucaagaaca

SEQ ID NO: 641 - RNA, 33064 nt, Mus musculus
cuucauacugaaaaaguauuuauuaugacaaaaauaaaacuguggacugaaaacaaauggauaucaugcuauauugcaccaugauugcaaaggagccaaaaccucucuaacagauuaacaguccagagcaaacugcaucuuuuuccuuggguaaguuggcaugcacacaauucauuagaacauaauugaagaaauaagaaaaucaugaauaugaccuaacauauaaaagaagcauuucaugauaguggaaaauguuaaaauucaaaaaacauuuucuuucaacaaccucauaaucaaacaaguuuggaagcauguguggggcgugagggugcgaaaugcuuuugguauuugcuuugacaguuucuugguuagcacuuaaguaucagagcaauggcgcacgcaucaguuucuuccuuaggguuccgaagcaguaugugauaugaaagacacuguuuccuccucugugaacaccagagggcccaccuugauccuauuaauaauauggucuuuugaaccaagcugcuuggcaaagauacugucagaccacuugcagagccugagauguaauagauaauaauguauauuuaaaucuuauaaaaugaacauacaugcacauuuaaagaguuuuacaauccaagcuaaaaguauaacgaauccagggccuguuucuccuuacuguuauaaagcaccaaguuaugugugaagacgagaauguucaauuaugaucauuauacucccauuagaauaaacgcaacagugaagccggaacugccaggagcuugcucuuuccuuaucuuaaacuauguucugagaaagagagcagcauggagaaacagaaaaugaucucauaauuggaaaaugccauaaucgucacuguauuucacaauuucagugaaaacagcagcuaagcucuuucaagaugaaauuuggaugaaaaacauucaccaugagacugaaaguuuacuccaagagaauaaacggaggugggggaaggaaggcucagucucccugaauuuccugagggaaaauuuaagacuaaaaugacuacuguuucucacaauuagagcuaaaacauagcaaucaauccugaacuucugagaucaaaugacagucauuugcgguguuagcauaccaucaguccaacugcagaccuuuccucuccuuucuguaaggaauuaaauacugggugcuuugcucaaguguaccuggucaccuucuugcugggaaacaaagaaaacaaaaauccggcccagcacucacacugccucuagcagggcauucugcauauucaaagacauuugggugaaggggguuuuauggaagcuuugacacuuaagcaaagcacucuguggaguaaaaaaugagguaauaauuauuuuuaaauuaaaaauucacaaguugugcaagaaaaccuuuucauucauucagauguucugauuucuagacuccaucuacacauagcauggagaaaaugcagaggacuggccuuuaaaaaaaaaaaaucaagaagccucugugugaguacaggucccgauuccauccuagcaggcuaaccagucuucaggcuuuccagccauaugaaaugcaguguagagcaccuaggucuauugaccucuauauagcuuuggucaccuauaauucuuaaaauauaucuuuuuccccccaacccuggcucuuggauuucagucuucacacuaauauuaaaugaauaaagaugagaagacaugaaaaccaaugaccuuaaaaagcagccauuuucacagccaagugggcuucagucuguaacacacugauguccuggcugaugauacucuuucagcacugccaagccaaguguuuaggaugccuuagaagcagugaacacacacacuaaccacuucuauccagucagaaaagccagaaaaauaagguaaguuuuguagaaguggguuuccaaaacacaugggugcugcuuagaagcaauucuaagccauuuuuuggugaauauaacuuguccuuugcacugucuuuaguuagaaauucagcuuaagccaaaggaaagcuauuucuccauacuguguuguauacacacuagaggacgugaugcucggguggggaucacacagugaguaagaccacccaggugcaccacuacaagcauuccucuuauuaguuuagauuugaaaaaauagugacagugcguaaggcuucagaauauuaaacagaacacauauuugaggcuuggcuuauuuaaaagguccucacuuugggaagaacaaaaagauggccaugaacaauagugucuuaaaucaacuagauacacgauaaaugggcagauugagaucagaauccaccucuugagacaggcuuugcaaugugugccuagacaagacuagaagcuguaucuugaggugaccccugacagaagauaaaggaccuucaaaacuaaaguucaggugugugaggauuuuguuucaaagccacagguaaguuggcacauaaaaucggccucuagagauaagugccaauaaaucaccagaguguggaggcacaaugcacaaucccagucugcugcuaauccacaguuaacacagcgggggacucaauggccuuggaaacaauucugcucauaaucuguugagauacaaaaccaaagacuuaaaaccuccucuucaaagaguucuugguggccaggcuugguagcgucagggaauauuguuuacagcauugucugaaucccucauucuuuccacagggaaaaccaacuguuuccucuuuaugcuacaaugaaaguuaaauuauauucaaucaaaaugccuacggcaaucccagcacugggauggggaagcaggagcauccuggccuggugcugcugcucaccuuggcuaccugaagcucugucuccagacacuccccauguuacaaaacacuauuccuaugggaguuauguaaagcuaguccuuucaagaaugaaauguauauguuguuucucuaguguauauagaauaaaagcaguauccccuuaagaaugcuaacacaagaaccuaaaagcaaccauuauagauucaaccccccaauuuucaauagguaacauauauuaauauuucagguuuuaagaaauuauaucacauuaacaauaaaaauauuuagugcauucccuuacaaaagcaagugcuacaucuacagugauucucaaaugugcuucuaggugacaacaugcucagguaaggaaauggcacacgugauuugcaaaggguuuuuuuuguuuuguuuuguuuuucauuuuuagcuguaacauguugagaagauucuaagguaaaacuuaauuucuucauuuuuaaauuaacaauacaagauaaucuggagggguagagccagucuggggggaggagcucuguacaauacagacuuuacuaaauaacauauagagacaaaggagaaugugaaacauagccacuccccuccaucucaucccuguugacgugaccuugaaagaacagaguaaaaaaacugagaacucaucucaaaauaacaaaggcacccaucacacauuuacaaguucaugaaauaauauuuuacagucauucgauuuauagcaaauguucaagugaaacucucuagcauccuaugcuuauugggguccaaacauucucuuggaguaaagcauagcuaguuuccuacugaacaaacagcaaggcugaugaaaagccccugcaaaggucucacaggaacuucccaaggagcccuauccaaucaacagcacaacaucuacuugaaugcugauuccauuuccaaauaacuaacagcaguugcuucuaguccaaaugaaucaugugccuuuaaaaaggauuuacaaguaaaauaaacuguacuuucaacaauuaaauagcaaaucugcaucuauacuaguagcuguuugacaaaauacaaucaacuauuaaaaaacacuuucaauauaaugcugaugugguaauauaaaaaauaaccauauuaucugauagaagaaaauugaaccagccaaucuuacuagauucaagaaggcagaaaauuauuucauaagcagaaauauugggacauuaaauauucuuuuucugaggacaggcuuaugagaaguauuauuuaauauuuaugguaaauaauauaacaaaguaaaauucaggcaaagugugcuuucaguaacugguauuuucucaguucccauccccaccccucaaccaccaugcaccauacacacugauuuauaucugcuuuucucucucaucuuugauuaugaguuauauuuacaacacacaagaaaaaauuaaacuuauccuuuacuucacauagaaucacuaagaaaaagauucaaaguuuaaacaauucccaaaaguucagaaaaauuucccucuaacuacuuucucagaucaaggggacaaacacuaaaaaaaaaguaguaucaaauucaacuaaauuaacuaaauauaacaaaugaguacaacccaaaagagaguaaaauuuaaggcaucuuacauacaaaaacccugaaauuaaaauaccaauuuugagcagguauuuaugaacacugaagcuuauuuugaucuaaaugaaaaauacugaaaaaaaaccuaagaacuaccccuuaguacauacacacuuuaucccuuucauaaggcagaugagccagaugacacagauagggcuaaugacaacacguguccccuuuucaacuuaaggguucauucuuacuuucaucuuagacaacugcuuugggaaccauuaacacugcccaguaagucugacuucagcauugggcccuuuccuuccauuucuguaaccaauuaaaccaucuacauggcuaagacuaugacagucuggucuaccuagugaguuccagggcaaggacuccugagggaaacccuaucaaaacaaaacaaaacaaacacgaaaaccagccaaacaaacaaacagacagaacaugaacacugagucucauaggaacauucuaaagcuaggaauagauucagagcacccuauaagaguuuaggaacaauucuaccuacacagagacaggagguggggcaaaaagaauuugaagccucuuucacaucauccacagccacauuuauggaaagaccauguuauuaugccuuucaguaauauacugcuggugauaacgaugcucugacagccacuacuacaaaccuaagaaagcaaaagaacugucuaugcuaagucugcugccagagcaggggugguaucucugacaaaacugcgaagguuacacugauaauaaagcagauaggaaacugacagaaaaacauacuccaaguguccuggcucuaauuuacauugguguguuuuuacaaauucugccaguuacacacacacugaaacaucuuagcuacuagauggagccaauaguguuuaucacugaagcuggguuuuaaacucaugcuucaccuucauuaguuuuuaaccaaauaugguugguaggaaagugagcuuaauuccuuauauaaauaaauggacuaaauaauucccaugcaaagaguaacuuaaaauuguacuaucacaugcaaugaggugaggaaaauuuaaacgcaaguauuugugauguuuacacacacacacacacacacacacacacacacacacacacacacacacacacacgggggugggggggacacggacgucuagguagauuuucuucacuguaauuaauucuguccaaaagacaaaaaggguuuguagagcaaagaaugcuuagugcuggauaaauaaauaauacaugccgguucccacuacuauucugucaaaccaguaucucggaaagagcaugguggccaagaggugaaagaaacugguuauaaaggacauaacgaaacuucagaugucaggaaauauaugacaaaugguuuuuaacaaggcagucacugaagaguuagaauacagucagaagaguccggcuucuacaacauagugacacguuaugcucguccgaccgagauuaguacaugggaaacgaagguaagaaaacaucuuuauguuccaguacaguggcacuugauucaagcgucacuuggagguuuguguugucauaaauuaaacaugcugcugccucagcagccaaagguauuaggaaaaauguucauaucaccgaauaaauagagaagucuuuuucaagcaaaaaaauuaucucacaccaauccuggaggucauccacucuagaccuuggcacaaccuaaacaaaagacagaagcauucagaaauuagaaacuuuauguggaaagaucgaagccacaauuaguaagucuuauuuaaagguuagcguuacacucggaugcgauuuacauacgcugguugacaaccuuuuaauccucacaaggaacagggugugaagcaguacaagcuagccucaaauccucuaugcagacaacaucaagguaagcuucuuacccuguggcccugaccucaucuucaagugcugagacuacagaaauaugccaccacccucaguguguggagcagcagggauggaagccagggcucugucgugccuggcaagcagucucccaguggagccgacccugagccuccaucagggacagcucucugauaaaauccuaagugaaauucuaaugcaaguguccuuuaaacaaagugggaaacugcuuagucucaucuuaaagauucaaacucucuaguuuucucaucaggacugcaaauaccacacccacugcacccucuaaaagggagcuaaaaccacuauuaaaauagcagaaacuucucuuuauucaccgucucuaaggaauagaaggguacaggcuccacacuuagcuacuacauuaccacauaguugagaaagagaaaaccaauuguuaggcugcuaugaggauccugucaugaacgagguaucacacauuacacacuggcuuccccuugucauagaaaagcaagaacacacuacauuggcccugucaaacguuccucuagaaaugugcuccggaaaggacucuugauauuacaggagacagauuguuggagaagacuaguuaaguccuuucagaaaguguguaauuucuuuaaaucucuaucaugaauucaggugacauugcagcuuuugcuuagaaaggauaugaugaacaaaaaccugaaaucuaaacauuuaauuccacagcuucuuaugccuucaaaaauauuacauguauguuaaaaauuugaagaacuuggagguaaauuauucacuagaaguauuucaaaauguuaagccagaaaagcaauauaacaaccaccaugcuugagagaaacaagagaugguggcugggaaagacggugucggccuauagcugugagagguugugggagagcccuggcagcaccuacccuucuccugugagcgcacagcacgacuggaugugccacgggugguccuugauugaacuuagggugagguauuuggagauuucagcugcugucaugcacccuuucauauccuguuuauuugcaaagauaaggacugcagcuuuccuuaaauccuguaauugacacaaaauauucaaccaucaaacaugggaauaaccaugaaucaaauuaaugugugaacuaucaaaaaacaaguuaaacuaugaagucagaguguaaauuguauccugcuagccauuuauagcaaggcaacucuauuuucaaauaaucuuguccuaacauuuaauuuuaaaauaaucuuaacuacaauuaaaugauccauccuaauaaaguauauguguaagucagagaauuaauuuuuuuucuguuuuuggacaaaaauggccauauugaaaagaauauaaaucccagguugaagccuuagacuacacgugugugguccucccuacagugggaagaaggucgacuuaaagccuugauaggccugaacucacucaacuguguucacugcagcuuucuuuucuguuuuguuuuguuuuaacauccaaaacuuuaugacauagccugacagagcagaucaacugacauacaacgaaaaacauuaccaauucugaaaucacuucuaaacuuuagcuauuugucuauuuuuuagagaggcauauaucagcauggcuaaaucucacguuucugggacuggugggagugaauauguaugcagccacuauggagacagugugaaguuccugcaacagaguaaaugccuaauaccguacgacucaguuacgacacuacugggaauauacgucaagacucugaagccaacaggucacacguauuuauacguauugcugcaccacucauuaauagccucaaauggaaguccauugcaacugaauacagagaaugugguguauauauaaugaaaauuuuuaucugugaaauaaaagugaaacaugacuuuuaagggaagugaaucaaagugaagaucacugugucaagagauauuagccagaguaagacauacaaguauauuuuguuucauacaugagauuuaguuuuaaauugaugugugugcguguucauacacaugaggguaguggucaucaaaauagaaaagacaaguagaaaaaaaaaguucuuaugggaaagaaagggaaggagaggggaguuuccagggaguaaaaugaccagcagugggggagggcagauucaggcaggcaguggagggaagagcuaagagcuaacuaaaaucacacacuguaugaaaacaccauuaagaacugacuacgacuuuguauggcaaccuaucaauuuuaaaauucagauguaaaaaauugacauuacagaaagauaacauaacauuaguuuuaaaaauguagaguuuaguauuuuacacaucuaaauauagggguaacaauuacuauauuuaagagucuagauacuucugagaaggaaaccuuagguuaaauagcauguacaagaauauguuuuauugugcuuacuuuuuacauuucaaauacuuauaauuuaguuaccuccaauuauucauuauucauaguaaacucuuggcuggaagacauuuaaguuuuguuggucucccaccaugacucuaaucuuaauuuaucaauuuuuuaaaagcaugaaucgguacuuuuaauucuaaaaaaguuaaaacuuagcuuuuaauaguuguagcaagcaaauuaacaggcuugaagauaaaaugugauuuugacucuguuuagacauacaguuuugcuuaugaugaaauuaccggcauuguuucacauuaaucuuugcauagaacaaaaucaauucacagauaacuuacuccaucacguuuuaaagauuuacuuucaaacuuuaccucaugggccaacauucuguauaauucuucuuucguaauagccaggcguucccugucaaugcuauccacaacaagaaugaugaacuagaaagcaauauuaaaauacagggagaaauuaguagcaugcucgguuuccuacaaaaucagugcaucaacauuagcucucacuuggcacuaucccugcuacagaaccucacugccuuuccaucagcgagcacguaacacagaacuacagcaagcaggagagccagagguuaacacguaagcaacuugcaacuucagcaacuaaaaagcacaaccaaucuauauuaagcucuugauuguagguaaugaaagguaauguuuauagcaaaccaggaaucuauauucuuucguuaaauuucaucgucuccauucgaccauccgaucaagccaauucucacccugugugucaugacucacggauaucacauauugacauuaugguucauaacaggaacaaaacugcagcuaugaaguagcaacaaaaaucauuuuaugcuuggcagucacaacauaagaaacuguauuaaaggguugcagcacaaguaaaguuaagaaccacugaaauuuagaaaaucaauaauuuguuacauguuuauguauaaggucuucugccuauuaaaggaagaguuaggucgacagaaaaagauaagcacauuuuucaaaaauaacaaaccuggcauuuuuuuacagaaggaguuucagcaaaaagaaguucaagaagugugcugagccuugcucagucccgugcacuggcaguaugccgagaugcaggugagaucugaaaaagguacaaaaacuaaagggucugugugugcaccuguauguuggggugggaugagagaaggguauguguguguguaaaguagguauuaaauaguaaauauacaagcaaaugaaaaacuaaauaaaaauaacuuuguuaaacacaaauaagaacaaagugaaaaagagcuauuaaagcaaacuguggagaagaaaggauuaaaagcucaagcauuagcaaugccaugcaccauagagaauaggacauuaaucuauaaaauuacaacagggaggcuagaaucaguuuaugggauaauacaaaauuaugaaguaacaacugcagcaaucucacuacacaccagaaaggccuagaagggaauaaaagggagggagcccagcaacgaaugggcagaauacugggaagugauggguuaaggcaaggaaggacucaggaguuaacacccugaacuucuucucacaauggagaugcucccuuugggaggccagcucaaagaaaagaguuuucucaaugcaagauuacaagguugaacgaugugauuagugaaacaucaccucagaaaaucuuuuucuggaaucaaaggcugcaaauguaaaugaccacucgggcauguugcaauaaaaucuuugugguaauugagauguacuuauggaaaugguuuacuagaggaauauuuaaugcuaauagcaucaguaguaagauauuucuguuuggacccaggcuaagccuagauugucagcaauuucaaaaacuacccuguuaaagugcuugacaugcacuugggucagcuugaaucaucuuuaauuuauuucuguauaaaaacugcuuuucuucacagcuggaguuaaggaguuaacuauacgcuuugacaauaaacuuugaaaaaguagcucuguuaccagaguaugugaaaaugcuguuauuccccaguaggauuuuauuguagaaauguguacucagcuagauuauaacaauauuugcguaccaaccucuucugucccucccaacccccacaaagaauauaauucagggccauuacaaguguugcaugcugacaaccuguuuguuauucuggcuuacacagugcacugaaauaguacacacacaaaacuauauuaguaaauauauguccacaauauacauguuuguuugcuuguuuuuuaauuuuauuuugaaagacaaaaauuucuaugcauuauacucccuuccaucuccaauuuuuacaaaaugucauuuuagaaaacacgauuucuuagcuguaccuccuuacaaagaaaguuuauaugugcaacugcauaccauuauuauaaaugaaaaagcucaaaagcaccacaugagcauuacaaaacucuuccucuaggcagacauacuaguacaaaugaaugugaauguaauaaggauauauucccuaagcuaauacugaauugauaaguaacaguaaaaagaacaugacacccuggaaagucuccugcuuagaaacugcuccucugugaagcucugcagaugugcucucugcagacuugccucaugcacugccuucucaaggccccucacagaccagcacaugcaucucugcaagauacccucaccaugcuccucagccacucacucauggccugugucuucuacaaucaugucagcaguuagagcuucggaaaccuagucuuucaguguaaauuugcagaaguuaaugaagucagaguugcuucucucuugccuaauaccucuauuuauuuugccuuuaacacaaucaauuucuucccauguuucaaaauagucaauaaauauauaacagaaaauugauguucuuugccuuuuucuaucgcagauaaaaaauaaaaacauuuaaaaugauagugacagcuggggauaauagccugcaaauccuuucguccccauuaauuauaggaagguucauucauuucaggcagugucagauuucuccaggccacagagcauggggcacuacugugaggaugauaagcacucagcugagaaggguccuggcuaggcacaguguugcaccucuacaauuccaguccuuagguuaggaggcagagaaccacgaggauugguauaaguuagcuucaggcccgcaugagcuggguacagcgaguucuaugcgagccagguacauuucgcauguauauaaucuauuugacuuuaguaaaacagguuuacaugucaguguuuucccugacucuuggacaggaaaagcccaugcucccucuuggaucuuacuccaucugugcaaguuucagcagugagacagucaugaccagaauuuagcaccccuaccuaccuuuuguuccacgauaaagccugaauuccuuauuaaaggcaauugcuaauaugucucauuacagccuagccauuuccuaugcugauucucuggaaaaauuuuaaaauaaaacucaaagguaauuuuggcauaccucuguguuugaguaauagguguuccaggaugaccucagagauucuugaccaccgauaucccacauaaggaaaugaguguucuucacaacgauuucuucaacauugcuuccuaugguuggagaaguaugaacuacuucauucauuaagcuguugaaagacaucauugaaaacucuuuuguaaaucuuaagaaccccaagaauacuuuaucgcuauguuuuuacgagaagucaaccuuccucauuuguaccaaucacaauagcaauuaacaagagaaagagaagcuuggagacuuaaagauguaaacagugcaaucccugaagacuguuuuguguuuuauaaugggacgaacugcaagucugacacacagagaugggaacaccgugauguggguuuacacgcccgugggcaaaaugccaauaugaccaguuauuauaccaaucuauugagacccaugcucuacccuggaagaccaauuucuggaaaauugugaccacaauacuugcagacuagcaauaaucaagcaauauccuguuaccaucuugaugaagguccauguaagcaagaugagcguugagccauaaaaacuaauuuaggcacacuaaccuaccaucuuaaaggccacaggcaaauagaaauuugauuuaaaaugaacuguauuuagaauacugauucccauaucacuuguauuaucuuaauugcuuaaguuauauuaccuuauucaacauacacauuugcugauaacauuccaugauaacauguauuugaagacaauuauaauuuucucuugaguuuuauauuuuguauuugacacuauguacaagacuguuaucagagauauuuaagcuuuauauuaaacacuaaauaacauuaaauuguauuuuagcuaaugaaugaaaauaaaugauucaacucuaaaacaauagcacauaaggaggagccuguuugcaauguaacuaaaaaugauucaguuaggccccaugggaaagcgugaaucccuggcacacugaaaugugacaauaucaccucccuccgccccucuuuuguaguguuaggaauugagcccagagacuccugcaaaauggaggauugcucugcugagcuauaacccaggcccacacugauaggcuuaaauguaagauccggaagagagagguaaguuucauaugauggugccaaguaccaugugaguauuuguuaaagugcucuggguagaaauaaacccaugcccacagcuuaacauugcuuuggcucugagaggauaaagggcaauucuuccacccuggauuccuggggugguaacauuuacugcagaugagcauuaauguaucucuaaggauuucaaacuuuucaguuuuaaaagcuacucaaguagcauuuugaccaccaccacuuuagacaggucuggcucuguuaaacaacgccaaagcuguuaggggcgagcugcuuccagagccacgcccacgucugcuuccgcagggcuccugugggaagggguaagugagaggcauuucaucaccucacccaggagcaucugacuuuguuuuaguuuaauauuaaagucauucuuccuuucacagucagaaggcuagggcaugguggagacuucaguggguaaagggcaucuucuuuuaccuuuuuauuuggaaauauagaaaaagcugcauguuuaagucuaaccaccgcauuauuaaaauugggaaguguggcaucuuauaacuuauaaaagccaaguuuucaagagccaguaagcaggcccagauacuuacaacugauacagaauggugguuuuccccgcguuauccagucccacaaugauuacuuugugcucuacgggaaaaaagagucaugaacaguuacacuauugcacacuacagcacagacguuccacagugaucauuauacacgagacucaucgccuaagcacccaccacugaaguuuuaugagagaaucuuuauguaguaaggacuugccuugaguuaaaccauccaguguuuucuaugaaguccuccuguaaacuuguuuagauuggcugguuagaaacaaagacuuuguucacuuuugaguggaggcacucaaauaaaaaaccuggcaucaggacuuaaaacugugaguauaaacuguuggcucuacucaccugcucaaagucuccugcucuucaaguuagcuuuauguuguuuucacacaagcagauuuucccaccuucauauaccaacauuuuugccuuuccuuuaaaaagggcauuuacugcugaaaacuacaacguuuuuuccauuagcgggcagguuuuacauuaauuggcagaaguaaaagcaauuacuuagccucaaugguuuuuauugaaaacuguuuucuguaaucauucuaaguggauguuucugcugaugcuguccaacaaaagccucuuccccuucuaaugauaggcccuaaauaaccauuuuguuauaagcaguuauuaggccucucuaauuauucuguuaagugguacauauuuugaaaucugcuuugaaugagugauagaaaaucgucuaccccccaucuagucagucuguucaagguucuucuuucuaggagaacagggggaucaacaaggucccuuaucuggggagagggggacugacggcuccuuaaggguguggccccugguaugucacccaugcuccagugaauggcccuacaagcaagaauauacgagcagcacaaccagaacuuggggguggagggugagggagugggaaggaggagauggggagggaggacggagaggaggagggaagaaagaggacacaaaguugggagggaaccgaggagauuugggagguggaucuggaaggaacaggagaacuugggggaggaaugagagguacaugugaucaaaaucaauuguauauaauguauguauguauguauguaugaaauuuucaagcauaaagugaauauaaaaauucuccuuccuagcacuaaacgcuuccgcugcagcuccugugcuuccguggauggguggagagggaagcugcggcaacaacaggagaagacgccuucuuccccgugugcuucacggagagagaacucuuuucuugccuuuaucaccauuuauuuggcucuuuaucuagucuuugaugguagcugagggacccucagggaggaaucuuuggccaauaacuccagggaugucacaacucucacacuaguuuaaagguuggugauaucagguaugagccaagaacguacgccccauacgccaauaaagaucaccaaaaguguaacagucuaaauuuaagacaauaugggaagauuuguuucuucucugaccuacccucuucuccgugacauuaguaggcaacuagauuuacccuacagacagaagaaauagaaaagagccuuuucuaggaaauacuauaaacuuggaguuaugacaaggaauuaaauucuuauuaucucccaaccuuguaagacuuucaugugauguuuaauccuccccaaaguaaaaccuuuguuugcacaaagccuugcacuuggauuauaguguggcaaaccccuucccuucauuuucuuugcaccaauucuuuuaaaaccagcuaauuucaaaauaccaagggguccgauccagccaauagggaaaagacagaguccccacgccuuucaggguaaaaaccaagugcacauccccgggcuuuuuugcuuuuuugcuguuuuggagugugcucucuuaaucaagaauaaaguuuuaccuuggggagacucuucaguuguagagcuggucucuucuuaagacaacagcaaucuaacaacacaguuggcagccugagcagagaagggugcaauaguaucuagcacuauggugauauguucauaacuguuaaguaaaaacgaaccagguggccugacugugugagcuccaaccuguaaguuuagcacucuggagggucccuaaguucaagaccagaugggaugacaaacuucucuugucuuccaaugguguauucauuaucaguaagaacuaucucuaguauauuacuggacaaguauacaggacaacaaaggugaauuucaugcuuacaaaagcuguuuuguagaacaacaacaacaaaaugauuauaacugacuugauuuuccuucuaggcccuuuggcuccauucccuagguuugaaugaaaccaaucuuggcuuccuuccccugacuguuguuccuuaaagaacaagagcacucuuuaucaacagagggucaaacagacugcuuggacccaagcauucccaaccugcuaaaagccuggcucuauagaccucaauaucccugccucggugagaaagggccagcaaagcagcaaaacuugguugcacagaaguccugcucaggaagagggaacagcacgcaugggcagcagcagaugguuugcugcugaagcagcucuuggggguaacugugacuauuuuuaaaauggucugugcuacagugaugauaguaauauuaaaggccugcuauuuacacucaugaauaaugcauuguuuucaaagguuggucuucagugugaacugaggggaagagauuggugauagacgggguauagguuucauucccauucaacuggauauuauccuccagaucccccuuucuucacagcauagggaacucuggcaaucagaacaaagcccaucaucagcucagccuaggaugaaggcaugcacgauaccuuucagauaaaauggccuaauuucucauaaaaaugucaccaacagccuaaaucuauacauacaaauaccacaaaaaggacugcacuuuguaagaucaugaaguagcaaaguuucuuuuugaucuuagcucggaagaagcaucaauccuaucuagacagcaagaaugaaagcaggaucaaaggccagcuacuaagggccauuuacccuguuauguaacagcaacauuccuuccaacugcccacuauccacaauagcuaacaguucaacucccaaauacuaguugguaguguuuacaacucaaagagcagcaaggaaaauguagaaaguggugaugugaaggccugggcauagaaucuccuccuccuaagaagaucaaaaagacaaaacaaaacaaaacucccugaauguacugcccugauauuucaauuaauaagguacauagcuucuuaaagguauccuugccaggguggucuguucccaguccacacacaggcugagcgccuucuguguagagcaugugacauuuacuaugggaugucuaauugggaccccaggcuugaaaacgacagcacauguucuaaauacugucuucuaauugggcauaaucaaucggccacacacauacaauuccugaguaggaaacaaacaaaagcaguugaacucugggucagagacacuuucugugauguugcuuaaguauaaagaauuucccucgcuugugccauaguaaacuaaagccaaugucccacggcguuugcacauuuguaccaucuguauacuuaacagugacuauuaugauuucuugaccaaggagguuaaaaaggaaaaauaaauaaaagaaaauaaacccuuuuaagaaguuagcaucaacugaaaaugagagggaaucuguccccauagucaaaauagccaccaaucugauggggcauuagacauuuaaugucauuuugaccucaguguagaaguaaagaucucuguuucacuagacuuuagauaucucaugccaugugcacaugguuuaaaacuucaucugguucacaaggccuugagaggagagacaguguguucacuucuaaguccuuaagccacucuccagaaaaccagacauucaauucccugucucaaacagucuacauuuguuauuuagaacgggcuuugaaauaucaagugagccuuuaaccacuuuaagaagcacuauuaacuuccugucagagagcacaggcaggaguccuaaugguagaggucagacaucuggaauuugcaucuacugggaaaagcugggggaagcaucaggcugucaagccagagguaggggcuagucugggcuagacacagcaagccacugccucaaaugccaacaagaaaagcuaaaagaaaacauagugugaaguacuucauuguguaaauguaccacauuuucuguauccauuccucuguugagggacaucuggguucuauccagcuucuagcuauuauaaauaagucugcuaugaacauaguggagcauguguccuuauuacauguuggagcaucuucuggguauauacccaggagugguacuacuggguccucagguaguacuauguaaaaaacaaugaauuuaugagauucuuagccauauagauggaucuggaggauauuauccugaguaaugugacccaaucacaaaagaacacauaugauaugcacucacugauaaguggauauuacccaagauacaauucacaagccacaugaaacucaagaagaaggaagaccaaacuguggauacuuugauccuucuuagaauugggaacaaaacacccauggaaggaguuacagagacaaaguguggagcagagaccaaacagagacugccucaccuggggauccacuccauauacaaucaccaaacucagacacuauuguggaugcuaacaagugcuuggugacaggagccugauauagcugucuccugagaggcucugccagugccugacaaauacagaagcggaugcucauagccauccacuggacuaggguccccaaugagggagcuagagaaaggacccaaggagcucaagggguuugcagucccauaggaggaauaacaauaugaaccaaccaguacccccagagcucccugggacuaaaccaccaaccaaagaguacacauggaggaacccauggcuccagcugcauauguaacagagguggccuugugggucaucagugggaggagagaccccugguccugugaaggcucuaugccccaguguggggaaaugccaggacagggaagcaggaguggguggauaugugagcagggggaggggggaggagauaggggguuuuccgaggggaaaccaggaaaggguuuuugaaauguaaauaaagaaaauaucuaauaaaaucaauaaaaagaaaaaaaaaaccauagugugaaccgucagguuuuagguuuaaggucuuguuuguagacaaggacacguugaaaacuggcuaacaagaaauagaacgaaagaagggauucccagagucaagaaagauugaaguuuucuucugcaugauuucacuuucacuagcaagaacaaaacuuuuuuaaaauuuugguucagaauaccacaugucacugaacagaauacuauuggaggggaaaggcauccaaaaaguacuauauagugaugugauuuuuuuaaagauuguuaaauaauguaugcaaauuuaaguuaucacauuaaaguuucauauuguuaagaaagaauguggcauuacuauacuacgaaauauacaaaggcuguaggcucuaucaauucccugccuaguucucuagcuuucccaguccuacugaggagccacaguacaguucaaugucuccuccaaucuacagaguccaucugacgagucaacacuuagcuaccuuaggaguucuaagggaaaacacuugcaaaauaccaccacuucaaaacgcccccaguaaaaaguaacagauagggagguaugcaucaacaacacucuuucuauaaguaagaguucaacuccaacguucaauuaaggaaagaaaugucaguaauaaaaaauguaaacucuaaguguuuuauccuuuuaagacagggucuccugguguagcccuugguagucuggaauuauguagacuaggcuggccucaaacccagggagcugauugccucucugccucugagugaugagacucaagucaugugccaggguucccuguuauguuuuacgcauacuuuauaaauuaauauucauaauuauccugugacaaaauuccaucacuucuuacuuuacugaugaggaaaccagaucucaggcucuuauguagccugcucaacaucacacuacuuggaaagagagaugacuguggcuggcauuugauuccuagauaaugcacuguccuaagaacugaucagcuuugagcucuauuucucuaucaguugcaggauacacaagcaaaugcuuccacaucaguaaguuccacuaagcauucagucagggagagggcaggaugcacaaugggcucaagagaaacagaaaugugcuaguguguaagagauaccgaugaaaacaugagagaucugggcaagacgaggcaagcuucaccucagaacagucacaaaacacuacacaaauguggggaacacacuucuccaaagguaaaaaguaaacggacccagagagcuuauaggagccucauuaagaagccucaaugagugugaaaugaagccgaaauguuaugggguuuacugaauuaggaacggugauuaagcuaucaaaaccaaacaaaaacggacaaaccccaaaaaauuaaaacuaaaauuauuugcaaacuaagcaacaaaaaucaguaauacagucaaaaaauaaaucacacaacaauguaaaaguacaucaaauugaauaaaaaugaguagcuagaucaauagcaaaagggauauguuuaacucugaaaugcuuguacugggucuguccuuaagacuuuaguaauagaagaaaaaaaaaaaaaagucaagccaaaaaguggguagaaagaaggaaauaaauagcaguaguuaaauuuaaaaaacaaaaacaaacaaacaaauaaaaacccaacuaauuuucucuuucuuuuuccccauuaaaagacuaagcaaaguucaagucuccacugacccuaaaaacuccacauggcuguaagguccuaaggcuguaaggcugugccugagaacaaggacccccgccuacagaccaacgccacaggcuaauacacacagaaaaguguggcacacagaaacaaggccacugucuuuccuuacugacaucuaccaggguuccaaaggaauccacuuggaggaaaaguguuuaaucaucuccaaaguagauguccacgugaaagcacaaaaucucaacuuaacauaaauucaagucugucacagaaaugaacagaacagcuaauguuucuggaggaaaggagcagguaucuugaaacugucaaaagcaaaaagccauuccaaauacuuggagaacuggguugauggcccaacguuuaaaaguuuuuuuuuaaauggguaaaugaucuaaacuguucacaaacagcaaguaagaacaugaacaaagacagagccagcacuugccagaaugacuaaaguuaagggcugacaccaucaacuguugccaagaucaagaagagagccuaagaaaauuuaaaaauaauagcacuuuaucugcccuaugacuuuaaaacugcucuucuacauacuaacucuaagaggaagacaaagucuauggaaguucuccugggucugugaguaccucagaggaaagcauuacucuuggggcugaguucugugcccuugaacauaggguugccugucuuucgaccacccauauuguuuaauccaucaggacguaagaggagagucauuuacaagagacuuauggagaauaccuccaauguaaaaagcuuugcaaaacuccaucaaaacagaaaaauagacaauaagacaaugucaaagaaaagagugaugugagccuucacaaaaauaugcucccagagcaguaagaaacaaaauacucagcucgaagaauggagacaaaggaaauaaccuaagauuagaaccuuaccgcuaauaagaaaacauucaugugcaucuuuggcagucgucuuagcaugcacuggcaauaaaauguccagaaaaaaacagaggagcaaacccuaaaauaaauaaauaaauaaauaaauaaauaaauucugcagugucaaaaaggaacaucuuuacauugaaaaaauuacaaagaacccacaaaaaugaaugaaaaacagauauacaaggaauuauaucuuuuugaaacuuaaaaauaccugagaaaaugagaaaauucuaaaacaaucaaaauaaagucgaucaagaugguuuuacuuagcaauaguggaaguuggagaucaaggcaacgucuucaaaauucuaaaagcaauguuuuccaauccauagcuaagccaguuauaugucaaaacugaagauaagugauacauuuccaggauuuugaaauaaaaaaaauauaauuuauagaugucccuuuugggggugggacacagacucucuccauagcccuagcuguccuuuacauaacucaguauguagacccaggcuggcuuuguacuccaauagaucugccagucucugccuccugaaugcugggacuguaaaggugugcgccaccacaccaagcucuauagauaccuccauggcaucuuuucaauaauuuguaucauuuuuguuguuguuuguuugggguuuuuauacuuuucuuuuguuuguuugagagagggucugucuacauagccuuggcuguccuguaacucacaauguagaccaaauuggcuuugaaacucacacagaucuggcuaacccagccucccaagugcugggauuaaaggugugcaccacugugcuugccugaauuuguauacuuuuaaagggagagauaaguacagaaaauguuaacaaagagaaacccggaacagcuauguacuaagaauuccaaaaggaggaaaaagacacagcaucugcuaggugcaagauggaaaaacuguuaaagagccgagcuuaggccuacaaaaccucucagccaaugcacaaagaaaaccaagacgaugccauuuuuacucuaggaacaaaaugaagggaaagcaguaagacaauuagagcaaacuggcuccacagaaccaaauuuuaauaucacacuaaugaaaacucaguggagaacaaaccgaagguccgaagcacugcuaugcagggaggaaaaaagaggcauguaacugucuccuccuccugucagagggauagaugaucauggcucaaauucccagcgagcuguaugauaaaguagaaugcauauguuacugugguacagcacuuuaugcugaauaaaauaaagccaagaccuagcacguggaauaaaaacauuuugccagauacugugaauaaagcagugaauaaaaaaaguucacaccucaaggagauuauuucuacugagugagucaaaugaccaagaaauuuacaauacaacuauaaacagagauaagcauuacccagauaccagcaauuacacagagaguugguacuagggcaaaagcugcuccugggcaucuauggaaaaaacgacucuaccuagugagucuggaucggaaaucugaaggaaaucaaggacggacuuuucaaaaguagggaacaaacacacucuaggggacagggcacagguuuuguuggaugccuaggaaaucagcaaaagccuugaauuaagagcagaauuaguccaaaggaaacgauuaagacaacagccagcaggcaaaguuauacucaucaacagcugagagggccccaggggacaacaaaaaaucugcugugaggaagaaaugauuuaggugccagaauaaauaaguugcugauuuuugguugugaaaaugaacuacaauuaaagcuuuaugucaucuguccuucugucgaagagaaaagcugaccgauaguguauacagucacaacaaagagagauaaagaccaggccaaugcaagguagagaacuuuuaaaaaucaaguuuaaaaaaaaaaaggaaaaaauaagaaaucuuggaagcguuaagaggagagccaaaacacgcaguccccauauaggcaagcaaguauucuauaagaacacauggugccgggcauugguggcgcaugacuuuagucccagcacucaggaggcagaggcagguggauuucugacuucgaggccagccuggucuacagagugaguuccaggacagccagggcuacacagagaaacccuguuucgagaaaacaaaaacaaaaaaaaacaacaagaacaaaaacaaaaaaaagaacacacggacaaccauagguuagcuccaccugugauaauuuaucagccuucuauuacaaaaugaaagacuacaaaguuccauuagacaaugcagagcuuuguaacuuauccccaggaagauaucacacauaaaaggaugcuuagagcucuuuaaaaaacugaggcaagagugaggacauacugaaugacagauaagggaaagagccuguagguugcugucaguucucugacaaccaucaccccacuggcuuccagaccaccucacucucacuuaacagguagagugaagacuuggacauauuauuccaaugcuaacucuaccugggcaccauugaauaacugaaaugagcaauggugagaaagaugccaacacugguacuuaauuuguugcuacagaaaacaaaaauuccagacuauuguaugaguccgaucucauuauuccccaucaggaaaauaccuaaugaccaaacccuucaugggucccuacugcuuacugccuuggucagcauguaagaaagacccuuggugaucuaauuuccugguuacuucugcaaucucaucaaacaaacaguaauuaaaccauguucaauuucuuuaaguguauccaacguaccucuuuucaagcagcaguucaucugccuacaccaauaugccggauucuacucugucuacauucaacccaaacuccuauuccucauugagucuguguacaccuuacccugaaaggcuucugcaaaccaccugagaaggaucacucccuggcaccaucaguccacacuuacaaaugucugcacauuucggcaaacaauuuccuacacuaacucuugaguguucuaugagcacagauucuguucuggaucucuguagcuaacugggucuaaucugaaggacugguuuucccacuagaagaaauuaaucaugagcacagagaacacagugauacaagcaccugucucuacauuucagcaggaaagauaaagaaauucuaagauggcucuagaaaaaccaaacaauuauguaaaggcaggcacagggcacaugaaggcuuccaucaucuucaaugacugcccuuuucaucuccccagccccauuccagucugaauacggaauccucuaaugaacagggauagcagcaauaaccuacuauaaagggagaaccaacacucugaucauuuuuauugcuaagguguguguguggggggggggggguugauaaaagguaauauugcguaauucauuuuuauuuacacaaauuuaauuguguaaucaauauauauuuaauuauauguugaaauuguucuugacauaguacuuuuacaaucauuagaaaauguuaaguugcugaaaaauagugcaugacauuacugagaaacaucgccgggagcuucaguuuggacacuccaaagucacuuaaaagggaguauuuaucugugguacuugcauacacacacaugugccagugugcuugcauguauucauaagcuugaaaggggcuuuuuaaaaaucagcguucagaacaagugaauuaaugccauucaaaaugauuucacgguuuaaauccacaaaacaaaggaccuuaauaauggcaaagacuugguaccuucauaaaaacaaaaguaguuuauaaaucaugcccuacaaaaugaaacaaaugggaacaaaauuuggucuuaauacucagaaaccauucuguuacaagaaagacgaagacuuuaucauuggaccccuuucugucuaguagugacucuucucaagacagcauugcuuauucugccucggaacagguuuuacaacuucuagguaauucaugaccuguucuagaauaauuacggccacguaacaucuuacacauaaccgagagcauuuagauuuuuuuuuucacgccuacggggaggaggggaagcuguguguauguguaaaaauuucagaaacccgugcaccugaauacucacucauucuaagucuugacgaacagaaaucagagccaagucagacaacgugaaggugcauuggcauagacaagaggaagguaaacagugcaaaacuccuguuucguguuaaacaaacggaaaguuuuggguucucggggagacacuuucuuggggcuaaucagaccuaaaagaugguucgcugagaccggaaaggcccgcaaacagauugcaggaauauguuuucaccuugguuggcuaaaagcugcacacgcgugggauuccuggccaucgggugcguccccugcccgggcuccggguccccagauccgaguucuaccccgaacccuauccagaucucaaucuggacuugccagcgccgcguccacccucccgccggccucaccuugguuacaaaaaaggcuccacaguuuagcgaagaucagccccaucaugagccccggacgggacagacuuccugggcagcacucggcggcaggugccgcggcgcccgcgguggaaccgaggggaagccgauccggagccgcggagccucaagaguccagcgaagcuuugguccuccgcggagccgggaaccgccgcagacuccuuuguucgcagcgcgcugagcccagccccgacccguagucgcucggucugcgcccaccuacccugcacagccugggcuggccacgagccccgcccccgccccgccuccccaccuacgcccgggaccacccaucgccggaaggucggcacgugacgucggcgcgcugacgucagcgggcgccugggacguggcggguccucccuguacacuuccggugugcggauggugggcgggcuuggcgucugcggaggcgggguguggccgaucuggggauuuccucggcgcgcgcucccucuccugccacucugaagaaacgcggacugagguccagagcagcggucauccccgaggccuggccaccgcgucccucgcugcugaccgccugaggaaccucagcuggcgcgguccucugacugaagcggaggaguggguuuccguuccugucccaguguugggauucuagcgugauucuuaauucugaauggaauugauagggacgugcgugcuggaaugccuguagccaggguccaguuaaguuucuaaaaucaaagugccaucaguuuggccaagcguuaggugugguaguuaaucucaaaauccuuaccaguugaaacuggaaacuucauaggccagacuaguccuugaggccaccuggcgggccccacauaaccagagaagaagccugccagccugaccuuguaacaagguaaacugucccaugaccuauuccaaauaaaacaaaugaguauagcuuaagaugcccugcuaguggccgggcgugguggcgcacaccuuuaaucccagcacucgggaggcagaagcacgcggauuucuugaauucaaggccagccuguucuacagagugaguuccaggacagccagggcuacacagagaaacccugucucgaaaaacaaaacaaacaaaaaaaagaugcccugcuagugcuacacuucaaaggacagugaagacuugaaaacucggguacaagaucacaacaacuucuugauacuaaaccauagcuccagccucuccuacagaggaaaaguuguacugauccuguucaaacauagcuuuaaugaucauccguuggacuacaaauuugaaugaguuugugguugcgcaaacuuaucauuucuacuuuuggccucauuauuaaaaagccgacuuaagauucucuaacgcccuuuucagguuagaauuuagaaauuugaaaguuuugcuaaccugaaggaaaagaaacuuacucugacugaaacaaaugauagaugcucacaaauacaguugaauauugccuaaacuaauaaaugcugaugcauguacugauguuaggaaaaaauggaacuuguuuauacuguacauguguauugacuauauauguauguauauauauaauacauuauauauacauauauauguaaugcuugucagaaauguaaugaaaauagaaaaaucugagcauaagcgucuuaaauguagcucaaaaacuaaauacuuuuucuuuaaauaucccuuuaagguuuuguugagacuaauuucaguguugccuuugguauacaagagguaauauugauguguaucauggugccacuugaaaaugaauauaguuugaguucaugagauaagaauaacuucgugaaaauauuaugaaaugacaacuuucagugaaguagaaucccauuaaaaugucuccaacaaaauauaaguacuaaauuaguauaaaauaaacugaaguuucaaggaaguaaaauguuaacuuacaaggccuaaaaaaaggaaaauuauauagauuaggaggaaccaauguaaacugaccaggugauacuuggaaaaacuugauauauuuggcauugaguucaacuuauuaaucaguuaaguuagaucaguuuguacaggccuugaaaaaaagagaguucaagaaacuguguguucugccagcucaggaaaaaaagccacucuucaaaaacaucaaacauuuucaugucaauuacaauuuuaauccaguuugcugauuuccagaugaaccaggguugauugagugcccauacggaaguucuuuucugccauauggucgaagaaaucaauauaauuucauucaggaauauccuauuagacacuuuuagaugcuguagaugauuaauuguugaaaacaauuuaauaucauucuugaaaguagaaaagaauguauugauaaauuucugaugaaguuguuuuaaaauucacagagguuacacaauaccuugagcuucauaauuuuugcuagaccaaaauaucuuuaaguuuaugacucugcucauaugugagcaguguggcuuuuuucucuccucuguacuucugggaucaccauagcaagccuccccagaguuuucuccagugagucucccaacaggugcuuggaagcugucaccuugugcuuaucauuuggagacaugcuuacugucuuccuggauccaggaaaggcacagugguuuguaaaauacccuuuguaggaugguuuugaagcugacccauuuugugcgaugcucaugguccucuccucuuuauaaacaauguacccugccuuuuguuacaaucuuguacuuagggcgaggccuauuacacauuuauauaaccucccauuaaaaacccggaaaucugcacuccucccuuacauagacgaguuaacuccugaucuguuugaauuugggucacuuaguucuuccuugcagagugaagacucuugacaaccauuccuccaacauggguauaaacauaucuuaacacguagugaagguugcccuuuuccuacacucuuuaagucaguucauguaauuuguuuggucuguaguaacacuauaaaguaugaaauauuauauccacuuaauggauccgaaaaaugaaauauaagaacuuuaauaauuugcccauggcugcaagaacuggaauaugaaccacagcagucuagaucucuaguaaaauucuuaacaauuaagaaguuacucacucaacaaccugauaagccccauauucuaaaguuaaaagcauuuuauuuucagaaucuuuacuguuuuguuucuuucucaaauguuaaguacacauucaggaccaaagagcugguauuuaggcuuguaguagcuggacugcuaagucuucagagaggucuggcuugcagggaguuuaguccuuaguguuucauaauagcagcaggagaaaugaggaaaucccaguaagguguggauuauaauuuauagaacuaaugaugaaucaguccaaacguuugugugcuuaauucuggcagcauuuugaaccagauucuauucauuuauucauucauuuggcuuuccaaacacuguaaguucuaauuuguaguuucucagaugaggccaauuguauuagaaaagcugaauauuguauugacaggauuagauuuguggcuaaauggauaugcaaagauauuacguuaucuuuacagaacucuuaagauuaucaggaggggguggguguuagaaaugccuauaauucugucucucacaagguugagacaguaggauugugaaucaagaagcgccugggcuaaauagggauguuugucuucaaaaauaaacaauuaaagaaaugaaugggacuaaguagaaauucuaguuaguaaagugcuugccaugaaagcacgacgaccugauuuuuagaugcccagcacuuggauucaucaucaucaucaucauggucgucaucauccagcugagccaggagugugagccaguaauuccugcucuggggaggcagagacaugacgugcagaucccuugagcuugcugccggucagucaauccaguuaagucagccagcuccagauucagugagagaccuuaucccaaaaaugaaagcugcgaguaauugugagugcacaucaaugucugguuuccacauauaugugcacauauguacaucuggaccugcacacacacacacacacacacacucacacacacaaacacacacacucauacaagagaaaagcauugaaagaaaaagaaguuuccuguaauggagaaguguagaauccagaauuaagucagucccccagaucaaucugaaauaaaauccucagagauaaaaugaggucauaaccaaacuuaaaaugaugauaucacaucauauuuauuucucccaccggucccugcuugggggcccauacuaccccuuuaaagaucuaaagucucugugacauuugcauguuuauauaggagucuuccauugcuuagacagaacaucuccacucuacuaacugcagauuuaccacauguuuucuggucacuguucaaguguucugaaguagugaacuacuuuauaucaaaugcauauuuaacaacaguuuccuuuucuauuucacaaagguuugauuagucauucagggagugcccuuuauaugucaaacaaugaguauucuauguggaaaugaaauuucucccacauggacuuucaaguucaaguuuucuuuauuuuuuuaaagacuucaacuauaucuagugucaagguuacuacaaaguugucuguugaaauuccuuuguguggguggucuagcccucugaauccugggcaaagcauuccauguugcaccaagaugucauuuaccuguucucccugccugaaugcagcagaacaggcuacccuucccaggucagacugugcuuggugacagcaaggauagagugcacauagacacauaaccuuucccagaguuugauucaccugugcccccuuggcugcuuuuauauuggguagcucuaugaaacuaguuuuauguuaacugcuguagauucauaucacagccauauaaaauaguguggugguuccuggaggggaggcugccuguccugcuguaagcaagccuagcaaacuaauguauuucuucaauuuggacuugucaaguuuuucuucagccacaucacucuuauuugggggugaauagauguuuauguccugucaggcaugucaugcaacacuuaacaccugugucccagacacauucuguuaguuucaggugaugaagucaggaaggaaucccaugcauugaccacagauacaugaucuuguggaaaaacuggguacuuguuuuagaaacuggcuuacuggucuauagccuauuuucuuuuucugagauuguggaaaguuauuacaacucuuggaacuuucuuuuacuccuugaaaacugcuuauaaccacugugcugagcuguggcagugucuuugucauggaauuuucaccuaguaaagacuuggugugucaguuauauauauuuuaaagccagugugaaaacuuaaaagauuaaacacacaccaagcaaaaacccuccucuauaguuaccuaugaaauauggcucagaacaacaaaaagcacaaaacaaacaaaccaaaacaagcaaacccuaacccaguggcauuggagacaaaaguauucaucauguucaagcauaaaacaucccacugacuuugguuaguuauuuuuaaacucuugucaccucauuaccaucagggaauucacaucaagacucuuguucucuaaagcacguuaacuagaagcuucauggcuaguuguaaacacuauuaggggauuuuaaguuguaccugaguacccacggguauuagcacauucaaaaaauauggguacuaggguaggagauauggcucaauaguuaagagcacuuguaccugcauagugcccagguuccauuguuagcucccauauguuggcuuacaaccuucagauccuggguuugaucaaagaggcaagcacaugcacucaggcaaaacauucauacucuugacauaaauaagucuuuaaaaaagaaaaaaaaguguccgagggaagccuccaccgcuacuuguacugggacaauaaauggaaaucucccuuauuucagguuagugagguauccaguucaacccagcauucaagagucccaggauguacccggcacaguccuuccuagaaaaagcucca

SEQ ID NO: 642 - RNA, 4232 nt, Mus musculus
acuguggcauacauuucuacaaauggcuugcccuguaaaacuuccacauucugugccaaggaaaguucugguucuuacaagguacagcauucagcauuggcagauucagguuucacgaagcaaauauccuuaccaguaacaccucacugacaguuuacaaucuggguacaaugucuccacuggacagcugccugccagguuauuauuuuccauaagcaaggcuucuuuucugucacuugcauuucgcguuauacuuuauacuuguaaauacuucaaguaugugacgaugguaacuuuucccuaaccuugguuuaaaaugucagaaaagaaagggagaagaggaacaugguuacaggauguggugacaaccuguacccuagcuaugcucguguuauaugcaauaucucaauuuauucuugucgguacaguuuuggugagaaagcaauaaccaaaugacuugccaaugcaauuggugcagcugguauucuacagacacauaagguacacauagacgacuuccuuuuagggcaagauaaggaugcuuucguguacuuuggcaauaaucauggcuucuaaaagcaacggauuggcagcuggcuagauaucuuugcauuuauuuuucacuccuugcauaauuccuucaagcaguaauguuagccuuauauucuucaaagcccaucuuccaguuggacuuaagauaaucaauaguucuguuaaauaaaugcacaaggcccucuaaauuaaucaguauaccaaagcaccaaauaacaggagaaaaacaauuggaagcaaauaggaugcuaaguucuaugaaaauguucaaaaauaauugagagagaauaaacucugcuuuaccugaauucacaaggcauuagaggaaauauugggagagucucuucuugcuaagaaauucuaguucuguuugugcuucugguuuguucuugauuccuguuuucuuuaaaggaaaggcauagaggauuuccaaaaacuucaaaaaggaguccaguggcauggacuucaucuuauuuauacauuacaaaggguagacacaagcaccuuagucaacauuugugagaaugaagauuagcacuggcauuuuuaugagaaaaaugacaaugggaugcaaacaacuuuagaggaaaucagagaaauggcguuacaaaggaacuuacuuaugucaucuuaauuauuuguaagaguaguaaucagugaucagaguuacaaaucaaccaacaagauguuacaggccacuuacuggcauguuuguggugggacauuaacaaauagagaauaguuaaaggcaaagaacaacugagaacaaauauuauugcaguaaggcuuuuaggguauuuaguagacucugaaauauaugaucuaaaguggugcugucuacuauuauaucuacuggccaguuauggguagugaucuuuaaauuaaauaaauuuucauucaguugucugguuacauuuugaaugacucauagccacacauggcucauggcuaccagugugggcuacagacacuucuaucauugaagaaaguuuuacuguaacaugccauaauguuucaacugaacuauuugcuuuugaaggaaauaguggagggaagggaggaagaaaggaagcaagcaagcaagcaagcaagcaagcaaggguauuugagagcucuuagguauauucaaacaauuauuuucuuguaauauaagagaugccucauaaagaaaugagaauaccaguugacauggcuuugcaucuucaugguauuuccuucaacuucucaauuuucacacuggaaaaaaauuaaauauauuuuccugucuuuuuugcaagauuacuuuacagacggauuaauacagauguaaagacuugaaagcuuacagagaagugaucuauaaagcacaccuguaaggcaagcaccaaauugcacacaagggaacaauaguccaucaauccaaaaggcaacucaagacaaugaaggcaauauauucuugagaaagugucaaagugaauagaaaaacugcuugaguuucuuuuuguccauguuuuuuuuuuccugccuuguucucuuauuugccaaaucaccuguguauccccauuugccuggacucucucuuauuuggagucacuuugugccucuuuguuuguucugcucaggaaucccggcaucuuagcagaggcucuuuugaaagcaaaauagaugauccuguaaacauuaguuaucucuuauguauuuuauuucuauuaaaaagcaaggaacugugacauaauuccauauaaauauggaggaaacuugcuuuugauguaaauucuacaaaugccagacuuuauaaacaaaauaaaacuaccuuaaaguaugcuuauguccagauaauacauagugugggaaggcaucucauacaaccuguuccuuuuacugacgugaaaacaaaggcuuauauagguacaauaauuaucguuggugucaaaaguggguuuggaaguuaaaccucucaauuguuuuuuuuuuuuuuucuccuuuugauugcuguggcuuacauuccucuguaaguaauuaagacaacuaagcaucuggaagucauaauccaugaaaaauuaauuucaccugcuauaaggaugcugucuacacacuguguccuauaguaugaagcauugaagcaauagucuucuaugcuauuacuguccuaagaauccuguuguucuauuuccaguuccaucccugauaggguccuuauguguccccucucucaccuccucagcuguggucaucaguuagcagugcuauuuauguuugucauuugaauguuuuuucugccuuuguuucauuucuacucaaugguauuugaaaacuaauacuguuuauugaagaauuucugcuaccuagauaaucaccguuuuuacuuguucguggaaacuauucgggaacuuguuuuccaagaaggucuuaugggaaaagauugugagaucagggcuguuaccuaugauauacucauacuguuguguuuuuauaaagcacuuuacauuuuacauaguacauugauucgugcuuuuacuuguucuuucauugaaccacagaauuaauuuuccuauguguuaagcaccuacuguguggaaguuauucugcagaucuucugauacaagaaaacaaauuauaugguguuuuguuucgcacacacacacaaacguguguguguguguguguguguguguguguguguguguguaaacuguucagagggcugaagagauggcucaguggcuaagaaaacuugcuaauuuuuuuuuucagaagaccagaguuuggucaacgguguucaaaccaucuguaacccaagcucuaggggaacucacgucauuuucuguucuccaugagugccuguacucauacaaacauacaaacacacacauauauauaauuuaaauaugaacaagucuaaauaaguaguuuagggaauaaauauaacauuauaauacaauaagauuuucaaacacaacuuugcaaauaagaaauaauucaaugaacuauuugcucuauuucaaauaagcuguuaauuuuaucaaugagaugagaaaggcucaaagguccaggaagaauuguccauucacuuaaauguguacugagcagacccagaauagaguuucucuucccuuccauggauucugcugucauuuuuaaauggugaacauauuuaguuuuaaacaccagugcaucuaaaaagcuuuuaccaguuaaguucacugcaacuguuguaucaaaaaacagacgucauuuccucaacucagcgcuguugacauguaagguucccaagucuggugaagguuugaaaaaugagucucuaccuucuaauuccuagguauuuggcgaccuucauaacuuuuauugauuacucggaaucauacaaaucccuccaaagaaaaggcauuuauagacaucacuaguguucucagggugcacagugggaagaggauggccaaagcauucuuuguaaaguuccuguguugccuguuaagucgauuuucucaggaaucaggccccagaacagugguagacaccuacaauucaagccaugggaggcaagugcaggaggauuacaauucuguguugaggagagaggauggggggagggauuaaggaaaucuccauuuccuguauuauuuagucuuuacuauauguuuaucuuuauucauaucaaagcuuggaaucauaaacuucaaacuacaaaaauagcacauagu

SEQ ID NO: 643 - RNA, 4232 nt, Mus musculus
acuaugugcuauuuuuguaguuugaaguuuaugauuccaagcuuugauaugaauaaagauaaacauauaguaaagacuaaauaauacaggaaauggagauuuccuuaaucccuccccccauccucucuccucaacacagaauuguaauccuccugcacuugccucccauggcuugaauuguaggugucuaccacuguucuggggccugauuccugagaaaaucgacuuaacaggcaacacaggaacuuuacaaagaaugcuuuggccauccucuucccacugugcacccugagaacacuagugaugucuauaaaugccuuuucuuuggagggauuuguaugauuccgaguaaucaauaaaaguuaugaaggucgccaaauaccuaggaauuagaagguagagacucauuuuucaaaccuucaccagacuugggaaccuuacaugucaacagcgcugaguugaggaaaugacgucuguuuuuugauacaacaguugcagugaacuuaacugguaaaagcuuuuuagaugcacugguguuuaaaacuaaauauguucaccauuuaaaaaugacagcagaauccauggaagggaagagaaacucuauucugggucugcucaguacacauuuaagugaauggacaauucuuccuggaccuuugagccuuucucaucucauugauaaaauuaacagcuuauuugaaauagagcaaauaguucauugaauuauuucuuauuugcaaaguuguguuugaaaaucuuauuguauuauaauguuauauuuauucccuaaacuacuuauuuagacuuguucauauuuaaauuauauauauguguguguuuguauguuuguaugaguacaggcacucauggagaacagaaaaugacgugaguuccccuagagcuuggguuacagaugguuugaacaccguugaccaaacucuggucuucugaaaaaaaaaauuagcaaguuuucuuagccacugagccaucucuucagcccucugaacaguuuacacacacacacacacacacacacacacacacacacacacguuugugugugugugcgaaacaaaacaccauauaauuuguuuucuuguaucagaagaucugcagaauaacuuccacacaguaggugcuuaacacauaggaaaauuaauucugugguucaaugaaagaacaaguaaaagcacgaaucaauguacuauguaaaauguaaagugcuuuauaaaaacacaacaguaugaguauaucauagguaacagcccugaucucacaaucuuuucccauaagaccuucuuggaaaacaaguucccgaauaguuuccacgaacaaguaaaaacggugauuaucuagguagcagaaauucuucaauaaacaguauuaguuuucaaauaccauugaguagaaaugaaacaaaggcagaaaaaacauucaaaugacaaacauaaauagcacugcuaacugaugaccacagcugaggaggugagagaggggacacauaaggacccuaucagggauggaacuggaaauagaacaacaggauucuuaggacaguaauagcauagaagacuauugcuucaaugcuucauacuauaggacacaguguguagacagcauccuuauagcaggugaaauuaauuuuucauggauuaugacuuccagaugcuuaguugucuuaauuacuuacagaggaauguaagccacagcaaucaaaaggagaaaaaaaaaaaaaaacaauugagagguuuaacuuccaaacccacuuuugacaccaacgauaauuauuguaccuauauaagccuuuguuuucacgucaguaaaaggaacagguuguaugagaugccuucccacacuauguauuaucuggacauaagcauacuuuaagguaguuuuauuuuguuuauaaagucuggcauuuguagaauuuacaucaaaagcaaguuuccuccauauuuauauggaauuaugucacaguuccuugcuuuuuaauagaaauaaaauacauaagagauaacuaauguuuacaggaucaucuauuuugcuuucaaaagagccucugcuaagaugccgggauuccugagcagaacaaacaaagaggcacaaagugacuccaaauaagagagaguccaggcaaauggggauacacaggugauuuggcaaauaagagaacaaggcaggaaaaaaaaaacauggacaaaaagaaacucaagcaguuuuucuauucacuuugacacuuucucaagaauauauugccuucauugucuugaguugccuuuuggauugauggacuauuguucccuugugugcaauuuggugcuugccuuacaggugugcuuuauagaucacuucucuguaagcuuucaagucuuuacaucuguauuaauccgucuguaaaguaaucuugcaaaaaagacaggaaaauauauuuaauuuuuuuccagugugaaaauugagaaguugaaggaaauaccaugaagaugcaaagccaugucaacugguauucucauuucuuuaugaggcaucucuuauauuacaagaaaauaauuguuugaauauaccuaagagcucucaaauacccuugcuugcuugcuugcuugcuugcuugcuuccuuucuuccucccuucccuccacuauuuccuucaaaagcaaauaguucaguugaaacauuauggcauguuacaguaaaacuuucuucaaugauagaagugucuguagcccacacugguagccaugagccauguguggcuaugagucauucaaaauguaaccagacaacugaaugaaaauuuauuuaauuuaaagaucacuacccauaacuggccaguagauauaauaguagacagcaccacuuuagaucauauauuucagagucuacuaaauacccuaaaagccuuacugcaauaauauuuguucucaguuguucuuugccuuuaacuauucucuauuuguuaaugucccaccacaaacaugccaguaaguggccuguaacaucuuguugguugauuuguaacucugaucacugauuacuacucuuacaaauaauuaagaugacauaaguaaguuccuuuguaacgccauuucucugauuuccucuaaaguuguuugcaucccauugucauuuuucucauaaaaaugccagugcuaaucuucauucucacaaauguugacuaaggugcuugugucuacccuuuguaauguauaaauaagaugaaguccaugccacuggacuccuuuuugaaguuuuuggaaauccucuaugccuuuccuuuaaagaaaacaggaaucaagaacaaaccagaagcacaaacagaacuagaauuucuuagcaagaagagacucucccaauauuuccucuaaugccuugugaauucagguaaagcagaguuuauucucucucaauuauuuuugaacauuuucauagaacuuagcauccuauuugcuuccaauuguuuuucuccuguuauuuggugcuuugguauacugauuaauuuagagggccuugugcauuuauuuaacagaacuauugauuaucuuaaguccaacuggaagaugggcuuugaagaauauaaggcuaacauuacugcuugaaggaauuaugcaaggagugaaaaauaaaugcaaagauaucuagccagcugccaauccguugcuuuuagaagccaugauuauugccaaaguacacgaaagcauccuuaucuugcccuaaaaggaagucgucuauguguaccuuaugugucuguagaauaccagcugcaccaauugcauuggcaagucauuugguuauugcuuucucaccaaaacuguaccgacaagaauaaauugagauauugcauauaacacgagcauagcuaggguacagguugucaccacauccuguaaccauguuccucuucucccuuucuuuucugacauuuuaaaccaagguuagggaaaaguuaccaucgucacauacuugaaguauuuacaaguauaaaguauaacgcgaaaugcaagugacagaaaagaagccuugcuuauggaaaauaauaaccuggcaggcagcuguccaguggagacauuguacccagauuguaaacugucagugagguguuacugguaaggauauuugcuucgugaaaccugaaucugccaaugcugaaugcuguaccuuguaagaaccagaacuuuccuuggcacagaauguggaaguuuuacagggcaagccauuuguagaaauguaugccacagu

SEQ ID NO: 644 - RNA, 625 nt, Mus musculus
aaagcaaaacuggccacccucugguauacccucauuuacacucugauccauguuucuggguuuucuuuuuaaaaaugagaagagggggggaggagggagggagggagggagagagagagaaacauaccauguacagaauggaaguuuuguuuuuuguuuuuugggguuuuuuuuuuugccaauuucucaacuguggcaagauuuuaaacugcuucccuaaagaaucccugaaaaccagcccugugagguaagacgcggccucagucacugcccccugcgggugugcgucccaucaggaccccagcacuuccuguuccucauggugcccagggagaagcaaggcugagaagcgaugaaaccggaggaguauuauggagccgguggcuuugugcuauggauccugggaugggggccucuuaccccccacuagccaguccuugccccaccugccccagcucuugggccgcaauagguguagguugccugcagguuaaaggcacgggcaacaugggccagggcaggugugcaccuggacaagggggcugggggugaaccucguuggagucuacagcaaagcuaagggacugggaaggcuuuacacaggcauugugggccucuauuccca

SEQ ID NO: 645 - RNA, 3725 nt, Mus musculus
caagauuuaggcauccucuuacacugcugggaaauaucagugugacuugucgauccauagugggacauccaaagaagagguucugcagauggugaggccaaggguccagaaaauaacaucagugagggacagacuccgggauucugguccgucaggcccguuucgcuugggggacccuugcgcacgagggugaggcgagaacuaccaaccuccacccacauucacuagcgugauagauuaucaggcaguuccaccuuaagagucccggagcgcccggcugcggagaucccuggcaccugcagggggcgcuggugccucgcgguuccucccgcgccagggcacagcaggcucugcagcuuccaggccuuaguccccggaggggguggggacccuagggaaggaagggcgcgggugcggccgcuagguaaggaacccgagcccuccaggauugaaaaacagccucaacgaggcgcuagcaccauggagcuuuccgucauucgggccagagaggaagugcaagcaggcgcccuucccugcccccaccgccugccuuccugcgucccuccaccuccgcucuccgaccccggccgugcuucccagacccuuuguucuccagguugggagcagcuggauggguuccccggggaggagguguccccgcugcacguggaggggaaaggauuguccccaggcuuccgacccucaguucucgccuuuagaguccccugagccccaccgcccucuacuugggcagcuccgugcgggcuuucccgccucucuuuccacgucgcggccucccgggucuccaggaagaggaaggguaaagacugacgccaggggcuagagagaccacgucuacuuccaggcgcugagaaacuccugggacucguuugggccugaacccacacgcccgccgcaggucgcagaggacauccucggaccuugggcgcauggucccggcacagccucucuucgugaggaccccagagcccuagaagggagaaugggacauuguaugucgcgcccaggagucugauugcaaacgaacgcccucuccaccccacccuaggcggcaccacccgcgucgccccucugcugcgcgugaccccaagggcuugggcgauugugucucccugaguacaguuacaauuguguucggcuuaauuucuuacuuguuugaaggcgucgcggaguaaagcgaggggagcaggauguggggugggggaggggagcuagagcgcgaaacugcgggggaggggagggcaauugcacagugaagggucccguguccgaggugaccaggcagcacugcuuauccaggcccagaaucugggcccaggagccguagcccggcggagcucuccccagccuccgcccugugcaccaaucuccgcagacugcaguccucauuccucgcacuccagcacguuugcucucggccggguugggggaggguuccguaccagcagggugucaccaaguaggugcagcggcuggaguagcugcucggccuguggauguaggcuccaggcuuacgggagccccccucccgccucuuggcuugacccagguccucacuggcuggucuaaaggcgcgcuagcucuucucuccgcagcggguuccgggggacacaccccguccccaccccugagagcuggcggccagcucgguaugccaggcggccagacgggcgcccugccaaauuccgcguuccucuccaggagacggggaauugcgucccaggcucgggaaagccgguaguucgggcuugggacuggcuugcaaagccucccccccgcacccccaaggcgccagggacgccucugcagguuggauuccugcuccguaucacuucaauuuuaauuaaucuuuuaaaacaccgcugucacgucgcuugcagaaaauuaaucaaacuugaauccuuguugcauagcaagaauuucgauccaagucuuuuaaaaaggacuugacuuugcaaagucacgucuuuuacaguuccuucauucccccuuuagcaagggaaauacugcaaaagucaggacauguuugcuucuuucugccuuuaaaaugaaacucugcuuauuucugaucuuuauuuuccugucuuugaacaaaaaaaaaaaaguuaagcgauaaauugccuaccccuguuaauucaaaauauaauuaguuugaaugaucuuuguuuaagagcccagauaaacuaagauaaucuuaauuuuagugugacacgaccccuauuuuuccuugugaauaaugagaauaaagaagucauuaauuaauaccaagguaucuucauaaaagaugguaucuaguggugcugggacacugaaacacugguuguauuaguaauugauacuguauaauugaacaugaagauagucaucuguuuuuaaccucaaagcucggaguuuauuucgugauuacugagcuucuaauaauuaauuuuagucccuucuugaugcaaaaauaauucuuaagagucccaguuucccaugcaacagaggcugcuuguuaaagcccaccccucagaauggcugcgaagcuaugccaugcagcaacucuuccuguuccauuauuagaggugaauuugcaccucugccuucaugucuaaucacauuucccuuugcugugacuugcuaaaauacaagaacauacguaucuuuguauugcugcuuugucuccuugcuguagucaauugacgcagcuuaauacaugauuccuaagacuuucgauauuuuacguuucuaagauuugaagacgaauuccauuaaagaaucaaaauuuuuguagagugguugccacacaccagacucugaucaaacccacaaccugcauuagcuuacaccuuucuguuauuaaaacugcaaaacacauucccccuuucuaacaugaacugaaaaacagcuacugcaguuuucuggacuaaauuuaguguuaguacaacuuuuggccuuaauauaaaauccucuccacaguaauaaggucuuccaaauaacaauggauauuuagacucuaacuguaaagugucuaguuauuucucaccaugaauuugcuaauggcccugccuuuugaccaaucuaaaaggccauaugauguuuuucucauauguacaaaguuaggaaaaccuugugauaucucucuccaaacacgugucaccccaaguaaguaugaaguauuuuauaccacaucaauauucuuagaaucuacucugcuccauccaucugagcauccugcuuaauuaucagcacuaguccugaaacuguuggaaaguacuucagcuucacucuuuaauucuccuuuacuacaauuaaaacuuucggucagucuaugcugguguaauacucuuuucuuggaucuuauauuuucccacuauaauuuaggcugaaaugggauuaaaacaggaucuagaguucuaaucucgguugguguuuugggguauucacaguaaugaguccuauucccugcggucaugaagcucccaaaugucaaucaagcaaacugauucagaaaugccauuguucggcucccacgucacucgccuuccucucauuuuauugaacaauaccggaguucucugaucagucauucggaauaugaggcauuaucuggggaaaauucacaaagugucuugaucuuucuuugggagauacuguuaaggggcuuccgcaaggcagagagcuuguuuauauuucuaucuuuggacagcacuguggauaggaca

SEQ ID NO: 646 - RNA, 1959 nt, Mus musculus
agauccaucauuaacuuauggaggcauuuuuucucccuuaaagcuuccuuguuucagaugacucuagcuguguugaguauauaaaacuauacagaugaagauauaaaacugggcagcacuuccucauucucucuuuggccacauuucccaugaacuccucaucuaccagccuuuuguuguuacagguucauguaauuaugucuaguccuauuucaggcucaacuacccaauauguuuacuucagccaaucaaaguauuuaaaugaccagaauauaagaaacuggcuuacaggggauauuuugaaauucugcccuuuacaauaauuuaaugcccaccaaaccucuccccccacuuuaauggaacguguugcuauuucccuuucaaaaaaaaaaaguguuuucucaaccccagaguuaacuuugucauuuuuuuuuuucauuuuccuccuguuuuugcagaacagauaauucaaccaugagcuuuguguaugccugguaggcaguuggucuuauaucuugguauaguaccaucuuuuugugucugucucucuauuuuauuuaucaaaguuuaaaaauucuuaauuuucuauuccugguacuacuaccacaauuuauagggcaguauaccugauauaaugaaaagaaaaagauaaagaaagcuacaacagauaaaagaaaagaccucaggaacauauaucuaauugacacuaaguugcauuaaucaauagcugcauguuuuuguaaacugaaucuauguuggucuugaacaggaaggguuuucuguuuaagcugcagugacuuuucugacuauggauuaucauuccuucagauuuuuacaguuccucuaaugcauuugggacaacugucucaacauaaccuccagcuuuccugacaagucuuugcucugucucugucucugucucucucucugucuuucucucucacuaagaaguguagucuguuucuauuuuacuuuaaaaccuucugcuaccauagcuuccacuuccaccaccagauccauaaccaccaccauagggacugcucgagcuucuuccauccacacugccucccuucaugggucuauaauuugaugguugcuguccacuguaauuucugaagucauuauaguuuccaccuccagcauagucaccuccaccaaaauuuccuccuucauuguaaccgucauauccuccuccucuaccaccauauccaccacccuaguuuccauaucccaguucacaacccccauaaccucuacuacuguaaccaggaccaucacuaguugccaccguugccuccuagugcauuauauccaccaucaccaccuucauaacuaccuccgcugccacuaccuccaccaccauagccaccucuuccaccaaaguuuccuccacaaccaaaaguuccuccaggacccauaaagcugccagcuccaccuccacgaccucucugugacccagcagacugcagcucuuguuuagaaagggccuuuuucacuucacaguugugugcauuaauaguguggcauuucugaacaauuuuaucaaaaguuacaaaagcaaaucuucuuuuucccacucugcuugucuuucauaaugucuaugguuucaaucuugccacacuuuucaaaguagucucucagguuauauucuuccguauccucuuuaauaccaccaacaaaaauuuucuucaccguuaaaugggccccaggcuuuacagaauccucucuagaaacagcucucguugguuccaccacacgcccaucaagcguguguggccgagcacacagugcagcauccaccucuucaacacaagaguaggucacgaaaccacacagucuguaagugugccccauuucucagaauguucucuuaagcuaccaucugugguuucaaagcucagaccagcaauggacaguuuccucagcugcugugcuuucuuuggauuagggcccuccauu

SEQ ID NO: 647 - RNA, 266 nt, Mus musculus
gauggcguugcucgugccauuaaagaagaagaagcucaugggagucagacuuggagagcugccgagcuggauaaugaugcgggauuucaccccuaguggcauugcaggagccuuucggagaggguaugaccgguauuacaaguacaucaacguucagaaagacagcaucucggggauuagcaugguccuggcagccugcgugguuuucagcuacugcauuucuuacaaggaacucaaacaugagcggugacacaaguaccacugaa

SEQ ID NO: 648 - RNA, 3824 nt, Mus musculus
augccgcccuucuugugggaauaccaccguauuuauucaggguacgauacuuuaauagggcuugaagacgcucaagauagaaggaacgcaagaguaauacugaaaauccagaugcuuaagagucucccucuuaaccauuucacauguguaaaaaaagugucaaaauugaugguuggcaucacuucaaaagggugcuagcucuuuuuccacugaaaaugacauccagcucgcgcgaacgaugguccagcaggagacaaggcgcgucugguuuuccucuaggcuccuggggucaucagccuccccaaauuacaacugaguugcucuuuccaggcuuuuugaagcauccuuaaguuuccccaccaaguccuaaaagauguacaaucaugucacaacuugggcauacaagugaggaagcagcaacucugaagcagcugcaagaacacagucggaaggaagaacaccuaaggaguccacgggagcucaacagcucgcaaagcccuuuggaaaagaagcgcuucuucugcuggaucugguccuccaaucagguauucaaguucuaguuaaaagggaauuucuaacagaauuuuugcaggcugagaauaucuaaauuaucucucaacuucucuaaggaagguuaugauucacacacauuuucuguuuaaaguuucgcuaauauuuacucuaaagugacuacagaugucuuuggaacauuuaauuucauucaaauuuucaggaaugaucuucauuuuauuuaauugguaagaaauucguuagcauauccaucaaucaacgaagacuuuaauuucuucaguuuuacacugaaaauauuaacaguuuuaagaacuugugugaacuuucccuuuauaggguaauuuaaaacuccugcuuaaaacuuuggaaguuuaauuugugaaaggcauucuccaaucucuuacuuuugcucaguuuuaugagucagaugcaugauggaaugaaagaaagugugcugaacucaaacuuuaaaguuauuuuucaauuaggggcaccaguaaaugcaggcuacuggggauguuacuauguuacuuuuaaaagugaaaucuauguuaaauuucugcuuuccauucucucuuugccauuaaaaccuaaaccaaccuucauuaccugaugcugggaauauuauaaagucuccauaacaguucucaaaugcccacugaaagaaacauuuaaagguccuaauacuguaccuguaacuguuccauguugcaacuaaaauuaaucucuggguaggauugggaaucauuguucuauggaagaaaaaaauguuuguuuauauaaaggaaaugaaaauuuuuauuacacauaauuuuuagacaaggaucuauacauaccucuacauuuaaggucaccaaauauccaggucgguacaucuuaugaaguugguuggucuaaaacaacacaaaacaucagucuuuaacucuaaccuuuuuaaaaaaaaaguuccucuaacucccucuacagaaaagcuuguuaucuuuaccuuuaucugguacuccaagcgccaagaaacaucaguuauaugagggagagaucugccuauacugaaagacaaugauaauuuuguaguaucuacagaaaaacuuucaggauuuucucaauggugucuuucucuucuuaacucguuucauuccacucugaacuuaaagacuguugaaccucaucuucaaguucaaaagagugaaagcacaccuacuaagauuaugucaggcucuaucuugaaaaaaacauuagcuuaacuucaauuauuccacuugcccuuuggcccuuuauuuugggucaggaucccaauuuuuuuggcucaguuuuguuucccaucagcacacuccauuccuuacccacaagggaaaagcuccgcagcuugacaccuaacacaguaccuaccuucccaguaggguuucuagagaauucuuauuguucuggggaaggagaaagaaaacacaguuuugcaaacagcaggaaaaaaggggguggguacuaauuguuaauuuaaaaguuuaaaguaaguaaccugauacucggugcaaaacaguucuauucgcucucggucaaauuuacagucuucuaaauaagugcugaagggggcaggaggggggggaaauaaagcaagguuuagucucuaucuuuaaaaacugaaauuacaaugacaaagauaccacuucaaaguaagcgggcauuagauaaagucuguaccuuagaguagacuugucaacuuggugcuuuccugccuccaggaugcaaguugcagcugcugcaugacaaugcuuuaaaaccacugggucgaucuguuucaaguaugggugaucuaaaauaaauuaauugcuaaugauuacaaauccuuuaggccccuguuccuaagaggaauauuugguuuugguaaaacuuccucuuuagaaaauauaacaaaaauucaauuguaaauggaugagaugaacaagguuaacugcaaaacaauaaagagaauacaucaauaaucugcugucacucucuuuucaauuaccuucuuuuauuucgucuuaguauuuuuuuuuuaaauaccucaaagaaagggggggcagugguugcuggauggacugaaagcaaaggagaaacugaagguaguuuacacaguaaauuucaaaaugaacaacuuucaaaagacauuuuagagcaauugacuccaugaacauaaauacaucaaagaagcuugauaggagggcauacauuagcaugcacaacagaaauaucaaaaucccauuaauaucuucaaguccccccaccucuccucgcucucucucucucucucacacacacacacacagcuucgagauaaaccagguagugguuaauugggggggggggggggcuuuaagaacagcuuccacuuucauacuuguuguccaaguaucuaguaugaaacgggggggggggguguggagacccaaggaguucuggaauguguugauagauuugagggaauuaucuagaagugauuugucuuaaaguacgcucuuaauccauuaugacaauugcagucugcgaccagacauuuuaaauagucucucuuccugguagccgcugcagaacaaaacauuaggcgcccuacuugaggguucuggacgaauaaccugggcuuaacacucugaacgcccgugcuggagugaucagagaauccggagguguucuguagguuggaaaaugucagugcugucugacccagccauugcuucggaaacugccuuuucaacccccuccagcccagcugggggaggcugaaucacaggaccuccccaguugaaguccaagugucaaaacagcugcagccuccgaggaggcugaaaacccccacacauuuaggccacaaacuagacuugaacacggcuuuacaaaggaacaaagaaacagucuggcagggaaaccaggccaggagcguagagcuggccccguguaggugcccugcgggggcacagcggcgcucagggcccgcucggguccccacagucgggcugggcgaaaaccggggacuugcccgggccggagcugugcccaaggcgccgggcuggcggcucugccgggcgccccuccgcccaggccgcggcggcgggagagccgcuuaccuagcgcggccucguccgcccgggcguccagcaggcucuggaaagccgcccggaggagaagcgcgaaggcguuggagucaaaggaaccgggauccgccagcgucuggaugccucuuugcacagacuccgagagcuccauugugagcgcgccgugaccuucgacacgcacaccacgugacucggggcgcgcgccca

SEQ ID NO: 649 - RNA, 1383 nt, Mus musculus
acccuagaggaggcaagguacaagggugcccaggugccuugaauuguugggacaaggacagggugaaugaagcacgccagguaucacuggaggaggagaggggugccucucauuaagagagaaccuuaaauccuguccuggaagcccggacaagcaacacaaccugcuucccucaaguaaagugccagugccuuuccaacgcaaugccagcgcaacagguuguuuggaacagauguggacacaccaggaaaccugcugacauuaauuugagaggaucauucagaggccaaaccucucugggaagcaacaguagaccccaaagagcccgaaaaugggaccagcaagaagguugugccccgaccacuguggccgcuaaugcgggcgcucaggccaccaggcaaaaccagcccgccaacaaccugcguuccuggccauccgaccugaagcagcaggaaugcccgaggcucccugccaggucaguggggcgcagggaccuggggccuccuuagaagaagucuugggcuccgauucccggcuucuuccaggccgaugacccccaauucaacucgccgcuucuuggaucccuuuuuggagauuuccaugcgcaaagguagaaaaaugguggagagcuggugccgggcagcugcuuccugccuccugggcggacagaccgcacccgaaccccgacuuuugguauaguagggguuaggcaggccucuagggcuacaccuccaacuccaccccggcucuccggaacccugggaacuggcagcagcagacggggcgcaugcgcgccuccagccagggucccuccccagccguccgaguuuggggaaaguuuggagagguuugccuuggcagcgauggaugucccaaaggcugaguugcccuggauagggggccaggagcccccgggcguccuaugagccgguuuggcaggggcccgagggcugaaaagcagcagaagguggggagaagaaggccuuuuguguguggcacaggagugucacuugcgcacaaacgcagcagcgcgcuccguugccgccucagccucuugggcugcaccuccgccuccgaagcgcuucaguacagccgggccguucccccgccucccccccggcuccggccuuuguucgguuugaaaguaaugcugugaauuaaaagaaaugacaauauuuucuaucugcuugaaaguccaagagaagagcccuugagcuuggcaaaaaucaggcaaaucauucaucaugccaccccgcaccuguggucuuggcauugaaaacccuccagaccuauuccuauuaaacuuaauuauucucccaaagcacacaaugguugaaauggagcagguuggagucuguuuauuggugguaaauguuuuucuga

SEQ ID NO: 650 - RNA, 2528 nt, Mus musculus
ugguuuugaauuggcuuuauuuuuacugaagcuuuaaggcaacagguuaugcucuguuaaacaaucaacaaaaccccacaggaguggccacaauuucugugccuuccugcuuuagaagagcacauuuguaccuucccacugggguaaaauuagaaagcugaacgugauauguguggcuguaaccagccccugacacacauaaacauuaguacacagauugaaaggauaagagagggcuuuaauuuccucugugucugcaagggguugaucucauugcuaaucccguuugcugaauuuaacucaaaaagaugacguguccacacacucagucaacaggaaacuuugcuuuccaauaucccaugagaacaaguggaaauuuaacaggcaggcauuguucugaguuuuuaaacaacuuaguuaaacagcaaacaagaaucuucaacuugaccuuggaaaaggcuguguuccuacaguuaaucuaucaaacaacuugggaugacaaugauauauuucaaaguauugucaggugaaaagauugauaaauuugcugcugcacagagagaacuuggaaacagcagcaggcaauuuaacuuaccaacuccuccuccuugucccauucccacaucccaccccuccaccccgccuuguguccagccauuucuagagaacggggccaguaaaucagcacuguaauacuucuuuaggggcacagaaaagcugugaacaguauuuuucauauuagacacaauauuucuuugcuuucguggugaacaaaagucauagcaagacgucuuuguggcuaauucagucaaaggcacaucucugguuccccugcagaaaggucagugucguuguguuugguccacggaggggguguuuucacacugaaaacuagccagcuguccuugucagaccuucaccaucggggagcacgcacaagccauggcuauuaggcacauucuacaccugcaaaauauaccgauuuccagaacuuuucaagacacccucccguucucaugcccccuccucugucuacuaaacuuugacaacacaauucaagcccuggaugaaagcccugugagcuagaggggagcuggggcaggggcagcuccacuacugugucagggugucuauugagcagucaucaaagaaaugaggcgucaaguauguucucaaaaguacggaaaaacuugcaaguaauugcugcgaggagucacacauuugcuauugccacaaaugcucauugcugagcccuaauauuuaauuguaugcacuuguggucuuugugagguugcagccaagcgcccuucauuuggaaguggcucauuuuaaaauuuucuauucuuguuucagaucaguuagugggacaugaauuuuuucugaauucauccagugcaagcaugcccaguuuuuuuuuuuaaugucaaagcucguucaacuggauuucauaauaaacuccuagaaaccucuccuaggcaaauuuaucaacccagucaguuuucaaaagcuuuuucucauauuccagcuguagaugacuagcucuuggcgagaugaccaugaaauggaagccuggacagugacuggagggaagcugcaaaauagacaccauuuuuaaaaaucuuugggagagagaauuccccccaagcgucggucuuucuaggacaggagcucauaaagagcuagcuuucuuuucucagagcuuauacaccaaagguuucuaucugguugcagaggguugagggaagcgagcugggggagugaaagggugaauuaguugugguaucccucuaauccggaucuuugucuaaucuugcuaccuaacauacaaagaauuacaugaggagacccuagaggaggcaagguacaagggugcccaggugccuugaauuguugggacaaggacagggugaaugaagcacgccagguaucacuggaggaggagaggggugccucucauuaagagagaaccuuaaauccuguccuggaagcccggacaagcaacacaaccugcuucccucaaguaaagugccagugccuuuccaacgcaaugccagcgcaacagguuguuuggaacagauguggacacaccaggaaaccugcugacauuaauuugagaggaucauucagaggccaaaccucucugggaagcaacaguagaccccaaagagcccgaaaaugggaccagcaagaagguugugccccgaccacuguggccgcuaaugcgggcgcucaggccaccaggcaaaaccagcccgccaacaaccugcguuccuggccauccgaccugaagcagcaggaaugcccgaggcucccugccaggucaguggggcgcagggaccuggggccuccuuagaagaagucuugggcuccgauucccggcuucuuccaggccgaugacccccaauucaacucgccgcuucuuggaucccuuuuuggagauuuccaugcgcaaagguagaaaaaugguggagagcuggugccgggcagcugcuuccugccuccugggcggacagaccgcacccgaaccc

SEQ ID NO: 651 - RNA, 2524 nt, Mus musculus
agaaagauguaaaaguauacauuuuauucauucauuccaucagcugagaacugcuacauuguacaaauaauuauuguacaaaaaaaaucacaaaauguuacaaaauaaaaaaguacaaacugcauuaccuaauaaauacacuaaaaguaguuaaaguggcaacauggauuuuuuuuugauggggggugggguggaaacacuguuugacccagcaaaccauacaaguggcuuacauuuuuacauaauacaaagugaauucuauuuugccuuuuggaagaacuuuaaaacgacagaauauuaagacaaaagcuuccugcuaaaaacaguguugaaaucaagaagcuguauaaugcaggaggcugaccuucucacaaaaguucauaaaagccuuuccuaaguugaugaauaaaacgaacacaaucgagaacaccaaucuacucuauaaacauaagaguacagaauuaucauucugccgucagcaaauagcagacuucaaguaaggccugguacugucauuaaaaaaaaaaaaaucgucccaaagcuaucccuuccuuaacuucuucaaaaugaaccauuucuuaaaaaaauaacaucuucucucccccccuccccaauagguuuuuuucaucaaaauggaaugggcuaaucaucugguaacauaaugugucaauauccauuugaaauaauuaagaauugugaaauauuccaacaauaaacuaguuacuaaaucacaaacugaaauaaacuucauagaaagcacuucucuggauucugcuuaaaagccauuucucgaaauuggaacaaggcaauagaugaaaguacacccauuuuuaaaaaugugcaaaaauacauuuuuauagaaaauagacuaccaggaaugaacaaauucauaccgugagacaucagcuugcaaauuaaguagcacucacuuuauacagcaaauuuuaaauagcaguaggcucacccaaagcuaucaggaaacaucauucaggugcccagcaaccugcggcucugagaggacauucaaaaacugauuaaggcauuacaccuaaagucagucuacuaggaaagugaaaagugccauuacccuaauuagaguucgugugguucucccaacacaacugacacgcgccauuucccccaacuugucagguccucagacuuuucaagagcaugcauuuuguucaauauacauuuuggacagggauauggccauggacuuggcaaguucuucaucgcguuuuuucuguaucuggguuugcuugcaccaauugucauacucuggguuaggauaggaguggucaaaaacagcaucauaguguccauugcugagccaacugagccaaauacugggccguagagaauccucugggcccagauaguggaucaugguagacacgguggggcucuccagccucccuccaguaguuaaguguauauucacauucagcaucugccccauggccagcaauucgggauauccggcccacgccccaucuugggcagcagcgauaauaaacucccccacgucgcccucaaugagugggcugaagugguccaggugguccgcgauguagugcacggucugcucccucagcucccggugcaggcucugguccccguacacagucuugcugacagcucgguagaggcaguugccgucggggaugauguggaaucgguacuuguuucucugccucagguacuuguccugccucuccaccucggccagguacagggcuagcuucucgucccugggauccgcccgggacgugccuacggcuucgccuucgccguucugggccggcucgccgcugcuccgagcgggugccggaaccgggugagccucggcuucgggaucuugccgucggagcgcgucagacccggaggcgucgcugcgaccgcucgcccggucccaaccccgggaacugcgcuccgcccggcgcucuucaccccacgggccggagcccgggccggcgccgggcuccgggccgacgggggccggugcaggggcccggugcugggaggcugccagggccuggcggugcucgcucagucggaaguuccuguccggagcgucgcggacggcguucggggccgcgggcucgucgggccggagcagcucuuccagcagccaggcagaggaaccgcgacgcggcggcgagggggcugaggguggcggcagcaggaggcgcucggcgcccagggcccgcacggcgaugugcgccguggacgugaagugcggcggcagcggcggcuugcugcacgcgcccggcggggcggcggcggacccggaccgcucgaagcaggcagagaaggcgggcauggcagcggcggcggcggcuucgcgugguucgguggccgcggcgggugggcgcucuccgguauccggcuccggggccgcggcggcggggcuggcugacugcaaggagaccuugaaggcggcggcggcgguggcaggcggggcggcggccgugggccccggcgugcccgcaggguaaugggugcacacgcugcuguagag

SEQ ID NO: 652 - RNA, 1254 nt, Mus musculus
acaauuguugggaauugggcugccgacuguaagucaucaauaaauuccuuuauuaucuagagacuauccauaaguucugugacucuagagaacccugacuaauacagaaguaguuacagagacaaaguuuggagcugaaacaaaaggauggaccauccagagacugccccaccuggggguccaucuuauaaucagccaugaaaugccuacacuauugcauaugccagcaagauuuugcuuauagaacuuugauauagcuguuucuugugaggcuaugccggugucuggcaaauauagaaauggaugcucacagucaucuauuggauguaacacagggcccccaauggaggagcuagagaaaguacccaaggagcugaagggaucugcaacccuauagguggaacaacaauaugaacuaaccaguagcuccagagcucgugucucuagcugcauauguagcagagaauggccuagucgaccaucuuuggcaggagaggcccuuggucuugcaaagguuauaugcccauaguacagggggaugucagggucuggaagcuguaguggguggguuggguagcagugugaggggaggguauaggugacuuucaguauagcauuugaaauguaaaugaagaaaauauccaauaaacaauuuguuuaaaauuaaaaaaaagaaagaaaagaacagaggcuaacaaccagaugaaugggcucccagccuccgugcugcaauccuugugguagcugcugcugcuccaacagucaccgacuuggagaccauagcugugccucccacauaugcuaaucuuggcaaggccaccagggcugucuucaccaagggcuacagcuuuggcuuaauaaaacuguauuugaaaaugaagucguagaauggauuggaauuuaccagcucaggcucugccaacacagaaaucaccaaagugaacggcaaucuggaaaccaaguacagauggaccaaguaugggcuaacauuuacagagaaguggaucacagacaacacccugggcacugagaucaccguggaagaccagcuugcucguggacugaagcuggccuuugauucaucucucuugccuaacacuagggaaaaaaugcuaaaauaggacaggguacaugagggaacacuucaaccugggcugugacuuaaacuucgacgucgcuggacucugaauccgggguacucugguguuuggcuaugagggugacuagcugccuaccagaugaauuuuugagacc

SEQ ID NO: 653 - RNA, 3820 nt, Mus musculus
cuccaguauggagacgaaaccaaacagcugcggaugccgaaugaagucacaagcacagacacaauccgagcucucuucgucagugccuuuccccagcagcucaccaugaagaugcuggagucgcccaguguugccaucuacaucaaggaugacagcagaaaugucuacuaugaguuaaaugaugugagguaaguaguuaccuuugggggcguuguuuuagaguguaauugccuccaccuauuuuauuuugagggucauugaccacuguauugaaugucuagcguuugugcucaguccgaauuucuacuccuccugauggcaagaguccagucauuacauuuagugggacugcugcacacagaugggaauucaugcucuggcuccuagaguuaaguacaaagaugaaaacacacuucuucuggguagaccuuugaauguguuacuagcccugccuguaucauagcugaaaaggauauaaaugauccagcagugcauuuuaucuaaaaagcaagaaaacuaaagcccagagagguggucaagaaguaccaagagcuaaaggcauacuuaaaacugaauuuucaaacuccucccuagaauauucuuucucccaugacagagccuguucuagguaaugaucccacuggcucuucaccuaugccuuacauguuuaaaaugaaaugguaagugcacuauacacagaggacgcugagaaacagccucacguuccauuucuaaaaaauucuuccuuuacucaaagauggcacgugucucauagucuuucuccaggaaacccaguuggauagauucacagcacugcuggcagccaggggaucaaagccuugacauuaacugcaguggcacugucuauacaaccaagggacccuucuggucugucccaggcaaacaaccugaaagacagaaucuaaaucuauauaaccaagcaguuacuguuaaggguauaguuccuaaauauuuuagaagucaaauaauuauaucaggacuaaucuaacccuuuccuuuuauagaaucaggaacucagguguaucaaaguuaagggucuuauucaagaguacacagauaaacaauuaaaaaccaaaacaugugcaugcgaguacacacacacacacacacacacacacacacacacacacacacacacaccccaauccuggcuguuuacaugcgcggcccaaaucaugaaggacaggacccagacucucuguucucugcccuggggauggccagcucugcuguuucuucacugugaaaagagcaaggagcacuuuguaaaacugugccugcagaacaugaaugccagcugauccauaucuaacguugaucccagaugacauucugagacaugugccaaggugugaguaauuucgggcuuucagaaucugacacaugccccaagcuacaggugcuacaucuguugcgcgacuuccugcuuuuggaaaacaggguuaaauauuuaugaucacugaaaagucaugcuuauuuuuuaaauaaauuauuaaucaagcugucaccauuuuuuuuuaaauuugcaaaacauaaccuuaaaccggagguaauggaauuauauuugaagcauauacuuguaauaauagaaagccaugagacacuuucacauggacagaccacuucaaggcaauugucuugcauuucugcauuuccauggagaggccuugagaacagcaauagagacuaaaggugaaaaugagcaagagcucgugauuaucuggcuguaaggaggagauugggagaggcugggcugcagacuugcagacucuagaaacgcuuucauguggccauuuaccauuuucuacagccugucacaagaccuaagcuauauuuagcuccuggggauugguuuugcauucuucagaaaugucacaaggagacucaggaagagccaagguggagaacagucaugguccuccucaauggaaacccagcugauaagacaacuaaaagcauugcugcugaaagagagaugcuuuuuaaacauuaauaacuugagggcguggcucaagagaagagcaucugccugccaagaacaaguccaugguauccccauacaugcacacacaacgcacccacauacucacacauguacacaugcgcacacacacaaacuaauaacgcucaauauaguuucugugccauuuguuuuuuuuuauugcaauaaugauaacuuguugguccuuugccugccauuuucucuccuuagauuucuuuucaauuucuugaauuuaagugugaaaaaugagccuaaaauucuucaagauaaaauauuuuuguuuggugaauauauuauuaacccuaaaugauuauauguacgcuccucauaguaucauuugaguuuuagcuuuaguacauaugauauuucaauuauauuuagcaguggaauuuuuuuuuuuuaccacaaacauuauauaauacauuaaaaaaaaaaaaaaaaaagacugucagguaggccuuaacuaaaacaaugacuuuaaucugaaguuacgaaauucccauucacaucuuucugugucuucgaagucaaagccuauuuccugaccauuugacuaguuccuuauuguguuggcuucauaaauuuuccucagggagguucaggucagacugcuguaugacaaugucaccauaaaugcagucugguguugcauuuugcuguuggcucaucucagaugaacauguuucuaaguuaauaauaaccaagcucauauauuuuaaaugcauuuacaaccgcaguaagcccuucucauggcgagugagauucucugguucaucaugugucguacgugaugucugcuacccagaggcaggguucuuuucaugaacuacugugccuaccugcugacucucucucccuuuugcauuaaccuagccccuguuaguaucaaggacugacugcucccuccccucacccccgaguuuauuucuaaugagcuacuuaacucaugaagcaucaugcaagcugggacuaguugguucuucaaagcaaugacuggcagauauuuagauagaaacaggacucagcuaacuaccauccacuucauuuaaaacacaaacaccacccaagaauuccaaugguuguacucagcccacucaguacaagaacaccuacaagaaagaaaccgucugcuuacccacaaccccucagcuccagccaccaucggauagauaggcuagagggguuacaggugacccuugcagaagagccuaaggagagagaagggcgucgucauacaugggcugcucuugugugauuugagcaggcuuucuucugcaaucugauuucuugccucuaagaacugggaucaaaagcagaaacgacucaguguguuauauuuccuuuguguuucaauguguauggaggcaagcuuuuuggguuuuuuuuuuuaagaaugcauuguuaaacauacugggcuuggucuuuuugauauucuuuccuauauuuuguauacauuuuuucccuugcugagcauuugauaucaaagaaaauaauuuuuaaguguacauucauuggauaaagaggaauguuuaaacaaaguaaacaauuaaauauuuaaauauuaaccaagucucuugaagggauuguaaauacuggaguuuugaugcuuuuuagaguguucuuuuucuguacucugaagcuuggaagcaaguucuuguuaccugauaucucuggcuggacauuaaugcugcaagaauaacauguucgcuaggaacaagugaagggaagaaaaaccagagucguuuuucuucuuuucuuauuuaucuuugcccauguuauggugaaaagacuuuuugu

SEQ ID NO: 654 - RNA, 3007 nt, Mus musculus
gccgccccacaggccuugaguuugucaccaucuuccucaggcagaccaguccaauguguggccaucauuucauuucaaauuguaaagggacaaauccuuuggaguccacauuggagaagugccaccacacaccaaacgggaagcaauuccacagcagauucugaggcgaugaaggacuggucaaaaaaacgauuugcaggaagccccuucaaauaccuucuucaacagacuuagcccucuucauuucuccagucuuaaaguucaagggcgacagguuuccuuggcagguaggguggaagccaagugcagagagaagagguccgcuuccaggcgguguuacucggaggccagagaaaaaucagcuuucggagagccuuccuggaacagggagaaguuaaugaaggacaugaacuuuccccaggcgccgaucuuuagccuugccacaagcccggaccaagcucccccucucccacaauacgaagaaguaaagucuacuaaggugaauccucucaugcaacaauuaaaaaagaaggaaaacgccugaaggucgguuagagaaagagaacgagaccucagaacugccccgguggcuaugucaaacacgccuggcugcuaugaagccuucgagaaggggggagaaaaaaucccgauucaagugcugcauuuccugggcaacgccgaggcagugggcucauucugcagcacccggacaccuacucuuaagcgaaguuuucuccgcaccggguuagacucgcagacgcccuacaacuccccaacaaacaaacaaaaagccagcucggaccagggcgggcgugggcucggcggcgucuguggcggcggccgcccgggccgcgggugacuccggccggccguggcagccugcccugcgccccggcccgcgcccccaaggagacggcuguuuuccuuggcccgcggcggggauggguggggaggcgugcggccgcgggugggacgcggcgccgcucccgcucccgcuccggaucccuagcaugcuucggaagagccgcggccccggcaacucucagcucccggcuacggccccccacccccgagcccggcucgcccuccccgccggccaccugaagcagaggggaaagcgacgagcaaaccacccaccuaccacuauuuccuccgccccuuccugaggcgggucgccggcgcgggcucccgggaagcgcggccggggcgcgugcgggaagcaagggcuccgcucggcagcucggcccgcggcggggcgcgcuaggccgcggcucgguuaauauucaugaggcgccgccccuccuccgcagcccgccggaccccggcgcccgccgcucgccuuugugccccggccucccucgcugcacacacgcgggcgcggccuccgcgggcccgcgcuucagccccaggcggugagaggagcggccacgcaacggagaacgcggguuaagggucggcucccaggcagcgccgcgaccugccccggccagccucgggcucugggcgccgcgggagggcguggggcggggcggcggccgccgcacucaagccuggccgggccggccggggccccacgcucccgcgcccgcgaucgccgagcgcgagacuggccgggccggcgggcgcgcgagcugcuucccgggggcggacugcucgcgccuuccuucuggauccaccuccuucuaccccaccuccuuccccuccccucccgggggacgcuccggggcgaggaguuuucggucugcagucacccggccccgggagccaagcuagaggaggaagacgggccgggacagggguggugcucgccaggcccccuacaaccugggcacccgcuagcucuuucguccccgcaccccgacgcugggcacacaacuccggcugcuucccgagcgccgcuccgggagcgagcacaucccugcagcugucugccggacaggucuugggggacggcggccccuuuuuugcagcggguggggcgagaagcuacgggauguggagcuuccagauaagggagugucccugcccgccgcacugcaagguagcuuccugcgguaagcagggacugggugguggcgguuacgagucauucagaauuuuuuucuuguuuuuuuuuuuuuaaaaccugcagggcggcugagcgauuaggcgcggcuagcggaaccgagcggcgguggcugggcuuuccccacgcucccgucacuaguuaagccgccagccccguggcagccgcuccacagcccacucccgggccugggcucugacccgaacggcuggcuccgcccuguugcaccucauaacaucucccgcugcaaaccguccaauccggugacgcuacgacaguaugcgacccaaucaagggcuaccgcucaagccuucuaccccgccccucagccuccccuucccacuccaucucgggagguggcucaccagcucugaucccuagaggagccucuagcucuggggauagugcuuggcaccucuucaccaccccaccccuguccucuccccgucuuaugcacacccccccuccaggucucugcccugcugaugcuguugaggguccuuucgauccucauugacagcuuuugugucugccaccauccugagagaacagaacaaaaaccaagaugcuguggaacguguuaccuuuuucaucuuugcuacaauugccuucuaaagacuccuccuccuuuccacacccaucgccuaggguccuguuucuuguggagguuuuugaaagagcacucaggagcugauaaagaagaaacugaaccucacuuuauuguuccuuacagugaaagagggcagacagaauuuacaaccaaauccaggcagaauuuaccaccagaaccugacauuuagaggagagaaauuaacuagaucuuuuuuuuuuuuuuuuuuuuuuuuuuugcaguagccaugaaauauguaaggugugacugccccuaaccaaauuaaccaauagccagggugauaaauaauaaauaaaugaaaacagagccua

SEQ ID NO: 655 - RNA, 3007 nt, Mus musculus
uaggcucuguuuucauuuauuuauuauuuaucacccuggcuauugguuaauuugguuaggggcagucacaccuuacauauuucauggcuacugcaaaaaaaaaaaaaaaaaaaaaaaaaaagaucuaguuaauuucucuccucuaaaugucagguucuggugguaaauucugccuggauuugguuguaaauucugucugcccucuuucacuguaaggaacaauaaagugagguucaguuucuucuuuaucagcuccugagugcucuuucaaaaaccuccacaagaaacaggacccuaggcgauggguguggaaaggaggaggagucuuuagaaggcaauuguagcaaagaugaaaaagguaacacguuccacagcaucuugguuuuuguucuguucucucaggaugguggcagacacaaaagcugucaaugaggaucgaaaggacccucaacagcaucagcagggcagagaccuggagggggggugugcauaagacggggagaggacaggggugggguggugaagaggugccaagcacuauccccagagcuagaggcuccucuagggaucagagcuggugagccaccucccgagauggagugggaaggggaggcugaggggcgggguagaaggcuugagcgguagcccuugauugggucgcauacugucguagcgucaccggauuggacgguuugcagcgggagauguuaugaggugcaacagggcggagccagccguucgggucagagcccaggcccgggagugggcuguggagcggcugccacggggcuggcggcuuaacuagugacgggagcguggggaaagcccagccaccgccgcucgguuccgcuagccgcgccuaaucgcucagccgcccugcagguuuuaaaaaaaaaaaaacaagaaaaaaauucugaaugacucguaaccgccaccacccagucccugcuuaccgcaggaagcuaccuugcagugcggcgggcagggacacucccuuaucuggaagcuccacaucccguagcuucucgccccacccgcugcaaaaaaggggccgccgucccccaagaccuguccggcagacagcugcagggaugugcucgcucccggagcggcgcucgggaagcagccggaguugugugcccagcgucggggugcggggacgaaagagcuagcgggugcccagguuguagggggccuggcgagcaccaccccugucccggcccgucuuccuccucuagcuuggcucccggggccgggugacugcagaccgaaaacuccucgccccggagcgucccccgggaggggaggggaaggaggugggguagaaggagguggauccagaaggaaggcgcgagcaguccgcccccgggaagcagcucgcgcgcccgccggcccggccagucucgcgcucggcgaucgcgggcgcgggagcguggggccccggccggcccggccaggcuugagugcggcggccgccgccccgccccacgcccucccgcggcgcccagagcccgaggcuggccggggcaggucgcggcgcugccugggagccgacccuuaacccgcguucuccguugcguggccgcuccucucaccgccuggggcugaagcgcgggcccgcggaggccgcgcccgcgugugugcagcgagggaggccggggcacaaaggcgagcggcgggcgccgggguccggcgggcugcggaggaggggcggcgccucaugaauauuaaccgagccgcggccuagcgcgccccgccgcgggccgagcugccgagcggagcccuugcuucccgcacgcgccccggccgcgcuucccgggagcccgcgccggcgacccgccucaggaaggggcggaggaaauagugguaggugggugguuugcucgucgcuuuccccucugcuucagguggccggcggggagggcgagccgggcucggggguggggggccguagccgggagcugagaguugccggggccgcggcucuuccgaagcaugcuagggauccggagcgggagcgggagcggcgccgcgucccacccgcggccgcacgccuccccacccauccccgccgcgggccaaggaaaacagccgucuccuugggggcgcgggccggggcgcagggcaggcugccacggccggccggagucacccgcggcccgggcggccgccgccacagacgccgccgagcccacgcccgcccugguccgagcuggcuuuuuguuuguuuguuggggaguuguagggcgucugcgagucuaacccggugcggagaaaacuucgcuuaagaguagguguccgggugcugcagaaugagcccacugccucggcguugcccaggaaaugcagcacuugaaucgggauuuuuucuccccccuucucgaaggcuucauagcagccaggcguguuugacauagccaccggggcaguucugaggucucguucucuuucucuaaccgaccuucaggcguuuuccuucuuuuuuaauuguugcaugagaggauucaccuuaguagacuuuacuucuucguauugugggagagggggagcuugguccgggcuuguggcaaggcuaaagaucggcgccuggggaaaguucauguccuucauuaacuucucccuguuccaggaaggcucuccgaaagcugauuuuucucuggccuccgaguaacaccgccuggaagcggaccucuucucucugcacuuggcuuccacccuaccugccaaggaaaccugucgcccuugaacuuuaagacuggagaaaugaagagggcuaagucuguugaagaagguauuugaaggggcuuccugcaaaucguuuuuuugaccaguccuucaucgccucagaaucugcuguggaauugcuucccguuuggugugugguggcacuucuccaauguggacuccaaaggauuugucccuuuacaauuugaaaugaaaugauggccacacauuggacuggucugccugaggaagauggugacaaacucaaggccuguggggcggc

SEQ ID NO: 656 - RNA, 3291 nt, Mus musculus
uggcaccuuugggacugccgccacacccgcuccccacauaggagcggaaccuggaacuccuugaggaaagguagguucccgauguuuaacuaagaccuguucaaccugaacaguucuauuuaaccgagaggcguuuccuucugaacccacucguucuaaaucaauccauaaacacauccaaucauuuccauaaacagauuagcugugaauuacaugcugggcucuggaaagaggaucuuaauggcaaaccagccucacccaccaccuucacaccuuuucauuccaauccuggagucauaaccaccaucugcuagagcuuaauuucaagauuaugggagguggguacccuccgguugacaccugaaugaucccccgaauugcagagguuuggaucuggccccaccuuccaucuugacacacugcuggguuuuucucgcauaucaagugaaggcagagggcacucuggcugcuggcuucugcagagucgcgcuccacauucuaaguuccaauuguauucacuugcguuacuuugcauuuugguugcccugaagaguuaguucucugccguuuugaaaacaaaacucauugaagugcuaauaggcagugcagaauggucucucgagcugcaugcuggggucuuccuacacccggacucacaggccagacuccuuguggcuagccgaaguggggacucgguaggaggcaggcuuccgggccaaaaacccaggagagagugggaagggaggaguuacugggaacucuggaugaaggagugauuuuaguaggguuuucgugagaugggguggagagaggaggcuuggaugcgaagaagccagcgaucuccgcccgcaggaggaacaaagccuuggccguucucaccccaacgcaauucagcuaaaggggugggagguggaagugaaggggugcaacgaagggaggagaggggaggggcgcgagcuaagggagcccgaauccagaguucgcauuuaccacgacgccucgccuagagucuggcgccuucucacugcucccggccacgucucucgcggggaacgcuggacagacagacgcccggaggaugcgugggcgugggcggggggguggggugggggagaauguggcugggcccgccccgcccccagccugcgggcgggaaagcugggacuagagucgagccucauucccaaagcggcgcgggagcagcuguggagcagcgccugaugcaccugagcgcgcuccggggagcgucccuggcuuaccgccccccaacccccgccugccccuuugccgacucugcagcccgcggggauaugggacaggccugcgauucguucaggagaaaaagcaguccccuguuauuugccuucucaaagcccaucgcugcagcccccaggccagcaaucuccaagacuccucccugccagauuuuaaaugcacauuugucccaagucaaugcauuaaaaagagucagugcagugcguucucgagcauuggaagugggccggaguaucccggaggacuucagagcuuggcguccugccaggaguuggaaagcuccacgauccgagccggcauuuccucugaccaaacccuagugauccgauggguccagggcagggacauuuuacaaaauacuguaucagauuuaccacuugacucuaauugucucagguuguagcuaaaggcaauuauucuacucugauuaggaagccuuguuuuaugaaucuguuguuaaaccaaccccuaauuccagcuuucuaauagcccagcgcccugguucuuuguucuuuccucuaagguccugcuuucugguuauauauccuuggucucccauaucaugccagagccugcacucagcacacuuuggguuuaaaggccucacauuaguucucuugacuaugucuucuccaaaagauuuuugcuaggauaguguguaguucagugauagagcauuugccuaggaugugaaaagccacgggguuucuaaacauagcaacacacacacacucacccacacacacuagcuucuucacucuuuggcuaagaucaagugcacacacuggcaagaggaaugcugguuguguugcucugaagggaaaauaguuaccuaucaauccauguugcccuaaguuggaauaauuguguaauaauauuguacuuauguuugguggaucagccaugcucagcacuuuagcuguuaaucucuaaggaccagaacuguggaagaagaggaguguaagguguaggcucccugacauuaguccuuguguuuggugccuggcuguaucaauggguaauguucucuugcacacagguaaauaguuucacucagaaucauuuuuguagcugccuuuuguuucugauuucuuucuuuaaaacugacccagacaauauucaucagcaauauuauugaaauuuucaggaauugggauggagagauggcucagucaucaagagcacuugcuucuuuuacagaggaccaggguucaaaucucagcacucaggugguugcucacaaccacccgugacuccaauuccagggaaucugaugcucucuucuaaccucuguggguacaagccaugcagguguugcauaugugcaggcaaagcacucauacacgaaaugaaaugaaauaaaagaaaucuuaaaaaaauuacaggaauugaaaagugcuguuaugguaacaguugaacuccaguguccaggaagcagguccauguagcucagugacuacacucuucccacuguguauggugcagaucuaggguggagcuaugcagugaccacacucuucccacaggguauggugcagaucuaguguggggcuaugggugguucacaccgugcuggaagacacaucacaugaguuuccaacggcuucaaugccagacucagccacaagaaucucauugugaagucauaguacaaauuauggcgcaggagacuucaaaacauauuucagggcagggcacuugucucaguagagaagcauguguuaaggauacucacuggcugaaaaauggcagauagauguuugcaaaagaccauauguuuagacauaaaucccaaugaauuucugaaaaaaaauauagcuugcuugaaggacaauaagaaucuuuuaugaauucauguucuagaucauucuauagacauaaacuucaaugaauucaguguaaaaacuauagcuugcuugaaggacaauaagaaucuuuuaugaauucauguucuagaucauucuauauauaacauuguauaaagaacaauaaauaaacuuuagaauaauacauuua

SEQ ID NO: 657 - RNA, 9288 nt, Mus musculus
cagucagcgcaggcgcagaagcagcagcuuggggcgggcuugccggcugagguugccaggcggugccgaaggcgcuucccuuucucccuuucucucuuuccucuucuuugggugguuuucuuggugaguuaauggaggaggaauggaaagccagcgagaguuguuacccuagcauccccccuuccgucgugccccaucaggccucucuuugccauccaccugucgcaccggacccugcggcgggcccugcggugcucugucuccacggugcgugcgcgagcgcuacccggcgccaggaggaccagccuuuggaagagggccucgaauuuugcccagguuucagcccuugacucccuuuuugacauguuuuuguuuuuuuccucuccgagaagugcuuauauuucguuugagcuguuugaucucccguucaugcauaugcacuugugauugcacucucauuugaaagccuucacccagucacauccuuuggcccugggauuugggaggaaauuucgugggucuaaauccacuuggcaguugcccugccagggaagucaggugcaucaguucuucaauucucacugccugguggcuggguuaaauggccugguggcuuagugaacuuuucaguccucacuuggaaggccucgcucaaugcaagucgugauuggaggcuucugcuaaauuuuauucgauaagaauaaagaaacaauuuaguuucccguuuuucgguuugauagaauuuaucuauuuuuuuucugggcagcccacgguucagaugaauaaucuuuugggguggggugauguguuuccuuauuucacagcagauuggguuucuuuaaaaacauuccauagauuaagggguggauagggagcaccaauuuuugcuuuugaaaaaaaaugauuucucugcugcuuuuuacuuaacauguaaagagaaaaacuuccuuguuggauauaugcuccugugcauguuaacuguugaaucgugaauucauagaauguaaacaguauuaaccaacuugauagccauuagccaaggcauauaccuuccugaccucaggauagaacccaaggauucagguauuugaggccaguagucggaaccagguugacaacccaaggcauguucuaauuagaagcagcugauacgugaaaagggguguaagaaugcagcuuucacuaaaggggaacgacauaaaguuagcagacauuauucauggauucuguaugucagugucucauuuguucaaguuuauucauaauucuucaauacuuagccacacauuauuaguaauuuauggacguaggcauggcagugaaaauuuggaagcgugguaugugauguuuccagcugaagugaggccagcuguguuuugucuugugugggguuucaguaacauauauccuuucuauauucugcaaaacaugccacaugcuuugcauucuuaugguuucaguggccacuuaaagugaucccuaaacugaguacucagguaguaguccaaaguaugacgagacugguguguauacagagaaagcagguauguuaagaugagcuucauucaggaaugaguuaagagugcugcuggcuucauuccuauuaauuaaugagcagcauauauauguguauauauauuaauauauucauuggaaaaaguauugugacuaaaggcucaugggaacccaacccagcgucucacuuaggaauucauaguggccacgcucaccaguucauggguggugggagugacccuaacuacauaaacuacauaacuacauaaaggagaauacagugaagacucggauuacagguaaacgggcagcaguggaggauuaguccaucuucuucugucuuuuaauuagcucaacuaagacuuggccagagaggcuccaaaguuauuuuuauggcugaauauuacaaaacaaacuuuaguauguaguuuaagacagaauuggaaggauauucuuuuauuugccauuugucaucgcacuugccugccuuuugcuagucuaaugagcccauuuacugugaaauuguauggaugcagaauuuauaaguugaauuuauaaguuuacuuagaccugccaguauuguuuagaaagaggaaaugagguaaauuuugaagugagaccauggggugguaggcccgaggaagacuggagaaaguaaggaaaguuaauauguguaguguuugccuuuccacugucugcucuuuauggaauggauauuaaguaaccuguguaaaauguugaaucaaacaugaaauauucauugucuaugaagacaauaagaacaaaccagcuacucagcuacucagguaguccaccaugucuugugugugugugcgugcauugugaguuguuuaaugcauguguguaccuaagaguguguguuccuaugcaugugcagaaacagaggauuaauuauguuguuuugagguguccauaaaagcagguagugcugcugggcagugguggugcacaccuuuaauucuagcacuugggaggcagaggcaggcgauuucugaguuccaggccagccuggucuagagagugaguuccaggauagccagggcuacacagagaaacccugucucgaaagaaaaaaaaaaaaaguagguaaugcuaacacacacuaccaaaguacaauuuugugaauugcugagugauuuaaauuaaauguuuucacuaggcuuugcuuggcuucagagaguguaucagacugcauggcaaacugguuuucuuugaaauuuauacaugauauccuuggucuuaucucuggauaauuugauucugucuguagauuauuugauaucuaucauugacuggaaauuacuaauauuaauauuugugggaccgugggugugggggaaagaggggagugggagaaaacccgcauccugccagaguuccauugcucugggugguggaagacugcagcaugcuuucuaguggccccaggugggugucuggcugugugaagccacugaccccagcuuggcggauuguggacaaggggcagucccaggcaccaagugcccagcuuugggcaucccauacacggauguguagaaaggcaggggggaagagagaagguagaaagagggagaccgaccacugccauguggaaagaggggggaagggagagagagaaggagggcuagagaugagaguaagaaaggugagagcuuaaagagagggaggagggggucaagcaguuccuuuuauagugggcugggcuaucuugcuguugccagguaacuguggggaggaggauauuuggcuauagucaggaaacugugggggcucuguggugucaggcaccugucucugggaauguggcucacuuuucugucccuuguagaguucucuacuuggucgcuagagugagccccauucaaccaaaauagguugccuaucauagucccacaaauaguucugugauacuuaccagaauauacacuuugaauuuaccauagaucuauuucaguagcuaagaccuguguguggauagcagaggcuuacaggguuuucagaguggcuuagaugaacaggaaaaucugaaagaacaguuuagguacucauugcauagcuuuuaguuuaccaaucugcccucagcauuaaacauacaguuaaaaaaauuaaagucagaggucauaaugaaagauacugcaauugcuacuauuugguuauguugucauuuuguuuuguuuuguuuuuuguuuuucgagacaggguuucucuguauagugcacauuaugugccuaucugguuccuauagagguuagaagaggugucagauucccugaaacuagaguuuauaaaugguuuugagccacugugugggcacuaaaucaaaucccgguccucugcaagagccagugcucuuaacuucugagccaucacuccagcccuggauauguugucuuuuauugcuugaugauucaaauaacuucaauacuguuacuaaaauacauuuauaugauaaaauuuucaagauaaaagcccaguauuuuaauuauucaauaauagauuuggaaacaugaaaaaauuuuccuugucauuuacaaauuucaagugccauuuugaaauauuuaugcauaaaauuuuaagauacuguaugaaguuaggauuaacuugaaauucuuuuucguuguagacccugcuuuuugcaaagaucgacuuugccucagacucaguacacucuucgucugugguuccuguaauggugugcuuccacuucagugaguuaagcacagcaccacacaaagccaaauaaggaaaugaaguuuuccucuugacaggccagcuugcuuguaaguaaaauuuagaguuagauuuuaaaaaacggucuaaagauuuuauuguaaaacagaguuuagguagugucaaaagcagugaacuguuggaaaauuuuuaugaguaaauauaccacuuaauuuuugauguaguuuaguugcauacuaguucuaucagagaguguguaaaaggccucacucuguaccuauaaagcuacaucagucaauuuaagaaauguuacaaguuauuaacacaauacuugauaccuggcauguuuuguuuuaaaaaugaguacauuuccaaagacggguuggaucgguauugaaaauuguagaucaucucgagaugccaaagugguauccuuucagcacugaguaucuuuauguguuucuuggcuguuuaucucaagucuagaauuuaaguucaaccacuaaugaugcugcaguaacgcaaacaagugaggacuuugcugguuaaucuuuauuaauuuuuguccauuauccauuccacuauggccuuuuaaaggcauccaauaugaaaauauauaaacaugguccucagcagugugcauauaggaagggaaagggcgcacuuggacucaguguagaaagucguaucuuacgagcaaguguggucauuuacuccagucuucuauuguggauuuuaugagaaguuaauaaauaacgauagucaguugacaugaucauaaagauaaauugaauauuaagacuguagcucagcuuuugugaauugcaaaugaguauuuguguaacuacacauacucuguguuauaagccaacaaaucguaacccaguguuuccuacaguauuuuuacaaggaaaggggacacuaguaggagauacuguauuuuuuuuugagauacuguauuuuuaaagucuuucugauaagguauuuucugaauaguauuucugcugucuauuugcucuuuguaauccucagucauacacuucauuuugaaucucauuuuauugguguccugaaauuugagaggauauuaaccaaugcuguuuuuuuucucaaagaacaaaauagacaugacaauagcagagggccuuggagggaggaggugggggaggagggggugggagggaguggaggaaagauaaucagaacguaauaaaagccugauggaaauggcacgaugaggcucauugguuacguaauuaauaugucauaguuauaauaccuuguuaagaagaauagugcacaguauuuauuauaagacuuuuaaagugucccaucgauuugaaguaauuugaacaucuguguauugagugcauguauauauucaguucugucaggauguuagcaguaaucacaugccuuuuuugugucuuaaaaaagggcugaagccaaccccuagguuggccuggucagaaaacugaaaagaaaugcugaccuugaccagaugucaccauuugaaacagauagcacaggagugucuuucuagccugcugguuaaagugcagagccgcacacagcuccugcuuccacgagccucugcacgugcagaaucagggaagucauggcacuccacccacucucuuguuggagacaaaaauauuguccugauggggccgccugguucugggaaaacaacaguuggcagaauauuaggugacaaacuaggcuguugugucaucgauguagauagugauguccuugagaaagccuggaauaugagcgcaucugaaaaauugcaggauguugguaaugagcgauuuuuagaagaggaaggaaaaacaguguuaaacuugucugcaucuggaagugugauuucccucaguggguccaaucccaugcaugaugcuagcauguggcaucugaagaaaaauggaauuguuguauaccuagaugugccucuaacagauauaauuagucgucugaaaucaaugagaauugauaggauuguuggccagaacacuggagcaucucugagagacucgcugaagcacguaagacuguacuauaagaagugguacgaugcccgagucuucugugagaguggggcuucagcugaggagguugcagacaaagugcuugaugugguuaaaagauaccaagacguggauucagagacauucauuucaacaaggcauguuugucuuaaagaucaugacaagaaguuuccaccaaaauacuucagugaagcuguaguugagggauuggcuucugaugguggccucuuuguuccugagaaggaguuuccaaaacuaaguccuggggaguggaauaaccuaauaggagcaaccuacauagaaagagcacaggugcucuuggaaaggugcauucacccugcggacauaccugcugccaaauuaggagaaaugauugaaacugcuuauggggaaaacuuugccugcuccaaaguugccccugucaggcaccuuucuggcaaucaguucaucuuggaguuguucuauggcccaacgggguccuuuaaggauuugucuuuacagcuuaugccucauauuuuugccuacuguaucccaccagguugcaauuaugugauacuuguagccacuucaggagacacugggagugcagucuuaaauggguuuagccaucuuaauaaaaaugauaaggaaagaauagcuguggucacauuuuuuccagagaacggaguuagugauuuccagaaagcagagauaauuggcagucagagagaaaaugguugggcaauaggugucaggucagauuuugauuuuugccagacagcuauuagaaaaauauuuaaugauucugauuuuacuggcuuucuggcuguggaauauggaacaaucuuaaguucagcuaauucuauaaauugggcucgacuacuuccgcagauaguuuaucaugccucugcauaccuugagcuuguuaaccaacgguuuauuucuuuuggaagcccaguagaugucuguguucccacaggaaacuuugggaacguguuggcggcaguguaugccaagaugaugggaaucccuauucgaaaauuuaucugugccucuaaucagaaccacguuuugacugacuucauaaaaacuggacauuaugaucuaaggaauaggaaauuagcacaaaccuuuucaccaucaauagauauucucaagucuuccaaccuggagcgacauuuauacuugauggcuaacaaagacggacaguuaauggcaaauuuauaccaucaguuagagagucagcuucacuuccggauugagaagaugcuggucgagaagcugcagcaagaguuuguugccgacuggugcucugagggagaaugccucgcagcuaucagcacuaccuacaaugcaucaggcuauauuuuggauccacauaccgcuguugcaaaagugguugcagacaagaugcaagacaaaagcugcccagugcucauugcauccacagcucacuacuccaaguuugccccugcuaucaugcaggcacuggggauuaaagaacucaaccagacgucguccagccagcuuuacuuacugagcucguacaaugcauugcccccuccucacgaggcucugcuagagagaaugaagcagaaggagaagauggauuaccagguuuguguagcugauguggauguccugaagagucaugcagaaaaacucauccaaaauugguuuguaaggaagucugaguagggguuuuucuuggaaaggagcaauaauaaaucucaaacauugauuuggacuacaauagcauuugcuuuauuuuauguaaauguuuaugugugcaucugaucucuggacuaagagacggaggccagcauaguaccuggaacccucugcuaucaugcuuuauuuucugcacuuguugguauggcaguuucuccuuuacccaacacuucugaguggaacaaaauaucugguauuuagcauagcauuuacaaauauuuaaaugcaguuaggugcugcauaucuagucauuuaguguuuauugaacaauuugugcuugagauaguuagcuaacauagaggaaguaguaagcucacuaggauuagaaucaucguuuuuaaccccuuucaaauuccauuuuggacaauacuugaugacauguacacuguccagcuagagauuucguggcccauucacugcucuuugaaugucuguaguuagugcuggugaaguuugaaaaucaggccgauguaggauguagcaguugacagaacugugaaguagugaacacggaaacaaagucaccuacuucaagagaaaggugauccaagauuaguaauguuuaagaugcuuuauuaaaguucaguuauagacagcagcucuucuguauuauuuuuagucugguccuauuuguuucacuuaaaaaaacauuuugggguaccuaaauccacacaaaaugguaacuguguuucauuuccauugcuguguagugacagugaucuuaauugugguuuguauauuuccugaguauuuacuuucuggauugaagggugugacugaaugaagacaugcaaugggcugcuccccaccacaagauggcauuccucacagcauuugcuauugcccaugacagucugcuucugguuaccuuucagagaaauguucaacauugaaaugaugaaaaagguuaauaguuuuaaugggcaauaagcaauuuguuauacaaguuuuaaauuaaaccauuuacauguuaauaucagcucucugguuuugcuucuaaaauguaguucuagggcuuauaauggaggccagggaugucccuguacagugcacaaaacccuggguuccauccuuagcaccuaggaagguagacgcaguaggaaaaggucauguuuagucacacaguuugaggccagccugggauacaugagguccuguuuaaaacaaacaaacaaacaaacaaacaaacaaacaauacuugaaacacuuuuuguuaauagagacucaaagcucuguauuuguguacacauucuaucauuucagaauauuuguuucaguagacuuagaaaauuaucca

SEQ ID NO: 658 - RNA, 2014 nt, Mus musculus
uggccuaggccccguggccccugauuggagccacggcggugcaaguggggccuccacuuucgccgaagcccauggaaccacucggucucuagaguggcguuagccagguggugagcggaggaggacagguccugcagcaggaugcgacucuccucgcggguggccuggaggaagaccugcggggcgggcguggacagcgacucggugcugaaggugauggccgcccgggagaugcugggcucacccuccaggagacuucgcaccagagccugguaccacugcaggucauccugcacggucuguucccgagacuuauugcucugcaacaucauguugaggaaguugguggcgugugucagaguguccagcgccccgugcaaggaaggaugggagcuggcuagggacggugacuuucccggcaggccagccaacucguagcggccugagcaguuggcucucuucagcugguggaaguccccaguguagagguaagaggccacguccacgggcaccuccucggcuaguuuuugugccaagauggugccgucaguggagcggcuccagggaauagaggggucuggggcagaggcucgcggcagcugcugaccaugcugcuucccccucggaguccucucucgaggggaaucuggccgucccggagggucgaggcuggcaccaaccucucccaaucccagaugagcgagcaggaggcagaagaguaaagaguaagccauggcucccaucugucuagcauagaagagaggcgauaaccggaggagucacuuuguaaauuuugguccucaauuuaucaucaguaagacuuuugaggggaggcuuccuucuucuccagguggcgcccaguccagauggacuuuaaaauaagaauguuuugaaauuggcccagcuggcucagcugccgucacagaccaaaucaccuguggcaaugcuggcugcgcccggcuccacaaugggucggcucgggauuacgcaccucgcagccuugagccaaacagguuacauccccagcagcuauaguuagcccgcuuacgucuuucugcucagccgcuuccaccgccgcucucauugagguguguucaagagcugaugcugaugcugcugaugcagcugauguugccaccgcggccaccaaagaugcugcuccaucaucucacccuuggcaggucguucccgccucccaguucuggccccuccucgaccgcuucgcccggagauggaagcgcgcacacagauccaagccgcgagcucagcggcgagucccaaggaaccaagguuuucuuugaagacguucgugugucugcaguccagacagccaggcagcugauuaacuagagccuuuagguuuggccacaaaccacagcgcugccuuucucugcucucagaugaaagcaguuuaaagagacagcuuggccgcaaccaaacccuuguagggcggcuucaagucgucuugugcccuguuuggucggcgccucugucaaucagcugacugccauuuguuggcuggggcgggagcuguccagugcugaacccgaggcgcacugaggaggcggaggaggaggcggcggcgcuguuuucacccacucguguucccugaugacucggaaaccuucagggguggcaaggagugggugggaaauaggggagaaguggcgcuuuuggugguugaaagcgaaggaaacuuggacuacugaggaggaggaggcuguuggcaucuugcuugcuuaguaaaaucagcccuuucuuuugccuggaaaagagggagaagagaguaguuuucauuucugacugaaacuggggaggagggaacguaggauggaaauguguccuucuuagcaucugcucauuuuuuaggcaaauuaucaaauucucuuccuuguuuuugguuaagagaaugauuaaaccuggcuugccaaggauagucuuagcuguuagagaguaauggagacgucuacuggccgagcuucaaggaaaaauaaaugucauauuuaaagauucu

SEQ ID NO: 659 - RNA, 2543 nt, Mus musculus
caguggaguuucuggauaaaagauguagcaugacauuuuuaugcuauagaaacucaagaaguucauuuaaaaaauaccuccacaaagucuaugaugccauugcaacagcugccccacaaagcuaggccacgcccccaugaaacagcagugguuucucccauuucagugguggagccugagaaggaccuuccugacucaugacaagugccugcuuucuuucuggcucucugggcccaaaucugagcagcugaguuggcagguggaugugaacagccugagaaacuucuucugaaucagaccucccagucagacucccaacucacagacuacaauaaagugaguuuauugguaaggauagcuagauuucagaaucucugguagagaggcagugguuguagcucugccugucauagcucugucccaucggcuggcucugcagcacuucugcugauucaaagucugccaaguagacuuuauuccaaaauguaucagagagaaaaagccccacauaauucagacaaaacagcaaaaccuaauuuuacauuuuaacaacaguggguuucauauauacauugacaaacagccacaacaaccgaauuaugagagcagaguguuugccucacccuucaucucacuguuuccuucacaaccacucuccccaauccaaucuacacaaauccuguaugucuagguuagcacugccuuugcuagaauuuaguaugauuaaguuuaucuaauacuugcaaaacuucugucccacugcugaacuucugaauugaggauaaugauguucucugguaaggcuuuuccugguuucugacuguggcuagugucagcugcuguccuucuccagcucugcgugccugggccaagccccagauauguuaacacaggaccaucuuggggaguuagaucuugcccuggacacagacuuuggccaggcagccaguaauggugcagggaugagaucagcuuuuguaauuuauuuaagaaaacuuuuauucaaccuaaccugucaaguguauuaucauaaaguaauuaauauuccacuuaacacaauagaugcuguaacaugugaugcaguuucugucagucuucaucacuuccauuuuaacugcuguaaauguuuuauugaauuaacacauuuccauuuaguggcaucaaucugcucaugucauugguuccuugugauugucacccccuuccuuccacgaagcuuaaugcuguacacauaaaugugcucuacugacauguuuguuucuaccuaacaacucaggcaucaccccaaagucuucugaugugcugugaaccuucaaguuucccucaauacccuagcuuagcuaccucauacaguuuuauguuuuucuuccccuuaaaguuuuggauucaaaguauuuuauuauuucucucuuuuguugcuucuuuaggaacaucaauacacacuuugaaaugugugguuuauuucugaauauuuggaauuuuaugauauacuucaguuucugguuuccgguugucaucagagagcauagguguuauagucuaaccucucauauucacaguuaggcgacucauuuuacuucugagcagguagcuuaucccacuugguauuuuagauguguuuggagaacauagguuuuguuuauuugaguugauugaaauuuuguucuaggaaacugucuguacauuuucuaacaucuaugacuacugagauacauggcucuaccaucuaggcucuaguuacuucucuguagacacuggaagcucuaugcucaggugcacaaacaguuggaaaugggauauuccucugacuccuuuggaaauaugcauuuucucauccaucagugggcucaccugagagccuauuugacugacagacagucauccagccuuucacuguauacauauuuaugaucauuuucccuuagccuuucugugucucuauuucaaguucauuuccuauggccuauccuugaguguuguuucucuguauaaaccacaaugucacuuuccagugaucacuucuccauuugcauuuaccgagcacuguaacaacacagguucauguuccccaucuguaucacugaaucuucuucccugugccuugcauucuuugguguuacagauuuguaauauuuccuugugucggauuauuaauuauacucucacuucauuuuuuuggacuaacugccauaggccuucaaauaugcauguucuauuaaauucuaauuucauauaauuguaggcugcucacuguguaacgguacacuuauaacacaaugucaguguccucugacuuguuugcuuuguuacauauuuuauuuucacguuauagaauuaauagucauuuguucauacagucucaauauuuaaaaaaaaaaaaaaaaaaaaaaaaaaaaaaagacaguucaccggucucaaacacccaggauuauagauaugggccaccaaacucaauacuuuguuuuuugagaacuuuuucaccaguuauaaauuguugguugggaguugcaauuaguuuguuuguguauuugcuuuuaucuaua

SEQ ID NO: 660 - RNA, 484 nt, Mus musculus
augagagucggcccggcugucccgagcgccaugucggguucuucuagcgucgccgccaugaagaaggugguccagcagcuccggcuggaggccgggcucaaccucgugaagguuucccagucagcugcagacuugaaacaguucugucugcagaaugcucaacaugacccucugcugacuggagugucuucaaguacaaaucccuucagaccccagaaagucugcuccauuuuguagucaucuaucuugagguuucucaaaccacuuuucaugaaccagugaauauucaagagaacuaaauuugaagucuguacaaaagcuucucuuuaacacgugccauaauacacuaucuucugcucaucaguccuuaacaucuaccucucugaauuccauggguuucugucucacaagguuuaacuauuuuauauacacuggcuguagcauacaauaaagcaucauacaaaaaaaaagaaagaaauaugag

SEQ ID NO: 661 - RNA, 1365 nt, Mus musculus
ucaaaagaacaugaaaguauuuauugcuacacuuaucuaggcaaagccuaccuauuugauuauuucauucacucauucauuaaguaauuugugguguugggauggaacccaggauguugugcaugcuaggaaaacacccaaccacucagucaaaacccuaaacagcaaacguuuuauuuugacaaguuucauacauguauaaccuccauuuuuaacauagaaaccuaauaagaaaauaaugagcucaacuuuaggguuaacccucuuuaaguguguugcaaacaagaaaaaaaauuaugauucagaaaauuacagcugguuuauuucuuccuaggagggagacugggaggagaggggggucgagauguaaaaugaauuaaugaaugaaugggaaaaaaaacaucaacaugggaaggcaguaaacuucuucagucuccccagcgcuugccucucauugccuccaccuaagauuauggcguaagauuauuacgagcauguauaaucauuugaugaaaguguuauaaaaaugcuguuucaacuucggaauaaauccgacaugcgacaggcaaaaugaacaaaugaaacaacgacaauaaaaacauuuucuugagcauccugagcugcacuguaugcauuagcaaauagaguuggaaauggggacgcaggucgguaaucucagcagcaauaggcugaggcaggauggucaauuugaacccaaucuggucuauacaaagccaaucuggucuacacggcgagauaagauaacgaaaaaaaauuaauuuugcguaguucauuacauccaaggguuggucucccauauccagacaugaacaaaaccgcuaaacuaugcauguauacaucucuaaggcuuucaggauagaguccaaaagcuaagagauaaggucaacuuagcuucuguuacacaauaacccacagcguagacuaauuagaggaaguuggcacguccacucggagcuuggcauugcgaaaacaauggccucaggguuagcagguaccggaaccagauuucugcacgcuuugucccgcguaggacaacaguucggacgcacauuucuggauaaaagcggacgcggcucccgacuagagccaguggcuccgaggaggguugaagaggacaggcgaccggguggggaacagggugcggcuucgcgcuuccggugcccagcuuccggcuccggguuugggcuuggggcagaggcggagcuacggcccgccgcgacuuucagacuugaaccauggcuaugcgcuggucgugcuggcggcguggcugcuccuggaggccgaccgcggucgggagcccgcggcgggaacgaccuggcuguguggagccucucggaacacgug

SEQ ID NO: 662 - RNA, 44747 nt, Mus musculus
gguggggaacagggugcggcuucgcgcuuccggugcccagcuuccggcuccggguuugggcuuggggcagaggcggagcuacggcccgccgcgacuuucagacuugaaccauggcuaugcgcuggucgugcuggcggcguggcugcuccuggaggccgaccgcggucgggagcccgcggcgggaacgaccuggcuguguggagccucucggaacacgugccgccucggacacccgcgcgcaggugaggccgggacgcgcgcgcuguccgcggcguagaggucaccaugccaaugacagccggcgauccaaugaaugggaggaugcgcacgugcgccggggccugcaguccccacugggugggacacccgggaagugggacuagucgcggggccagaagugcggagcugcugaucgggcauccagaagacauugggguugagguagagggagcggcggagcgcagcccuguuaagccggggcuacccgggugugucgagaggacaaccagagccaaagggaccucugcuuucacuuuccuagcaauuucggguuucggauccaguuagccucaaaauucggaaaggguguuguagcgacgcaaagugaugcuagccaggguggacuucagugcugcaggugcuuacaagagaacgcacgccugaaaggcgcuggaaggacacuagaaggagaagagccgaagggugucaugagagaccuaugacuucuuugaaguaaaaucauuaucuaauuaguaauugcggauucuuaaaacugucuccuacugcguuugauuacaaauucauuuucuuuugguuuuuagcccuguaaaugacucucgcuucugugugaguugggucaguccgugccgugcuuuaccuggcaguaucugcagacugacuuuugaaguuaguguuuuuuucacuuuggguuuuggagaccuuuccggccaccgaguaauuguauaaguaauucaucuuucauuuuaaaaauaaucacccaccucuuaaauuuuaguacuauuugguacauuucauaugucaguguacuuaucaaacucuauacuaggaggagauguguaacauuuauaaauauguggcuuguacuaaacaagaugcauaaaacggauuauccaaaaaagaauuuggagagaaaaugcaagcugcucuaaauagaaagaauaacaaauaagagaaagagagcauguaggaagaaucuuagaggaagauaggcuuuguagggauccauuuugauacugcaagcuagacuuuagaggguuugggguuuuaucucuauagaaaggaaggaaggaaggaaggaaggaaggaaggaaggaaggaaggaaggagaaaaaggaaaggaaaaagaaaagaaaccucaccugugaaaagaguuuuucuggaaagaaucuuugucauuggcauccauauccguuuccuugagcaaaaagggagacuacuugaccguccaacaucauguuuuucucauucauguguuaacuuucuacuauaaacauauuuagaauucaggugucuacuucagacaugagugcuuucauuacuucaggucucucaaggacuacaagacuuaaggacaauuauuaaaacaaauuuguuucuccaacauaguaucguacuguagcccagaguagccuagaacuuacugucaagcuaagcauggccccagauacauuauaguaguccugccucaguuuccacccccaucccuaucccuauagcagugcauuagaccuaagcaaccacacccgauuuugucauuaauucauauugagcacuuucucuuauuuuaaaaagucaauucucaacuaggucuguaauacuagcauuuguuagaaaucaggaguucaagguaaucuuuggcuacagagugaguugaaugccaaacugggcuguaugagacuuuaaaaacaucuuaaggggcagaguugccuuucaaagcgaguaaaugauauagagagggaauagaaucugaaguggaaaaauuauuuucacugccauccucagugagccccagaacugguuguaaagaacugguugccauuuuaaaacaugauucuuucccuuugaaaacacugcccugagguagcucuaaguagaauacagguugacugaggaccugagaauauaauugaauagauacuaucuuguguuucugcagaacuaauaguuauaguucagugguagaacacuugccagucauuggcaaaguucugaguugagcccaaggacugcagaguaaauaaaaauaaguguaugcuguacauuggauucucaaguuaauuauauauauauauguauguauaauauguuugaguauucuauguauaauguguaugugauauauauauauauaauuucuaagaguaguuauagagagaaaaauguuacaaaguggcccagccagaaauuuuugauauuuucaccaagcucuguccucuaagacugcaauuaacaguauuuaagcuaccuaguggcagagaguagccuguauuaaucaugcaguuuuaacucuuagauugaaagcuguuacucuuccauuaagaugucacuuguuauggcggaaugguacacuaaugcuaacccaacacuugagaggccgaggcauaaggaucaauucagugucaacuuaggcuguguaauaagaugcugucuuaaagcauuggagggaggcaugauccuuauuuauauguuccauaauaaagcauuacauuuguauaugaacuacuuaaggagaccaaaagaaguaaguauauugucuaaagaguguccuguaauccuagcuacuauggauugagucagccagacugugaggucaaaggcagcuugugcuacauaucaagacgcccaucccagaaggggggaaagugggcuguccuaugguaaaaucaaaagagagaacuccugcuauguugugggaacauuauaauuuucuguaacucauaaauguucuuaauauuuuaaugaauagauaaugcagugguggagacaacagaccucagucuucuuagccacuguuuagcaaagucaacauuuguguucuuuuaacagcuaaagcaauguaugguucauucaggcaaagucagaaaauacauacuaaaaaugaguaacuaaagcaagacccccccccccccacacacaccccaauccuauuugguucaaaauaacuacuuguaacgcugguuccuguguuucuaaacccuguuuuugucucuauguguuuuacuuuuggaugcuuacauagaggguuguuuguuuguuuguuuguuuggguuuuuuuaagacaggguuucucuguacaaaccuggcuguccuggaacucacucuguagaccaggcuggccucaaacucagaaauccgccugccucugccucccaagugcugggauuaaaggugugcgccaccacgcccggcucuacguagagguuuuuaaugagaugacgauaugcacaguucugaggguauuuuuugcuuauaauuauaaucaugcuugucagucaguucuucauucuugaauuuucuggaauccagguuuucuaacuuuuaaaauaagugggcugguuaggugacucuggguaaagccugcguugucaagccugaugaccugaacuugagccucaugauccacaugguggaagaagagaaccuccaaguugucuucugaccuccacauaugugccauggcaugugccuauguacaaaaagauacacacacaaaauaaauaaaugaauaaguauaauuuuaaaaaccuaguuaugaccagauguggauaugaugguguauaccuuuaaucucagcacucaggaggcagagacaguaaaucugugaguuugaagccagcuggggauauauagugagauccugucaugggacaaacaaaacuguaguugugaagcucuuugaaagaaaaaaaaagguuuuaaaacauauaacacuuuauuaucaagaaacacacauuuuauuuucauauucaucuuuuuuuccaagaagugucuucacauauuuuauauaaaagcccuugccagacuagauuaguaaauuaguuuuuaaaaugcuuucauccugucuuuaagaauaguaauauauaagcuacagacaauagauaagagcacugaccauuauucugaaagaccugccuucaauugccagcauccacauggccuauaacuccaguuccaaggggcucuaacuccuucuuuggucuccuuggcacuguauauauguggcguauagacauauugggagaaguuggccaaguugccuccugauucuccugccuccugaucuguccaggagaaccgaagcaggaaaccagggaacuggaggcgaccaagcacuugaaugcaaugugcgugacaagacucauuuuuuuuuuaucacagcuccuuugauagcaggaguuuagaauucagcagagaauccugcuucacagcccaguauggccaagguaauauaagcacgacgccaugcagcuccugaagaacauccgcaguuacccgaaccagucucuggaaauugggaaaggcaguuguuggcauccagauccccuucucgaaaaauaacagcaucgggccuucccaugccugugccauaaauucauuauaucccuauauaaccuugccaacccgaaauacauacauucaggcuaaacacccauacgcauaaaaauaaaucucucuuuuuuuaaagaauaguaauauuaauuguuagaaauaguauuuguuuagaaguguuaaacgguaauucuuugauauucucuuucagccuuuuuuauguacuccaggcugaccuugaacuuguccaccugcucccuuaaccucacagugcugagaucccaggucuaaccuaccaugcccaggugauuccuggcucuuugaucgcacuauuaucaaaaugccccugagguugcuagugcuuuguaucaucaaagcacauagucuaccugggcuguacucgaaguccauucauuugcuaaacacuacuuacccugaagcaccauuuccaacuauguguaauaacaauagcauaggcagcauuguguaaaugucagucccuuccuaaugguaaaaaucuuuucuuagucaucccagauacuuuuggcauuuguguguuuuaagaauuuaaaagauacccuaggcgucccuguucugugaccagucuuaguuaaauggaaagaaauuguuuugcugcaucuuuucugguguagagagguagaaacaaauauggacacagcuuaacaaauauggacucaacuuuuagagggauggauguauuauuacagauauuuuuauuuucugcuuuuucuguuuucucacugcuggaaauuagaccuuuaaccucugaggacaaagcaacugcucuucuacugagcauucccuagcucucuuuauuuugagauagggucacuaaaagugcucaggaugaccuugaacucaauguugccuaggccaaccuugaaccuugauccuccuaccucagcuucauuaguagcugggauuacaggccugccacucugggacugacuucugcuuuccucuaauuccuguauucugauaugacacauuaccuuuauaaucagguaagggaacuucuaauuguccuuuuaaaaaucuaucaaagauuuccaaccuuuuauaaguggcugacugaacaauaucuuuuguucugaguuauggggauauuuguuguuaugaaugaguuuccaggaauauucucaaagguuucuucauacuuuuguuuuacagauacccuauuuuagucuuaugaagauuuuaaugucugccuccccaacuaugcauaguauaucacaguaaguuuauaauccuuauuagagcuacaaagauaaucacugcuaguaaacuucuaauuuuauuagguuaggaugacaaaauguguaaggaaaagucaagauaguuugcuuuacaugagcucugccauuucaaaaacuaggaguauaguauaacuugaguucuacucagaauacagugaacauaauauggucuuuuuccaauguuggcugucaagguaccauucauuaaaaucaccuauuaauguauuauuuagcaagauuagaauucaguaugcauuuuuaaauuauggugaccuuugcagauucauauuuaauuucuagcaaguuggcuucauuuuuuccaccauauaaauacacauguguuugaauuacuuaaaaguggagucaugugcauuuccacucaccagguuucaucaaaggacaccagcaaugugcaguugucgucaaacucagaguggugagaaauacagugauccuuuuaaacuuggcuggagagacuugaaaggucuguaugaagacauuagaaagguaaggcuuuuauuuuccugaaacuugauaacauuuuagaauuagaaaucaacacacaaugcagccauuuuaugguggcucacgccuauaauccagcacuugggaagcugaggcaggaggaccacugcaaguucaagucuagucagggugauauaguaaguucuaagcuuggcuaggcuaccacaugagacccugucucaaauaacaaacaaaugaaaaggcagccaugccagugcccacugaguucgauguguuacucaggaacaacugugagcccgaugcuggacaggacuguauagggaggggauggaguacaugguacugcacagaaaguuguuagugcagaguuggaaaacuaaagaaauagguucaggaaacaugccuguucaguaucuaauucugaaugccaucgcuaagcugcuccaaauaugacuuucuucuuucaacauauauacauauacauauauauauauauauauauauauaucauguggauuauauagcacugcucaguauauggauuggauuauggcaaaccuauucuccugggccucucauaaugucacgugucaaagcaaaucaugaccuuagccucugucuauagguugcuaacacugaugugaauugugcagugaaaaacgaacucgaaucaggcuacagaucuggcucaguuagaaaaauguuugcugugaaagcaugagggucuggauuugauccccaaaaccauauuaaaaagcuggaccugguggcuuacucuuguuauagugauggagauagauguguacuuggggcucacaggccagccagccuauccuucuuggugagcuccaggucagcaagagauucugucuccaaaauggaaaaaugaaugacaucuaauguuguuaucuggcaugcaugcacaaauuaaaaaauaaaaaugaauaaaauccuucuccaaaauguucauaugacucuuugucaacuuaguaccccauuuagaauuuaccaucuuuucccugaggacucuagccuaaugccucacaacagaauagcagugucacagaggacucugcacaugcuaggcaggugcucuaucaucuaguaguacucaaagcccuuguguggugcuuuguuuugaggcagagacucccuguguaguccaagcuggacuuggacucaugaucuucuuguucugccuucugaaugcaggauuagagaaguauucuaccacugucuuucauauucuggguuguuuguuuacuuagauuauuuuaagguaagcucucacuaugacgccucuaggcagacuuuaaacuuccuguguaucaagauagccuuagacucaccauccuccugccuccagaaugcuggaauuauuaacauaugcuaccacacccagccuaucuucauuuucagccuccuuccuuucccacaguaucugaaccccuuugcauuaccccaccacugccugugccuuucuuuucaaaucacaggagcagucucucacugacugcagugaaugcuuuguucuuccccugccuuaacccuuuucacuaccauuuuccuuccuugaaacuguucauguagcuuccauaauuuccugagucaccuagucuuuaggccauccuguguugauuucugugaucuucuucuaucucaucuacccuaaccccuuuaacugugcuguuguuuggacuucugacaacccccacucccgugugugugugugugugugugugugucuguguguucauuuuuauucuuaaucccccagauagcuuuauuucagguugaauugucuauucuaaaccuacauaacuaacuacuuagcauacuacuccaugaaguaucuaugacuaugucaaacuuaauguguuuggaaugcuguucucaccccauacauaguuugguuugguguuuugauuuccucccugguaucccugacuauugacaggaucaccuaggauccuuggaaaagcccuuggacccuucuuguccuuucuuccaugaccuucuagucuaucucuugccuccagaacccuucagguuccaggacacacuauauccucccuucuguuauuucucucuuaaucucuucuggccugaaccagccuuucuguguguucccagagugguuuucuuuacccuaaaugauauuacccauuauacuguauuaacuguaguuguuagucuugucccaucuagacccugggcuccuugugggcaaggguuguugucaugcuuaucuuuaacaccugugccuuuaucuuagcaauugcacuccauaacuuuguguggcucugauucaagcuaugugcuucuugaguggcagauauuacaagugcaugcccauggagaacccuuucuguucuuaucaagucaaaccgagccaggguuucguggagcucauccccgugcagcaggcccaguuucugccccacaccaaucucuuccuuuuucuggacuuuuauuguuaccaaccuauugcccacugaaucagucuuuugguuuuggguggguuuuuuuguuuguuuguuuuuucuguuuuguuuauuuuguuuuguuuuugaggcagggucuuacuauguagcccagcucauacuugaacucauaccauccuccuacagcuucccaugggcuagaauuagugaguuauaagcaugcauuaccauauacagcuucccccccuguuuuuuaugcuuguguuuuguugaauauuauuugcaaaaacaggggcauuguuauauuuucauaaauuauauaauuugcauugcccgugacuuuuuuaucuuccuccucccacuugacucugcucuccaucuuccccauaguuuuauuuuccaagcacaucacacauuuugccccuacacacuuuacuccuuuccccuuucucccugcuguucuccauaguuucauguguuuacuuuuaaaaagaaauuaggaucuauaagugagagaaaaacaucuuuuuuuuucugagucuguuuuguuucacuuaauaaagugagcaccauaauuucauccuucaacgcugaauaaaacuccaugguauacggauaucacauugucuugauucauucaucucuugaugggagcauaggcuggaugcauacuuggcuguugugaguaguguugcaguaacauggccauaaaguaucucugugcuagguugacuuuugaguucuucagguauauacccaggaguggcaucacgaggucauaugaaguuccacuuguaauuuaugggguuguuuuugaggaguggguacuuucauauuaauuucauaguaguuaaauuacuuuacauuacugucaacaauauguggauuacacauaugaacacacauccccacaagcauuuguuguauuuuguuagcuagcgugaccaggguaugcugaacacugauucucagccagauauauagcuagugagauuuucucccauucuauagggugucuuuuuacucauuuguuucuuuugaguugcagcuuuuuauuuugaugcauucccaugugucaguuuuuguuauuauuuuccaagcaacuagaguccuguugaaaucaucagcuauguauaucuuaaaucauugucuguguauuuucaguuuuggaguuucagaucuuauguuaagguauuugauucauugguugucuuuuuggagauaaaaaucggggcucuaguuuuauccuacuauauguguauuuccuuuguuccagcccuguuuguugaaaaggauuuuuauuuuuguauauguauugagucuauagcucuucauauauagccguuuucauuauccaugcgugagccuuccauuuucuagugucuguuuuauugcuauaaaaccuucacuguagagcucuuccccuucuuugcuuaggcguauuacugugcugaaacuuuuaucauuucugaguuuucugaugggaucuugagagucuuauaugaucacaugaaguguauuuagggaucauuuggccuuuuccuuuucuaucuguauccuuuucuuucuuucucaucuuacucaucuagcuaagacuucaggcacuguauugaauaagaauggagaaaaugaauaaauauucuuuucugaguuuagaaaaaguguuuuuuggguuguuccccauuuagacuaauguuagaaauuguuuuuaguuuauucuauucuacuuuaaggauaucuguuuuugugccaagugcugugauuuguuacuauaacucuggaguauacuuugagaucuuggcucagguugcuuuguuuuuuuaguuuguuuuuuugguaaacauuauuauguuccuuuuauuccuaauuucuucagggcuuuuaaaagauucuauauuuuaaguguuugucucaggcauaguguuccuguuucccaacacuugauagguagaaggaggaagagcuuggcuucaaggccaucuagggcuucacggcaagaacauaacucagauaacaauaacgauaaauuaucucuccccaccucauaguaaguuucucacaguuaaguaaaccaugccuuuucuacauuucuucugugaaccuuugaaauguccucugcuaaauacagcccagacacacuuccugaccugugcuucauccuagcugucugcccccuugccuguugacuccccacuggggagauucuugaucugcuucauaggaucccacacauuauauugucugaucucugccuuccucgcugcuuccuccccccuuucaguuuuucauccuauggucacuagcuacccaucagaaaaguggcaauacuugcccuaguacuaauaccauaccacuuggggcaaagccacacauucuuuuuguguugaauuucucacuugaaaugaguacacuaaaauaaaauugaaguuuugaugaaaacaagauuccugucugcaugucuguaaugccauguuaacaagaaggaaacuguguuucaggagcugcacaucuccaccagagaacuaaaggacauguccgaauacuacuucgauggcaaaggaaaagccuuuagaccgauuauuguggugcuaauggcccgagcguguaauauucaucauaauaaugcccggucaguuacuuuauuuccugcuuuuguuguucuuuuuaauuuggaaaguugucuuucauaaccuuauuaauuaauugcucacuuaagaagcgcaucuaagacuucacuagaccauguguagauucugacuuugacucacuaaauaagcgucauuuuacagacuuuaugaauauauaguagaaaacuugaguuacaaauaaauauauuagaaacauuuguuaguuaguuaguuuccauuugccaguuaguuucccauuagaaaguaaagaaucccaagauguguagcuauucauuuaaccauuauacauauagacaguuaacccaaagcuuguucuaauguuacacugugcuauuaucauggacagaccuuggauugagugcuuucuuaugacccucauuuugcagaagagaaaugcuuaaagaaaacaugaccaauuauccucaaaucaguauagauaaaauguuaaaacaucaaaacguauauauuuuagcauuaaaggaaauauuuuaaaaguuuccuauugcuuugcauggaucauccaaaguaaggcaagcacucuaccacugagcuguagcccccuucauguuagaaguacuaccauauugccaaaaugucuuuauaaugaugucaagugaccugcugguagagacucuuguagaucauauucuggugaacuagauaguacuuuuaaagacugccucaaagcuguuaccacuaauuuuaaugaugcugcuguggaaaugaacaucagauguugcuucuuagcagauauuucucugccuaaagugcucuguaacugugccaaucaguucaacaugucaugccaugcucagaguugacuuccacaaaacuugagacuuuuaggggcucacaguauguucugcauguguagugaaaccuuuuaaccagcaccuaagccgcuuucacuuauguggcaagcagaccagaagugcuuccccuggaccagacugacagguuuuucucagugucaguaccacugcugcccgaccacuaugcugucaacagcucuaaugcuuccugugcguuguggcuucuagcuaauggaugcccccaagugauaguaaccagcagugccuuuuccaaaaaccucugggagcuggagagauagaugcccaagcaguuaagagcacucguugcuccagcagagaccugcaugguggcucacaacugucuguuaauaaccaguuccagggcaucugauaccucuucuggcuucugcacauggcacaaauguauacauucaggaaaaaacucauacacacaaaaaauauaaauuuaaaaaaaauuuuacuuaaaaaauuacuucuguuaaaaaaauuuuuuaaauaaaaaauaauuuaaaaauaaaaaaauuacuucugaggugaaggcuacuauucuagagaaaucauugaugaaauucuuuaacacauaaaaugguuuaugaauuucauauauaguaugagaaagaacauuuucuccacuaucuaaaauccuuauucccuaguaagugagauggcuuggugggugggugugcucgccaccaugccuaauagcuugguuuaaugucuaagauccacaugguaaauggaggaaguuaauucccuuggguugcccuuugaucuccauauaaguacugugacaugugaucuuccacuuccacauuaaauuauuaaaauuaauguguugaaaaauaaagauuuuuuuuaaaaccauuauucccuauaguuaaaauuuugauuaucuugaaacuuuauaagcuguugauugcagaaaacacagaauauaacacaguuugggaauauuugagcuguaccuucauuguaggauacuugauaaagagcuuaugaaagacaguauagagguagcaucagacaugugggccugacucaugacuguuacaugcauuaaagugauucuguacccauuggcaugcuuuugacgcacaacuucuuuuuuccaaaguguuuuaccagcauacauugauauauacacauaacaaugaguuucauuaucuuguguucaucaguuuaauauauauuuugaucaagucuaccacucccccauuccugucucuugucccccagcuagcccuucuucuaccuucuugguuuugcuuuuggugagaugacccagugaguaucauuaucaacccucccaagcaagcacuaacugaccauaaauccauagagagggauggggucuuacccuaucguuuaccaccaugacaggaugcugagaggcacguucuugugcagguacucacagcuguuguaaauucaagagugcagucuucccauacugauccccuccuuauaaacucacauucucuauauguagucuuuacaguuucuaacaauuuuugugagcuggagcuauugcuuagugggagaacacuugccuagcauuauauaagguucuaguuuaaaaacccaguaccucaaaacaaggauuauuuuuucuuuuucuuuuuuugagacaguuucuuuguauaacagccugggcuguccugaaaccugcuuuguagaccaggcuggccucacagacaugugccugcuucugccucuugagugcugggacuaaaggcaugggccaccuuccccuggggaauguuuguuuucugaaacagacuagccucaaacucauuauauuccuuccuuacuucccaaguauuggguuuauacacauauaucacccaguucagcacguuuucauguccucaaauuacaaauauuuaaaugcuggcuuuuuguugagugcucacuguuuuguccuucuagucagagcccuauuuauugacauaccuuauaauaauagaaaugguggccaacuuggaaauacauagcaaaggucaaaggccuuaacaguuuuuuaccgguaaguuuuaccacuaauuagucaaaagucuauauuuuguuaggcugaaauucauuuaagauaauauucuuagaaaaguguuuauauuuuaaaacuacaaaaacccauuucccuauguaucaacucaaagaacacagagccuaauaaguuuccguagauaauacauacuuucuaacagcaggccuaaggaucugcucauagauucagcauaagcucuucaaaacugcaugaaugcugauuuuucucuuucaccaaugcagagucuuuuauugguauuggagaucaaacccaagaccucucagugccagaaccuucucucucugugagcugugcugucugcagcugucugcacugguuuugugugaugauuugucugugucugcuauuacuuuuuguuuacuuuuuccuccuugagucuccuagccccauaggaagaacagcaauaugaaccaaccaguaccccccagagcucccagggaauaaaccaccaaccaaagaguauauauagagggaccccuccagcugcauauguagcagaggacaaccuuccucaguggaaggagagguccuugguccugugaaggcuccaugccacaguguaggggaaugccaggacagggaauugggagugggugggugggugagcagggggaggggagauaggauaggagggguuucagagggaaaggagauaacauuugaaauguaaauaaagaaaauaucuaguaaaaaaagcaaaacaaaacaaaaagaguccccuguaaucuggaaauacuaggagcugcuauguuuugaauugugaaauuuaauauauaauauauauuauauaucucauaaauaaaauuauauaaccauauaauuuauauaauauuacauauuacauaauuauauuuaguauauaauaagcaguaccuuaccauugauguugggguuggaagcaguuaggaggcugagacugaguucuaaagcuuuggguaagaugggccaccacagcaccacacuuuaaaacccuauugaaagcaagauuagaagaugcuccuauaccuauguauagugaaugccugugucauuuucacaaugcuauuuguaaugacuuucugcugagccuaaagaauuaaaaugagcacuagcuaugcagauguuaaguuagguccuuaaaggaaaggucacuuguuaugccucucccuucccuccccugugauaaacacuuagugcaccagucaaauguuacgcuacaauuauguaucaaaaaacauaauugguguugaaagggaaaauacuggcucagaauucccaagacuaagaucucuuuuuaccugugagggacagggaauaagagacauagacaggagacagaggauccgggaaaaggacugucucuggguagagaggaaacagaccuggcacauaaaaaaacgauaguuuguaaagguaaaaggguaaacccauguuaagauaagguguuuaauuuugauuggguguguuaaguagaggacuuuugaaugcuggacuuugcuagcuggauuuugauagucagccucaggaggaagaaauggccaagcaaaggaauagaccuugggggcuagcuucagcaauguaaucuaacaguuuuuaacaaggcagagggggagaaggacaaggccuaccacagccauguuugccaugcucaggauggcuuaaguccuuucaaauauauuucucuaguuugauuuaucaaaauucaguguuuuacaauucccauaaauagugauauaacaaugacugguucuugggccugaggagaaaagacugcuuaaggaguagucccucuucugagaaaaagaaauuguagcauucccgcuuuacuauuaaauuaguauugcuuaucaccuugcaaguucuuuuuuuuaaauauuuauuuauuuuauguauaugaguaccugucguugucuucagacauaccagaagaaggcaucagaucgcauuacagaugguugugagucaccauguggucacugggaauugaacucaggaccucuagaagaguagucaguuuucuuaaccacugagccauuucuccagcccccuccuugcaaguuccuauccuguaauuugugaggagaaaugaauuuagagacccaacaaaguuaaauaugaggaaauuauuggucaugucauucauuuaguauaguuuuuaaaacuuugcacaguggcauuugauuuuuuaagauauauuuugauuauuuuuagugugagagagagagguugagagagagagagagagagaaugcaugcaugcccuagcauuuaauucuuuaagacacuuuauacuggggcagaaaagaacaugucuuuuucuuguagaagaucuggguucaauucccgguacuaacauggcagcuuacaacuaucaauaacucuaguugcaggaaucugacauccucuucugaccuugaacaggcauacaugcaagcaaaacaccuauaaacaaacaaaauaaucuucauacauugcaaaccauuuuuguaagauacauuuauuugugugugugaaguguaagggcacaugcauccuaaggugugcauguggagguccauugcaagacucacuucuccuuuuccaccugugguucuguggauugaaaucugggugucauagcugggucuuucgggucuauagagcaaccaacauuuuuauacaguuucucuuagagaaauacaauucuuuauccuagauucgauauccaguuuucacaagaugauugcugagaagguucuaggcggcgucuguuaaaaagcauugcuuucuguuaauuagagagaugcaagccagccagcgcuccauagccuuaguugcagaaaugauccacacugcuacucugguucaugaugacguuauugaugaugcaaguucucgaagaggaaaacauacaguuaauaaaaucuggggugagaaaaagguaugaugguuuuuaauguuacuuugaaaaaucuuucuuaccaaaccacaugcugaugggauugcguuugcuuuuuagacuuguaaaauagacuuguuugaauguggucucugaaaggaguguuucuguugccucuguaaaggucugacagcaaaaacgaacucagugauucuccuuaaucucuguuguucuuacgugaauuuuucuaguuauaagagaaagcauuuucaugcguauuucuugcggauuccuacauuuuucuguucaacucagauugccuacauugauuugaaaccauaagcauuuguuaacuugcugcauguucaagagugucaaagcaaauagaaacuauaaaacaagagaaaucacagaaauaguauucuacuaccaaaacuuacuguaaagagauccuaauaagauuugcuauacauacaggcguaugcacacacacacaaaugcugguauguauguauauauauauauauguauguauauauauauuuguuuguuuguuuguuuuaaacuuuaucugcauuuauuuuaugcugaauuuauucccgggccaugaguuuuuguuucuucaguuccuucugggauaucuuuuucuucugugcagccuccucuucuggcuuuggaacgaucuguuccuucccagugaggaucaucucaauguggcagggggaacucauguguggguuaauccggccaugagcucuguagguucgucggagcaucuuaggugccuuguucaccuggaugaguuuaaugacuagagaaucuaugucuaaacccucaguucagcauuacucucugcauuuuuaagcaugugcagcaaaaauucgccaccgacccuguguccagccccacuguuuguccugggugcaccuacugacuccaccauuauaccgccggaauggcacaccuugcuucuuuaaagugucauccuucagauacuugguggcuuugcauauaugcacacccuugauggccugggugguuucccugguguuuuuaaagugaacacgaagguuugaaccucuugauuugcaugauuuugugggguuuucugggucaagagaguagcgaacgauuuuggcacgugaccugugaacacagcagcucuggucgcuuccaggaagagguuauauuugauauauagagaaagagauuauuauuuuauggguauggguauuuugccuucaugcauacacguauagcagaagagggcauuggaucccccuaguaguggguugacaggagguuagaagcuaugaugugggugcugggaaucaaccugggguccuuuggaagaucauccaguacucuucuacugagccauuucucuggccccuguauauuuauuuuaaauuguauuuccuguuuuauuagcauugcuugaagagaauauguaaaauagguacuuuggauugaggauuuauaaguuauggguugaagaaugaagaugaacaaaugaaaaagaggauguguaagccuuccuucugugagcaagcguucucccacacaugugccuccauuggcagucuuacauaguugagaaccaaccaaagcacauaaagccagucuacccucuuacauuguucuucagaugaagcauaugguucccuccuguuugucaguacucucauguacuuuaauuggaaugaauuuuugcaaaauggugaguaauuaguaagcauaugcuaaguagcaguauucuagauaauagagaacagaaaaauacuaagaugguuauuuugaaaauucuauuaccuugggcagggauguagcucuguugcgagaacucaugcucagcauauaaaaggccuagauucaacugcuggcuucucaugcaugaaugacgucucuaauccugggacucaggagguggagcagaaagaucaagaguuuaaaguccgcuuugccuacauaccuaguggaagacagcucagcuagcuugcuuacuugcuccuuccuuccuucuuucuuuucucucucucucucucucucucucccucucucucuuucucucucucuuucuuuucucuuuuugagacaggguuucucuguguaacccuggcuguccuagaacuugccaugcagaccaaacagaccguaaacucaaagcaaucuccugccuccaucuucagaguacuggaauuaaaggcaugcuccaccacuucucugugacagccuagcuuuuuaaaacaugaaauccuaugaguaaaacauucugugaacucuagcauuucuguguaacagaguaguacugauguauaucuuuagugugcauguaaaguguacgauauaauuugacuguauaauuuuuaacugauaauuuguucugguaacauuaauauccuggguaucaaaccuaggcuuuguguaugcuaggcaagugccuaacugcugagcuagcugugaacuuuuuuaucugugauguuuuauucucuuuuuuuccaggcuguucuugcuggagauuuaauucuuucugcagcgucuguagcucuggcacggauuggaaacacagcuguuguaucuauguuagcccaaguuauugaagauuuggugcgugguaagucgguucugauguuucuuuuuuauuuagaauaccaguucugguauuuagccaggcaauaaaaccguaucucaaguaacccuucuccuucuugauaggugaauuucuucagcuagggucaaaagaaaaugagaaugaaagguuugcccacuaccuugagaagaccuucaagaagacagccagccugauagccaacaguuguaaagcaguauguacguucugucuuuuuucaaguugaaaaaagcccacauuuauuucuuaguggcuaauucuccuagaaacauuuaauuagagaaccuuaaaauagcauccuaaaauuccagucgucauagagaaaccauuacgucccagacacuuuguuguucucacuuuccuuguguucuucugguauggaaauaaugaacuuuucugucauauuuccucccccaagaaucaaucaaaauauuuccuagucuaugcugacaagauagcucaccagagaagcacuugccacagauuccugauguuagacaccugagaccuaaaagaggacagaagcaauuccaggaacuguguucuacucucugcacacgugccauggcacacguguguccauacucaaacaugucacacacuuguagauaaaagagugaaaucaagauauuucccaaucaaacguauauaaaauucugagcaacucuuugucacaguuaucacucgauauuuuugacauuuuaccuuuuaaauuaugaaauacugaauuaucacauaaauauuuaccugggagaaaaauguuuauuagauuguaguaguauucuacauacuuguucauaaauaguagaucuaaccaauuuuauuauaucuccuauauguaagccauaauuuucagaguauaaauuaaauaguaacuucuucgcagucucucugguccucuuuaccuccucccuacacugugcucucugccucucaguguuauccaaacauuugagucacugucuuuaaucuguguauuaaaaugugauagucauuguuaguucacaaauaacagucucucuauaaaacuguuccugugagaagcuguguuugauggugcauaccuguaguccuagcccuuggaggcagaaacaggaagauuauaugcucaaagcaaaccagggcuacauagugaauuuuaggccaccgugggcuauagaugacauccugucucaaaaauaaaacauuguuuaucugagcaugucccaaacuagcagguuuagagaagaaaccugggcaagcaauggucccauguaauagucuugugcgaucauggcaacaagaaacauguaagguaagaucuagacugucuuggaacacucuuagaaaauuauagggaaaaggagccuuuuagcccuuugacaacaaugccgcuguuuugccaugcuucaagaaacauacuugugggccagaaagaaaaaaugaggacaacacuuucuucaugaaaagaucuaauugaaagagaugugaauugcauaggauagguuggccacagucacagcucuuugucuuccugaaaaagcuauuacauuuccauuugggagaaauuacagguauacugguuuuuaagaagacaugaaaguaugacagacaucuuauaaauggguaucauaaugcuacugcauugaugcuuuauuauuaacguuugguugucaaaucuuacaaaguuuaaccucagaauguuugcugcucuuaaagaggaccuaaguuuaguuccccgcacuuaaaucaugcagcucacaaccaccuauaacuaaaaaaucugauacccucuucuggaagaucuggcuuccaagaccgauggagaaacaugcuccuguuauccaagucuugaggcugaggcuggaggauugccauaauuccaaggcuagcuaaggcuguguauguuaggggugcaggaacgaaacugucaaagcagaggcucuauugggggacguuuauaucaugaauaagagaaagaaaacagcagaggcauuuggaagaguucagaacagagagaaaaagaaguagucuguauuuugaaauguauaacagguacuugugauuagggacuauaggugccuagagucuaucaggggcuuugacaugaagccacggguacaugucaguggagcuauauguccauucugauguuccuucugccagaggcaagggaaaugacuuccuuuggggaaggaaaaucuguuucacagguuccugagggaugcuagacuuuuaucuaaccaccagaaauccuacuauacucuagcuuuagcucauuucugacauaugaauugccugagaccuuacacauaguuuuaaaaaaaaaaaaacuauauaaaaaaaggaacaauccauccucaggagcuacuaguaugcaagagaaguucacaaguuugcugcugcaguuuagaaaugcuaaaugcgcauucucuaggcacauaggagcagcuccgccuaggaaccaguucacacagugguguaaucguagggaccugugucaccaggguaaggcaucauuacuacucugcuuaagcagccagagauaaugugugugcugaggagcuccugugcuuuucagugauuaucaagaaaacagggccuaugagguaccugaucaccuggguucagucccuagcacccaagugaugggaagccauaugcagagacaccuguacacguuaaguaaaugcaauaaaaaaauuaacaaguaaccaguagacauguauuuaaacuuagcucaauccugauuaaaaaugaaauagucuaggacuaaaacuuagugguagagcauagcuuaccaagcauaaauuccuagguucaaucucugguauuaccuuccccugcccccaagaaaacuccaaauuuucuuuuuaaagagggagaaaaggagagagaaagaagguaaagugaaaaaaaaaaaaaaaugaaagaaguguugugugcugaccacaccgaggugugcuagcagugccccagagcugccuacuuggauaacagcaaaaucucagugcgagugcucugaauaccagcucugcauuuaagugaccauggauggaaauacuccagaggguuaggcauuuaaaacggcuauuuuuauaugcucuugguauuuaagaugcagacauaugaccaaagacauucauucaaaggaaauuaggcaugccaaagaugggaaguaagaauuuggagauaaagauuauuacagaacuaaugggauuccauagugcauugagaauuuaaaggaaauuuaucagacuuuauuuaguuuacuaaagacaccauuuuuuucuuacuaagccuccccacagcuuauaucuacauucuauguuuuuggccaaaaaaaauuuaaaauccucagaaagggcuggcuagagaaauugcuuugugucuuuaaaugauauuaaaauagaauugauguuauuuucaaaacaugguucgccauuuauuuguauacauaaucaugccaaacacacucuguagcugacaguuaaaaccaccauuuguuccccgggauucuggugugaauuagcaacaacaaaacccuucucucccuuucuuguauguguugacauucucccaucugcuucaccuagcauauuggucuuagugcuuuggguucuuccuucuguuucaucuugcauaaguaagauauauacauauuaguucuuacucuuuguaaccuguaauaaauuaguagacuacauaguguuucuucuggcugccuaccuacacuauauucuggaugauuucacaaugauuauagaaucuucccucuaaaaccagcuggacagcugggcgugcuggugcacgccuuuaaucccagcacucgagaggcagaggcaggcggacuucugaguucgaggccagccuggucuacaaagugaguuccaggacagucagggcuauacagagagacccugucucgaaaaaccaaaaaagaaaaaaaagaaaaacaacuggacagagugaagugugguggugcacaucuuuuuuuuuuuuuuuuuuuuuuuuaaucccaggaaacaggaagguagaucuugaaguuugagacacaguuggucuacguagcaaguuccaggaagccaggacuauauagugagucccaaaagaaaaacaaucacaaaaagaagaaaagaaaagaaaaccccaugguuguacaauaucaguuguguggccauaguaucacuccuauauacaggcauuuaggaucucaauauaauagacuuacaagccacaguaaugccugugugugugucguggggcuugcuuucaguguuaagguagagucaauuauacguguaguuuugauaagcaccaucagauuuucuugcauaaggccaugugcaccacugucagcaguuccugaguguguccucuuugccugaggcgucacuaacagaaauuacacuagaguuuucuauuucugacaauccaaaauuacaucucccacuucuugagugaagccaaacauugagaucauugauggccauuuguggcuuugcuuuauuuuuuacucuauuacuauuuggggagguuucugccacagcauuuguguggaggucaacagcuuuguagaguugguucucuccuuccacauuuauguggcuucucaggauuugcgcccagguaaccagacuuuuggggcagaguacuuauaauuaaugcuccccucccuuccccuucuccccccccccuucucuuucucuuugaguugucuuuguuuuugacacauuuauacugcauauuugcaggggggcuuguauuuuguuugaggcaaaaguuugcccuguaucccaagcuggccaacaaccaauguucuccuugcuuuagccucuggauuauggaaauuacuguguucaagaucacaguccagaucuuugugauacaauguugcauguguuucucucuaccuguuuacuauauuuauaauggaacagacugaaagugucuacaguacuuuguaaucuuuuuauuauuuuuuauguuuauggauguuuugucugccuguguauccaaguaccaugugcuugcaguuuccacugaggucagagcagggugucagauacccugggacugcacuuaaagaugguugugggccuguauauagguguuggaauugaacucagguccucuggaagagcagccagugaucuuaaccacugagccaucuguccagccucucuaacuacuuuucuuuguuuguuuugagaccagguuucacuaugaggcccuggcaucuggaauucucuugucuuauugauugauugauugauugauugguuuuugagacaggguuucucuguguagcccuggcuguccuggaauucacucuguagaccaggcuggccucaaauucagaaauccaccugccucugccucccgagugcugggauuaccauugccuggcgaauucucuguuuuaugaggcuacuccaugaauccauaaaaauacuccugccagggcuggugagauggcucagaggguaagagcacccgacugcucuuccaaagguccaaaguucaaaucccagcaaccacaugguggcucacaaccauccguaacagagaucugaugcccucuucuggugcgucugaagacagcuacaguguacuuacauauaauaaauaaauaaaucuuuuaaaaaaaaaaauacuccugccucuacuucccaagugcuggaugaaagcuguaugccacuaugccuucuauacuauuuuaaacaaauaagaucauaaaacauaaaaucuucccguaaaauaccucuaauucaugguaaugugaguauacauuccaaaguuaaagagauccugguuaaacuuugcuccuccagugcaaucaguacuucucagucucucugagaugaaauuugugggaaugugguguuaucugugauucucaaagaagcacuggggcacaacacagccugacuguggcauuuacuucaagcaaaacaauuagucuuuacuuuuaucaucuuucauauucuacccacuucgaggaagauauuaggcaucucucuggugcugaguucaagcagugucauacaucuugccuuuuugccuuuuuguacaguauaccacucuuuaucugguuuuguacuugugauugguguucuuuguuuccuaacuuuaugaagguaaucaggacuccuuagagagcuccucaagccaaacagaaaccgugacuugucagcaaggaagggaauuaaguaauccauagugcuaguuuuauguaucacaaaugcuaauucauugacuucauaaauauaagauguuugccauuuuuaauuuuugaaagaaagauucuuuuccuggcuuuuuuuaaaagcauuuuguuauuagauauuuucuucauuuacauuucaaaugcuaucccaaagcccccaauauacuccaccccccgccaugcuuccugacccacccacuccugcuuucugaaccuggcauuccccuguacuagggcauaugaucuugacaagaccaagggccucuccucccauugauggcugacuaggccauccucugcuacauauacagcuagagacacagcucuaggggguacuaguuaguuaauauuguuguuucuccuauagggcugcagaucccuuuagcuccuuggaugcuuucucuagcuccuucauuaggggcccuguguuccaugcaauagaugacugugagcauccacuucuguauuugccaggcauuggcauagccucacaaaagagagcuaugucaggguccugucagcaaaaucuuucuggcauaugcaauagugucuagguuugaugguuguauaugggauggauccccagguggggcagucucuggaugguuucuccuucagucucagcuccgaacuuggucucuguaacuccuuccauggguauuuugaguauccacacuuuggucuuccuucuugaguuucauguguuuugcaaauuguaucuuggguauucuaaguuucuuggcuaauauccacuuaccagugagugcauaccauguguguucuuuugugauuggguuaccucacucaggaugaugcccuccagguccauccaauuuccuuaggaauuucauaaauucauucuuuuuuuuuuaagauuuauuuauuuauuauauguaaguacacuguagcugucuucagacacacaccagaagagggaguagaucucauuacggaugguugugagccaccaugugguugcugggauuugaacucaggaccuuuggaagaacagucgggugcucuuaccugcugagccaucucaccagcccaaauucauuguuuuuaauagcugauuaguacuccauuguguaaauguaccacauuuucuguauccguuccucuguugaggaacaucuggguucuuuccagcuucuggcuauuauaaacaagacuacuaugaacauaguggagcauguguccuuauuaccaguugaaacaucugguuauaugcccaggagaagaauugcuggaucuuccggagguacuaugucuaauuuucugacguaacaccagacugauuucuagagugguuguauaagcuugcaaucccaccaaaaauggaggacuaucccucuuucuccacauccucgucagcaucugcugucaccugaauuuuugaucuuagccauucugacuguuuuuuuguuuuuguuuuuguuuuguuuuuuuuuuggaaaucucaggguuguuuugauuugcauuuucuugaugauuaaggauguugaauuuucucagauguuucucaggcauucuguauuccucauuugagaauucuuuguuuaguucuguaccccauuuuuaaauaggguuauuugauuuucuggaguccagcuucuugaguucuuuguauauguuggauauuaguucccuauuggauuuaggauugguaaagauccuuucccaaucuguugguggccuuuuugucuuaaugacggugucuuuugccuugcagaagcuuugcaauuuuaugaggucccauuugucaauucuugaacuuacagaacaagccauugcuguucuauucaggaauuuguccccuguacccaugucuucgaagguuuucccuacuuucuccucuauaaguuucagugucucugguuuuauguggaguuccuuaauccacuuagauuugaccuuaguacaaaggagauaagaauggaucaauucgcauucuucuacaugauaaccgccaguugugccagcaccauuuguugaaaauacugucuuuuuuccacuggaugguuuuagcucccuugucaaagaucaagugaccguugguguguagguucauuucugggucugcaauucuauuccauuagucuaccugucuguggcuauaccaguaccaugcaguuuugaucacaauugcucuguaguacagcuuuaggucaggcauggugacuccaccagagguucuuuuauccuugagaagaguuuuugcuauccuagguuuuuuguuauuccagaugaaucugccgauugaccuuuauaauucauugaagaauugaguuggaauuuugauggcaauugcauugaaucuguagauugcuguuggcaagauagccauuuuuacaauguugauccugccaauccaugaucaagggagaucuuuccaucuucugagaucuucuuugauuucuuucuucagagacgugaaguucuuaucauacagaucuuucacuuccuuaguuagagucucaccaaaguauuuuauacuauuugugacuauugugaaggguguuguuucccuaauguccuucucagccuguuuauccuuucuguagagaaaggccacugauuuguuugaguuaguuuucuuuuuuuuuuuuuuuuuuuuuuuuuuuuaauuuauuuauuuauuuauuuauuauauguaaguacacuauagcugucuucagacgcaccagaagagggcaucagaucucauuaugggugguugugagccaccaugugguugcugggauuugaacuucagaccuuuggaagagcaguugggugcucuuacccacugagccaucucaccagcccccuugaguuaguuuucuacccagcuucuucacugaagcuguuuaucagguuuaggaguucucugguagaauuuuuagggucauauauauauauauauauauuugacuucuuccuuuccaauuuguacccccuugaccuccuuuuguugucuaauugcucuggcuaggacuuagaauauggaauagguagggagaaagugggcagccuugucuagucccugauuuuagugggauugcuuccagcuucucuccauuuacuuuaauguuggcuacugguuugcuguagauugccuuuauuaugcuuagguaugggcuuugaauuccugaucuuuccaugacuuaucaugaaugggugcuggauuuugucaaaugcuuucucagcaucuaacgagaugaucauguggguuuugucuuugagucuguuuauauaguagacuauguugauugauuuccauauauuaaaccaucccuucaucccugggaugaagccuauuugaucaugauggaugauuguuuugauguguucuuggauucaguuagcgagaauuuuauugaguauuuuuguaucaauauuccuaagggaaauuggucugaaguucucuguguuuguugggucuuuaugugguuuagguaucagaguaauuguggcuucauagaaugaauuggguggaguaccuucuguuucuauuuuguggaauaauuugaggagaauuggaauuaggucuucuuugaaggucugauagaacucugcacuaaacccaucuaguccugagcuuguuuuguuugggagacuauuaaugacugcuauuucuuuaggggauaugggccuguuagaucauuaaucugauucugauuuaacuuugguaccuuggugucugucuagaaauuugucaauuucauccagguuuuccaguguuguugaguauagccuuuuguagaaggaucugaugauguauuggauuuucucagguucuguuguuaugucuccuuuuucauuucugauuuuguuaaauagaauacugucccugugcccucugguuaguuuggcuaaggguuuaucuaucuuguugauuuucucaaagaaccagcuccugguuugguugauucuuugaauaguucuucucguuuccacuugguugauuucagcccugaguuugauuauuuccugcccucuacuccucuugggugaauuugcuuccuuucauucuagagcuucuaggugugcuaucagacugcuaguguaugcucuuucuuguuucuuuuuggaggcacucagggcuaugaguuuuccucuuaggacugcuuucauugugucccauacgccaggguauguuguggcuucauuuucauuaaacucuaaaaacucuuuaauuucuuucuuuauuucuuccuugaccaagguaucauugaguacaguguucuucagcuuccacaugaauguuggcuuucuauuauuuauguuguuauugaagaucagccuuagucuguguugaucugauaggaugcaugagauaauuucaauauuuuuguaucccuugaggccuguuuugugaccaauuauauggucaauuuuagagaagguaccaugagguccuaagaagaagguauauccuuuuguuuuaggauaaaauuuccguagacaucuguuaauucuauuucuuuuuaacuucuguuaguuucaaugugucucuguuuaguuucuguuuccaggaucuguccauugacgagagugggguguuaaagucucccacuacaauuauugugugaggugcaaugugugcuuugagcuucacuaaaguuucuuuuuuuuuuuuuuuuuuuuuuuuuuaaaacagaagcacucuuuuuuuuuuuuuuuuuaaagauuuauuuauuuauuauauguaaguacacuguaguugucuucagauacaccagaagagggcaccagaucucauuacgggugguugugagccaccaugugguugcugggauuugaacuucagaccuucggaagagcagucgggugcccuuacccacugagccaccucaccagccccaucacuaaaguuucuuuaaugaauguggcuacccuugcauuuggaacauagauauucauaauugagaguucaucuuggaagauuuuaccuuugaugaguaugaagugccccuccuugucuuuuuugauaucuuuguguuggacgucgauuuuauucaauauuagaaugccuacuccagcuuguuucuucagaccauuugcuugaaaaauuguuucccggccuuuuacccugagguagugucuguuuuuuuucccugagguggguuuccuguaagcaacaaaauguuggguccuguuuauguagccaaucuguuagucuaugucuuuuuauuugggaauugaguccauugauauuaagagauauuaaggaaaaguaauuguugcugccuguuauuuuuguuguuagaguugggauucuguucuuguggcugucuucuuuuagguuuguugaaggauuacuuucuuguuuuuucuagggcauaguuuccuuccuuguguuuguguuuucccuuuauuauccuuugauuggcugguuucguggaaagauauugugugaauuugguuuugucauggaauacuuuugguuucuccaucuaugguaauugagaguuuuacugguuauuguagacugggcuggcauuuguguucucuuaggaucuguauaacaucuguccaggaucuucuggcuuucauagucucuacugagaagucugguguaauuuuaauaggucugccuuuauauguuucuugaccuuuuuucuuacugcuuuuaauauucuaucuuuuuuuuuuuuuuuugguuuuucgagacaggguuucucuguguagcucugggugugcuagaugccugcaguguagagaguucucuggggaccugggacccucugcugagauaaugcccgagaucccaugccuggcuuuauguugaaaagauagcauuaaucucaugacuggagauagcuuuauuaucaauuauuucugcuugcaggggguggggguaggggucauuuuguucuccauucaauauauccagcugccugaaaccugaaacuugccuuuuucaggcagguaucuugacuucuuuucuacauugaucuucauguagccucacaaaguacuugcaaagaauagcccuuccugggcugcuguggaucacaggucuuugcuuuugaaagcagugaagagcuuuaccacuuacucaaguggcuuugugaccuuuuggugugugcagcuuagcccugcucugcuaagcauuacaacuauauauguuauuaaauaucugaaagcauucccaggguugaauggggcugagugcuagaguacuuaucaucaugcacaaagccauggguuugauccucagcaccaccaaaggaaaacaauaacaaaaauaauagugagcaaagauauggcuagcagauccugccuucauccuguuccuggauguagugaacaaagagaagggggauucuguuguuucugacucaacuguuuagccuccagccucaacucugcagucuuccugccucaccucuugaaugacuggauuacagguauggauguccauauccagcuaaacaggaggaucaguuuccuuuuuccucauuucuuccuuuuuuccuuccuuuuuauucugucuguuguaccugaguccaaacaaauaugcuagguaaaugguuuccuacugagcuauauccacagcaucaaaggagauucuuuaaugggaaguuucugcuuuuguaugagguaaaaguuuaguuccuacauuuuacagguaaggaaacugaaacacagaaggaucagguggaagaucagggucacugauaguugcuagucauaucgccaaccccacaggcuucuggagagcuugucccaccuugccaugcugcuguccaggaggaauacagucuccaaaagaaguaggcagaugcuuaaguaucaccagugaccuauuucaucuggcuuccuuacugaacgucaacagagacuuugcuuuccaauugaacagaaugucuccccaguuccccucuuguucuuucccagucuuugauuucugaaaauguggcugggccugcuuagcaugcuuaacaguacagcaggaaguagcuuugguggauuagugaggauucgcaugcucagcacuaaccagcuuguguuugagguuuugagcuuuaaaggcuuugaaagucuuccuugucuccuuuuggaagggugggagugcaaacaaacaguccuaauauaauuguuacuucugaugagaaagggguugaagauccuucucauaaugaaaaccagacugagacuugaggcuguuaacaggcauagcaagaaacaacugcauucaggggaaaagaaaaaaaaaagugaucaccaaaacugagccacagaugaggaggagcuuggcaaaguuuuauauugaaugagaguacaccccugaaaugaggguucuccucagaggucauuaagccagcaauugcacugagugcuagaaggcaguguuauacacaaugggaucuguuuugcauaccagaaagguuugcuuacauuauuauuagaauuuagucuuguggcucuuugcccaaaagacuguuuuaucuuguuugaaagaacaggaggaagaaggcuagauucucuaaaauuuaagagaaugggacugcaagguguacuuccuguaagcugccaaccugaaaccaaucccuggaguccauguaaagaugaagaaaaguaaugccagaauggcacccacacuccugcauacucacaaauauuacaauaaauuuaagaaaauaggcuacauuuguagcuggaugguagacugcuugccuagcuugcaaaagauccuggacucuauucucugaacuacacagaaaggaaacaucccuuuguuuuguuguuuguuuguuuaauuuuguuuuauuuugaggcagggucucuguagccuugacugucuuggaacucuguagaugaccucaaacucacagcucugccuccugacuaaagaugugugccaagaaaacagcacuuuuuaaugugcuggguuuccuuuuagugccagcauccccauugucuauagcauaggcucagugcucuuagggaaugcgugaguggcucugccuagugccuagaugacacagcuuaccagaaucuucuuuuucuuucaggucucuguccuggguugcccugacccaguggugcaugagauagccuaucaguaugggaaaaauguuggaauagcuuuucagguugguauacuuguuugugggaauggugacauacaggcacagccugcauuuuucucaguguagugugcuaagcaguggagacaguggcagcucaguggguguacucaucuuuccuuuugccagcucauagaugauguauuggauuucaccucauguucugaccagaugggcaagccaacaucugcagaccugaagcuaggcauagccacuggcccugucuuguuugcuugccagcagguaggucuuacucucuuugaaacaggaccaacauagaaccaauaucucaggcacaucugguaaagugugagagaaaaaaauagcuggaggcauuuagauaagggaccacagauuugaucuugguuuaguaacugagauguuagggcuauaauuucacuucuauaaaccuuaucugugaaauaccaauuauaaucuccucaguuguuaugagcgcuaguugauauacuacucauuaucuuguaaaucagaaagugcugaguaaauuucauguguuuugaguguugcaauauugacaguuacuacuuuuaugauuggguaugccucaaagccucuuaaagguacagaaaguuccgagggugucuaggucugaggaagucauaaguucuaguuuaauggaaauguugacaucucgagggaagccuugaugccucagccauugcuuccaaguguggagaagucaauugaaugcaccaggacugcauaguuccuuccuuuucacacugagaagcuuucaaguaaagcugcuuucacguccucuguaacagaugagaugcuucacaaguaucaaagaugcugcagugacugucaagccaaccauuucacagcagcaucuggacccaggccauuugcuuuuagcugggccagaugcugcuuggaauaaguggaccauuagcuguguauggguaucuuuaaaacaaauagucaucugaguggcauuuaacugguuaguuggcaguguacuaagacagucaucacuaacuaccuuuugggucuaaaauuuuuaaauuaucaguuuuuccauaaauuuugccugcauucuuuauuuaaaauguaagucacgacuucucuaggacuuaguuccauuuugauauuaaaaccagugacauuccuuuugauucguuucugauucaagaaagguaagagaugaucuuuuauccuuugaccuagcagaacuacuacagguaauucagccucagggaggcugaagccuggauggcugugcugaguaccauggacaguaccugucaauuaaaagaauagagacuaugaccaaagaugauguugcacuuagaaacucuguccuuauuagcaggcucuaucaucucagacacuugaggucgggguaagaagagaaagauauagagcucagauguaguaacacaggcgugccaaccaacacccaguuauaggagggucaugagauugaggacagucugaacuacauuaaaaacaaacaaaaaugucucaaaucauaaacaaacaaaauacaugcauucugugaaugguaggucccuuuucccaugagacuuauuaacuaacuaccccaauauucaggaaaauuauuaauauaaugcuaaguuuuaaaaaauuuaaaaaaucacauuagagcaacauaaaggaacauuuucuguuaugccauagccaccuauacacacacagaguauuccugagccauguguguauaaaaguauaucugaugauagaaaaauuaaucaucagccagcauuuguuguauagucacagaccuucaucaucucugucacaggugaguauacaugaauaaaggagagucucaacaauuauaaauacuugcguguuauacugggaaauccaagaggcaugaggcacccaguuacucugaccaggcagcaccuuccccuuucugccuauaagucaauggggaaaggagcugcaggcauaaacgcagccucagaaaugagacacaugaugaaauugaacaguagugccucugggcagcacucacugugccaaaaguuaauaaaauagauauuuauacuuagucaagguuguauuuauaaauuggucucaaaacccugagcuuaggaucuuuuuaugcauuauucugcuaaaaaagaguucauggggcuuaaaauaacuuugggugaaucaaguucaaaaauaauacaggauuauacaguaucuagcuuuaauaaaacagcauugauuuuaguuuauaaaggauucuuucuuacauuuucccugauucacaagucuacuuugugguagauaacuguuuguucuuugaaugaaacugaugcucaugucugaccaaaauggaacaucugguagaugacacagagccuucuuuuggguaauugaacaucuuucccaagucuucuaagaccagcauucauuuuacuaugcuugaauuguuccuucaacuaacaguguacauaacaguacccaguaggucuacccagaaaccagguaacugguauacccuagcacugaagauaccaccacacaggguauccacuauuguuaguggcuaacaucauuuauagaguacuuggaagguguuuguaaaccuuuccuagggggauguuuuguccacauauuugucauugaacuaauccaucuguguaacacugaagaucuugcucugagauccuaggccuuccacagacucccugucucagucucucaaguacaaagauaacagacaugcucuccaaacccuggcuugccuuuuccuuuuuaaugcugcaugguaaaugaucuuuacauuauaauuuguucgacuaagaacuguuugacugagucuucuauuuuugauaucuuugggaacgauuccuuuguggccauguucagggacuugaggugugucaggaggucgucacucagcaguagagauccgccuaacauguauaucacccuggguuugacucaaagugagcauaugcauaucucucucucucucacacacacacacacacacacacacacacacacacacacacacgagcgcgcgagcgcgcgcacuucaugauuucugaagaggucucagugguaaugaaguuaguauauucuugauuaggaguguauauugucauugagcucuguuguagaguaauugccuaguaugcacaagucccuggacuccaucacuagcacuugagagguaaaagcuaggaauucaaaguuauugccagcuacauaggucaucauccugggccccaugagauugugccaaaaaaauaaaaaggaaaaaagggaaaaaagaauacaacccacaacauugcaaagaccuuauucacaagugcaaacccuagccagaagcagccgucuguaaugaaacuguacacagaagcuacuggguaagaagugggaaauauguuucucuuaaacaagcaagucuccacccuuuuucuuuaaaauuccuuggacauuaacucaguaacauuuaccugaaucuguuguacugucucaggcuuuaugauuuuucucaaaauauaaacuuacacaaaaguuugagugucccugcagugugguuaugucuugacgguuacucuugcuguguguaaugccccagaagguaaaaaauuagaaauagcuguccucuuucuccuugcugguucccuuaccuaaagcugguauuuaaauauguaaaugugggaaauucauuaagacauacugauauacuucacuuuggaaacaaugugaaaaaauuguuugacuuucuauuuuuuauguaguuuuuuuuaauuuucauuuuaaaucuuucaaugacauaugaaaauguuuaugaaauacucagaaauagaaguguuuuccuuuuuuggugagauuauaauaguuuaaaagcucguuuuaaaauuuuccuuucaucugcuuuuuauugauaaaucacuagacaaaugucaggcuucccgcugucaucgccggccucugcaccagaugccuaggcuuaugcuacggugccuuagaauuacucagguuuggacacuacugacccauccuagugcacugaucacccuuguaguuuugugaacacauuucccaguuacaaucugauuuccucacaggcuauuuuuccuacuuguaaaaagcaugaguaagcaaaaaaaaaaaagucucacugaaucugggaugagaaccaacuuguuucucacuucuuccucacauacacagggguagggaaguuuagaaguuugauauuugcauauugaaauuuacauaguguuacuucaaaggaggaauguagucaugcucacugcaacuuaguuuaaauguugcuuucuugauguuuuuacauuaaaagcaucagagaaacuacacaguuggcauauuuuaugacacauaacucaagcugaggaaacauacgcucgauauaugauacauacacaggggauuuuuuaugagaugcccaagacaccaucacaucugcuuuaagauauagccuagaaauaaacaagugugugugugugugugugugugugcgcgcgcgcggggggggggggguauuuaaaaaauaaaagcaccaaaauuaucugauugauuucuugauuuuauuucuugaugcaaacuaguacuuaagaacucuguauggauguuaacugucucuacaacuuuguucucaaacauguacuuuucuagaacacugcuccuuguuugguuaggguuucucuucuguuguuugccuuguuuuuucuacugcagauuccauagucacuacuacuggagaacuuacuucauccuucaggcauagugccagggaaacuggcaacugcaucagcauggauaucagacagaaagcauccuaccucuuacuccauagaauuacagacugcuagaaauuggacaguugaaacagaaaagaagacugagaugaggaaauuauucagcugggaugguugcuggcagaaccuggauaugggguuucugucuggaugccguccuccuaaauaaccaguaaaaaugaagaggauacaagacauugucaucauuacugagggacuuauagugugugucacacacgguggggagacaggugucugaguagucaguucuuucuucaucaaacuccagucaucagaccaugcacacucaaccagaccauuucuccagccuguuuuguuguuguuguuuguuuuugucuuuuugcuaucagaccuuuuuauucccucucuugugcuacaaugaauaggacuagccacugaaccuagaaaagcagaaggauuuucuuccccuaugaagucuucaagcccaugaauuuuuguuucuuguguuaggaauggaacaaaacucuaaauaugcuggacaaaugcucuaaugcugagcuguaccucugaucuuuuuauaacuugguacacugaucuggcugaucuaucuccuccaguccaaaggaggugugcauuaaaacauuugaugaucauaacaccaguauaaucagauuuguggggagugggaucaaggcacuuaaucccccgaugauuucagugugcgcucaacagugucuaauuccuaaccuuuucguagaacaccaguuccaacaucacuuggcaauucauuaaaaaggcauucucaaaccauagccuacugaauuagaaccccaaaagcucaagaauacaguacuugguucuccugagacuuacucaguacuggacugcuaauaggacaauuaguucuguuuuguuuaauguguaugugcaggcuugucuguuguguacugcguauauguugugcacuuggaggucagaggggaaauuacagaagacucaucugccugggugcuaagaacccaauacaaauucuuugcaagagcaccaaguguucuuaacuauugagacaucucuccagccccaccuuuuguuuuucuuauuuucuauauuuacaaacaaguauuaacaugcuucauugcuccaggaacaauaaaaauauuuuccuucuuuaugguuaguucccagaaaugaaugcuaugauaaugagacgguucaguuugccaggagauguggacagagcacgacaguauguauuacagguaagacuacuuuuaaaggaugguuuuaaaucuugcuugugcacaugcauaugcccagcgguuggugaaggucagaggacaacgaguaagcguagguuccuuccuacuguggauauuccagggaucaacucagcuuaucaggcuugacaagcaggccuuuacucacucaggguuagguccuuggucuaucccuaagauaagacagaccauuaaaaaaauauagaaaaggcaacagcugguacgguaacaaaauuuuauauagagccaaguuggucaacccuuaccugauuugacaauaacuagggcaacucauuuaaaguacuaauuauuuuauauuuaacuguggugccuuggugguaaauuugcaggaguuggcucucuucuuacaccauguggguccuggagacucaucaagcuuggcagccagcuccuuuacuugcugagccuucucagaagccaccagcgccccaccccccccaaaaaaacugaauauaauuucucuuugaaguuauucaguagucuuccuaugcaggccagaccauguuaaaucuauuagauugaaaugagcugucccguguccaugaauaucaucacuguacugugcuuaggaucgaccccaucccuguccaaagcucacuuccuauagcuagucaguuauaagagccuaccauaaauacccuuccugcuaaaagcaagugaguuauuaaaaacaacuugaacauagugaacaagucauagucauaggaccuagacacauuuuaaauguguugcuguauauauuucuccuagaugcuaaaggcuuuguuuucuuuaaaggauuauuuccagagccaguggguaaaggaacuugcugcaaagccuucugaccugagucugauuucagagacucacauaguggaaggagaaagucaacuccugcaaguuuuccucuuacauccgcaugugcccugcuguaugcaugcccacccccacaaacuaaacacaaacauaaauggauugguuuuuuguaaagggaucaguuuccaaauucaguuaucuggaggucacagguuaaauggaauagaguaagaaaacaagauuuaguaagcaaguacagucuaagaucucuauuuaguguccaauacaagaaagaauuccaaauaauguuuccaguauuuuagugagugcuuggcagugcuauaaaaacucaaauccaauauucaucucuagccuuagaaacaguccuuugguaucccugaggguugcagaacccuccuuggaucucaaugaugaauggauguuuagauauuuagaauacugcuuuauacuuuauauuguuuauaauaccuaguuaugauugcuuagaugcacagagaauggacaaagguguacaugcucagguuauguccaacaugguuuuagaaagcgaaucaagacucaagugauuggugagaaugaagagcgaaauuaauuguaguucucacaacuucuacacuguuccuuuaaaaaaccacccuuuuugucuuugugacggugcacuuagaaaucacaaguaaauuugucaaaggggucuaaauucugauccuuauacacucaguggggcuucuaaauccuauucauuaaguauguguggacaauugaagauuacuaaagaguugguuaaaacuugcugagcagaagaaaaugugaauauaaacugaaaaauaaacaggaaaaucuacaaagauacugaauucuuaaaacaagaccuuuuuaaagcucccuugugccaguuuugcacacgguaacaagggcuccagcaccaagccuauucaucucuagcccauuauucaacucaaacagaacaggaaguucugagaagugacaaaugggacuauauuguaaaagcugcugcaugaucaacagacagcaugcacaagaaaauaucuaacaccccaaauauauaaagaacuacaaaguuaaaugcuaauuuaaucauucacuaaagaaauacaaauggccaauaaguauuugaaacauguucaacauucuuagcaauuaggaaaaugacacuaaaacugagauuccauuuuaaccaccaucagaguggcucuuaucaagaaggcagguaaugcugaaugcuggugagggugcagaguuaaaggaacccuuauuuacugcuaaugggaauguaaagucauguagccacuaugaaagucagugcacaaagcacauggcccggcugugggcuucccuugagacagcauacagccagagaaaucugcaguucguguuuacugcugaacuguucaccuagguaagaaauagacugagcuggugaauaaaauaugauacauaagcacaguggaauuuuaucaagccauaaagaaaugucaaauaagcugcagagaugccuuacuguucucuaagaggacccauguuuaguucacagcaucuaaguuugguggcucacaacugccugugugagccuccugaguuccaggagcucagacaucaucuagucuacaugacaccuauacucaacagguacauacccacauauaaauuuauauuauaguauuuuacuggagaauggagaucauuaugauaggcaaaauuauccagucucaaaaaaacaaaaaucgcuucucauaaacagacucuaguacaugugccagucauacaaggagauaaaagaucuuaagugaaggaggaaggguugaugaaauauauuuacaugaaagcagaaagagauagauacccuuaagaggaccaguaacaaguggggauugggaacaacagugggagguaucaguaagaauaaagugugacuguauguaugcaugcauaagccauaauguaacuauuucaggaagagaauguacaaagugcucacuacaaaaggcaaagauaccaaaacuggcccuguggggggaaaaauacugaaugccagacgacaguuggaauaaggccuuccaaauagacauccaagugaacacuuuaaaccugagauugaguugaacuauuggauaagucuucaggcaagugaaaucauacuuggagaagaaaaagcugguuucuaauugguugugaucaugaaagccuuuaaugcuugcacuuggaaggcaaaggcagauggaucucuguugaguuuaaggccagucugaucuauauaguaggcucuaggccagccaggguuacagagugagauccugucucaaaaaggaaauaaauaaauguugguuuuucacauacccuuugugguagguuauuugcacaaguccuuaagcaggaugugcugaaacauuaaggagaaaaaaacauacuucuaugcaagauggcacugaaaacuaaacucuuacuaauguuuuaaggaaagcauuuucaacuguauacuaagacuauuguaaucugauugagaaccauggagaaggauuuuaguauucuaucagaaaaauaaaaauguuuuauuacugcucagcuucuagaaagaaccaccauuagaaacauaguuacagaauguaaccaucuuuaacauaauggcagaguggacagaagcaaugguguccucauacaaaaggacaccagaaguuaaccaugcuggcaaagguaaucugcagaagaacucaagauggugagauuacgauuagacuaggaaaugcugcaaaugggcuaugugauuuccaauaggaaaggcaccaguaaaaacuggcauuuuagccgggcaugguggcgcacaccuuugaucccagcacucggggggggggggggggggggcagaggcaggcagauuucugaguuugaggccagccuggucuacaacagaguuaacguuccaggacagccagggcuacacagagaaacccugucucaaaacaaaacaaacaaacaaagaaaaaccuggcauuuucauuguaagccuuuuagauuuucauuuuaaaacaggauuuuauauagacagaacuucuucagugaaaacaaacaaacagaaaauagcugggugcaugacagaguugauuucuuugugugcuaauagaacuagaauguuuccaugugagaaaaguuguagaugaaagcaacagccacuuggugggaagggaacuucaagacauagucugauuauuaucuguccagcucaucugaucucaaacuguguccuucucuuguggcagcaauucaggagcugaucagggcagugaucugucuguuuuguuguuuccuauagagugauggcgugcagcaaacaaccuaccucgcccagcaguacugccacaaagcugugagagagaucaggaagcuuagaccaucuacagaaagggacgcccucauucagcuuucagaaagugugcucaccagagauaaaugacaauuccuccucuucuuucuggcagcuauuuuaccagacugugccuaaugauuuugugaaacacuauuugcuucaugugcagaaaaccaaaaaucauuuuaagaaauaauuucaaccuuauugaugggcaauuuuuauuggcaaaguuuuucggaaaacuuuuuaaauguaauuaaaccagugucauuauaguccuauaaauucuaaucgagguauccugaugguuauaugugguauuguuuacacuguuaaugcccacauguaaagccauuacacaaauaaauaaucaacguuaaaauucaag

SEQ ID NO: 663 - RNA, 100391 nt, Mus musculus
gggugggggggaggaggcggggagaguaaggaggaagaggaggaggugcagucccacaauacccggcggagggagggugggugguuggcgucuggucugugcggagcucggguccccggcggacucagcuuccucugucucuuuaaugcgagaggaagcgaugcggagggguggaaaauggcagagcugcagauguuacuagaggaggagaucccgucuggcaagagggcgcugauagagaguuaccagaaccugacccggguggcggacuacugugaaaacaacuauauacaggugaggagcuugagcggccggcgggggcggcugggacgacaggcaggcugggcgccguggggacugcccuacuccgccacccuccgccccagcccgagcggcggccgccgcggcgauacaggaaguggccgccuugagaaaaugggugaggagcagggccgccgcgggcgccgcugacccgaugccgcuccccgcagccugcccggggccgccugugcuccccacagccugcccgggcguugcucccuaaagccuaccccggccgagcucugcuucucgccgucugcccggcccagcugugcuccccaccaccugcccuggcugaggucugcgccuaaaccccgccgcuuuccccgccagggaucuguuuccugcagccuucccaggccgggacgugcucccggcagucuuuccuucccggucuccgcucacugcaggccgcucuucuuagucgggcuguauucagcuuugccucuuuuggcugcgguugguuccuaagaccccccacagccuucccuggcuggggucgguccuggcugaggucccccuggaaaucccgcagccucccuuggucuccuuggagcucagacuucgcugucgcccccauguccggugugaugagccuaggacugggacagcugcgagaggaaugggcagggaaggaaaaguggggugugugugugucguuggaggguggggugagggugauuaugucaguucauccuagagggugugccuuuuauuuauuuaaaaaaauugucacgagucacauuuguacagaccuccuaaucgagugcggagagugacugcugagggugugauaaaauccauauuaaaauucuuuuaauugaaggaaaaaugcgugcuuggcgauuuucaaguugggcuuuuccucuuccaccuccucauauuuacuuccgcuuuagcauaauguauacucguuauuauaaagcacgaaugauucauagggaaauucagugggaaaucuguuaaauacuuuucuuccucuaaauguucuuggacuguuggccuugaacgcaguaguguuaucgugguugcuuauguucugagauuucuuucuauacugaguuaauacauagaagaauaugaauaaaguagauuagcaaacauuauguagucuuuaagucauaacauagaauugcuccuuaauuuaucaggaaauucuuggcacuuuuacuaugccaugcuugcuuguguuuaucagcgauuguaagugaauuguauguaguaguuugacuugucccuaugguugaguaaaaauuaacaguuuucacuagaagcaaauacaguaguggaauucuuuguaucagauaaugagaauagaaauucauuucuuguugauaaggcaaaaccagaacagucuuugaaaaauaaggaauauuguacuuuggaccugcaguauuucuuaaagugccuuucaugugauuaucauuuucaagagcggcuaauuucuguucuagcagauuccuguagauuuuguuuucagaaggagaugcugucuugagacuugucugaguauuugucauuuuccauauuaguaacauucuaucuggagugguacuccaaggaguuugucuuccuacucucguuuccagccuuugacuuugguaaucuacucauaaacuuguugaaugcuuccugugucuucuguauaacuugguuuugaaaacuauauggcuguuuaaaaacacauuuuaagcagcagaagggcugccuuaaccacuguuaagagcaguuggugcuuuugcagaggacucggguucaguucccagcgcccucauagugguucacagccauccuuauccuaggggguccguguccucuucugacaccugugggcaccaaacacacauucaguacacauacacacauacacacaugcauacacauagguacgaugagugaguuuaaaccuauuucaaaaucauacagaaauguggauauaguguggaaauagaaaggugaucuuguauuuuauagauacuaaaaaauguacaucuuuuauuuauuuuaguaugaaaaaccuuggguuuguugcaucuuugguucccagcacuuguaugaggcagguuacaacuaccucuaacuccagcuucaggggaucuaacacccuauucuggauguaugggguccugcacucaggagugcauggacacauccacaaacaauuaaaaaguggauagacacacaauuuaaagcaacccacuuuaauugguaauagugcugauuaggauaaguaguugugcuauuuguuuuucuuuguguguaaaguuugcguuuguuuucagacacaaucucauucuagaccaggcugcugacuuucuauccucuugucagcuuccaggugccaugcagcugccauacccagcugaggugggaaaggguuuuuauggggggugagaugggggacagggucuuauuaugccaucuuggcuggucuggagcuuauuacauagacuaggcugggugacagagaucucucuucucugucucaucuacugagauuaaacaugaaucaccaugccugaggagaaaaauugucauacuuacugugagacgauugcuguguguuuuaccaugauaauuauuuuguuguuuucuuauguuuggaaaauucagcccuguuugcugagaaguuauuuuggcuaguucuugggcuuugggcccugcugaguuuaguacuuaaacugaguuauuaaaugcagaucuuauugaaagcuucuucagcuccuuaaaaagaauggaguuuuaaaguuauggggugaggcuggagaaacagccacaccagaagagggucccauuacagaugguugugagccaccaugugguugcuggguauugaacucaggaacucuggaagagcagucugugcucuuaaccgcugagccaucuugccagcccuauuuuuauuguuuuaaaucauauguauauaugcgugcuucugcugggcauaugcacaugaaugcaggugccuacacaagccaguggcaucagaucucccuggagcuggaguuacaguugguuaugagccuccugauaugggggcugggaauccaauuuguguccuuuggaagagcagucugcacacuuaacugcuuagcucagagaaaagccagcucuaaaguacaaaccuaccugcucuucuguuugcagcuuagaacuuggaauguauuuucaaaagaaugguugcuggagcugucagguucccauacugguccaacaggucuacuuacucuaagaacauuccugaacuagucugaggucuagauucucaugaaaacugugugauauacaaacuacucuacccacuuguggagucugucacaccuaaggaaucugccaaucacuaaauguauagccaagcaaaauuuauuuaacuuuccugugucuaaauuuucuuacuuauaugagggcacucccuaugacagccagcauauaaggauuaaauacaaaguagaaagauuacagcacaauagaaacucaauaaacagacucaauuaagacugguucuccauaucugugugauucgacaaucauguauuaaaccuacugcugacccaaugugcugcgcagauuuuauugucacucuucccuaaaaacuauugugugugaaaacuuaagaauuuagggucagcaucuauagcacagagggcaggaauagugagcaguuggguagauggauucagcacuaaggaacaaagaugggcuucucucucagacuucuguauagcuggguuauugcuggagggucugucuauuuuagggagggguuuucugcucagucaguaggauuuucuuuucaaaguacaucauugaaaggauaauagggaaaauaacaaugcacuuugauaaagaaauaguugacuugauaauuuuaacaguauacguauauaguggacuuugggguugcuuuuuagugguacuacucuguugacccaaauaaguuuacccuuggcucuguugauuuuucuccacuuauaaaaaauuuuagaauuaauugcaaguguauccauguucauaacaagaaucugaaagcaaauagaacaucuuaagaaagguaauguuuuugucgcuaagugaugugauggccuggugugaugacuguugccuguaauccugugguaggaggaucacuaggaguucauggcagccuguugagguacagagugauccaaguuagccuagucuagaaugagacucuggcucaaacaaaugacagaagaauuagcuguaaaacuaaguuccuucuuuuccccacuuuaucucucccuucuuccucucucucucucucucucucucucucucucucucucucuccucucccucccucccucccucccuuccuuccucccucucucccuuucuucccuuuuauuguagcccaggcugauuucuaacugguagguaguugagauugaccuagaauuccuuuacugccccuaucuuccauauucugugcuaugcagcugugugugauucuucacaacuguguuauccuacuuguuccuauuccugccccaaacuaccacuaguucaucuuggguguguguauuuguguugggagggagagauagaaagagauggauagauggauucaugcagaugccacagugcccauuuggaagucacacagccuuugacgguuuguccauuccuuuuacuguggucugaugauuauucuggguuucagguuauuaggcuuucacuguccagcaguuucucugcugaacuauauuucagccucccuucauccccauuaauucuucuuaaguggcuuaaauaauuccuuuuguuuuauuuauuauguuuuugagacaaucucacuguguagcucaggcugaccugaaacucauggguggcaaugucuucccuuuaucucccgaguguugggacuguagugugaaacaccucaccuguggguuuuuuuuuuuuuuaauggacuauaaugcuccaguaugaggagaggcagcacuggagaaugucucccagcugacucacuaagugagucacuuuaaaaaagcaaucuguuggaauucuggccugcucaacaagagggaaagcauguuuaguacuggaaaccuagccaacuacccagaacuagugaagucauggaucuuggaagagaaccuacaaucaaccgccacuucuaaaccagcauaauccuuaacuacauuuaaaauuuuuuuuucauacagaauacuuugaucugauuauuugccuucuuccaacuccucccagguuuuucuuaacuccugaccaauguguacaugagagcccaagcaaacuucccgaaagcagcaacccucaaaagcagaaagaaacaaaacaaaaugagugcacauaaaaauggaguccgcacgccuuuaauccuagcacuugggaggcagaggcagguggauuucugaguucgaggccagccuggucuacagagugaguuccagaacagccagggcuacacagagaaacccugucucaaaaaaccaaaaaaaacaaaaagcaaaaaacaccccccccccaaaaaaaaaggaguccauuuugguuuuguguuggucauuuccuccugcgcauggggcauguuauaccucccaguggcaccucauuguaggaagcugauuuucuuuucccagcagguaucaauugcagauagcuucuuggucuagagugggaccuucucugugcugcuuuucugccugguuugaacuugggcaggauuugugccugcugucacaguugcugugaguucauaaagauaacuguccuguugucucuggaaaaugguguuuauggcuuagagucaucugccaccucuggcuugaacgaucuuucuaccucuucuaaauagcugcauuuugcauagacacauuuuaaauauugaucuuuaugccucaccuuucaucaucuaacuucuuuuugcaauggaggggaaccauuacagaaaaugauaacccacaaaauaaaggguuguagagcccaguuauaaccauuacaucuacaacacagcuccugcaccuaaggcucggggaucauugcguaagagugaguagaaaagauuguuaagagccagagcaucuuuugaugugggagugucuccuagaaaugacagaagcuacacucaugaggucucaucagcauaguugcaugaacacgaccugaaaaaggacuauaccaguagacaugcuaauaugagaggggaaaagcuuacaaggucucuagacaaauagagaagugucccuucccacuccccuaauugcuuaucaaauaccaaaaggucaguccugagagcauacauacaaguaacaucauuuggacugaacagguuguuuuuauguguuuaggaauacacacacauacacagacauauucaaacaauuaaagaaaaagaggccaugaguuugaaagagaguguggugugaauguacgugagggguuggaaggagaaaagacaagcuggaaaucauauaacuaaucuuuuuuuuuuuuuaaagauuuauuuauuauauguaaguacauuguagcuaucuucagacacuccagaagagggcaucagaucuuguuacagaugguuguaagccaccaugugguugcugggauuugaacuuaggaccuuuggaagagcagucagugcucuuaaccacugagccaucucuccagcuccauguaacuaaucuuaaaaggaaaaaaaaggagcaaccauuuuuguguuugggccaaucacaaccauuucuuuggaccagucacagccuuguccccuagcauuaauuauagucuuuggggcuuggauuuuaggcccucuguaagucucaccacuuagcaucagucagaguaguaccucuacuggggacagcgcuagcucucugaccaagguggcaguaguugcaggggcaccuagagucccucagggcaugugauagcaaaagccugguaccagcuauuccagacagcccuggcugagcugguuccuuuaggagcggcagucuuagugugauuaccagggguuuccaggguaauccaaacagcuaguucuaguguauaggugcacaucugacucagaagauaacuuuuuguuuuguuuuguuuuguccuuugcagacagagcuguucuugaacuugcuguguagcugagggugaucuugaaaacgauguccuccuguuacauuucaagugcugggauuacaggagagcauuuauuaaauccuggcuucuauuacauuuuaaaaaacauuuuguauuuuuauguguaugcauguuuugccugcaucugugucugcauaccacaugccugcuugaugcccagugaugccagaaaaggugccagauccccuggaacuggaguuaugaauaguugugagccaucaugugggugcuagacugaaucuggguccucugcaagagcaauaauugcacuuaauuucuuuccaguucucuaccccacccacaccuggcuuuuacaucuuaaguuugucuauucuauauccauugcauuaacuguugaguagacauuugcuauagcuucccaaugauccuuuugucaucuucacacaucuuccuuugaccaauuaucccuccugagcuuuuguugcaauacugugguacuuucaaaguagaaaucuggacugaugcaaggcuuaggggguuagagcacuugcugccaagagugaugaccugaauugaucuuugggauccaugugguacaaggagagaauuuacuaucaccaguuguucucugauuuucauguuuacaccaugggaaugcaugcaaacaaguauuaaaaaaaaaaaagugagccuagcaugguggggcacaccauuuauuuuagcacucaggcgguagaagcaguugggucucuugaguucaagguuagccuggucuacacaaugaauuccaggacagccaaggcuaugaagaaaagcccugucucaaaaaagcaaaaacaccacugccuguuuaaaauacucuacugauuuacuauuaauauacuuguaguuugaaugaugguacaccuuaaagacucauguaacugaggcuuuuuggggggugcuugucguggggauucuguccucagaaaugggguaguacuuaaagguuagagggaaugaguuuagcuuguuugcccuuuggccuuuugccauaugaggauauagcaagagacuaucacuacacaaaauaaauguccacaacuuucuuuuuggcucuuuuuuuuuuuuccuuugagauaggguuuuucuguguucuugacuguccuggaacuugcucuauagaccaggcuggccuugaacucacaaagaucugccugccucugccuccugagugcugagauuaaaggcaucagccaccacugcuugacaaguauccuagauuuuaaaacugaaauaaggggcuggugaggugguagagcacuugcugcuuuuccuuaggacucagguuuauuccuagcacccacauacugguuuacagcaguaacucuaguuccagaagauuggaacauucucuucuagccucugcaggcaccauacacauguaguauacagauauacuugcagucaaaauacccuuacacauaaauuguaaaguuuguguuuuuuaauguguguguguguauguguguguauguauguguguguguauauauauaaaaucacagccugugauauuuuguuguaacagcacacauuaagauauguuucagugaggucuggaaaggucuguauguauagguggauuggccauacugacuucuuaacuaccuuucaguggcugugacaaagcacugugaccaagaaggcaccuuauggaaggaagugcuuaugguggcuugcagugucagagggugaguuuguauuuaucauuguaggaagcaugguaggcagacacguauggugcuggagcuguaggugagagccugaaccugacuuacaagcaagaggcacacgcucgaaugcucacacgcacacacacacacacacacacacacacacacacacacacacauacacacacacacacacaaggggggggggagagagagagagagagggaggggcauuugaaaccucaaagccugcuuuuagugauauaccuucuccaacaaggucccaccucuuaaucuucccccaacaguuuaaccgacuguggaccaaguauucaaguacaugggccuaugggagucauucucauucagaccaucacauuggcuuucaguauuccuaguuuucuuuuuaaacucacuuuaauuccuuaguaguauccucuaauuugauuuguuucuuuugauggauauuacucacccaugagggcuuuccuugucuagauggaaaauugucauauucuuccauacauuaauacuuaacuuaauuguguaucuauuuugccucccagagauaauaaugacugagacaaagacuauauauccuuaggaaauuuucguuauggggacaagggaacaugcugaguaugcacacacacaccucgcgcacacacacccacacccacacgcacauaaccaaacaccaaaacuaaaaccccucauuucaaauagauaaggaaguaguaagaugggagcuagaaaaccaggauuuggaagaaggggcuucuucagcuacagggguuuggaaaucaaucuuucuuuucuuucuuucuuucuuucuuucuuucuuucuuucuuucuuucuuucuuucuuucuuucuuucuuucuuucuugggugggggcagacuagacaugguuucucuguauagcccuggcuguccuggaacucucuguguagaccaagcuggccuccaacucagaaaucccucugccucuaccucccaagcgcugggaucaaaggugugcgccaccacugcccagcugaagauagcuucuuuauauuauaucuaaauauuuuuauguguucugagagugugcaguggcugcagaggccagagagggcaccagauucuguggagcuaggaguuauaggugguugugagcugccuaaugugggugcugggaacagauccuggguccuuuggaagagcaguagugcccuuagccacagucaucucugcagccucugugaaaggagcauucaugcagauuuggaggacuugcuaguugccugcuuuuuugaagaucuaaggaaaccauguggaacuguuaggaaaugagaaaaaaaaauuuuuuuaaucuuauuuuauuuuuuaggguaaaguucuuuauggcaaguauggaggcauucuggggccagauuuauuuuaacauaacaguauuacaauaaaauuuagucaacaaacaugcgacaaaaggaggugugggaagcaaaugggaacagagagagggacagaaucuucagugaagaucugcugaacucuuuacaauuucaaaccuguuucccagagaagucauaugaaaauggugauuccaggauguucaccugggacucagccaugaaagucaguaaagucacaaaaggagugaacacagccuagaaauccagaucaguuuaaaaguuguaucgguggauuuaucggagacaaguaaaucagagaaauaaccaggagccaauuugugacucauaggaagaaagcuggaguuuucuuagguuugauggggugaguuuauuaugggaguauuugauucacuuuuccuuuuuaaggacaggaucucacuguguaguccuccgugaccagagacucacagagaucugcaagucucugccuccugagugcugggauuaaaggugugccucgguugugcugggcuugacuuacuucuuagagaauuagacugcucagugggaaacagacugaaggagggagggcagagucagccaguggggugaguaugacacugaggaguuagagcagguacguguguugaagacacagugggaaguguauguuggauugcacgugguguaagagaacgguguaaguacuccuccauucccuuuagcaugcuagcagauggcugggcccuggggguagguuuuagggagaagaauaugauggugucuguucaguuauguaaaguaugagauaucaauuaagcauaugguccaguuggccaugcuggagcucaggaaaaacuauauaagauaugaaaaauacauacuuaguaacacuaccaaggucucauuggaaaaauuuuaaauauugaagagguuuaaagcucaagugauaaauguguuuucccaaaaucuuuuuuuuuuuuugacuucagaguucaaauuuuauuuauugaugauaagucuugcugguuauuuuccuuaaaugacaaacuguguacucaucagcaggagacugccaguacucaagccugaaaguaguaguuggugugucaguuuaaaaaaaaaaaauggucuccuuuuacaaguaaguuguacugcggcuuuuuucuaaagacaaccaucauauguaguauguaacaaaggcaauuuucagguauuuaaguucucuuguggggagaaguugaaauagggucuuauccuguaucuccagcuggcuuggaauuugcuguauagacgaggcagaacucauagaaauccaucugccucagccccccaagugcuggauuggaaagcugaaggccagcuugagcuacauagggagagcgagucuggaaaaguuugaccuugaucuugugaacaaucccucccuaaaguagaccauacuaaagagccuuugugauuuaguaagcuucauaacuucugcuguaguaaugggagccugcauuuuacaaaucauaguauacuuauuaauauuuuauauuuauugagugucucugacuaaaguaaauugguaaucucauaaaaauuuaguuacuuaugcaugaaucuucuuggcauaauaucuaauauauauuauuuuaauaauuuuauauagaggggcuagagaugguuaauagcauacauagcacuugguaguguuuuggagaaccugaguuuggucccuagcacccacacugagugguucauaaucaccuauacuuucauauagguuccaaucaccuauaaucuucagcuccagggaauccaacauuauucuuuuggcuucugagggcaucugcaucacaugcacauucucacacacauacauaugauuaaagaaaagugaggaguuggagagguggcucagugguuaagaguacuagaugcucuuccaaaacaccagaguucauagaccagcacccaugcccaugaccaccagcugccuguaaccagcacccaugaccaugaccaccagaguucauagaccagcacccaugcccaugcccaccagcugccuguaaccagcacccaugcccaugaccaccagcugccuguaaccagcacccaugcccaugaccaccagaguucauagaccagcacccaugcccaugaccaccagcugccuguaaccagcacccaugcccaugacucacaacugccugcaguucuaguuccaagaucugacaccuuccucuggccuugguggauauucccucacauguagcagacauucaaauuaacacacagaaauaaaaauaaucuuaaaaaaaucuuugacuaggaauuuagauucagagccuuucuauuauguauauuuaauugcugaugauccuguauucgcuuucuagagucugugucuaucaauaauuacuuacaugguuguuuuuaggcgguuguucaaaacgauuuuuaggaaagagugaaaaauagcuuuuuacucuaaaaugaugauauagucauuuuaaauuugaaaauguuucacauuggguuuaaagaaaucuuaugaacacuccuuuauucuuguagaagaucugaauuuaagcaucuacuugguggcucauagagaaucuaaugaccuucuggccuccacuggcacgaggugugcauauggcacauaaacauguaggcaaaagacucauaagcauaauuuaaauccccccucccauccccagaaaccuaaaucuguuguuggaggccagugagauaaaaguauuugcucugaagcccaaauucuguccauagagcccauguaguaaaggagacagccaguacucucagccucugacugccacacauuuuaacacccacugauaaauguuuaaaaagaagcccauuguucaugccuaugguacuuauagaacuuccaauuuagaauauguguguguguguguguguguguguguguguguacaugaugccaugugcaggccaggcugcucccuguuuacuugacaucuuucuuuggguggugguugcugcuguagccauacuucuugcugcaguuuacagcauagugugcaggucagcacuugcuguagaucaucauguccuagguuuauguacuucagggcaagcugucacagugagggccaguugauaacacugugcaugcaggguaaacucuuaauguuggacacagugcugucauacuccagcuguucgaccaugaguauggagugugauaacauucuugauaauguuacugggcuugaucucaagagcuauauggucuugugagucaaggucuucucaaagacuaguaucuugucuguuggugagcugcccuguugaagaagaaaaaacugggcucaguucuugauccuguugucuuaacgucucaaaugcuaggauuacaggucuguaacaccaugucugacucuucauuuucuuauauacauuuauuacuuuugugaaaggcuuugaaugaguacauuuuucugucaaacuaugucauuuuaaaaagguuugauaaaucuguuuuauuuucuaacuccagguuccauuaaaguuucuaauauuuaaauuuacuaaauugugagaauuuaucuucuuauuuuguccuaugauguuuuaauuuuuuuuuuuuuuuuuugaguauuaauagaguaccaaaaaucccagaggaaaccggcaaacuuuuauaugaucucaaguuagaaucacagaguuucaaaauaaauguuuaguaaaaugagauguaucuaacaaucuguaaugugcuucaccgcaggaauauauucguuacuuguuaaguuauccagcaaccuaaaaagugcauucaucuucugugugaggaggcaggagggagagagagagaauaugaacguguuguuugugaguccugagcaaauauguaccauggugugcaugccaaggucuuaggacaacuuuugagagucaguucuuuccuucuaacauguggguccugcagaucaaacauaggucauuagccccuuuacacacugagccauuuuacugaccuuuuuaguuuuaaagauuuuauuuuauuuuuacuuuuuacucugauuuuauguuguucaggcuggucuugaacuccugauucauuugccuccaccuuccaagugcccaaucacagauguguguugggcgccagcaugcccagcuuguuuaguugguuuuuuuggagacaaggucucauuaguugcacagguuagccuugaaggccuagucucaaguaauccuuuuaugguaggcuuaucuguggguagaauaaaaguugccagucacccugucagcaugucuagcuuagcaacuuucugccuccuauuauucauuccagugguuuugucuauaagauguaaucacucuccucaaaucuuucucauuagucaaauaagucaugaaacauaauaaaugguauagagaaaaacacauugacacaacagaguucuucuacucagcuugauaugucaaagaagacauuauuaggcuugaguucugaaaaauguuaaucaggaaagcugggguugugggggugcagauagugguauguaucuagaccaaaguuaugugaaaacagaaugauuuuuaacaguuuauaagcuugggugcuuuagauuacacaaaguagggcaacagucuguaaagaaguaguaggaaucagauucagcaagaccuuaucaagucauuguagugauuuuagcuuuuuucaaacccuuaggcugaugaaaagguacugaaaguuuuuuuuuuuuuuuuuuuuuucuucgagacaggguuucucuguguaacccuggcuguccuggaacucacucuguagaccaggcuggccuugaacucagaaaucuaucugccucugccucccaagugcugggauuaaaggagugugccaccuuuguucaguacugaacguuuuaaacaaugagaugacacuaaucccaacucuugggaagcugaugcugaggccgaggccauucuugaccacaagagacccuaucucaaaaaggggacgugggggcuggugaacuggcucagguguuaaaagugagugcuguucuuauaaaggacccaaguuugguucccagugccuaugucaugugccucacagaugccuguaaccccaaaugcaggggacccaguacccucuucuaucgucugugggaaccuguagucacaugcacaugcuaacaagcauauacacauacuuuaaaauaagauaaguugggcuagaggguuguuucagagguaaagagcauuggcuauucuucaaaaggacccagguucaauucccagugugcacauggcauaucacaacugucuguaaccuuaguuccaggggauccaacaccaucacacacacauacaagcaggcagaacuccaauguacagaaaauaaaaaaucauaaaaaauaaaaauaaguugaaacaacaauugcaaauuaaaaauaaagguuauuuuugccuuaugugaugacacgaggcucacaccaguaauuucaguacucaggagccgaggaggcaguauugcuacaacuucaagguuaguuggggcuaauacuuuuaagccacagagcuacuaggucuagggcuacagagcaauagaucuuguuucaaccucuacccuccugaaacagccuggagccuccccaaaccaaacuaagguuacauuuaagagcugagaacagaguaggcggaagcuugagcuguacuuuggagaacucuagaagagaucacuaagaggguugguuuggaggugauaguccuaagcaguggugcaauucuggcaucaacaugcuaggcagagacuuccugguuuucuguucuagaaaggagaaugcucgacacuauuagguuguguugaacuggugguuagaaggagauucauuaaacaauuacuaguugccuauucuguggaaggcuuucacuucuagauaaucaugauaugguauuaugaugcuuguguuauauggcuguuuagagaucuuugcuugauggaaauaucuaagaacauggaaguuggucuuacgugugugcacacaugcacaugcccauccucaccuauaccuuuugauguuuugcuuuaagacaagguauuuuguagccccgaucuaguagcuuugaacuccugaucuuucuguucuagccaucgaugaaagacauggguccucugaagagaaagcucagagaugccugggcacauauauaccuguaaucacaguacuaaggauucugcgguaggaggacugagaauuucaggccagcuugggcuauauagcagacccuguucaaaagcaucuucucccuacaaacaaacaaaaacaacaacagagaaagcucaaagauggcauauuuuaccaauauucauucucuauugucauaaagcgauuaugccugaaaaaggcaauuugcgcucauagaagugaaucuguaaaaccccucuuucucaaucauuagugcacaguugguuucugacucuuuccagcuuucacuccuccacagugggauugauuggcagaacaguggguugaagaaaaggaauaacgcuugacuauuagcuggcugugugggcaaaaguggggagagggagggaagaaggaaaaaggacuccagggucugucucuguauaccauuguggcaugagguaaagcuguacagucuuugucuucuaauguuaauuuuguuguuuuuucaguacuuuccuauauuauggaucccuggcauuuuuauaucucuaguagcuuuuuacaaauaauuucaagacagauaugucuuccauauagauugaaaacuaucuuuugaaaggaaccaaaguauucuaaagacccaugguagugucuggagaaggagaugucucggcagguuuagcugucuugaauuuaaaaguugagagaaaagggauguuugagaagcaacagaugcagcagauuguaggaacaacaugacagaagguguguuugugagacccgaguauaguugcagauguaagggagguuaaugaaguugagaucuaaggcuaaaauacaucuuagcugcuaacacuaagcuguagaaaauuaguccugugcuucccacauacagcuuuuaagaauuaugguuuuuugaagguguaugugcauguuugugugagucugugcacaugcguguguguaggggcaugagaaggcuagaagaggguguugaaucacuuagagcuggaguuguaggucguugugagguaccugacaugaaugcuuggguccaaacugugguucucaugauugagcagcaaauauuuuguuguuguuguuuugagacagggcuucuuuguauaguccuagguguccuguaacucguuuuauaaaccaaacucagacagagauccccuacuucugccuccuggguuaagaucacacaccacaccagaugcugaagaacaaacacuuuuaacuagccuguuuuauuuuuuuguuuuggaggggacagagucucuacuagcucaggcuuguauggaacuugcugugaacuugaagagcuuagaauuuuccuguugacuugauuuuuucaaacccuacuuuuaauauggguucuuuaaccucccuucuagccuacaauccaccagagguagcugaaaagaaagguuauuaggauaugagggaaguggaccuguuuagaaauuguucuuuggagcaaaucuaaucuguauugucaggaaauuagcaguucaguuuacaggaaucagcagcagcagcucgauccacucgcaaacacuuaaugaauacaccagcaguccaguucaguagugucgggguagcaagcacaaaucagcagcaguggcaugaauugucaggccuccacccaacccacaugagucagcaggagugaccagggaugucagaaguucucugccgugccuugaagcauugcaaagcuaacuaugcaaacuugcugaguccuauuucuacucucuucuucaaacaucaaguguccucccaggggucuuuccucaccaugugagucugucuuagcaaaacuccaugugagucuguaucaacugacuucacucugccaaucaccccgaguccucaggagcugcaagaaguuuuuuuuuuuuuugguauguuucuuccuaugaagucacaacaaaugaccauuaaggaauggcaagguauaccaauaccaucuagugucgucuguggucuguuggguccuucuuaacaucaugagucugcuuuagcaaaacauccuuucaccugugaccacuuccggaacacacuccuucacuugucugccccaguuuugucuucugacaaaacugacuuuccaaagaaaccagaaguuuccauuucauuuuccugcuguccuucaagugauggaggggaucaugggcugcaccaugccagcuccaugcauuacguguaguaacauguguaaaacugauauugugccuuuuacuuacauauuuuaguccuucauacagacguaccuugguauaacuaacagaaaccauugaguuaauugaguaaauguaagagaguuuuagauccaaauaaacaaccuuuaaaugagccaaugauuuuaacuggagacuuugauuauuaggaacuuauuuuuaauaaaguugugcauuuguuccacccauccuuauuuuccuguuuccucauucccaccuacaucccuauacuccccaaagaaagaagggcagcauggugcugucucauaguuuuuuguuuugaaugaagaggcacaauguauuauggaacaaacaagauguuuuuacaucagaaguuuuaggaaaagauuuauuugcugaaaaugucuuuucauuuuuauuucuuuuuaaaauuuucuuuuccuuauuauuuucaagacagucucauggagcccaggcuagcuuugaacuuuaacauagccagugguaaucuuuaauuuuuuuaucuuucuaucuucacuuuucagaugcuaggguuacaguauguaaccccacggugguuucuuagaugcuuugaccucauugaucaguguaauuauuauuauuauuauuauuauuauuauuauuguuuuguuuuuuccccgagacaggguuucucuguguagcccuaguaguccuggaacucacucuguagaccaggcuggccuugaacucagaaauccgccugccucugcccccaaaugcugggauuaaaggcgugcaccaccaaugcccggccuuuuuuuuuuuuaaugagaccgacuuucacuauguaguccugucuggugugaaacucacuauauagauuaggcagguuucaaacucacagagauuugcuugccucugcuccuguacccccaagcgcugggaucaaaugcaugugauaaugagugauaaaucuuauaauggucuuguuacuuaauuuuuauggaaucauggaaguaagagccaauguuggacuuauuuauuaugaggaacuuuuuaguaccuguggucucuguuaacuuguuaaaacaauuuauagguaugcucagaaaaaaauuugaaaacuuaucaaaucaugcugauagcauccagagacuuaauuuuuuuaauuuaaaaaaaauuaaauuuguguguguuugccugccucggugcauguguaugugucuugucuauaguggucagaauguggaauucuuuucuuuuaccuuuaaguagauuacagagaccaaacucagguugccagguuuacauggcaggugccuucgcuguaugagcaaccucacagguccaauguuuguauaucuuuuaccuuuacaaauauuuauuuuaugugucccagugcucuguuugcauauacccuugcaugcgagaagagguauauaacucauuauaaauggucgugagcaccaugugguuucugggaauugaacucaggaccucuggaagagcaagcagcugguauacuuaaccacugagccauuucuccagcaaccauaguuuuuauuuuuacuuuaaaaauuguaaaccauaccaaaaugguaggccacaaaaacaaugaaucagggaguuugcuguggaggucagagugaaagcagaugugaaugggugcagcaggaggaaucauggccaccaaggugauggaguccaucagaaaguuuggccuggcuuuagcaguugcagaaggugugguaguggacucugccucauagaaaauggacagaauccaguuaucuuuuacugcuacucuucagccauggaauguucuaguuagcaaagauuuguagaacaucagcaucauuggacauucagcugguggccagccagcuuccuccuaucuaaaacugcauuguggagaucucuguugagugguugcuaucauucucaccacagauacccucaagucagucguggccuacuuugaugcuagagauaugugguggaaaaggcugagcagcauaaggcggcagccauuaucugguaagggugacuucaaggcaaaugaacagguggucaacucacuggccacugcuggugauggccuaauugagcugugcaagcuugaagcugcugaggcuguugcugcauaacagcuuuccugcacucagaauauugccuaccugccaguggggcaguuugugcuccuccagcuuucucagggaggcguccucugcuuguaccuucucaggccaagugggucaugccuugauuauucugaaugaugccuuccuucugccccaccccagaaaucauugugaaaauucaugauuggcuuaaaaaguguaggaaauaaaaguaaaaccccuuuagaugucucucucucucuuuuuaaagauuuauuuauuucauguauguggguauacuguugcugucuucagacaccacaagauggcaucagauccccauuagagaugguugugagccaacaugugauugcugggaauugaacucaggaccucugaaugaucaaucagugcucuuaacugcugagccaucucuccagcucacuuuagauuucucucuucucucucucuuuuuuuuuuuagguuuuuuuauuuauuauauguaaguacauuguagcugucuucagacacaccagaagagggagucagaucucguuacggaugguugugagccaccaugugguugcugggauuugaacagaccuucggaagagcagucgggugcucuuaccugcugagccaucucaccagccccacuuuagaucucuuaaaaacaaacaagcagcugggcguggugggaggcagaggcagguggauuucugaguuugaggccagccuguucuacaaagugaguuccaggacagccagggcuauacagagaaacccugucucgaaaaacaaacaaacaaaaccccaaaaaacaaacaaacaaacaaaaaaccaaacaagcaauaaauggaacaaagagcaaacaaaaagcacccccacaguaaaagaaacaguggacaaaaugaaauagcacccccggacuggaaaaauauacuugcagccaauauaucugacaaauguucauauccaaaguuuacauagagagcuuacagaacucugcagaacaaaccaacaugauuaaacaaugaaugaaugaaugaccuguguagcuaucucccuaucguaggcuuugaaaugcucaagaagcauauggaaagguacuuaguacucugugggagaaucacuuuugaguuacuuaccaccuuaugguuaauaggguggcuacuaugaaaaagaugaggcgguggucagguagcacucaucuuaaguccguacuugggaggcagaagcagaucucuuuugagugugaggacagucuggucuacauaagagaaaaacuaaggaagcagugcuuaauuucuaagcaucugcuugcacaugaacuaacauggcagugagauauaacucccaugagaaacacaugccauucugguugaggaugcugauuugagguccuccugaggcucacacgaguaguuaauaguuaggaucugaguuucuggccucagggaguuccuuggaaggguuuaggaguaucugagaaguuuauggcucaagauaaauaugaugaauccauguauccacuccugcaacucuuacugccacaaguguggauaaaauacugggauguggacuguuuuacagguguugaacaggacuuuauuugaaucacaagucuuaauuuacauuguuuuugaggguuucuuccauucuucucgaggaagccuugcaaugaauuuugacaauaacuauugaacuuggacuguugggugacaugauuuacagucucacugcuuuugagucuaaugcugggucauugguaagaaagggccugccauacagaaccucaaaggaaguuaagcccugguauucaagugcuucuauguccgggagggagcaguuuaggccaaggggacuaugucuccugaaggagcuucuuuagcucucaucagucuuuuccacauuucucaggauugagggugccaaacacgauaaaauugcagugacucccuggugccuuggacaaacacuggauuaucucagucuuaaaggugggacuguagccgcuguggagauuuuuaaggauuuugaaucuagggacuauuucuuuaaguagauuacaaguuuuuacaaguagacucuuaaguugacuacauaggagagguuuucucuuggaugguaaaaccucuguccauuucauaaaaauaucuaccuguacuaaaguccuuuccuagauacguuccacauuuuuaguuggaggagcugcuggaggccucugcuugagggauugaucuuuuggcaacuuaguauccgugagcuaccuguuggauggcuuuucuaauguccaaaaauauuuucuuggacaaggccagaguguucuauccuagaguuaucaauaaaucugauggagagacuuuagaauauuccccugaagagauuugcuaacucuagcugacugugagaaaccaucugcgguggucuagcugacucagagcucgcuccccaggggaauauugggaucucucagguucuagcagagauucuucucuaaagccuugucaugccugaucuuuauuaucgcaggaugcuguuuuuaagcuucagaauccgcugccucauuucccccgacuuacaggaucaucuccuuucugguucugagcaaugaauucuauaauucugcuuugguggugucauccccuguucaccuggaagggugagguggaacagaaacuauuaaauaaguuucauggggcucuggucuggcuguaaaugccaaaguauuauagcucuuagaagagaagggaggaggucaggagagagaacucuugccuaaguguuauauagcucaguuaaaaacagcugcucucagaugauccuugguaaaauaacuugugcccuuuaucccauguugacagugacuuuauaaauauuuagaaguugggagggacuuagggguagauguuuccuguuggcucaguuugggauauuacugaugcucuauuugaaugggguaggacucuuuaaguguuuuacuguugcgacugauugccauugucuucucaguggauguuaugguuagguguuccagaacaggcacaggagugaguggauagggagcgacuccacuuaugcuuaucucaagucucagagauuccccggaucugagcuuauucaaccuuaguauuucuuauguuugucucauaacagggucccacgugccccauagggugggaaaagagacaacaucuaagagucucccaguuuaauggaggggucaagugguguuuagaagauuuaggaggcacauuuaaaucuguacagauauuuccucuuuucuguugggauaacucaaggguguuagugagaauaaggaacucagcaagcuuggcaguagagacccugaggcaagagugccaugacaaaaucauaaacuugguaaauauuugauuccaccauuugugaaagagcucccauuaguguauacuauuaaaucaggcuucuccagagacugguuaguuaaaucaugacaggugcaucgucuguugugaggcugugggugugggggaaagagcggagagggagagaaccuguauccagccagaguuucggugcgcuggguggguggaugcgagaggacugccgcaugcuuuucggugggggguggacaaggggcagcccaagguaucagguucucagccuugggcaucccacgcuggauaacccggaggagcugagaacaaauggggaccccuggacggcucagucagcuccggggccgaagggaggagagggcaggggauaugagcguccuuggucugguccguggcuggagcacaggaaggcuuucuggcgggagguuagacguggcucguuaggagaaagccuauuccaucuuucaagcucggcgggccuugaugagcagagacagucuauguaugguuuuagagcuuuauuguagaaaggcagggagagagagagagaagguagaaagaagggagagacuggccauggcuacguuggggguuggggggaauggaaagagaaaaagagggcuagagaguaagaaaggugagggcuuaaagagagugaggaggggccaagcagucccucuuauagugggcugggcuaucuuauuguugccagguaacuguggggaggaacuuaccuggcucuagucagguaacuguggggguggagucuaaccagaaugguagucacagaauuauggagugggggugaagaaugaaaaauuacuggccucuugugaaaacaugaacuuuuuaccucggagcccacccccucccaucuagagguuguucucggaacacuccuaaacuuuucaccccaaaacuccucacccuaaaguucgaccaagaacauuuuugagauaaaggccuccugaaacaaccucaaaaugaaccggguacauugccaaaugauaggacaugacuccuuaguuacguagguuccuugauaggacaugacuccuuaguuacguagauuccuuuggcagaacucccuagugauguaaacuuguacuuucccugcccaguucucccccuuugaguuuuacuauauaagccugugaaaaauuuuggcuggucgucgagacuccucuacccugugcaaagguguaugaguuucgaccccagagcucugugugcuuucuguugcugcuuuauuucgaccccagagcucuggucugugugcuuucauguuguugcuacuuuauuaaaucuuaccuucuacauuuuauguauggucucagugucuucuuggguacgcggcugucccgggacuuaagugucugagggagggucuccccucgagggucuuucauuuggugcauuggccgggaaacagcgcgaccacccagagguccuagacccacuuagagguaagauucuuuguucuguuuuggucugaugucuguguucugaugucuguguucuguuucuaagucuggugcgauagcaguuucaguuuugcggacgcucagugagaccgcgcuccgagagggagugcgggguggauaaggauagacguguccagguguccaccguccguucacccugggagacgucccaggaggaacaggggaggaucagggacgccugguggaccccuuugaaggccaagagaccauuugggguugcgagaucguggguuagagucccaccucgugcccaguugcgagaucguggguucgagucccaccucgcguuuuguugcgagaucguggguuugagucccaccucgcaccuuguugcgagaccguggguucgagucccaccucgcgucuggucacgggaucguggguucgagucccaccucgugcagagggucucaaucggccggccuuggagaggccaucugauucuucugguuucuuuuuugucuuagucucguguccgcucuuguugugacuacuguuuuucuaaaaaugggacaaucuguguucacuccccuuucucugacucuggagcauuggaaggaggugcgggucagagcccacaaccagucgguggaggucagaaagggucaguggcagaccuuuugcgccuccgaguggccaacguuuggaguaggcuggccaccuaagggugcuuuugacuugucacuaaucgccgccgucaggcaaauuguuuuucaggaggaagggagucgauguggaauccgaccccgucaggaaauagcguuuggcuuggcugguuguacaaguccaggcguggacgagugugcuuagagauacuggugucuucuuuuucucuguugcuaucuuguuuuuguuugugguuuuugucaugagacacagacacuguacgucagagguaaagugagaucccucccugucuguaugucugugugucugugugucuuguucacuuguguguccuccauuggaccaccuucugauucuguuuuguuuuugauuugucugguuucaggucugguuuuggucccaagaaguugacugauuaucuugguuugguuuuaggccggucucagguucuggggccuucccauggagacagguccauuugaguuggucauagugacaguaagcuucucuggaaaucgcauguaagaugcccuguauuagucuuguuuguguuugucauuucugugguacugugauucuauagugguugccugaaaaacgguuucugugugugucuuuugugucucuuuguguucggacuuggacugaugacugacgacuguuuuuaaguuaugccuucugaaauaagccuaaaaauccugucagaucccuaugcugaccacuuccuuucagaucaacagcugcccugccucccacuccaacuccagagagcagccagcgggucacaguggucccguccauggaccuggagccuagggggaaaaugaguucaaaaauccggagcaaaugaggaguggucccugagaagucaguggccuaaauguuguggcugcugaaaaaaaaaaaaaaaaaaaaaaaaaaaaaaaaaaaaaaaaaaaaaaaagaagaggaggcuguucgaguagccggccaagagcgcugcagguucccaggcagcuucucauuccccugucccucccaucccgucucuuguuaacagaaaaacugcuuucacuuuaagauaagugccgguugcagccagcugugagagcugcacucccgucucugcucuaaaguucccucuucucagaagguggcaccacccugaguugcuggcagugagucuguuccaaguuccagugagggaggcauccacccacuuggggcuucuguccaagguaaggagcaccugugagucuaacugccaggcucugaugggggucucgucucugugggacuagaaagucccaacaaucugaccaagguaacagaaaguuacaaaaguuaagaguuaaagaaacaugaggcugacaaagacagaaaccagagucagaaucagagcugugcugugagacagaaagauaaaaaaaauaaaaugcuggccacaaaagucaggaaaacuagaaaacuuaaauaguaccuggcaacaaaagaaagcuuuuggcugaagaucaauguguuaaagagauaacaaaaggggugcuaacacagaagcugaguccuuaaaagaguccgguggccuaccuguugaagcagcuaaaaaagagacuguguuucauacuccuccaccgaccagugcaaaacaagcuaaaaaguuccugggcacugcgggcuuuugcagauuguggauuccaguuuugcugaguuaaagagauaaacagcccuucguauagaagaaaaaaaaaaaaaggaacaaucuuagauggccuuagaugcucuugagacugcccuaauguuauccccagcuaugggacuccuagaugugacugagaacaaagguauugccaaagaaguucuuacucagagauugggacccugaaaaagaccuguggcauacuuguaaaaaauuagaccugguggcuguaagauggccugcuugucugcacauaguggcuucuggucaaggacgcagauaaauugacucugagacaaaacuuggcacaugucacauuauccaaccgucccccugaccgauggacacauugucagagcuuuuuguugacugaacgagugacuuucacucccccugcuauccucgaucucacuacugccugagacuucaccuacucaucauugugcugacauucuggcagaaggaacucauacucaaaaugaucugaaggaucagaucagccuuggccugagaguuugagcugguacacggaugggaguagccuggagguugaggguaagcggaaggcggggacagcagugcagugguggacagaaagcaagugaucuaggccagcagccucccuaaagggacuucagcccagaaagcuaaacuuguggcuuuaauacaagcucuauauauacagacaaagagagcuguugacaucugcagagaaagaccuaagaugcuguggcuaaaagaaaucagauggcaaaucuaaccgcccaggcauccuaaagagcaaugauccugacagucugaagacuaucaaguuauagacaaauuaagacuaguaaaaaaaacccuguauaaaauaguaaaaacugaagaaagaaaacuaguucucucaugaaaagacagaccugacaucuacugaaaaauagacuuuacugaaaaaauauguguaugaauaccuucugguuuuugugaacguucucaagauagauaaaagcuuuuccuuguaaaaaaacugagacuacucagauagucaucaagaagauuauuaaaaauuuuccaagguucggagugccaaaagcaauagugucagacaauaguccugccuuuguugcccagguaagucaggguguggccaaguauuuagaggucaaauaaaaauuguauuauguguacagaccucagaacucaggacagauagaaauaauaaauaaaacucuaaacagaccuugacaaaauuaauccuagagacuggcacagacuuacuuggugccccuuccccuugcccuauuuaaaacugagaauacucccucuugauucaguuuuacucuuuuugagauccuuuauggggcuccugugcccaucacugucuuaaaugauguguuuaaaccuauguuguuauaauaaugaucuauauguuaaguuaaaaggcuugcagguggugcagaaagaagucuggucacaacuggcuacagcaaacgagccggguaccccaaggacaacucaccaguuccagccagagaucugaucuacguacaccugcgucaugcugagacccucaagccucacuagaagggucccugccuaguucuguuuacuaauccgccuuauucuguuuuuguucccauguuaaagauagaguaaaugcaguauucuccacauagagauauagacuucugaaauucuaagauuagaauuacuuacaagaagaaguggggaaugaagaaugaaaaauuacuggccucuugugaaaacaugaacuuuuuaccucggagcccacccccucccaucuagagguuguucucggaacacuccuaaacuuuucaccccaaaacuccucacccuaaaguucgaccaagaacauuuuugagauaaaggccuccugaaacaaccucaaaaugaaccggguacauugccaaaugauaggacaugacuccuuaguuacguagguuccuugauaggacaugacuccuuaguuacguagauuccuuuggcagaacucccuagugauguaaacuuguacuuucccugcccaguucucccccuuugaguuuuacuauauaagccugugaaaaauuuuggcuggucgucgagacuccucuacccugugcaaagguguaugaguuucgaccccagagcucugugugcuuucuguugcugcuuuauuucgaccccagagcucuggucugugugcuuucauguuguugcuacuuuauuaaaucuuaccuucuacauuuuauguauggucucagugucuucuuggguacgcggcugucccgggacuuaagugucugagggagggucuccccucgagggucuuucagggggaucuguggugucaggcaccuggcucugggaacguggcuugcuuuuccgucccuuguagaguucucuacugggucgcuagaacaagccccauucaaccaaaauaagaugccuaucacagucccacacucuguuaggaacuuuucacaggaauuggagagguucccuuccccucugauauaugugacaagauuuaaaucuugacaggcuguaagggucacuuuaggaccuuccaauauggaggguuaguauuuaagaaauuggcugucagauagccacuguuucccccaacuacuuuuuaagcuacagggaucaaaaacccaacgacugugacugcccugagaccaccuggccaccccuugucuaagucuguacuuugauaacauacaaauugugugacuauaccugaagcuaccuacuuucuuucugccacauacagauagaacaugcacugaaugcauaguucuaaaguaggagccuuggagaggguucuuuuaaaaugcuucugaaaagcaugcugagauuuggggauccauggaauauuugaguuucccuuaaagcuugauaaagaggccuagcuggucuggcauauccaggaauccaaguucugcaauaucuagaaugccuaggaaggcuugcuuaguucaagguuuaagggagggugggguguaaaauaccuugagauuccaaggcuugaugaucuuucguugguacggugggcugaucuugagacaccuauuuucagccaagaaauuuaagagacugggugggggcgggggugcuggaagauuaaguuuuuauggccuacccaaaagaagaccaucuacaugucagagcacugugguuuggugaugugucugaucuuuccggucuugaagagggguagcccuacagauguggaguguuuucauuccugucgcaugaaaauucaggaaacuuguccuguuuggcucuuuaaauucaaacaggggcugcugugcuguuauagaauaggggggggggggcaucccugaguucuuccacuaaauagaaggugauugcuugagggaaucuugggucaucagugcauagggacuggggaccacaaaaugcacagggcagcagccucacuaaagagaaugaacuucugacaguuucugguuguuuggucccuucuuggauuaggagguguggcccucuggcaguagguauggccuuguuggaggagauauguuacuaggguuggucuuugaggucuaagaagucugugccaggccuagugucuguuucucugcuuuuagucugugaucaggauguaagcuuucagcaacuugggcagcuguccugauccuacuuguguucuuccaucuguucauacuccaacaaccguuuugacuuccacugaguguccugggggaaggaguguaacauuuauuuuagccaagacaccucuucccuuaaggggagcuggggucucagggacuauuaaagauaaaaaugaagaucuccccaggaacaggcaagaggcugaguaauauaucuuucaaggggcugacugauauaugcccuucauaguagaauuuuguugggaucuaaggccaggggacuuugaaucaggcuuacuuaggacaagggaucugguguucugcuacaggcaagauuguaccaggcuccucuggauagacuggcauaguguuuuggggaggcuccaggcccauugggguaaaaagaugacuuuagucuauagacagauucugaaugcauggaaucuucuagugauugucuuuauagaugaaauggguucugggggccacuuuugucucugaaacaguguugaagauggccuucucgcucacggaggaagccgaccugacuuagagcacugacugcuuccuagaggaguuggguucaauucccagcacucacguggcagcuaacaaccaccuguaacuccaguucuagagggucugacgcccucuuauggccuugucaggcacugcauguacaaggcgcacagacauacaaauucaaaacgucaguucacauagaaauaaaaacaauaaaaacucaacaucuuccuccccucuccuuccuuccuuccuuccuuccuuccuuccuuccuuccuuccuuggaggaaggagggccuucugggcuggacuguguuccuggaagaguuccuaugguagcuggcaguucccuguguugcuugucugccuuucuuuauccuuuccccccugcuucugaucuagguuauagaauaccacaguaggcgagccaaaucauuuaguggcuugcuuggcacaacaaucaaauuucugaagacuguuuuaauaucaagggcuggcugaguaaaaauguuaucuuuugagaggaccucuuucuguaaucucaucuuuauguuacacuuuuucauggcacagccucaacaggaaagccacacgggucuccucuuuuccuucuggcagauaguaguaauuugugagugauuuaaaggcuuaauuuuggucucucagagacucuaagguagaauagagauaaugccuucuauucuggacccccaccuaacauuaaggccccauuuaggaacuuguauagggaccaccagcuagccaguuggguuaguauuucucccuuucccccgggauauuuaguaauccacccgcccccagcccccagcauauucuguuaccuuuuguuucucagauggggucagaauuuguccugaguaacaucaccucuuuccaugccaaaccauagaguugagcaauauauucagaaguuuauacauacugguuuuuguuaccuguguacccaaguccuauuucaucuuuuuuagcuaugacaagacucauauuuauucgagugguuuaacugggucaugugauaguuacaauuuuaaaaguuacuauuuguguguguacauguaauaugugauuuccacagcaugccuauguggaggccagaggacagcaugaguccauucucuccuuccauaguagguguuagggauccagaucagguugguaggcuuggcaguauguguccaucaguagggcuccuuucccuaacauccuugcugguguuuguuguuaguuuuauuucugucuuuaauuagcauguauuaauuuuuauaguagucuugugacauuuucguaccuguguauauuuuuugaacauauucacccccacccuuacucuuuguuccccucccacugguguugacucauuucuucccagcuuggccacccaguccugggcagugaucaugcugcugugagcucagucuuacagcccugucaugcuuggaagacaacuuuccacagcacuccacccauuuacuagcucuuacuacggcuccggggcggggguggggggcaggcacaucuagacuagccagucaggaguugccaagaaccagccucagcuuggagaggguuucugaggaaagggugucugggggcggugaaaacaagcgaccugaagcuggguacuuucuuuuucucugauuuacuuucucuagauagagaucucuagcuguguucugcucgagauaguucucuaagcaguucucucuugauucucuaagaaaauucucuggauagcucaugucuuguagaucauaaacccagucuuuuauucuacauaucaauucagucauuuacuccagguuuccuuuugauuauccuaagaaucagcauucugucucuccagccccuuaauucuugggagaaagcaaguacacauuuccuuuuaacugcaaaagaauucagagaucugcuugccucuguuaagcacagaguguuaaguuuguugggugguacccuguccauuucuaccacacacugggguuuaacuuuguucugucccaggcugaccuugaacuguagaaucuuucugcuuuuguaagcauaaacaaaaaaauuagcaggguggaaucucuugcaaccaccacuuccuaaaucuuuuuccccuuccuuagcaucuuucugacaaguuggcucaccucacagcugcuuuuguaacuuuucauuucugaagucccucauaauuuuauuguauucuuauauuuuucauaguugaaaaauuauauauuuuugcaaucaugguuuuagaguucuuuuucacagaguucaaccccacagggcuguccugaaagucgcagugguuaccauguuagccacagcuuugccucccagauucacgcugucucugaagucauuaucaugaagucauuaauguuuacagggaaaaccuucuuugaagggggaacguaaaauaugugcauuauuauacaaacaacccuuacacccacagcagccguggacacuuguggggguccaggccuguugucucuguaccuggggcaggaaccaugucauucugucccuaccaaggccaugccggaccuggcaaguaguacgguagucagaguccacagcugcguguugaugaugguacuuguguucuggauaauuuuuuauuuauuuguuuauuuuuauuuugucaacuugauauguuagaguuuucuguaaagaggaacuucaguugagaaaugccuccaucagauugucuguaggaaugcuuggauuucauccuuuccuaucuguagcuugauuuuucuuuguauuaaugcucuagcuauggcuuuaaauacugcauugaaacaguggaaugaaugggcacauuugccuguuccugacuuuaguuuuuccauuuagccugcuuguuauaaguaguaugaacuuuuucuuuuaacugucuuagcuaauucccaaagguucuaggaaguuacaucuuuguggguuuuuuuuuuuuuuuuuuugauuucuagaguuaaaaaaaaaaguccuauuuauuuuauguguaugaguguucacuugacuguauguugacagugugugugccuugugcccacagaugccagaggagggaguuguauccucuggaauuggaguuacagauacugauagacaaccguaugguugcugggaaaagaacuugggucccuaagugcucucaugauugcugagccauuucuccaguuccugauucgaggaaucuuuaaauuuuauuccugauuucuucauuggcccaguggucauucauguguguauuuuucaguuuuaauguauguguaguuuauguauuuucuugcuauugauuuccuauuuuauugcacuuugaucugguaagauauaagaaauuuugauuaucuuguaaucuuguaauuugcuuugugaacuacaauguugucuauuuaacuuagcuaauuaaugaacuuauuuccuauuuauuuauuucccugugugggcauguguaugccaugguugacuagaguauggacuagaguacaacuuguaggaaucaguuuucccuucuacuguguggcuccugggaugaaacugggcucauuagguggcaagugccuuugcccacugaguugucuggccagucugaugaugccuccugaugucuaauuuuauugggcuucucugggcugcugccgccgaggagacuguauaguccgauucuguuggauggaauacuaccugcacaccuguuaggugcauuugaccuauggaguagcuuaauucaggaauuuuuuuguugacuuuagguugaaugucuuacaugcuaagagugggugggauauuaaaucagggauuuugugaccuuuuaucuccacuguuuguuuuaugaaauugugagccuacaauguuuagugcauauagacuuagaguuguauaccuucuugaugauuguuuuacuuauucauauauaaugcagcuuuuuaaaauguucugucuaauuuugguuugaaauauacuuuaucagguaucagaauugaaugaaaaaaagaaauaugcuagcgugcgugcuugguuuccauucgcugaugccuucugugggaguuuuugcuagucagguggauuucuuggcagcaacaaagaauugaaucuguguuuaaguacauuauaauuuguaucuuuuuguuggugaguucagcccauuuacauuuaggguuauuguuaaguaucccacaguucugaguugguggauguaaacugucuuaauuuguucuugucuugugaugccuuauuuuugaggccuuaaaauagucccucccucccucccucucucccucccuuccuucuuuccuuccuuccuuucauucauccaucuacccauuacaaaaguuuauuuaauaaaagguuguaggcuuuaauuuuuuucucaacccucuuuuuaguaaaggcuuuaaccucccuucuagccaaccacccaccagagguaguggaaaagaaaggauauggaggaaguguaccuguuuagaaauugguuuuuuggagcaaauccuaucugcauuguuagaaaucagcaguucaguucacaggucagcagcagcagcucaguccacucacaaacacuccauggaugauaccagcaguccaguucaguaguuuugggagaguagcagugguggcaagaccuagcaggaacaggcaagccucagcugaaucagcauaaaucaguacgaggaauuaagaccaccagggaugccaggagaaaguucuuugucaugccucucucaucgaagcaaaggucagggaagacuugagaccaagaaccuuugcaaagcuagcuuuacaagcaagcccccaucacuguccguugaguccuauguaugcucccuccaagcaucauguguccuccacuggucuugccuuaccaugugucuugucuuagcaaaacucaaugugagucuguaucagcugacgucacucugccagucugcucaagugggggggggggggcagcaagaagcugccuguaaguugcggauagcccuggggcuaauuguauuugauguuaauucuguucuccugugagggguuuagaacaaagucagcacucaggugauuuccuguaaaccuuuccaccuuaauuuauaaacaaaugcuagagcucaugauugggcugagaaagaggggaagguggagcugaagguuuugggagacagaaaggguggggggagggagagagagaacaacggaggaggaggagggggagggggagggaagaaaggaaaguagagcaccuggcuuggagaaacuuuaaguuauaaggggccucuuggagcucaagugugcauuguaaggugauccaauacaugcaugccauuagugaggaauccuucacaucauguguccuuucaugugcuugguuuagcaaaacauccuuucaccagugucugcuucagggaaacacaucuucauguguuugccucagcaaaacaccauccaauacaacuaacuuuccaaagaaaccagaaguuucuacuucaaagggauucauagaaaaauguccacauccauuuauuucuauaucauagucaaacaugcccucuaucuaggaaagugcacuuccaaggccaucaccacauaacaccagacucagaagggaccugcccugcagugguccuugggcaugucugacacccuuuaacuuuagugauagcuucuugucuauaacacuuuacacucagcuuuuugaggguggaccuugcuccugggacuccucggcagcuuugcuguaugacuucucggauucagccacaggcuugaggcugauaaucucauuucaugcuuucuugguagguuugcugacaagagugcugaguuuuuucugauguguuuguauuuguagguaaauuauugguuuuccuggauagcuuuuaauauuuguuugccuuuuucuuuuuuuuguaacccuacuugucuuggaacucagagaaccaucaacuucugccuucccaagaucugggauuaaagucuugcaccacugugccuggcccuggcuuuguauuucugacacugugaaugaaccuggcauaggcagguucuucuugaucaugucuguuuggcauuuagaugcaaguguuuggauauccuuuucuuuaaauuuugaucauauucugucuuagcuucuuguccuccuccuuuuugauuauuaguuuggucucuugauuauccuagaguucauggauguuuugcucauccuuuuacaguuuuuccuuuauugcucuuucccagaucuuuuuccuugucuguguuugucacugaggugcauuucuugugugcagcaaauuguuggguccuguuuacauaucuaguaaguucaucucugucuuuuuauuggagaauugagucuauugauguuaagagauauuaaggaauagugauuauuguuuccuguuauuucuuauguuauuuuuauguuuguguggcuaucuucuuuuggguuuguugaaagauuacuuucuugcuuuuucuagcguguaguuucccucuguguuggcguuuuccaucuauuauccuuuguaaggcuggauauguggaaagauacuguguaaauuuguuucugucauggaauauuuugguuucugcaucugugguaauugagaguuuugcuggguauaguagccugggcuggcauguguguucucugagggucuguaugacaucugcccaggaucuucuagccuucauaguuugugguguaauucugauaggucugccuuuauauguugcuugaacuuuuucccuuacugcuuuuaauauucuuucuuugugcauuugguguuuugauuauuaugugacaggaggaauuucucuucugauccaaucuauuuggaguucuguaggcuucuuguauguuuaugggcaucucuuucucuagguuagggaaguuaccuucuguaauuucauugaagauauuuacuggccuuuaugauaggagccuucacucucuucuauaccuguuauucuuagguuuggucuuauugugucuuggauuuccuggauguuuuggguuaggagcuuuuugccuuuugcauuucuuuguuuucugugguaucuucugcacccaagauucucucuucuaucucuuguauucuguuggugaugugugcaucuaugauuccugauuucuuucuuagguaucuauuucaagcguucucucccuuugugauuuuuuucuauuguuucuauuuccauuuuuagcuucuggaugguuuuguucaauuucuucaccuguuugcuuguguuuuccuguaauucuucaagaguuuuuuguguuuugcccuuuuuaaagggcuucuacuuguuuacccguguucuccuguauuucuuuaagggaguuauuuuuguccuucuuaaaguccuguaucaucaucaugagauguaauuuugaaucagaaacuugcuuuucugaugcguuggaguauccagggcuugcuguggugggaggacuugguucugaugaugucaaguagccuugguuucuguugcuuauguucuugcacuugucucucuaucuuugguguuagcuggucuugcugucucugacuggagcuugucccuccugugagccugugaucuuaggugugucagcacuccugggagaucagcuuucucaagucaggauuuagguauggagagcuguggggcuggguuaacuaacucagggucgcggauggagacuggaaggauccuggccccacuugcucaagguuccugagcccuguagucaccuagcuggucccucuuuggccaguuauuugagcaaaaguguuuguuucacaugugaacuuaggagugacagcauuccugggagaccagcucucuuuuggcgugauuuggguaucuaaucaacauuucuugcuuuguagaucucuuuggcuuuuauuugggaaucuuuuuacuguggauucuggccgggaacuuacaggaacucacagagaucuauccagaguacuggucucaagaguucuggaauuaaagggccaccuagguuuugaaggcugaccaucuauuacauuaccacuuggagaagagggaaaguauaucuuucagcagucacaacaaaugaugcaagacacugaaauacauuuaagaucaguuaaaguccaccaguguuucaccagugaccauaaaguacagaauggcaaaauagaguauaucaauaaguuaaaaauuauguaguaucaguacugauuaguaaaugggugagauaaggacaaauuacagggagaggggaaaauagaggcaaguaagauuuaaucagagaacaaagagggauagaaauguuuguuaugaagaaaagagcaaauuagaaaaaaacccaaagcacccaaagucuaguuauaaaccugugauaaguaucuguuuguuuugcauacaaguccuagauucagucuccagaagagccugaaugaaugaaugagugaagaaaaaugagagagauuucucaguaauaagaagagggauagaauauauuuaaaaaaauaaaauaaagucugcauauuguagaacaauagaaagaaaaaaaaggaaacacucuaggucagaagaaaagcaaaggaaaaguaagugccccacccuggaguccuagacugaaaauaaugaggagaaagugaacugagcaggcagugugcucacacuucacacuucugcccuccugagugugggcagcuuggucaucugcucacacuccugccuuugcaaucaagauggacugucucaaggucaaccaaaacauuucuuaaguugcuuuuuuuuguccaguauuuguuugagcauugaggcagguaacagauaguuguuuuuggucacgugauagcuguggcauggcagacugaagcaugcuuuugcuguuauuuuugcucaugaguucucuguguaagagagauaugcaaauauugucagacuguacucugguaguuuucacuguuuaucuucacuccagcucagacuauguucugcauaaucuucuccccucuaugguugccaaacgcacuggguuagaacuagccaaaagagggauuucugugagcagugcugucaaccauuugaagguuauccuguuagaugaaguaagagucaugcaggggcuugugggccuucgccugacuugacuuuacuuucuugcucugugugcaguucccuucccugaugcugacagccguccccuucauuggacacaucuccagauggaguggcaacucuggagugcacagcucccucguuagauuguccuuuggaauccuauuucuguagcuggaugcuuuaacuucucaagucgacagacauauuaaucuaugauuuucauccuccaucuuggauauucauugccucuucaacuauuaacauaaauuaagugaaauuuuauaguaaauaccuuauucuaauaaaucucagcacucugcuucuugcuuuagaauucugaccugaauauacuuuccuuguugguaaauaucuacauaguuuuugaguaaugugguaggaaaaaugauuuucuuggucaccugucauugucauuuuuucuuuacauugguucuaguuuuuuuuccuauaaauaaaggugauaugaauauucuuugcacucacccuugcuuuucuucugggcaguuuccuagaagugaagaacacuuuagauuuuaagcaguugugauaaguguuuccugguugcacuguccagcaguauguaugucaaguguuuugcaaucaaauucuuuuuaagaaguaaaauauaagcugggcagugguggcgcacgccuuuaaucccagcacauagaaggcagagacagguggauuucugaguucaaggccagccuggucuacagagugaguuucaggacagccagggcuacacagagaaauccugucuugaaaaaugaacuaaaauauaagagacauggauuaguuaacagcaaaggaguaaauggaaggaaagccaguaucuuagucuaaaugcgaauuuuuuuuauaugaacaaugcauaaauauguaacgucagauuuuuugaggaguacaagagggacaugaagagacauuguccuucuaggcagaagauuuuaucagcagagcugugcagcagaggccuaauguuacuauggugagcagugguguaucccuuaagacuucucagggaaaggaaaggaaaggaaaggaaaggaaaggaaaggaaaggaaaggaaaggaaaggcuuguauguugccuuuacugugugacaaaaggugugcauaacuuaggucacaugacggggcauuguuucccugagcaggagacugagaucuggcugcuguguaaccugugcagucugauagcagcuaggcuacuucacaccaggugugagugcacacugguguguggugggcauguugccuugcuuacagcccuuuuuguuuagggccugccuugacuaacagugaauuacauucuguuuauuuuuugguuggagcucacuaugaucuuaggguggccuugaaccuaaucauauguuuuaaauguacuugcuuuuucugaaacaguguuucuuaaguuuguguccuaagcauuuuaaaguauaagugcauugugauguugaugauaaagggauuacuguaucaucauaguuacuugggcuguaacugugauagaacuuaaaguuucagaacugugcuaucuauuagaaaugccagggagauagaaacugacuaaaaggcuuaaaaauguuuucuaaaauacaguuaaauaugaagauacuuguaagcuguuuugugugagauaugugguugauucuucugugugagcuuuccaguuauaaaacagaguaugccacaaguccuauucuuguccccagaccuccauuugugaggcagguucuccaguguuggucagguuguccucaaacugcuaaucguuuucugccucccagaugcuuguguuauaauagcuguauaaugucacgccuggcuuaaggauguuuuccuucucuugccauaauaaaaugggaaaaugaucuaccuguagguaaagaaagagcaaggaagaggaaaggcaagugaaacaaguguauaguuggggacaguguuuuuuuuuuuuuuuuuccucacuggaaaaagaggaaggagggagauagaaggaugaagaagaaagaucgugagugcuuauaaccagcagucuuuuacuuuaggcagugaaagagauuuuuacaaauuuuuuccacucacucacucacucacucacccacccacccauccauccauccauccauccauccauccauccauccauccauccauccauauaugccuuuugaagaugacaugagugggcagaaaagggcuuaacgaagucauuaacuucuuuucaaggauucuacucgagcuaccaguccuaauuuaauaaguuugaugucugcagguggaugaggaaggaugcagaagagaguuggucauaguugagaugaucauagaguucaguuaucuaaggaauuuccuguaugguuuauuuuaaaugcauucacuguguugcuuauuuuaaguacagcuauuuuaaacaaugagcuuuucuuucaaagcuguguauauuugauucccuuuaaguggccuucauuuguuguauaagacaggaaugacaaaugggcuucacaugauacaucaaaucccagagucauuaguuagcagaaugccugccaugguuaaugccaguuuuaauucuguggacacauucuuaguuguuuaguagucugugacacauuuugugggcauacuaagguugguuggugauuauaaaguuaucuaagggagcuacaaacuuaaaauaacuggcagcaggaauuuuaugcaaaucugcuggucaaauuuauaguuuauaugaguggaaauuaauggugacuugaaaugcauuuucugguaacacagucaccugcuuuacuucaaaaagcauggccucucuuuaaaaaucaauuguuauugcauauauauacauauacacauaaguauuccuaaaaaccuguugaguccauauaauguuacuuguaugaauguccucagggcugaccauuucaaauugaacaaccaguuaugauacucuuuccuuaccuuaaaauuuaaaaaggaagcucuguaaaauacugucuuugauuacauaugacauuauuguuaugugagacuacauuugacuuuauugcauuggaaugaaaagauuuuuauguguuuaugaguagaauuguuuuuguuaacaucucauugacuauaugcaguuauauaauuuuauaauaaagaaaacuggaaaauaacauacaagauuuugguggguggaaaaggagaaauagauguucgccuaacacugacauuuccucccauucaugucugugguuuguaaguugaaaauaaaaaagaaaaacaaaacaaaaccaggcagaugaaauucuagaauuuaaugacugaaauaauuaucuuguucaaguuuaagucuaccuggcuuuguaaacaaguauuuuuauaugcauuuuuaacuguagaaaaccuacauuuuccccuccaguucuuaaguuggauucuagaaccuagguacuuggacauucuagacaagugcucuaccacugaacaagauucuguguucuaaugcaaaacaacuuugcuuuuaauaguguggauggcugcuucuuuuuaacauacuuguauuucuagcuacuaaaagagcaagagaaggaacugagacaaaagaugauuucaaaggaaaaaguaaacuugcuuuacacagauagcauaauuguuuaaacaucuuaaguaaucuguaaguagugacuaaaguaaaacauugaauuuagaaagauugcagaauuacaagaccaauauuuuaaaaagucuguuaucugaaaccuuauccagaaucccaagaaucaucggauuaguuccaaacuuuuuuuuaaauuacuccuccauccaauuuuuuaucaguacugugugugugcacuuugugcauaggugugagggugccagugccacagagugcauggggaggacagaggacagcuguagagcuccauuaaacaugguaaaaucaugucacugggcuugugcagcaagcacuuuuccccauugagccaucuugccaaaccaauuugaacuuuuuagaugggggugggggagugggguuauucuuuaguuguauagaauguguguuuaaugaauauuaacuaagcauugguucuuuuuguucuuauuuuaggcuacagacaagagaaaagcucuagaagagaccaaagcauauacaacucaaucucuagcuaguguugcuuaucaaauaaaugcauuggccaacaaugugcuccagcugcuggauauccaagcaucucagcugcggaggauggagucauccaucaaucacaucucacagguaccagcuuguaaagucuucuggguucauuuuuagucaaauagcagcaugugucuuaagcauagucaugcauugcuuagugaggaggauacauaucugcuaagaaaugucacuaggagauguuacugugguguagagagcaccuacauagucugcaugguauauaagucuacccacuauuuccuauggauauuguuaagagugggaaaugcaaggugcaugaggcuguuguuggugcagaaaagcaguuuuaaaaauaauuaaaaaaaaguauuaguccacuggagagguggcucagcgauuaagagcacuuguucuuucaaaggaccccauuucaauuccuaguacaaacauggcagcuuucuaguucccagagaucuaauacccacacaacagacauacaugcaggcaauacacauauuaaaaaacaucauuuaaaaaauuuacuccuaaaacauguaguaauaauguacucuaauacaacaguaacaaguauuauaaauaaauagacugguaacaguuuauuaucauuguuggguauuauacaucauaaaaauguuucauaaauuauuggcaguuuaacagauauguucacacaguuaccaccaugaaacaugcaauuaaugcaucgcauuuggacauuaauauguaauccuaauagaacucaggcauauaagcagucucagacaauguaaugaugauguagguaacccgggaauguggaauccucaccucgcaguuuguauugaaugauuguaguuagcacuuuuagcuuuguuuugaguugaguaagccuauuuuuuguuuuguuuuguuuuguuuuguuuuguuuuguuuuguuuuguuuuguuauguuugaaauggucucacuguggcccuguuggucccuccagcugccuuagcaucuuuuguaaaaagaguuauuuuuuuuguguguacauaaguguuuugccuacaaauaugacucuguaccacaugagcuuccugguauucauggaagcaaaaagagggcauuggauucccuaggaguggaguuacagauggcugugagcugucaugcgcuuccugggaaucaaaucuggcuccucuguuucuucuaaagcuuucuuuugagguagccuugguaagcuguccaggcuggccuucaacucuccauuauugugccucugagaggcugggauaaccaugccagacuguugacuuuuguugagguaaaauaaauuacauauaauuuaagcuuauaaaauaucuugcaaauuuucacauauuuccaagagaucaucaacauaaagaaccaaacaugugcuguuaguaacccuuuccuucccauucccuguucucaggcuuuuggacauuauagaguaguuuauauuuugacauuauagaguaguuuauauuuugacauuauagaguaguuuauauuuugacauuauagaguaguuuauauuuugacauuauagaguaguuuauauuuugacauuauagaguaguuuauauuuuguagaauuucugugagugcagucaugcaccuguccccuaccccuuuauuuugguucagcuuuuucacacagcauuuuuuuuuuauuugagauuugcccauauuguuccauauaaaaaagucauugcuuuuuauugcugagugauuuccaugguuaagcauuuguguaucuguuguuggaaauauagauuguuuucauaauuuugccaauugcauauuaaauuuauacaaaugucuauauacacauuuuuccauagucaaaugauuuuuuuaauuuuuaaaaauuauuuuuuuauuuauuuguauguggguacauaugugucccaguauguuuggacgucagagucuaguuaucaggaaugguucucuccagcccaccuuguggguccugggguguggucaggugucuggcuugaaagcaagugucuuuaugugcuuuuaacauucucauugauucugcuuuuguuucuuuagggcagauacacuugugugaaacgaauaguuucaugguauaugucuguuuauaagaaauugucauuguuuucuaaagugguuuauuguauaguuuguggagagcucuuauaaggaaugagaucagagauuuuguuacuuuuuaugcaucugugaaagggaacagguuuuguauuugcuuuuacucuaauaaggugaacuauauugugaacuuaguguuugaacacagcuugcuauacucacaguuucggagcucugccaugcuuuucccaggacuuccaggggaaggauaaucucaacacuaggaagacugagacaggaggacuauucaagauggguuuccucaguagccagcugagucuuuuuccacacuguggcucugaucagugcagauccauuuggccuacucucauaccacucugaucaucucucugccucacaggccucuucauuguagaugcaaaacuguuuaccugcuuauuguugaaauacgaauuuuaagaaagaugcuggcuggacauggugucucacacuuuugagcccagcacuugggaagcauaggccagauuucugaauucaaggccagccuagugaguuucaggguggucagggcuacauagagagacgcuaucucaaaaacaaacaaacaaaaaaaccuugcugguucauguuugauguuuuuuaaauuaaaaaagugucucacucuguaguuuaggcuggccuugaacaugaguccuguuugguccuguuccuuugccugucuuuuuaggucucugcuuuuccuuuccucuucuuccuccucccuccccuuuccuucacguuuccuuccccuuccccuuccucucccuuuuccuccuucuucuccuccccucuuucuucuucuuuucccuccccuucuaucuccacuuuccuuuaugcuuuaaaaaaauuaauaaauauagcuggguaugauggcaucucagcagaucaggcagaaacaggagaucugaguucaagaccagcuugcucuacacagggaguugcagggcagccaggacuacacaaugagacucuaucuuuaaaaaaaaaaaaaaaaaaaggaguauuacauaauaauuaaaaaugcaaaucucauuaauagucauaauauaagccaguacuguggcauuauguacaguuguuaagauugguuagaaacagaacaaagugacaccauugcuaauuuugacauucugaugugggcugugugaaauguuggcagcugggaaguaaaguggacaaggccccuugcuuugguugugcccugaauacauauguacuguaggcauguugcugucauauuaaaggccucaguucuguucccgaagcuuuggaaguuaacuuuguaaauugcauuaagugaccuuaagguguaaaaacaacaaggacaaaaauguuaaacuugggaacaaaauaaaagaaauuaauuauccauuaauugccacuggaaaggcuaucuuuuugagaucagauauauagugcaguaacuuucauacugcaucauaacuacuaggcauaaauacuugucuuuuaaaacaucacacuuagugccagauuuacuaauuaacauuaaguauaauuuguaagagugcaucauuacuguauagccaaugcagaagagaaagaaggaaggccugucuacaaauguauuccgcucuuuaccacaaguccaguagcuaacucugagugaaacaagaugguaagguuagaccaucaguucuaaauaagauaauagugccauuugugcuuauuaguuuaaauuucaguuauuuaaacauacauuaguuauguaugggaaauauuuuccuagucuuauuuauaaauaugaugaaugacaaagauggaaauguaaagauuggcagauaaauauagcaauaguuuacuaaguaugagaugagauguauuuacguaagaagccucaauguuuuagaaauccccacaaauauauuuauaaguauauauaccuaccuuuuagucauuggacauaagaagcaaauauuguaauaaucacaauuauauuuuuauuaggucuuugacauaucagugugaucuaaguaguuagaguaguacuugcagauacacauccucuuaaccauugauggaaaugugcuucucacuguuuucuuaaucaaauggcacauuacacuugauaacaaaugcagcgaacaguuaugaauguuugacugaauauuuccuuucuguaacagaaguguagagguuagauuugcuuccuucaggccuuuuaagccaaacuugcuuaagguuaauugugggaccgucaaucuaucuuuaucaguuuauguaguccucauaccauucaccauuagaauacuguuuccuguugagaucagcacugcucagguggcucaguuaaugcucuguuuggaccuaauagagccauugccuuccucaucauuguggagucuucaggaauacuaaagauguacagcauagaaacuuguuuuggaccugaacaaguggcuuuuguuguugcuuuucgggcugaaaggauuuucaugcuuuuucuguucccccuuucauagcucuugaggaaauuuuaguacuacaccucuucucuuuaagccucauuuuuacugcucuagagguggugagaccugagaaaauggagcgaauauaugagguggacuaaagucucaugcacuaaccaacuuuauucagagcauuagacaauuuguauauagguuuaagaggagccacaggaguaaagugucuaguggccaagcaacaaguaacaauagccaauugcaaugaauaaugugaaguaaauuacucuucuccacuccaccugggagugauaugaagcauuaauccaagaauuccacaaggcucuuuucuugguuucuuggagguuuuucacaagcacuuagaaaucucacaugacuggauucuuggaccaugugucuuuuuuuuuuuuuaagaauuauuuauuuuauguaugugagugcacuguagcuaucuucagacacacaagaagagggcaacagaucccauuacagauguuuguaagccaccgugugguugcugggaauugaacucaggaccucuggaagagcaguuagugcuuuaaaccauugagccaucucuccagcccauuuaugugucuuuuuuuuuaagccaugauggggauggaauugaacccauucuuuaggccugcuaggcuaagugcuccaucacugagcugcagcucuuggcuuuucagaucucccugccugguggugccugcccugagauucugcugcuucuacuucauucugcugggagguagccaugugcuacugcacagccucuguaggcuuuccuuccagucucuuccucuuccuccuccuccuccuccuugccccucuucuccauccuucauccccuccuuuuuucucccccuccuccuuucuccuccugccuuuuccuguucccccuuccagcuccuuucuuuccuuuuuccuugccccucugcccuaccuucacucuugcccuuuuccuugcuucuuucugugguguuauuuuuugaggcagaauuucacuguguacucagacuggccuggaacuuaaucugcagcccagaggugaccucaaguucacugcagucauccugcuuccucugacccagugcuaggauuacauaguaugugcuaucacacccuucuuuuuaacauuuucucucuuucugacuguuuaauuugagucaguguguguguggggugggggcaguaaauauagcuacugucauuagauuucauuccacaaaucccacuccccaauugaguacuacacgaagauugcuaaaugccaaucacuauuacuugagggauuauaaugaaaaucuaaaaucuguuaaugccucuuucugucuuguuuucuugagugcuuauguauaguacauaaaaaugccaggguauuuuacacauguaaauaaccgaauuaauuuauccucacaacaaagucauuauaaagcuuaauguaguggcacacaccuauaaucccagcucucaggaggcagagacaggaagaucucgaguucagguuagccagggcugcauaggaagacccugucucaaaacacaaaccagucaaacaaacagcacccagccccauugcagaugcauaggcuagguaauuuagaauuauguacuauuaaaaauggcauuaugaaaaccaucaaaaauacauuauaugcauacaugaaauucucaaagaauaaaugaaaauauuuuuaaaauggcacauuaaccaaacaaauuucaccauagaaucuauuauuacuuguacuauucguuuucccggacuuuuuuuuuuuuuuuuuuuuuuuuuuuuuugcaggggaagugcuagaguucaaaccuaaggcuuuacacauggcagaugagcacuccucaccuuagcucacuuacaaucuuccuuuaaacuucuaaaggcaaugcuuugccugaccuguuuuacuacagucccagucaagucucugaguacagggccaagucuagaacccaagauucuuguuucugcagggauuacagaaaugcuccaucaucuagaugguucuaauaguuuuguauuuaauuuguccucuuucagacagcuuuuuaaauauauuuuauuuaguggcugucacacauacuugugugcaugcaugugugugugugugugcaugugagaucuugcagggauagcuugacugugguggucuucuaagaggaugcugugcugucacuugauggcuguuuccaucuggagaugagacuacuauauuucuggauauuuuuguauuuauacacaugcacacacauauacuuacguauuuuaauuucucuggcugugcuaucguuucuaaauauaccacucuuaucucuuuaggaaacuguucaguuuuacuuuuugguuaugucuauuauauuuuuuuucuccuuuguaagugucaauaguuuuuuuuuuuuuaaaguuauugauuaguuuuuauucugcacgaaaguucuuguuuauuacuccuuuauuccuuguaaaguuuuuuuuuucagauucugguuaggucccccccauuucuuauggaaucugguaauuuuuuuuuuuuaagaacuuaaagaauuggagauuaaaaugccuagacagagcuuuguugcuauauuguuaauauucuuguuucuauuuuucuuuuuuaaauaaaaacauuuaaacauuuuguguguguuugucuacauuuguaucugucuguguguauguacauuucguuauauuguuaacauucuuguuuuuuucuaaauaaaaauauuuaaacuuuuuuguguguauuugucuguguuugugucuguguguaugcacauguguuggcacuugugugacuaaaggaauccacuggaguuggcucucaucuuugacccuguuguuacaggaauugaacucagguugucagcuuaauggcaaaaccuuugccuauugagcuaucuacccuucuagccuuucauuauuuuguuuaacuugcacauguacauuuuaguuuugagcauauucccuaacuacuuuccucuuuucucuccaccauccccucccauuggucaguuucucuagacagcucuauuucuguuuacuaaaauuuauuuauuauuauuggggugggguggcaugccaugccaugauguuccuguggagguuagaggacaacauuggaguugcuuuacucuuucuacauuaggauuacuauugcugugaugaaacaccaagaccaaaggcaaguuggguagcaaaggauuuauuuggcuugcacuucugcaucauaguccaucauugaaggaaauuaggacaagaucucagucacgagccuggaggcaagaaggagcugaugcagaagccccucaccgaggcuucugaaucagcuggcccucccccuucagucacuaaucaagaaaaugccauacagcuuugccuauaggcauuuucucaauugagguacccuccucucaaaugacuguaguuuaugacaaguugacauagaacuagccagcacacauggguuccacuugagugauuuccgauuugccuaagcaagcaggcugccuucccuacugagcugccucuccccgugacuucucuuuucaggucuuguaacucagccuggucugggacuugggaucccuuugcccauuacuccaaguguugcuguuauaggcucuaguuacuuuauaauaauucugauucaagugguucauauuauguguguuuccauggugucugauuuugcaguucauauuuuuguaagaaaucuauuuuguaguguguguauauaggucauucugaaucaaguuaacuucagaguugauugggaacuuguuucaggcauauugaacagagcucuguaacagaaauuugggcauacugccauuuccagagucugguccaaguaagcaagaacagacaaagguugccuuuuucuuugcugaaggcuuucucuguguagcuugucucaggacucuuaccccuuuccuacccaucucuguuuguuauucugggcaaaaggauuuagauuuucauuucuuaguugauuucagcaaauuuauauuguggcuuuauuuauauguaagagugucugccugaaaccuauaaugccuucccucuaguggcaguugugaaguuugguaaguuuccugauaaauacauuguagaaaauaaggacauaucaaguaguauugugguggcauggcucuuucugccugcuuuucuguguuuugguuauugggauaggcuccccacccgacacccucuccccccccccccccgcacacccccuuucuggaagauuuuuaaaagaagcacauguguaccuccccauucccauaaaaaaugacaggaacaggaaggagaacacauuucaaacaauauauaucuuugugguaauuuuacauaacaguuuuuuaagauuuaucuuuuaaauuauauguauuggugugugaguaugugcagaugagugaguuucggugucuucagauucagcggaggguggagcuggaguuagaagcacuugucucugauaugggaacuuagaguugaacuuggucuuugggaaggccacuucaucuuuccaggccauacaaugaaauaucagagcuuauuaugaacagaaguuucuaaaaaaaaaccccagcaaaacuacgcccauguuaaagauuuacaaagccaguugccuaguuagaacuugcuaggagaagaguugcaugcaguguugcuugucuggagccagauuauuuugugcuauuaaugggcaaccauugucuuccucuguguuuuaccuaguaaccauucuugugauuauuagguaaauuauuuugcaauguauuuucuaccuugcuauaauuaaccuacuuguuacuucagugugcaguguauuugaggagugcuuuaguuucuuacauucuuuuguuauguaacagagcauaaugaguguguuacccagugggaauuauguguacauauuauguguacauauuauguauguaguaggcucaccugacucuguccugggcuauggucacucaugguucugaaucauagucuggccaugguuccagaauaaacugucucuuauucucuugggugcuagagcaguuuuuuguuuuuguuuuugaugugguuuugaagacagagucuccuuuuguuucccuggccuggaauuccuuuuguagacuucauuggcuuuaaacucacagagaucuaccagcccuugcuuuagaguucaugcuuccaucagcugugguuuuaaucaacagauaguuuuguuuuuagucugcuuacaaauuguaucuuugaguuugauuuuuuuuuugucucuuguagcccaggcuagccucacauuuauaaucuagcuaagaaugacccacagucaucuugcuuuuacacaaguguguguaccacuacaccuaguguuccacaguugucauggaaauuuuuuuuuuccucuaauagaauugguuuggggaauauuuuagucuuucuuugaaaaccuuuucauuauuuuagcuaauuucuaacacauucauauucauuagaggcugauuuuauaaauuaguguggcucagaggggaagaacacuaugcaagcagcaguaccuguguucagauccagguacccauauaaaaagccaguguggccuguuuguaacgccccccccaggacaggacauaggagcuccuggguugacuggucagucagcuaacuucuaaaaacagcaggcuucagauucagcaggaagcccugucucaagggcaugaggggaguaaucggucaggaugacugauguccuccagcauucacaugcaggugucuguaccugcacacaacuugcacgugcauacacacacacacacacacauacacacacacacacacacacaccacacauauaaauaauaagaaagaaauugucaaucagguauagugacaucugggugacaaguucagggcuugggcuacauaaagagaccugugcuuguaugcaugcgugugugugugugugugugugugugugugugugugugugugugugugugugugugugugugaaggugugugaagggagagagauggagaguaugaauuaguggacuaauuuguuacugaauaguaaagugacuggauaucaacagaauacuguccuauuuuauaagucuagguaagaaaggaaaaaaaagauaguuagaaaugauuuuuaaaguucuuuaccauaaaaaauaauaaauauuuaaagaaauaaacauuuaguuugacuuaaacauucaguuuacacauguaucaaaaaaaauuaacacuguacuguuuauguguauccuuuguguaccaguuaaaaaauauuaaaacuaugaaauugugaagugugaacuccuaacuuccauaguguuguuagcuuuuaaaagacuagauagagcucagccuacucugucugcucuucagcuugucuuuccucugaucaaacgucagggguagccugugcuuucuucuuuccagugugcuaaguguggccacugaaaugagauuucuuuugugcaauguuuugaugcugcuucagaaagauuuuuaauaugguucugggauuaauugccugauucuccugcuaggcuaguguucugccacugagcuguucccacaguguugcuuuagaaccuuaaucauucuaguccuuguucuuuuugucaucuaccugcaauugaaguacuuuaaaaguuuucuugauaccuucaaaagacuaaugcuagcuauaauaaacaucuauuaauucaucagcuaaacuacagacagagcaugaccaugagcacucuccuccauaccugaaggacuuguccaucauucccuaggccaguaguucucagcuuucauaaugcugugcccuuuuaauacaguuccucauguugugaugaccuccaaccauaaaauuauuuuguugguacuuuguaacuauaauuuaucuauuguuaggaauuauaguauaaauaucugauauucaggacauugauaagcaaucuccgugggggucaugaccuacagguucagaacuggugccuugggccuuccaguucugucaucauauauguugucuguccuuacauggaagucauaguccugaaggaaacaggcuagaccuguauuccuaagucauuacugcuuaauacuucuuugcuuugggaagcuauaugugucugguauggcuugcauuuuaaaaacucaucauugggcccaaugggaugaaucagcagauaaaguaggcuuuugccugaugcccugaguguuugaucccugggguccacaugguggaaggagagaaauaacuuuuugauacuguuuuguuucaggguuucacuaucuguagugcuggcuuuccuggaacuugcuguguaaaccaggcucuccuggaacucaggagauuuaccugcuccuacaggcaugcaccaacauacauugauguauuuuauuuacauaaaguuuuacauauuuacaauacguuuugaaugcuuucaaaugugcuggcaauauuuucauuaguauuaacuagcuaaauaauuuuuuuaagcuugagauuuuuuuauuacuuuguuuacauuucaaauguuauuccuuuuccuaguuuccccuccgaaaauccccuauccccuccccacuccccauguucaucaacccacccacucccucuuccuggaccuggcauuccccuacacugggucauacaaccuucauaggaccaaaggccucuccucccauugaugagcgacuaggccauccucugcuacauaugcagcuagagccaugagucccaguuuucuuugauuggugguuuggucccagggagcucuggggguacugauuaguucauauuguuguuccuccuaugggucuacaaaccccuucagcucuguggguccuuucucucccuacuucauuggggacccucuguccaguggauggcugugagcauccacuuuuguauuugucaggcacuggcagagccucucaggagagagcuauaucaggccccugucagcaagcuauuguuggcauccauaauaguaucugguuuuggugguuguuuaugggaugggucuccagguggggcagucucuggaugaucauuccuucagucucuacuccacacuuugucucgauaacuccuuccauggguguuuuguucccacuuauaagaagguuuaaaguauccacacuuugguuuuccuucuugaguuucauguguuuugcaaauugagaaccaaccuuuuaaaguuguccucugaccucugcacaugggcugugugaugcuguguacuugagcagguacacgcgcgcgcacacacacacacacacacacacacacacaccauuuuaaagauugcggcuuugucuuuuuaaagauuuaucugcuuuugcaguuuuguuguuaauguauaaugauagaaguauaagcaugccuuucuuuguauuuauauuucuggauuuggauuuuuuccuauaagaugggauagagauacauucuuaguuucucuuuuaugcaguaaacuaguauuucacuugaauaguauauuucccccacuauaccauaauucuaagacaagaaguuugguuuaaaagccuaaguuuguuuuuaaguuuuguccauuuacuugauuuuguauugccacaauacugucuuaguaagacuucauaaugaaucucaagcgaguuuuuaaaaaaauauuuauuuuuaugauuuuuaccauguguaggugugugcauguacauguaugucuauauauaugagugcaggugcccaugaaaaugagaggcuuuaggacaggagcuauagauggguuugagccacccaacauggguucagggaacugaacuuggguccucgggaagagcagcagugcuccuaacugcugagacaacucuaucuaacguuucacaaauaauguuuaaaaccauuuuuuccccuucaugcucuuucauauacuccuugaaccaugaaaaacuugggauuuuuauucuaauguauucaacuuguagaucaguuuaggaagauuuguaaucaauuuuacaaugguaugcaggcaggucaaugaaaguuauauuugccagugugugaguaaaguaaaauuguguuguaucuagcuuugaaggucacauaaguuucucuuuugaacucuuuauuuaucugcuuucaaauuuccuucauuaucaauauaaguaaaacauaaaagaaagagauuuauguuugugucagggcagucuaacaauuuuuuaugaguagcauauuuacauuuaaaauuuuuuuuauauguauggguauuauguaucauguuuaugcuuggugcccaugaaggccagaagagagaguugaguguggaugcuaggaaucaaacccgucuucagagaggcauuuuccaaagccugucccauuaucuuuuacaaagcaauuuuagcuguuaguauuugcuuaccuuauacucauuguauuuucaaucugacagagccuuaaugcuuauuaaacuugcuuuaugaagcugucuaaaggugcugaacaugauuuccauuucuuuacaauauaucuugugagauauuuacaucuuauaucuuuaaaauguucuaauuacuuauucacuuauuauuuacuuauuuuugugagauaggcuuucuucauguagaccaugcccagcacaaaauauuuuaucuuagucuugggauguagaugagauuaguuugguaaaugagauuuauauuugauacauguuuugggggagagguuguugaaauagucucacuauguagcccugguuagccugguggaacugugucgaccaguggccucaaacucacauagguucaccugucucugucuccuguguccugggauuaaaguacucaguacaccacaucugggcagauuacaaagcagugcuguagauucugcuaacuagucagaauagacaggugugcacacauguauggcucagauaccaaaucaaagaaaggccuugcacaugcugccaccacuacuuaacaccauuuucagcccuaccaaaaugggcuuaauggucuaaaaucuauauaacauuuuauaacaaggaagagcuacauuuuauuguuuugggccccuuuucugucagaacuagaugugcauugcuggacaaaauaugauuuggauucuugugauucagaaucaugauagcagguaggaguagaaccuugaaaaaagagaaauuuucaaguaauuuaaaauaauauuuugaauauuuguacaguguauaaggggcaggagaaugagcaaaagcugacuuucagaagcaaacuguggaaacaggaaaggcaguugagcccuuuugaacuuguuucccuugaagacuggagccacgugggauguucuguuaauaaagcuaaaaaacugagacauuaaguuuucagcuuuucucucuguauggcuacuuuguuagaagguagauaaaauccauaugcuuauguuauaaagaauagaucaggccagauugcaugcccauggaccaacuagaagacuaauguagcagcugaugugagagacaugccauuuaggauugaaguguuggcaauagaaggaagcagauuucugguauuuaaagguaaguaugacaagauuuagcaauaacaaauagaaguaaagaguauauauaauuucaauagagaacugaaguaaacacauuaaaaauaggcuguaguagauuuauguguuuuguuugugucauauuuauuauaagguaucacuagaggagcaggaaaaaauaugucugugaugugcauagcaauuuaaguguaaauguggaugaguuuacuaagcaacgcuuacaaagaacacaucucuaagaucaguacuguaagaugaccuugcagaggagauggagugaauaugcaggguaaguaggaauaagugagggaaguagugccccucaccuccaaacaaaguagccaugcuuuuccucuguggaguuacagauucuugaacuuaauuccaugacaaguagaauguaacuaaaauuagugcuuagcuaagugguauuggaccaucugaaaaugaaggagaugaacuaaggcuguuaacucagugguagaacacuuacucagcacuuaugaggguagggguucuaucucgagcaccacaaaaaagccaguuuagagcugggcaguggugguauagguguaguacaccuuuaguuccugcaacuggaaggcagaggcaggcagaucucuugaguucaaggccagccuggucuauagagugaguuccaaggcuauacagagaaacccuaucucuaaaagaagggaaaaagaaagaaagcuagaggcauucuaagauuacagcucuacauuuuauaacaacaguuaacugcauuagauaguucucaaauaaauuacugagggaauauugucaaaggguaugaaucauuuccaucacaaaaucaucuuuuaaauauuaauuuuauuugcauuuauuguguauguauuauguauguauguucucuguaugcaugacacguuuguguucagaguucagaguaggguguuuagagucucuggagcuggaauuagagggaauaauuaacuguuugauuuggauacuaggagccaaacuugggcccucuauaagagcaacaauugaaccaucucuaugacccucuucucuuuucuggggucgggagaggcaaaaaacuauuaaaacaaacaaaacccauaagcaacuguauagacuagcaauguaauccucuacaguuucauagaugcugauagaagacacaggacuucuucauuccugagacaggagauagcagaauguuagcauuugugugugcccuuagcucuauggaagucuaaauucagguugucugagggcuuggcagaaaagcacaguuccuggcugagcuauuucacugaccuucaucuucagugauuuagguuagcuuguacaggagugucaucucuauguuacaauguaaauugagcucugccuuugccuugaccuuugcccugaagagaaaugacauuuucauuauacuggaugauaaacaaacccucuuagaucuucagugggaaauauuauuucuagaccuuaggacuauguccaguacaacugugcuuuaacaagaaaauauggagcaaagagucagugucugucugacaagguggauaaaagcacagagaucuaaguagaucugagugaaucuuauaugcaguauaccuucuuggcuucugggaaaaguccccaugauugcacaacucgguggucacugaacacucuuuuguuugacuuagaagacagacagacauuaaacugagguuauuuccucuagaaugcugagcucccuuccccugcccaggaauuaagacccagauagcugacuaaauuagagagccagaugguuucucaguucuuggacugagucucgacuuggccuaaggcaugaauguagcuauugcaggauacauuggccacauacauauggccuugucuuggagaaggaauugcuuuucugucaucuauaacaaucugaaccacugaguugaacugacacaaguggcccuagaggcaaggugguugauugcuuuagcuauucagggacaaauugcaaauguaaucggaugacuuccaguguaggaauaauuaccucagaacauaaucuaauuaacuuauugguuuuccugugggaucccuccagucccuuaaggauggauccuuacuuaaacacuugaaggucucuuaugaccaucucugauuauaagucacaacauucauacuugauuucuacauaagaaauucucuggcugccuauuccuuuagaguuggugcuuccuaaacaacacacuguuuagaauccccauugcccacaccaacuacugaaguuggggagcacuugauaacaguuucucuaauaugccauccugguuagcuguaggcuucucacuucaguucauguaauuaguacuuuuuuuuggagcgcauaccugaaggcaggcaguacaaucuguucuguuuaucugugucacgacagaguccuuuggaguaauugaaugauagauguaggaauggagauagaacagauaccuggagaacuucgagcauccucuuguucccaagaggccguuuuguaugagguuaaggaauauggucgucagggcugucugagagggcuuguacagguccugccaagucaguugaauuuagaauguuugcauaguuugugguaauuguaccagaggauuuucuucugggaagaaagcuccagugugaucucauagaugccagggcuguugacuugacuucuuuucauugucuaaaaaugaguguauugcauuucgguacuuaagaucuaucuauugucuggaaugguuaagugcaugaggaaaaaggacauuuuaauuaaacuuacagagaucucuuuaugucuccuuuguugcucaguuauggguuaaggacuuagauuuuguuuuguuuuguuuguuuagacugggugucauacagcccaggcuggucucauuccuuauauagccaaugagaacuucucauguuuaccuccuuuaauguacaugcuaggcaagcacugugccaaccaagcuauauaaugugaaaccucagcccuuucaauuuuuugaguugucuaugggguaagcuugaggacacuuuuauuagaguuuaaaggaaaaauuccuagggcaagcagguuguaaaucucggaagcugcccagagcaaggggcgggggggggggguagggggguagaggggagagcguggcggggacaaguagcaagaguuggcguagaggucagccauguggugguggggguggggguggggugggggggcgggagcuacacagcuuugcagggccuuuagagaaaccauagggaagcccuugguguuagggaaagcacacuuaaaacagagucagagagaagaaaagguaacucagaaaagcuugcagacuuuugagcaaagugucugaugucugugagagauuuucgaguauugcucuuugagagaacugcuccagcauuaagcaauauuagaugcuuguggguggagaauguaaaagggaaucaguacuuuagcuaacaucugugguugaucaggugguucuguuggaauagccaauaccagucucugcaaaagagucaucaagaaugaagacugggcuggugagauggcucaguggguaagagcacccgacugcucuuccaaagguccggaguucaaaucccagcagccacaugguggcucacaaccauccguaaugagaucugaugcccucuucuggugugucugaggacagcuacaguguacuuacauauaauaaauaauaaauaaaucuuuaaaaaaaaaaaaaaaagaaugaagacuacuaaaacuagaaaaaggacaucccaaguucuauggagccaauaugaugcaugcauguaaaaugacucuuuacaagacacaacaguucugggaagagguuacgguaugguagccucuguguuaggaauaaaaucaaggggcuggagggauagcucagugguuaaaagcauuggcugcucuuccagagguccugaguucaguuccuagcauagagauccaccugccucugucucaggagagcugggugugccacuaccaucuggagaucuuuucaacauaggaauauuuaguauuugucaguauuaauaucagggagcuauaugaauccaaauuagaagcugcuuagguagagguugcucuugccagaagaauugcugagugauaugauaugugugcagagaaacuuguauucaaagggguuguaaucaugugaaaccuuaaagccucuagcccauuucuacaugggcuuucuuaacuggccacagucuccccuagaguuuauaaaugcucacaauauaggaauguauaauauagacaacaguuguguguacuuagcagugaagaccacaguggcaguacguuaaauggcuucuagaggaucuauuuaucaaaaaagaaagcucauuagcuuccuuucccuacugagaacuccacucaaaaaccagggaucuuaucccucugaaggaguugcuuuuuuacuuccaguagugcuaugcaguuucaaacuggccccuaaaauaauuuacauaauguuugaaguaacaucucuaauuuucucuuuaauaaggcugauugggaguuauagagaguggcagaauaauuggggugagggcaauauugggagacaagaguuuuguaccuguuuauaggaaacauuuacuuucuguuuugaguggugugguagcuucaugcugauuaauggaaacuguucuuuguauugugagaagauccaagucaacagggauagucuacuacauuuuggcagagggacuaagguuuugcccccuuuucauugacuagggcucgaucugucuaguaguccauguuuuuagaagucuacuuaauguggccuauuguucccuugacaaguuagcaucucugaauucucaguaaagccaggcuugguggcuagugcuuguaaucccauaaguuaagaggcauggaagaaggguugcucuaaguuugaguuggucaguguggguuguaguauaauaccccuccuuuaaaagacagaacaggaaaauuuuagauuguuuaguagaauuagagcuaacauuaagagcuuucuagauaacuggaaucuaguuucauagguuccgguuauguucaucagcauuuugauaccugccuguagcaauaaaagucaauaugcagagggguuuugucaaggacauuucuuccaguggaaccucucacaggauagccuucuguaaaaacaugcuugaugugccuuaucucaucuccaaaggacugauuguuaagaaaguagacugggaggaucugagaaccagcauaguauugcugcuccuuccuuccuuccuuccuuccuuccuuccuuccuuccuuccuuccuuccuuucuuucuuucuuucuuucuuucuuucuuucuuucuuucuaccaauuauugugcguauagcuguuuugccugcauguaugucuguguaccuagagcaugccuccugagguaugaagaggccagaagauaguauucaguccccugggacuggaauuccagacaguugugaacugccaugugggugcugggaauugaaccugaguccucuagaauagcagccagugcucuuaauugcugagcuuucucacugaccgucuccccaccuuuuuuuuuuuuaaguauguauauuauuguuuugucugcauguauuuaugcacaccacauauaugccuaguguccauuaaaggccagaagaaggcaccagaucccaccagaacuggaguuauagguaguuaguuauaagcagugagugcuaggaauguggaucuuaggcccucugcaagcuugucuaccgagccaucucuccagcccaguugucacuguuccuuaacaagcauuauuuaccuuacccugucaccuucaaaacaacuuagccaaagauuugcuuuguucuaaccauaguagguacaaaauuugcuucuuuuacauucaguguacacgugucuaguaaauauuugaaaauguuuagaacuuuacgugcucaucuuccaccaguuaaaucuuaauuucagcuguucaugggcagaccuguugaagcuuccaucugguagcaaguugaaaaucucuagggaguuauugaggcucacaaguacccaucuugacacugucuuaauuuuaauaaauaauaaauuagaggcuuauuugcaguucucaugaguucuuuuuaguuccuuuuaaucagcuucuuccaucccagaaucucuucuuugcugguguguuucauucuuacccugacuccaaauuugaaggaucagagcuuuucccuuugcaagguuaauuuaacacugguucuuggguucuguugaaagauaagagugagacucuaggccaaagacaaucacugagcaacuacaagagccagugcacugggcagaguguggcggcacucgcucuucuuuacucccagcacuuugagacaaaggcagguagguggauuucugugaguuugagaccagcgugaucguuuuuaaggacagcaaaacuacauagaaaaaccccaucucaaaaagaaaagaaaaacaaaacaaaacaacccccccaaaaaaaacaaaacccccuaaaacccagcauucaguauuuguucagguaacugagucugguugcauuaaggugccacaaagagggcaugcuuucacacaaagcuagacacauuccaggaaggaagacucccacuuuagggagcuagaucuuuuagaaugggcgaugacccuuccuuaccuuuguuucuugguauuuacacuaucuuauaccuaauacugaugauuauacauaaucaauggccaugccacuugguauaaauuugucauugcuuccucauuaaaagaaaaaguuuuaaacucuugagcaguuauauauuauaugaagauaaugaguugugggucagccagccugguacaugccuuuaaucccagcacucaggcaggguagaagcaggugaaucauugugaauuuugaggccagcauggucugcauagcaaggucagcagguuacauagugagacacugucucaaaugaaaaacaaaacaaagauucugcuucuaguuaggaaucaaacccugggcuuccuguaugcuggcaaccacugagcccuuccuaggcugcuauccguuggugaauuugaauuuugacaacuaaaugcaaguuuuaaauguauuucuauuuguugagguggaacucagggcuuuguacuuauauacuagcaagugaguuucauccucagcccuuccuccucaaauacuuuauuuuaaagauuuguuuuuuuuuucuuuucuuuuuccccuguaaccacaguuauuuauuuauuuauauauuuauuucuuguauguaaguguguggguucaugugccaaggugaguggguagagauuguuuuuauuuuuuuaauuauuuauacuuauuugucauugugccuacauguaugucugugggagggagucagauccacuggaacuugaguuacagauaguuaggagcuguuauguggauuuugggaauugaacuccaguccucuggaagagcagccaauguucuuaaccacugaaccaucucucuagccccaaaugccuuauuuuacaaacaauuucauaggcucuuacugggcaagcugaacagacagauauguaagaggcuugcugauaacuauaaacuuugugcuuacaauuuuucccuuuaaugguguccgccaugugcaauucuuucugccuucaguaauuuccauauuugccucuugguuuucuuuucaagccugucaaucuguaaagauucuaagugaaauguuuucaaucugcuugaacugcacacauuuauaguaguuuaaauaaucugagugugucagcacagcacuuaccucauugcacuguaaccacugauuuuguuguuguuguuuguaucuuuuaauaaaguaaaaguaaccaagcaggccuccucuccuuccacacauucuaggucccuaggaaacagguuuuccccucuaacaguugcuuuagaaaaguuauuaaguauuaacugauuugagccuuaaggaaauuaauuugccuaauacauauucauuggaaaguagguaugagauacagucccaugguccaaugcauagggacagcauauacauuaucuucuauaccaaauaauauuuucuugcucuauuuaaauuuaaaauauagacuguggauauucauaaagaaaaaguggcucgaagagagauugguauuuugacaacaaauaagaauacaucaagaacucacaaaauaaucgcacccgcaaauauggagcguccugucagguauauucggaaaccuaucgacuauacaguucuggaugaugugggccauggaguuaagguaagcauucuguacuacauaaugugaauuauuuugaauagaaauuguggcaggaaguuuuuacuugauagauucccuuuaucuagcaacuaguauacuuuuuauagaauauuuauguauuuuaaagauacaaguguaugaauguuugacucuguguguguguguguguguguguguguguguguguguguguguguguacacauacuaaaugugugucuggugcucuuaggggucugaagaggguacugcauccucuagauccucuggaaaugaguuauggguaguugugagccauuauguggauguggggaagugaaccuggguccucugcaagagcaacaagugcuuuuaacuguugagccuucucuccaccccucuagaacuuucauuuaauggcuauauguuuaacuaagcuuggagcagaauuuuauccauggaauaagcauuauucagaaaaacgaaaaaccuuaaaaggcuggccugccaagauggcuuagcagguaaaaggcacuugccacuaaacccuuugaccugaguucuagucuuagagccuaaaugguggaaggagaaguagacuucugaaagcuuccucuugaucuccuuguccacacagaaugcccuguugcuuguaccagaaauaacaacagcaacaaacacccagacaaauaaaaauacaacuugaaaaagccauuuaguaaaauaagccauuuaaaccauagguaugauugguuuagaaaauaaauuguauauaauuuggccuuuaauuccuaaauauuuuuguaccuauguauuauggggaugaaauuguaacaauuuacauuuuuuaaaaauagaaaaauuguauagaauucugcuuugcauacaucugccacaaccuauggauuuguagaauauuuguugccuuugcccaagcuuggcagaauuauguguucuugaaauuuguaguuuuuuauauuuaugugucuuugcaaacgucuggaguagcauuaaguuccuuaaccugcccugcacaggauaaacuuaagcuuugaaauaugguuguaaucuuuuucccagaagacuguuugauuuuguuuguauucaaaauauuucauaaugucuuugagguuuuaagaauuauuuuuaauuuuaugugugugaguauuuugccugccugcauguuugugcacuacuugggugccuggugucuauggaagccagaaguggugucucauccccugaaguuggggucacgggcaguugucagcugccauguaggugcugggaauuaaaucugaauccucucagagaacaggccaucacccuguuuuaaaaaaugaagucagccagagucuggaaacuuuuuauaguugguagauaggacugguuacgguauugcuagagguguugcauucugaauauucugggacgucucaucaagagaggaacaguaacuuaaaauacuguacucuuccuaugauuucugggaugcacuuucaugcuuggcagugcuaggaaguugaaacacuuggcaaauauagcagagacuacuuguuucuuuuaucaaggguaugucuaguguuguuuaagagcuugaguucuauuuuauuuuaaaauauuucagaauaguaauauguaagguuguugucuuaguuaggguuuuacugcugugaacagacaccaugaccaaggcaagucuuauaaaaaacaacauuuaauuggggcuggcuuacaaguucagauguucaguccauuuucaucaaggugggggcauggcaguauccaggcaggcauggcgcaggaggagcugagaguucuacaucuucauccaaaggcuaguggaagacugacuuccaggcaacuagggugaggaucuuauacccacacccacagugacacauccauuccaaccaggucacaccuauuccaacaaggccauaccuucagauugugccacucccuggucuaaggauauacaaaccaucacagcuguauuauugccuauuugaagauuuuaaaaauaugcacaacauguagagauacguauuuaucuaauuuguuauuuguggaaauucaugaaucccacccccaccccuccaugcugcaucuuaauuuucuuccuaccaaaacaauauguuagcaguucaauaaagaaaaauuucugagccagaugugggggaaaauucuaacacgauagaggcaaaauuagaaguuuaaggccagcuugaacuacuuagugaagcucugucuuaacacugcuuccucacaaaacuuuaaccauuaucucaaaaacaaauauccugaguuauuucuucucuucacucaugguugugugcuuuaagacaccauguuugggaguguacgaaauuugaucuauuuuauguaccccugcauaagugcuaagauuaaaggccugggugcaaauccuaaaaggaaguuugauaagaaaaugcaacucuauauaauuuauaaaguaggaagcauaaacacaaccuacuagauguugaaaguacguggaugagaacuuagguaguuuucuuuuuaauuacucaaaacacacacaagcacacacaccucucuuuuugagaauguucauguagguacauaucaucccuaauuuuuacuaaucacuguuaaguguauacuucuggaauauauucacauugcuuugguuacuguuuuuaaguguuuugaccaagauuuaaaagaauggguggcuggugaaaaugguauauuuuacaaacugguauguguugguagaaugcuugcuuaguaugaccgugccccuggauuugaucacuuuguaauucuuacacucaaauggugaggcaggagcaauugcaagcucaagaccauccuugcucacauagagaauuugaggcuacucugacauccaggaaaccaguaugaagcugauguguguaaaguguaucuguauguuugcaaaauauauaauacacaauugcuuuguucuuggucuuauuacugguuguuuuuugggggcuuguggugggaggaguuuacaaguucuauaagaacuuucauucucuuauauuacuuuuuuuuuuccaacaggauuauagagauguaagaauuaagaaauaauaccagagcuggguguggcaggugcaucucagaauccaaggcuagccuguucuagugagugaguuuuguccuagccagaguuauauacagagacccuaucucagaagagauacuacuaguuccaggaggcagaaggaacagaaugacuacagcuuaaagggcagccuguucugcacagugugcugcaggucucuugggcuggagacugacacucaacaaaacacccaaccagcuagucuuccugcuuuuuuaaaaaaaccauagaaaucugggcauucaugaaugauaaauuaugcacugccugaaauuaugaggcagaaaauuaaauuuauuuauaaugugcauuuucaauauaggcaaacccuacuagugccuggaauuacuauauuuuuggucuuugguuuacauuuguauuuaaaaauuuaauuucucuuuuccauuaaaauuuuucuucaugcaauguauuuugauuaaauuuucucccuaucuuaacucuuccuagaugaaguuagcucuggugguccuggaacucacucuguagaccaggcuggccuugaacucagaaauccaccugccucugccucccgagugcugggauuaaaggcgugggccaccacgcccggcugaaguuugauuucuuaacagcuuguuaaauuugugcuguauuaaggaucaggacuuaccugauguuuccucauguuguuuuuugucauuuaacuucacuguuuggauauuuuuaucauuauaaagaauuuuaaauacaauauuaaaauagauuaauauucuuguagauaacaaauuuuauguccaagguuuuaguacuccuaagauuaauauucuaucuuacuuacaaguuuuaguauuuugguuuuuguguaggauauacuuguacuuccuuuaaauagauuaugcacauuuaaaugaauuuaauacauuucaugcagaauaguaugugcuaccuauauuuuaauagaaauuuuaaaaaaugguguaaaguaagucugguuagauucuggggaacagaauaaaauacugauagaagaaacccacuaugcagaaccuaccagaauaugcacaugaagaacaacaaaagaugauguuuuuuuaugcgcagccacaguguuucacagugagcauagggaaggaaggcuugaauacuuaguggagaaauuuagaguuguuuuugguaauaguaacagugaacagacaucuaaauuaguuuauaacuuaaaggggauugucuguuauauauauuuagcauuuauuuggaagucaugcggaagauuaaggaaaagccucuaagguuaauuuuuaguuucuggucaauuauggaguugaguuuuaguuuguuuuguaggaacccagaacaccagggcugucucagcuuuaauggucucccaauuauuguucuuaauuuuuuucagauguuuaucuuuguaucugaguguuuugccuguauaauuguauauauacugugucuguagaccaugugaguaugccaaauguuuguaccauguuugugugccacuuguuugguguacccuuuguguacuauguucaaguguguacugcguauguguguagugaguuuauguguaccauguuuguguauguuuaucagauguguuuggucccuguggagagcaaaagaggcuagagaugcagucuuauucuguaugaucguugugacauuuuguauguggguuacgcuaccugaacucuggggccucugaaaggacaacaagagcucuuaaccaugggacuguuucucuagcccaccccuucugauuauuacuauuacuauacuacugcugcugcuacaacuacuacuacugcuauuuuaaagauuuguuuauuauaugaguaaacuguagcacagccuuacauaaauauuguauaugagugagaacuaaucaguuacuucaaagaaagaacuggccucauugacuuuugaagcuuacugcuagaaaaauagagugaacucaaagaaaauucuguugcuuuuaacuccguauuccagguaaauggugaaauuucucauucauaaguauaaauguuuagaggaaaagagauuuuagaaaauacuaaaaucuuauuuuguuuauguuugggauuaaaauauauuucauguaaauauugucaguugcuaacuguuaacauuuuuuugaguuucaagaggcagagauuaauuuuaugacacuccuuauuuggagcacagucacauacauaaacuauuuaguagaggaggcugagcuugaauaaagggugaauguuaggaaguuguauaguugcagggcucagcuaaacucauuucccauuuaguuuuauuguucuuuaauuugggaacagauuacauacaaaugcugaggguuuccccuuauuuuugucuucuuucaguugaaagaaauggagaugugaaaguguacuuagauagaacacuuuauugcacaauuaaaauguuauauuauuaugaacaugcuguauguacauguauaaaguucauauauagucaucauauacauaggucacacaguacacuaguaugucuuaucaaggauuuaauauuaguuaaguguaauacuucacaucuagguguacaauguggugauuagguagcguucuagacaguauucuuagguggcagcgagaaauaccauuuuaaacaaacaaauaccaaaguuguagcacaguuguauaaaugagaagauaucugaauuuuuccauaagguuuuauuuaauguugccauuggggucaucagaaaaauguuagauaaguugugaggacagcagauguuacugauagaaauugaaaucuccaaacuuuauggacaaacuaucgaaucgggaauuuuuucuuaauggccugguguaaaggauuggcaccauagguucugcacauuauuuuaauuguguuagcuggucaucucucacagaaguagccuuuaagaucaaaguagcuuuuauuuauaguuuucacugaacugcucaauaaaaacaaagcaacauauaccuuccuagaaguauaggcuuguugaagacgucaguagucuagaaaugagaguuuuuagauuuuuuuauucauucuuuaguuagaauuuugccaaccuaugaguagaugauuucuuuucuguauuuuuguuuuuuuaaaggcuauuuuauuuuuauuuuauuuuuauucuuuguccacuuuauauauauauauacacacacauauauauauauguauauguauauauauguauauguguauauauauauguauauguauauauauauuauuuuauuuauaacacagcacccauaauuuuguuuuugagauaggguuguaugggcccaaaacuggccuugaacuugcuguguauaccugaucauugcucccaccucccaaauucuggguuuucaggaguauaccgccauaguuggguuaugggaugcugagaaugaacccuauauugaugcacauuguacagaggucggcaggcugagcuacauucccaggacuuuggguuucauuuuuaaacacagaggugcaaggcugaauccuuuccugaacuugaaagcaacuugugaauuuuuauuuuuauuuuuuugagacagucuuacucuguaguucucucuggcuugaaacacuacauagacuaggcuggccuuaaaugcagagaaaugccugucucugccucccgagagcuggaauuaaagauuccacaucucaagcucucuucaagagcaguauguguuuuuaaucacugagccaucuuuccagcucaacuugugaugucuaacuauauguuuauuauuuaucugcuuuauucuuugugguauuaaagauuuaauuuagagacuuccacauauuaaguuacuuuccaguuaucugcacuuagccuuaaacuggaguuucaaauuuuagaauuuaaggcuuauauuuuuaaaguauuauacuaccauuagaguaaugaauaucccagacuugggcauucauuauuuaacaaagucuuagaucuuauauacugcuauauuaaaaauagcucuacacauucugcauuauuguaguuuaagucaaauuaaaagauuuuguuuuuauuuuuaauuauguauauguguguaugugaagggaugugcaugugagugcagugucuguaaaggccagaaaggggcauuugaucuuuuguaacugaaguuacagguggucaugagaugccugacaugggugcuggaugcuaucaucugcaaaagccauuacauacuuggagucaccuuuccaacucugcaucaucucuaauuuaguuggauagauucauggguuaaaugcugacuuaagaaauuuugagauuggcuuaguuaauugguaauuuuuuuuaugaauuaacuuccuuuuagaaguacauguuaguuagaccugguuacaaaagccagcaaucccaguuccauggcugaggcaagagaagcagucauaaacucaagaccuugucugggucacaagucagcucaaggccagucugggaaacuuaguggcugguuguagcucucugguagaauucuugaccaacaugugcagccccgaguucaauuccuaggaaaaauaauguaacauacaaccauuuauuuccuuaguuccucuagauaacuuuuaaaaugcauuugaaauagagcuggauaaaaacuuaacauaaguucaguaauauaaaugucaaccuguccugugagauacaacuuaccuagaauuaauuucuacuuuuccccccucuuuuuuguuuuugccaacauaaaguggcuaaaagccaagguaagagacauuacuuaucguuugauccacaguacuuccucuauguugacagaggcugcagagucacuaaaaugugaaaacuugucugucugcuuuucucuguaggauuuauauagauuaaauaugcuuaaacuuagaucacaucagcagcauuuagcuuggcuguguuaauauauccuagauauauugacguuugcacuuuaggaacauuaaucguucuaacagguacugcuuuugcucauguguuuuacaguugcuuugcuuccauugacuuacaguuagguuucccagaugugacaugcaauuuuguuguugaauuauuaggauaaagauuauaguugcauugaguauuuuagcagauugacagauuuaugguuugcuuuuaugcacacauaaugcauauauaaauguuuauucaaacauuuuaauucugauucuugaauaaguuugauauccaugaacaugucuaacaauaagauauaaaauuuacuagucucacuuguauuuuguguaaauugauaugaauagcacaaaauaugaugggaagaacugagcauauguggcuuuugaacuuuuaaaacuuaauaccaaacucuagucgaccugucugggaauccuuacuucacauucugauauuaagaaaaagacaucauguuaaaacaucaagagaacacguugauacagaaauaaaauuuuucuuuucacauuuuagcacggaaauaaccagccugcaagaacuggcacauugucgagaacaaacccucccacgcagaaaccaccaagcccucccgugucgggccgagggacuuugggguacaaauucagcucuuuucuacaaagaguuucugagacugagugcauguuuuguuuuuugaauuaucucuuguggaacuacccuuuaaauucauuuaguuagugugugugugugugugugugugugugugugugugucugucugugugucugugugucugugugucugugugucugugugucuugcaugugaggcaguuucacccucaggaaagcuauccaccuccuuuaagacagguugguuguuuuuuuggccugaagcucacccaugaagcuagaguggguggauauuaagugccagaguugccuguuuccccuccuuagcuuugaaauuauggcugccaucaugccaggaauuaaugaucuuuuagauauguauaaaugcguauccuuuuucuguuuguacacauaaaaauguagugggcuggagagauggcucagcaguuaagagguccugaguucaauucccagcaaccacaugguggcucacaacuaucuaaugggauccuaugcccucuucuggcaugcagggguacaugcagacagagcauuccuauauuuaaaaaagcaacaacauuuacauuauauauguuaauguaaaucugcuuuauguuuuaucuuaaauggauugaacagagagauccuuauagugcuuccacuuguauuuacaguacuuaugcuguggcucacugaauaagcggugugcuuccugaaguuuagcuuaguagucuccaucuucuguuccuccuguuccguggcaccuuaggcuuaggacucugccugaguggcucugacugcaucagcuagucacaggcccccuugcaccagaguagcuuuguggaaagcuggaaaagguaguggugacuucuugugguacuaauuguaucauuauuuuucaagguguuugugauggauuaccuggaaauuccauauuagauuucuugcuuuuguggaagguuccagucagcagcuagccaugugcgccccccccccuucccgaaaggcuuaugagugacugaauugagaauaauguauauuuuaauaucauauauuauagaucauuaagauuauaaccauuauuuuuagcauaacguuaaaugacccuuuccaauaauuuuccaacaaaaagcaacaaauuugaauuuuuauguuaaagcagcaaaguuuauauaaaaacuuuauaauuuuaaguagcaauuauuauuaaaaauguuuuugucauuaaagaguguguguuguguaacuugugcuucuauacacuuuguguaggucagaagagaauuuuguggcucuguguguguguguguucccaugugcgugcacaauacuccucuucccugguaaauugguuuuagggauugaacuaaggucucuaggcauggguggcaagcaccauuacucucugagccaucuugccagucuuuacuuuuuucgauuaaaguuggggggaaaaaguucuguuauacuuaauucagauagagauuuuuacaaauuuggggggaagugcugauugucugucucucuucauuacccuuccuguucuucauuguuagacggaauaccccuuacaaaacccuagagccuguuaagccuccaacaguucccaaugacuacaugacuaguccugcgaggcuuggaagccagcauaguccaggcaggacagcuucuuuaaaucagagaccaaggacgcauagguaagccuucuaccugaacaucugagcucuggaaguguguguugcugacugcugagcaaugauuucuaaagauacagaguuuuuacuuaaaaauuuauuuuucauuuguguauacuauaagccgauuauauuccuucuuuuugacagagauacaaguacauguugggauuacaacuaaaaaaugcuuuuuagaggcugaaguuugcauagugcuugccuuaacauacaggaagcucuggguuugauccccaguaccauacaaacuaggcacgauggcacacaucuguaauucuagcacuugggagauggaagcaggagggugugaaguucaggguuauccuuagcugcuuagugacuuugagaucauccugggauauaugagacccugucuauaccaaaacaaacaaaaagcccaaauaaagcuuaaaauuguuuugcuuuccuaaauuuguguauaagauauucuucagauaguuuggaacaaaguguuuuaguaguaacccaguacugucaccacucccgcccaccugacccaagacaagaaugcuuauuaacacaucuuuaaauguuguaagguagggcuaugguuuguauagcucgguuuuaggauagauucuuaguaugaaugagacuucugaguucauuuaccaggaacucuugcucauuaaaaugggcacagggaaaauacucuuaaaugcucuuagacaaaggguuacguguuguagaguuuuacauagcauauugaauucuaagaagucagacgagaucacucugcuuguuucugaagacgauuucagaaccgaguugauaaugagguuguguuaacaguucuugagaaagcaguugcccagugcugagauacccagcuuuuuauguuugguuuugccgaauuacagggucaaaauguuuuuuuuuuuucucauaguggagguaguaguacuuuaaucuuauucaacaacuaguuauuugaaaugacuguguuaaauaccauucagaaacuaguaagacauaguuuuguuguuguuguuuuuccagaagcuuauuguauugaaauacuaacacuuauuuuaaaaauauauuucuagaaugucauuaugucaggauuuuggaauuauuuaaucauuguugcaaauuuagccccaugacaaccauagacaauuuguaaaugagugaacauagugagcuauggauggccuaguuaaauuuugcuuaugguacuaaaauuugaauuucauauaauuuuaauuuuuugcaaaauaccauccucuuuugaguuuucacuguuaaaaaagguagcucauagucaaaaauuggacuguuguccagcuuuagcccacacaguauaauuugccaccacuuaugccuauuuuagauaaaaagcaccaaagucaauaauuccagaagauccuauuaguucauuaguguacaaauauuccugagucugacauaaagcugaguagauuuccugacuugaaugaguugaugauuucauauauaagccaguuuguuuuaacaguagaucuuuuuauugaaaugugaucaggaguuugaaacuagcccgggcagcauaguaugggucagguauuguagacaguuacucucaggaagaaggacuugucuuggagggaguugaauagaguuucuauagcagugaaaccuaacuaccuuuaaacuguugccuguuguuuaguuuugcucuugcugugaagggaugccaugauccaggcaacuuuuauaaaagaaaacauuuacuugguacauucuuuuuuuuuuuuuuuuuugguuuucugagacaggguuucucucuguguagcccuggcuguccuggagcucacucuguagaccaggcuggccucacuugguccagucuuaaacagagguugaguccauuaucuucaggacgggaagcauaguggcauaggcauacgugguacuggagaaguuguuaagaguucuacagccagauccacagccagcaggaagaggcuuugaaaccuuagggucuacucucagugacacacuuaauccaacaaggcuacaccuacuuauccuucucaaguagugcuauuuccugaugaccaagcguucaaauauaugaggcuaucaaaucaccacacuuauuuuccagaaaauuccuuaucaccugucuucaauuuguuuuuauauauuuuuuauuuguuguugguuugcauuugaggcaagguuucacuguguaaccuuggcuggucuugaacuuuuuuuuuuuuuaaagauuuauuuuaugucuaugaguacacuguagcuaucuucagacacaccagaagagggcaucagauccaauuacagaugauaaugagccacaaugugguugcugggaauuuaacucagaaccucuggaagagcaguuugugcucuuaaccucugggccauccugggacucaccugcuucugcuuucccagugcuggguuuaaaggugugccgcugugcucaguuuguuucuguuuuggaaacguggcuuugcuguauaggcuagacugaccuagaaguugccauacuccuucaucagccuccuaaaugcagggauuacauuagugugccaccaugccccuuuuacuuuucuuucagauagggagaaauuguuuuuccugauuuucagacaaggauuaugcgcuccccccccccaauguucuuuacuuucuuuuuugaauuaucuguuuucucauguucuaguauagaguuuugugaggguaugguucacaguuccuuucugagacagaaggagguuguuguaguuaggguuuuacugcugugaacagacaccaugacgagugcaagucuuauaaaggacaacauuuaauuggggcaggcuuauaggcacagagguucagucuauuaucaucaaggcaggaacauggcagcaucccagcaggccugguucgggagcagcugagaguucuacauucaucuaaggcugcuagcagaauacugauuuccagacugcuaggaugaaggucuuaaagcccauacccacagugacacaccuacuccaacaaggccacaccuacuagaacaggaccacacccucuaauagugccauuuccugggcugaacauauacaaaccaucacagaggggaaacaagagccucauuauguaugccaggugguuucagacucaagaaccucuagacuuagccaguacugaaugugcaguaugccaccacaacaggcuguuuacucuuagucacagcaggcuugaaauagacauuuguaacucacugacugugagauuucacugcucaagacuuagacuauaauuaccauuuuaagacaagguccuauuaugcaccccuggcuggucuugaacacccaaagauccaccuguaucugccuucagagugcugggaauuaaggccagguaggguucaaaaacugugcuaguuacuaguuuuaaaguucuugaagaacaguguaacacaagaaccauuuuaaauaauaggcuaaagguuaaccaaguuaaagaguauuuaguagcuccaguuuagauuaaguuuuuuuuuuuuuaaaucaguguauaaaaaugauuuuccaaugcuucucuucuuugcaguggaaguaguggaggaagcggaagccgagagaacagugggagcagcagcauuggcauuccuauugcugugccuacgcccucaccgcccacugcgggcccagguacgguaguuaguacccucagcuucacuguguugugucuguucacuuuauuauggaggcuaaaacacucuauguauauugaaugaaauuaguuacuagauuguggcuauugcuauaauaaaggcagauauaaaaauaugauauuuuuagauuaauuuucacaaaauuguuaggguuuuacaagcuguaugugugguacagagaagucacuuuguuaagucaguuuuggccauuuuguuuuaguaaauguugccuuucuaauaguuugugauguuuauuauuucaaaagcaaaccauuuugcauaauauuucauucagaaggucaguauugcuaaaccaauguauuugugccuuccuauuuauguaugagauucagcaccuguuuuagugaaaucuggugaauauaagaugauauuuaaaaauaugaaaauuuauuuuaccuuuuuagaaaguauguaaauuuaagguauucugggagaacauucaguuaacccuuugaaauugagucagugaaauguagacuuuuuugagguagguuauuucuguguagcccaagcuauccagaaacaaaauguguauauuaaaaaaaauguuugaaagguaaucauaauaaaaaaaugagaggaaacuaucuuaccuuuucaaaguauuguucaagaaaaaugauccuguuauaaacacaggcucauuuuguggguacugcauuuauaaacucauuugaacuuguuuuauauacggauguuuguuuuuuuuucuuugucuucaauaugcgguauuuuccugccauuuuggaauuuuugguucuguuuucuuacacuccgaucugagugauaaacuauuuugcuagaaaacauugugucuggcuuccuggagucauacuucucccagugaguguugcugaugagacuguguaggcguuggggaaccauuagauaaauuuuacauaucugcacuuaacucuuguagcugauagauuacaaguugcugcaguuacuggauuauagaugguaccacuaaaaguuaaagaauuaaaucuaauuauuucuaauuucuucuggugaaggaccuuugaacuuaacacuauaagaacacggagaagacucuuuauuaaauacaaugugguccuauguaugauuuacaacaaacuuaaugggauuuuuauuugugauuuauuuagauugacaaaaacuggcaguuauuacauccagucaaaggacugggcugaagguggagauaggaaguggaacauggaaaggaaauagagugugacugggcugcuguggugcuaucuuuuggauuauucuuugaaaauuuuugcagcagcccagguuucagauagcugagaaugcucugaaguaacuuuaucaauuggaugcauucaaauugucuuuaaguugggaaggacuagacugaaugcuaauacaaagaauucuagauccaggcugggcaguguguggcauauacaggaggcagaggcaggcagucucugugaguucaagaccagucugguugauguuacacagagaaauccugucucaacucccucccacacccaaauuuacauucaguuuagaaguacacagaacuuaagauaaauaaugaggugucucuuaugagaauuaauuuagaugaaauuaaacugaaaauauuuuuagauuauuuuuuuuaauauuuauuuauuauauguaaguacacuguagcuaucuucagacacuccagaagaaggagacagaucuuguuacagaugguugugagccaccaugugguugcugggauuugaacuccagaccuucagaagagcagucgggugcucuuaccugcugagccaucucaccagcccuagauuauuuuucaaaacauuuauguauacugaggaaaaggagagggaaggagauaauacaaaaucccauggauauagaaaucacugaaagaaagucugugagccuggaagaugauuguugaagccacaguggauaaguaaaaaugcagacagacagcucaccuuguugggguguguggaacuggugcuauacugcugguguuuguugauaugcuugcucccuuuaccaaaaccccuuuugcuuacuaaucaagguaaacagcaucuuucagugucagucuuagguacuaacaucagaacauuauuucucagaaaacucucuguuaaguuugugaggucaaagcuauuacaugucuuuuucauccucauucugucagaauuuuuuuuucuagaggcuccgugaagucuuuguguacuuguauauaaauucaccuuaaagcugugucaguuugaauauggucauuucauguagguguaacccacuccagggacaccuaauuuuuaguuuuuaagagucgacuuaaagaaaaaaauguuugcuaacugcuuacuuagagcacuaacuuucagagcaauagucccaaauugguuauuaacguagaggaauuagguagaaauuucaguuucagaacucauccuagaucuacuuuguuaaaaaucuccgaaaauggaacccauaaauuuccauuacaacaagcucucaaggggagauuuucaucagugcugaagcguagggaaauucagggacuauacuuagcaguguucauucagaaggagugauaguucuuaguguuagaauaguaccuaaauacaaccuaaauaauuaauaacaguaauuacuaacaguuauaaaaaucagaaaaauauacuuagcaguuuaaauuuuauuguuuacuuuauuacuuauccugagcuuuuuagccagauagaauuuuaaaucaaauuccgaaacuuggcugugaagaggaagcuguuuauaaagcagucaugaaugacccacagcuaacagcuagugccuuacucagacugugugugguacucauuuuguuggagccaguguacauacaaaagcuuuauacacuuguccuucauccccucaggugauugauucuuguacaccccaccuccaauagauacaaaauccuuagauaacucaaguuccuuaaucaaaugguguaguacuugcagacaacuuacacauauauuccuuuucauauauuucagauuaucccuggguuacuuaccauaccagaguaguuguucucgcgcauugucuagugaacauucugaaaugcacauguaaauuacauauagcauuagcaaaauagcauucaggacuaugcuuauugcaaaggauuagcaaugcucaaauggucacuuuuguagcucuuugcacuagcugucuucuuguuuauauacuuuagaaguggagauaauuugauuuucaucuucuuuuuuuauuuuaugucugggcauuccaaaaaaaauaagaacccccuccccucuguccugucacuugggguguuuguaaugcuuucuugguugccuuugacuaaugcuuuucagcagccccuggcgcagcuccugguucccaguauggcacaaugaccaggcagauuucucgacacaacucuaccacuucuucgacaucuucugguggauauagacgaacuccuucuguggccgcccaauucucugcucagccucauguuaauggagguccacuuuauucucaaaauucaaguaagcuuguguuugcaggcauacagcaauaguggagcuccuuuuuaaaggaaauuauuugaaacuguuauucuugacugugauagacaacaauuuaagccaugcuauuucaugcuuguuuuugcuuugaauguuaauccuugaauaaccaucuuaaauauuacugcuuauuuauucuccaggguucacucaaguauacuuaaucuaccaaauucaacaaauauuuuaaugugcuauuauuaguauuacuacaguauaauuugaacuagagaacaaaacaaucuuaaauuuuaucagcaugauuuugaugguucaguaaugguacgaagacacaaacacagccaaagaacuuuuuaaagaauuuaaugaaaagaaauugcuggcuaucacuucuaagguugugaccucuuuugaaaugcuuucaaaugaaaacauuuacaaugccugcuuacuuucucuuucugaauaauucuaacaggugggagggauuuucuuuugauuucccuuuguuuacuucaaaauacacaucucaguacuaauuacagccaguguuuaaaaccuuuuacagaaaauagaguuagaaaggaaaggcuugaauaucugaggauaaucauugaguucacuuuccauguuaagauacuaaauucagaacaaaaauaguuugaaauaagccuguuguccaguauuuguuuuugucgugaaguuacuggguguggcugacagguuuuucuauggcagcuucauuuuaaguauuucuagaacugaauguucuauaaaaauaauggugacuacucugcauuacaugggauuugcuuggcucuuuuauuuguauucauauuacgugcauauuuuugguuuuugcuuguuuguuuguuuuuuuuaaaagacaaggccauacuuuguagccuugaaauagcuuugaaaguuagugcucuaaguaacuggccuggcacugcuuaagucauacuggccuugaacuugcagcccuccuucuuuuugggaugauaggcaagcaccacuaugccuaacuuaaguagaggcuaauggucuuuuguuuaaaauuuugaguuagaggguaacugaguuauagcaaauugaaaaccauuuugucuuaaaugucuauauuuacagagaaccucagauuuuauacagcuuuuuuuccagaccugaauuuccagaauucaggcuacuaugaaauaauaaacucuugccugcuauuuuacuucacaucccccuuuguugauauugagugauagccucagugucugaaugcucuguaacucagucguuuaggugguggugguuguucuguuuuguggagauaggucguucuggaacgcaguauggcguucaggcuggcuuugaauguagagaucuaccuacuucugccuccugaauccuagaauuaauggcauauacaaucaagacaaauuaguuguuuauuccacuagugucugaacuuucuuuucauauucugcuuuuuccaucccaucuuuaugaucauuaucuucccucccccacuuugucuuuaaauuuauucugcaaauaggguuuuuaauuucaccaaucuacacuugucuaguuucacacauguuugugggauacuuccuuaguaaauaucaguauucuuuuugaaacuggaaaggaaacuuagccugggguguaaagcauguuuuguuuuauccauuuccccuucagucugagcugcuggugcagguuacugguacguggcuguguuuagugcugugaugugccgcuuccucuccuuauaugugcuggugaugagcaucuucauaguaaccuccugucucuucucccacagcuaacgagcauggcuagucacuaagggcucuuucuugaaacuauuuugacuaaugggaggcuuuuuuguuuuaaaaucaauacucuaaccauuuaacaaguguucucuguaacagaaugaaaaccaguuucugcuaguaaauggaaugcuguuuuuagaucuguaugaacuaucagcacauauauauuucucuaacuuuuaacuuggaacgucuaucacauuuuuaugcuuaccaacacauuuguaccuuggauuaaaaugauaaauauuagggaccaauaaaguuguuuuucuuggauaauguaacaucacuuaguggugaccacugggaaaccgaucuuuccacuugaacccauugacuuguuggaucuucagcaauuacugucuuguuaaagagacaaaguaaacauaucuuugcuucuaguuuguggcaaucuuucauauauuuguuagucauaggaacauuugauaccaauuucuuauaaaguaucuccugaaaaagguuacacaugcuucaagccagccaguaucuggcugcauuauauuaaucagaaaugaauauaguacaaauaauuauacauuuugacugauuagagagauuaaguuuccuuuuucaguauccauaaaaagaccauauuugauaacuuccccucagagacugaaugauuaacuauuagguacauggaacacucuugucccuuaguaaguucagggcugauuucuuacaaauaaagcuggcaauuuaaaaaguaacaaaucuuacuuuuguaagaaaauauuauccagagaaguauguaaauuuagauauauaagcacuuucuucaaagguaacucaugauuaaugcauugauuuaucuacauauuuauacauguaaucaacagcuguuaaacauuauuugguuuuaaaaaccaaauaauguuuaacagcuagacaggucuguuaguuuauagacuuaaagcaaaacaguuuguuggcaggcucuguagauguuuaaguguaacauauuuuagaaguuuuucuuugaaaagcauugugcuaaaauaaauguuacaguaaauuaaaaaguuccccaaauaauguaaugcuagguuaaaaguaaguauauuuauuauuuuaugcacuuauccuauggcugagcacaguguggccuuagguucuguggggacaaaaacuugaagaggguagcaggguuuguuuguuuguuuuuguuuuguuuguuuucauuugcagacuguucuuggcauacuuauuuauguuugugguccuuguaacugacuucugcuuuuuguuuguuuccuuuucuuuaucuguuuuacuccccauacugugucuugcugccaguuucuguugccccuccuccuccccccaugccucaguugacuccacagaucccucucacaggcuucguggccagggugcaggaaaacaguaagucugggaacacagccgucagagauuagaggcugucuccucuagcaugcauggcugcugagucaccauuuuccuucuuacugagaagcuaaucuuaccuugaagaguagguacaguuauguguuacugaaacggaagagcacgggcuucuguucuuuucucuugucugcaugauuacugacccauaucaauuucaaagcugcaguuugcuuaaguauuuagaugaucuaagcuaugagaucuauuguauauuuuuaagcaaagaguaagcccaagaaggcaaauuauguugaaauaauaguuacuaggacaauuagaaaacacuuugcagcuggguaugguggugcaugccuguaauccuaauuaccuuugacauuacggaagauucuauguguccugagugaauacuguauggcaaacgaaaaguacaauugcugaauaauuaaaugucagucauugaaauuaagauaguauuuaguuccauuuuacuucauuuggaaucuucuuagaaauacauuucagaauuguuuuagaaaugagcuacuacuuaagcagcccauccucaguacaguaaauuuuuugcaaauucuuugucaacguuuacugacucuuauaaugcuucucucagucccucccuuccaccaaucaaauauuguuaugcaguguuauaugauagguucugguaagaauacaaacaaaaaguuuaagacagucucuucaugagagcuuauugcaaauguggauuuagaguuuugaaauuucugagugcaaacccucuuacuauuaacuucaguuucuuaaguuuugauguucuaagcaauacccaaggccuuguacauguuaguugagcugcucuaagucugaguuaaaugaaugacauucucaguuccuggguuuuggagcagaucuccuguuucacuaagcuggccuuucagcccuucugccucagccuccugauagcugggauggcagguggguuuaucaugcccagagauauugucguuucgugaugcugauacgguuuagaaacuaaaccugucagagguggaagauuauaccagucaauauuuuuacacugcuucaucaugaagaguucuaggaaauaaguuuaauagccauugaaaaaucaacuuugugggccuagagaucauuggcuaacugauaacuggaaacaaaacccaguguucuuauucauuauucccaaagagacaccuugacacaacuauuucuguucuuuuuaccaaacacaugaaacacaugauauugagcucuuuuuuuuuuuuuuuuuuuuggcuuuuuggcuuuuuggagacaggguuucucuguauagcccugacuguccuggaacucacucuguagaccaggcuggccucgaacucagaaaucugccugccucugccucccgagugcugggauuaaaggcgugcgccaccacgcccggcucaaauucauuauucuuacaccacugcuauuccaaguuuauuuucaaguuuuucuaagcaaguugaaauuaagaaauuguguaucagcacuuuaaauauuuuaucaaguguacauauuuuaugugcuuuuuaaaugccaguguucugauacucagaggaagugacaauaaaugcauguagcuguaacccagucugguuuaagauaugagccccuaaugacucaugccuuuuauuauuuaacaucagauaggcuuuuggacuaaauaugcauaguguuagguaaaguacuagggcagaaaauuggguugaucagauuuuugccauaaaauugaagauaaaccaauguauacuuaauggcaguugaauggaaucuucaaccaguauguuguagaaaugaagagugacagcucuucagggaaucaaacaaacauguacuauacacauuaagccaauuuagggugugugcucggccuguucauagccacucuuccacauaaacaagcuuuauggaggagguguagguauaggcagauguuucguggaucagugcauguaguagacaaucuaacuguagaccuguuagauuguugugagugagcaucaccaaguagaauuuauuuuuuauugucuuuaucaucucaaggauuaaacuagaaagcacagaauugaagcagaaaugaagcaggacuguuuucugcuugcuuuaaacuagccucuugcuuagaucucaacuuacuguccucagucaggaacaauaaccuauaaaaccuacaacaguuaauacaagaaccuuuccuuuuuucuuccucucaccuaaaagacaagguucucuuuguguagcuguggauggccuagaauuagcuguguagaccagacuugccuugaacucagagauucccugagcuucugccucccaagugcuggaaauaaaggcaugcacuaccuucccugauuuuucuccucuccccuaaacuuuuaaaggaauuuguggaguagaaguuugagcauuaguuguguuagcuuugaauguuuuaaucccagccgcauugguggccaaauaaguacaguucuagucccacacacccauuuuccuguuaacaccuucaguucuuuaaugcauguguacacauaccccagccaucuagaaucugaaguguguuucauuuuuguuuguuuauuuuuauuucuuuuaaaauuacugcaucuucaguauuuuauguuuaaaucuuaauuguguuuuaaguuagaaauuggaucuuuuggaucugguaucauuucaugcauuguuuuauuagccauaaugcaaaaucuuaguuuccuuucuucauuaaauuuugacugugaauauaacuaauuuguuuaaagauacuccaugcagucuucucauuuggaauuauuuuuuauguuuguuaaaacguaaguaaaaacagaaaacaaacaaacaaaacccuacacaaaacauuuaaacaugauaugaccaacuuggcuuuacucuuuauuaaaacaacaaauaaaagauagguccacuugugauguaguuucuagggcacuaaagcuaccaaaagccaaaauugcaggccugacuauauacaucguaaaaacugucagaccucuacuauaagaaacuuagggguauuccaugacagaguccccucgggcaacaaggccgagcaaggggagcauuuguuuucacuugagacuuaggauaaagaaacuucuuuacuccuguaauucuaaugaaagaagauacuguauccucuuacauucauuaauguaguauuuauaugcuuauuuuaucucauuuuauuguugcaaaaauugugcuuaaaauuaaaaguaguauaaacuuuaacacacccagcuuuuacuucuaaucacugcauguuuuauauagugcaugcuauaugaguuagaauuguuaaauucuguuaauuuaaaauuguuccuuuagacucauuacuuucugaauccuuuuaguugcugauagcccaacuccaccaccacccccuccaccagaugacauucccauguuugaugacucuccgccuccuccgccaccuccuccuguggacuaugaagaugaggaagcugcaguaguucaguauagugacccauaugcagauggggacccugcaugggcucccaagaacuauauugagaaaggugagguacuauuuucauggguugauguaaaguacaguaaccuaauuagaguuuuauuacuguuuuaaaaaaugucucagccaguguuucuuaccuguaacugucuuaccagucaaggugguagcucuuacuauguauacuuuguguuuuucaggaguaugaaaaggagacuauuucuuuauacuuugaauuuaaauuguuagaugcaucuuuucaaaccauguaugcuucuagcuucagauuaacuugcuugccuguguuuuauagaucaaacauuuaaggcacaaaauugagcuaaaugacuuaacaguuauuuaugaucuuagugaugauuuuaaacguucccucuguccccacaucuuaccuugccccuccccucuccuuucccucucccucuugucuccuuuuuuuuuucucaagacuggguauaguuuagauuuagauuuugcuugcuauauugacucaacagguuuguagcucaaaguuuauauguguguguguguguguguguagauguagauguagauguaguguguucaguaaaacuuuauuuacacaaauugguaguggagagauggagaaaugguuuagaguuaagggcauuucuuacagguucaguuuccagcaccuacacaacacacacccaucuauuacuauaguucuaggagaacugaugaacucuuguguuugacuucuggcaccaggcaugccugugguucagauauagauauacagacaaaauacucaucacagaaaauaaaauuuaaaauacauaaauauaaagaaggaauggugauggguuagauaugccauuggggugugugucuguguguguguguguguguguguguguguguguguguguguguguguguaaaucaaguuaauuuagcaggauuuaucauauaccugaaaucacagcacccaggaggcagaggcaggaggauuauugcaaauuuuacauuagccugguguguggagugauuuuucucagccuucugccaugggcagacaagaucuaguaggauuauugucauacuuaagggugcuguuguuaugguaaaacaacaugacugaaaucaaccuggggaagaaaggucuuacuucauacagcuuguaauagaagucagggcagaaaccuacaagcuguagaggaauguugcuucucuuagcuugaucagccugguuuguuguuuguuuuucuuuugaguugcauccaagaccugggaguggcaccauccagaaugggcugaggccucucacaucaaucaagaaaugcauuacagauuuacaggccaaucuuacugagacauuuuuuucaauucauauuccuuccucccagauauguuucuagauugugucaaguaaaccaguaugcuuacauuuagaaguuuuaauaaccacuuucaugaugacaagauaaugaaaccuguuuaacuuggcuaauaaguuuaugacaugacuauuucaaaagccuuguucuuauugauacuguaucuuuaaccuaauauaugccgaugugauacuggucucuguauuaaacuaauagacaaaucccagaaagccuucacaguagauauaaaagggagaguuugaauaauagaaucaacaucaaguuauuaaugguaaauaguggugagagaaauuacaugagggaguguguacauugacaugagacccuuacacuuacaaaggaaaccuagaaagcaaacacaauguguuuuaguacuuuucugagcuguuugcauuagaggaacuaagaacuugaaguaguuuuuuauucugcucaaagauaugaaugcuuuaggcuuuuguuagucuacaagacugaaucucaucacccugugacucuagauaccagaguauuaccgaaguuaaauuaccuauggagcuuuucuuaauaauugaucuuuugcaaucacuugauccuuuuugcuaguuaucuuuuuuuaaaauuuuuuauuagguauuuuccucauuuacguuuccaaugcuaucccaaaagucccccauacccacccccccacuccccuacccacccacucccacuuuuuggaccugggguuccccuguacuggggcauauaaaguuugcaaguccaaugggccucucuuuccagugauggccuacuaggccaucuuuugauacauauucagcuagagucaagagcuucgggguacugcuuaguucauaacguuguuccaccuauaggguugcagaucccuuuagcuccuuggguacuuucucuagcuccuccauugggagcccugugauccauccaauagcugacugugagcauccacuucuguguuugcuaggccccagcauagucucacaagagacagcuauaucuggguccuuucagcaaaaucuugcuaguguaugcaauggugucagcguuuggaagcugacuuugauaguauuuaauuauauuuuuucaguauauuuuaaagcuucgauaaacuauggagaucauaaucaccauacugugauuuuuguugcagagcuaaaauggaaggaaaugggcuuguugaauucauauacuacaguguauuggaaugagaaaagacuaccugguuaacuuaauaaauggugguaaucaaucaguacuucaaaucucuaguucaccaaguuagaguuacuaaugaggcaagccaucuuucuuagggaagaaaauaauucuggaccaucauaaauguuuuaaagauuuguauuuuaagaaaaauacuguuaagaauaaaugaaaaauaaaaucauucauauauuagucacauauaguagaaaauuacauguaacuuuagaaauauaaaaaaauggguuuagcgggaauauuuacauuuacaaaucaauaguuaaaguaguaugcaucugucuuagucacaaacaucauaacaaagaagcaaguuggggaggaacggguuuauucagcuuacacuuccacauugcuguugaucaccaaaggaagucaggacuggaagcaggucuggaagcagguagggaugcagagcccauggagggauguucuuuauuggcuugcuuccccuggcuugcuuucuuuuuguuguuuuuuuuuuuuguuuugguuuguuuuuuugguuuuuuguuuuuuguuuuuuccagacagggguuucucuguguagcccuggcuguccuggaacucacucaguagaccaggcuggccucgaacucagaaauccaccugccucugccucccaaguccugggauuaaaggcgugaaccaccacuccccugcccugcucagcuugcuuucuuauagggcccagggauggcaccacccacaauggucccucuccccuugaugacuaauugagaaaaugccccacaacuggaucuuguggaggcauuuccucaacugaagcuccuuucucugugauaacuccagcugugucuaguugacacaacaccagccaggacagcaucuaaguuguuuucccugcuuacaaaauggaaagauagaguauguuaaccagaaaggaagaagaucuccaacuucgucacacuuucuggggcuuccuuuacuuuugccaacuuuuaaaacaaaacuuuuaaaaugagcagaauuuuuuuuuucuauuuuaaaaucugaguuuaucaauuaacaugggauuuugaauauauagauuuauuacccaguaaaugugugauauggucaaauuaagacagcuugaguuguuauuuaguuuacugaauggcuuuguucauaauacauuaguaaccuggcaguuugcuuagauacuccacauauauuugucugaaugaauagaaauacugacauaaugccugguucugugggaguguaagccaguagugcucuggucugagaccacucugagcuaaauagugagaucagaaaaccaaaaauaaaucuaaaaccaccuaaauucagagauuuaaaaauuauuauuacuccauuuguuuaauguggaaggacauaugccacugugugugugaagauuagagacagcuguuagcugccucuucuaccguguaggacucuagggcucaaauucagaccuucaugcuuggcacuuguuuucaagcugaguuaucucacucacccucagguguuucuuaaagagaauuuaguaggaacccagugucuucuuucguguggccauauugucaauguggucaauaugucggguaagugauuuagggacuugauugaccauuuacuuauaccgauagaaaaauuaaguccaucugggcggaggcagcagcuguaccuuuaauccuagcacuugggaggcagaggcagguggaucucugugaguuugaggccagccuggucuccaggacagccaaggcuuuuuacacagagaaacucugccuagaaagaccaaaaauaaauaagugaauaaauaaauagaccaaaaauaaagaagugaauaaauaaauaaauucccacuaaaaauacuuaguuuuucuaaacuaauuaauuggcauuacauuuuaaaaguaaauguucaagauaguauucucauguuauacuuuguuuccuccacaguuguugcaauauaugauuauacaaaagacaaggaugaugagcuguccuuuaaagagggugcaaucaucuauguuauaaagaagaaugaugauggcugguuugaaggaguuugcaaucgagugacuggacucuucccugggaacuauguugaaucaaucaugcacuauacugauuaguuuuucuuuuuucuuuucauguagguuauuacuccgucauacugugggauuauaugguuaacagaauuguuuuaauguuuaaaaugugcccauauuuucaaggacauguuuuauugguauauuuggaugucuaccuguaagcauaaauuuuggaggcaguucaaacauugcugagcagcaguuuauaugccuauaauugauuaugcauauguacucacaccuugcuaaguuuaugaccagccuaaaacuucuggggauuggguauuauguuuaacaaaucaugguucagaaugcaccauuacauguuucagugcagcauggucacuaacauugugucagacuaauaggaaaaaacagaaaacgucaaugcuggugcuggucauacuuuugguuucaauucucauuuuuaaaaaaauacuguguuuaaagcaugcauaaauuuuuauguauugaaauauacuuaacaauucaagaugcuuccaauuuguguaacgauuaucuggaguacucauacuugagucuccuaagcucuccaugugaaaugaaagacuaucuguaauguuguaauuuguaucuaaguuuuuuaaugagugaaauuugcauuauaaauuuuuccauucauaaauacauaagugaaccaaaggauuuuggccucuccuuuacugguuugcuuuaauuauguaugcuagugcauaugcaugcacacccucccaccccuuuaagaaagauuuauugcagaauuaugguucuauuuucucaaugcaucaguuuugaaaauauuuuuagcuuaaucuuaauguguccaaacagucaaugugacagaauuuugcagauuuuggagcuagacugugucagaguaagcacaugauauucugggggcaacaucugaaggaggagugccacaccgguccuuuggauuuuaaugaaacugaauuuacauugacucagugaaaggaaaauccuuuacauauuguaaagauggaugcaguucauuuguggauaggcauauuuaauccauucccuggcacuagaaacauaaaauuuuacaauaauuuugaaagaaacuaggccauguauuaaucuguaaacagguaauaagcagguuuguauuguaacuuugaugcaacacaugcacuuugugugucuccuugauucaagggagggugugagggauacuucucuuguauauaagacuguacugcuuaggauauuaaaguagaucacacaaguguggguuucuauguacugaggguugcagauuuaugacagcauagugaugagagcagugcaaaauauuucugaaaauuaaagaccauuguuccuaccaaaucaaugauuccauauauauuuuaaccuuuguuauuuuugaaguacuaugucauuagcaaucagauagcuuuuuauuaugcauuuccuuuuugaagcaaaauguuuucuucauuuguaaauaaccuguugucuaaauuuuaucuagucuuuuauaauaaacuaugcuccuauaugaaaaauuuggauauuguuaaaguauaacuaauguggauuuaaauaguacagacuucaaaauucucugaccuuuaauccuauggugaaacaaagacaaaccacuugaauuuuaacguugauuauuuauuuguguaauggcuuuacaugugggcauuaacaguguaaacaauaccacauauaaccaucaggauaccucgauuagaauuuauaggacuauaaugacacugguuuaauuacauuuaaaaaguuuuccgaaaaacuuugccaauaaaaauugcccaucaauaagguugaaauuauuucuuaaaaugauuuuugguuuucugcacaugaagcaaauaguguuucacaaaaucauuaggcacagucugguaaaauagcugccagaaagaagaggaggaauugucauuuaucucuggugagcacacuuucugaaagcugaaugagggcgucccuuucuguagauggucuaagcuuccugaucucucucacagcuuuguggcaguacugcugggcg

SEQ ID NO: 664 - RNA, 3066 nt, Mus musculus
uaguaugugcauauguauauaauucaagggaaauuuuugagcuccagauucagugagaaauccugucucaaaaaauaaggugaugaucaauaaagaaagauaucaguacuuuaguuacuauucaauugcuaugaagagacaccaugacuaaggcaacucuuaucaaaggaagcauuuaauuggagguuggcuuacaguuucagaggcuuaguccauuaucaucauggggaacaugguugcaggcaggcagguaccagagcaguagcugagagguugcuaagcauccugaaaaucuuugcuaggaugagaggaugggguuuagcuuaagcuuugaaaccucaaagccuacccccuagugauacacuaccuccaacaaagcuauaccuccuaauccuucuaacccuucucaaacagugccaugcuuucaaauuaacuaaguauucaaauauauaagcauaugggggccauucuuacucaaccaucacaccuaauguuaaccauuuguguccacauauacaugcacagaugaguguauacacacaccguacaugcaugcagcacacacauaaauacaggagcaauauaaaaaagaaaaguaucaaagugguuuucuuuguccucuacaacuaacugagacuuaauaucaaacucuaaaguuaucaguggaggaucugugcccagcuccauccaccucauuguucaaugugagucuacugccaccuaaacuuuucugcaggccaucuagcccucccccauucacguugccucccaucucugucucuuaguccuggggcuuuggcagguugacucuaggcucccugauuugugauuacuuccugagauugggcccccacccaacucaguguuacauaguaggaaauagacuucucuguucucucauuaauugcaucggaaugucuuauggacccuaacuggacugaaggcuugcaagauccuugggcuggcugggcagugguggcgcaugccuuuaauccuagcacuugggaggcagagucagguguaucucugaguucgaggccagccuggucuacagagugaguuccaggacagccagggcuauacagagaaacccuaucucaaggaaaaaaaaaaaaauuccuugggcugguccuauggccagucucuuggucagugcugccuggcuuaccuucugaauaaggcuucuguuuuccuuccccuuguagaacuguguggcucaauguauauguugcuugccccauuuuacugaauugcccuucuguucucagccccucucaccuaccuaauccccuaugcugugaugugugaugcucucccacuuccuggaggagagucuauucauuguuacucucauucuucucuuuuacuacaucaaacaggcaaccuuuaagccuccauguucauagcuggcuuacuauaaagacaccagucacauugaauuaugcccugcauaauccugcucuaauccaaaauaaccucauauuaaguaauuagaucuauaaaugauguaguacuuuuaguggaagaggugaaauuuagcccaugauauaaaugugucuuuaguuuuugguuguuguugauggacuuguggauuuuaacccaggcaugugcucuacaccugaaugucaguuacuucccuucuccucaggcuuacuuuaggguuugauuuuuuuuuuucuuuauuuguuuguuuagaaggggaggcaggaagauggaaugagcccaaaaagaauauacuguggaggagggagagauaggucugugcuuaagcacuuguuggucuugcagaggagcagaguucaguucccagcacucacacaaggcuacacaacaacugccucuagcuucaacuccaaaggacuaaugucuucuggccuccaggcacaugcauacacguggcauucacuuacacagacacauaaauaaaaauaauaaaaaauaaaccuuaaaaaaaacaaaagugaccgcauagggagaaagaccagcugucucaacuaacccagaccccgggagcugagccaccagccagaggcaugcacaggaagguugcagagccccggcacauacauaacagaggucuuccuggucuggccucagugggagaaugugcacuuaauccuugaaagugaggccucagggaagggugaggccugauuggggggaggaaggagcacccucagagaaaagggggaggaagaaugggaugagaaauuuggacaggagacugaggaggacaacaacuggaauguaaauaaauaaaguaauuuaaaaaccaaaagcucuaccuuuaauaaagauguauguacacgucugggcauacauguacauauacauaugaaaaugcaggcacacgagucagaaaacagguauucauccucaucugcuuucuaccuuguuugagaaaggguuucugcuauuuuucucuguagaguccaggcuaagcagcccacuccuagacuccuagggauccucuggucucugcuuccugucuucuugcagguguacugagauauagacccccaugccauugcaccuguguguuuacauacaaccuaugaaucugaacucagcuccaugcuuucuucacaagcacagcuguuucuuugguuugguuuucauuuuuguuucuuugagaggugugugguguuuuugcguuuguuuuugagacauggucuaacuaugguuuccugguuggccuggaacucucauauauaucagacuagccuugaacucaaagaucuuccugcaucugccuacagaaugcuaggauuaaaguuccuggugccuggcaaguacuuacaaugcacugaaccaucuccccagcccaacaccuguguuaaagucuacuaggccaaauaacugagcuuccugauuguaguaaaaauguuggagaucaaauuauguuaaguuacuuuuaaugccuuugaaagccauguacugcccacuccuaucuaaucuaacauccuugugccuaucauagccaaaauuauucucagcagaucacuggccuccaccagucuagagcuaaggaugucagcagcaucugaagccuguaacugcauuuca

SEQ ID NO: 665 - RNA, 1521 nt, Mus musculus
agaacuuaaaucacaaaaacaugcagcuucuuuuuucuuuguauuaagaaaguuuucacauauuugcagugcauaaugaauuuuacauuuuugugcugauuucuauaucaauuuuuguucuuuuucucucaacuaaugauucacguguagucuugaagucuugugauauaauaccuauacaauuccuuguauuacccagucuuauccuuuuccacaaauuuaaaugaggucuuaauacuagaaaagugucaucugagaacagugauuaacaaacacacacauacacacagauacaguucccuaggcaaaauuuuuauaguauauacuguucaaagcucuaaaagcaugugaaguucaugaaaauugaauagcaaagauaaaaaugaaaaugguauacauuugacaaggaguaauaaaguuagauguuaagaagacaggcucacacagucucauacuacaugagcaaguauagagagguaaaaagaaacauuuucauuuaauuuuauuuaucaguacauuaagagaauuguuucuuuugggauuuuuguuuguuuugguguuuuuuguuugguguuuuuuguuuuguuuuuugggguuuuuuguuuuguuuuguuuuguuuuguuuuuuuuguuucucgagacaguguuucucuuuauagcccugguuguccuggaacucacucuguagaccagacuggccucagacucagaaauccgccugcuucugccucccaagugcugggauuaagggcaugcaccaccacugccuggcugguuuguaauuuuguaccauaauugaaaguuaggguuucugagaaaaagcuuauucugcuauuuguucauaaccuccauucccauaacaaaagaauaugaugcugacuuacaggacaguaguucucaacuuauguuaugaacuguuugauacuguuccucaucuuauggcgaccacuagccauaaaauuauuuuguuucuacuucauaacuaauuuugcuacuauuacaaauguaaauauaauacaaauaucugacaugcauacuaucauucauauauguauaugcauaccaaugucgugacccacugguugagaaccacucucuaauuucaaaggacaugucuauaagggacagcucaaggaggaugugcaaagucauagcuaucauuaaguccuugccugccauuaaggcccccauacuuuuaccaguaaaaccauaguucugccacgaagaugaacugagguaacuacuuaaaaagauuaaauaaauaacaccacuguacuuaaauuauucugacaauauauuugcuguguaaauccaucaugugcucaagggguagacuugaugguuuccugucucaaauuguucugaguguaauguggaguauagugguuuuggaagaaaaauaaccuuaagaccuauauaagcguguuuaaauuggggagggcagccucaaucugaggcugcuuccauucugugucaggcagaagcaguugugcccuauuaaagaguuuuugcuuuacugau

SEQ ID NO: 666 - RNA, 3757 nt, Mus musculus
uuaacaauuuaaaugaaaauaucaaaauguuuugagacccuauuuugggauacaaagaguguuugacuuccaauuuccauucucgguagaacaagaacagaucauuuccuuuauugacaugcauaaaauacaucacauuuucuguucugcugaugcuauaauucaauaccaauucuccagccacaucaguuaugagcauaaaguauaucauguaaccucaaaccucuaacaguggaagguuuaaacaagaacggaugcugcuagaauaaugcugcuuccuuugaugugacagcugagcauccaucucccucccccucagauggcuucuucaacauguuagagcaaugaggacugguuuggucuaauaaccaaguuagagugaagacauuggccacauaauacacauacuccaguuuuuuuuaaaaaauucugaaucuugggcaacuguucucguguaacuacuucaguuucuaaaagcaguuauuguccaaagcuggaagaacuuaagucuucucagaugagcaugugaaugaauggagggagguaaacaaaaaauaaaauuaaaaaagaugaggucugauaggggagcagccggaaaaucaaaaaagggccaguaauuuaaaguuuauuccagcuauaaugcagguuauucugacuguaagguagcgucacauggcauacuucugaguccguucccgagaucuucuguuguauccaucgcugucuguuuuauagauccgugcaaucucuggcacuagggggucauaugggucugggucacauagcagugaacaaauggauaaaagagccuuagaaauaguuacagcaggagaccacugugaucuuagaauaucaagacaaaugcugccguuacuguuaauauuuggaugauaaauucuuguuggaaaugcaaccuuaggugguuugaagggguggguagucuguaggaaaaugaauugucaaaaagaauacaccaccuugauaugggcugucauuaggucccauaauuguggcuugcaaaugaaacaugucaucuccaacuggaccugcagaacauugugcuggagggucacgggccaaaucacuaaguuccuuauuaauccguuucagcgccauagucugugcuuuucgccgggcuccucacuaucccgagguguacucaaagguccggccaaaacucuugauuaucccggcggcggggaaggguugucucuucuucucacaccggcucuggcagacacaggcgcuugggauggaggggccgaucucacgagaaccucguggccggcucgccagagcuccgggucugcaaugacuuaagggcaguuuugugcucucuuccugguuccggacccgccagcauauuguuuuaaaauagacuuuuuaacuauagcuuuuuaguuaacugaagccaucuuaaaguacauugagaaaaugcugucaaauaaccguuaguuaucaagagaaaacgagcaaagauuguauuuuuaaauauuucaguuuugauucuuugcuguguuaaaaugguaagaauuauuuggaauagaagaaaauuuuucaacugacaauggacuuuacccuauauaagagaauuaugaugagcaaaaguuuauucccuuaauuucaucauaauacaaacccuguuacauuaacaguguaaacuuuuaaacacacaaauacacuuuuaauacaagauauuuucauggucuaacaaaaagcaaagauuccgcuccggguugaauacauugucacauuguuauaagaacucugaagucaauguccaacacauuguaaauugauuuauugguuuggucuauauuucuaaccauggugaaaucaguaguaaugccauauaauaagcauuauaaauguuuauuaauaauguucaaaauuuucuuauacagauuuuugguuuuaguuugcuaacauauauucuaccaaaaauuuccaacacugugaucucuaucaguguuuugcugaaugcccacuuuuuggaugguacaauaccaaccauuacacucacagaaucauacaaucuuuucuguuguuguuuuuuuuuuaauguauauuuuaguaguuuugguucuugagugugugauaaaagacuguuuauuuucuucuuggaguggccuaauugcauuuuccccauucacucauuuuuaaacuauauucaacuuggucaaaauagguacuauuucugccuaauacaaucuuuuuuguuuuaaguuaccaguuugcgccuauuacauuuuagucaccuaaucaaggcuuuucucagaacacaaugaguuguuuuaaauauuacaguuuaaaaauguaucuauuggaaaacuguuauuuagaguaagauuuagaaauacuguauuugugccuuuuucauuguuuugcuuuuuaauguguuuugauauuuggagcacaaauaugaaggugccauaagauggcuugcuaauguuaccuccuuaaauacuuucuauauuacuaucuucaaauaauaauugaagaaccuugaaugaaaugugguccuuugugugagacauguauguguuuauauuuuuuugggcuguguguaauguuuaaagagugaauuuaugaaaauagaacuuaaauaugcugaaaguucagauuaauugaaguaucucauuuaagugagcuuuauuugaaaagacaguggauugccagaagacaguguaauccucaaaaaugugaccagcauucugcauuauaaaauagaaaaauagugcuguuuuaggauaucaaggauaauuaaauuuuaaaaauaauugcuuuaaauauuuuuaaaguaucaugaacauuauuguuuuauuuuuuaacucgaucuaauugaguuuaaauuuucagaaauauucauuugcucauuuaaacuuuauacaugaacuuuaaguagaaguuuuuauaugaaauuauagguaagagcuucaaguauggcucaguaauagaaugcuuaugaauauuugugaucuauagguuggauccauagcaacaccaacacacaaaaaaugggaucauagauacuauucauuguuagaaaaaugcaacagagacuuggguaaguuuugugaaaaccucacucagcaguuuuaccacauguagcggugaaacaaucugucuuacacaugccuaguccguggugguuacauggagauauuugcuguggugggagaggugggugaaugggugacgggcuuucaguguucucagaaaauaaacacagcacuuucagcauacaggagaguauuuuacaaaccuuuuuauauacagauugugagcuccaacuugaguguucauggaaugauaaaaauguuggcuauuucuaacugaaaaaaauacugagugccuccaaugcaagacuucuuugcuaggaaugaaaucacgcuguauuuucuguuauuauuguguauaaauuuaugucugagaaggaauacuuauuuuuaaauauuuuccuguuaguaaaguuuauuauauacuauaacuaguuaauuuaacauuacuuacagaugaguugaguccauuuuucaaaauaaaguucugcuaaaauuauuuaauuauuaguucagaaggaaauugacuuuuaagacucagacucauacucagaccuuuaacauuuaaucuuccuggccuuucuuuaauccauuuguuguuuuaugaugagauucacacuauuuguaucauuguuggaaauagauuuuguguuucagcacguugaguuaaaauaaaauuguuaguacuuauucagaau

SEQ ID NO: 667 - RNA, 1654 nt, Mus musculus
auugagagacuuacaggugcuugccugaacugcaauaaaggacucuuauuauugaucaggacuuauuuaucucuucauuuuggagagccucauaaacuguuauuacaguuucucuacugacuuugaaaaguuugaaguuugaaagagacaccugugcagcuaacaaagcaugagcacggccagaacagagaacccuguuaucaugggucuauccagucagaacggccagcugaggggcccugugaaagccagugcuggcccuggaggagggggcacacagccacagaugaaccaguugaagaacaccaacacaaucaauaacggcacuccgcagcaagcccagagcauggccgccacgauuaagcaugucugauguucauaaaggccagaagaguuuguugaagccacugaacuuagguuauaaaugaugaccuggugaugacuggaaagacauuaaaacucccuccaaaggaucuaagaaucaaaacucuggaugugaccuccacaaaaggaaaugaguuugaagauuacuguuugaaacgagaguugcuaauaggaauuuuugaaaugggcugggaaaaaaccaucuucuauucaggaggagagcauucccauugcuuuaucugguagggauaucuuagcuagagcaaaaaauggaacaggcaaaagcggugccuaccucauccccuuacuugaaaggcuggaccugaagaaggacaauauucaagcaauggugauuguucccacuagagaacuugcucuacaggucagucagauuugcauccaggucagcaaacacaugggaggggccaaagugauggcaaccacaggaggaaccaauuuacgggaugacguaaugaggcuugaugauacagggcauguggugauugcuaccccuggcagaauccuggaucuuaucaagaaaugccuagaaaagguugaucauguccagaugguaguauuggaugaggcagauaaauuguugucacaggacuuugugcagauaauggaggcuuuuauucucacacuaccuaaaaauaggcagauuuuacuauauuccgcuacuuucccucuuaguguacaaaaguuuaugaauucccaucugcaaaaacccuacgagauaaaccugauggaggaacuaacucugaaaggaguaacuuaguacuacacauauguaacagaguacaaaaaaagugcacugccucaauacacuuuucuccaggcuucagauaaaccaucccaucacuuucugcaacuguucucagaguugaauuacuggccaagaagauuucuccgcuggguuacucuugcuuuuauauccgugcuaaaaugaggcaggaacaucgaaaucgugucuuucaugauuuccgaaauggcuuaugcugcaaucuuguuugcacugaucuguuuacccgagguauugauauacaagcugugaaucuggcagagaccuaucuugaucguauuggaagaucaggucacuuuggucaucuuggcuuagccaucaacuugaucacauaugaugaucgcuucagccugaagaguauugaggagcagcugaggacagagaucaaacccaucccaaacaacauugacaagagccuguauguggcagaauaccacagagagccugcagaagaugagaaaccauaac

SEQ ID NO: 668 - RNA, 1654 nt, Mus musculus
guuaugguuucucaucuucugcaggcucucugugguauucugccacauacaggcucuugucaauguuguuugggauggguuugaucucuguccucagcugcuccucaauacucuucaggcugaagcgaucaucauaugugaucaaguugauggcuaagccaagaugaccaaagugaccugaucuuccaauacgaucaagauaggucucugccagauucacagcuuguauaucaauaccucggguaaacagaucagugcaaacaagauugcagcauaagccauuucggaaaucaugaaagacacgauuucgauguuccugccucauuuuagcacggauauaaaagcaagaguaacccagcggagaaaucuucuuggccaguaauucaacucugagaacaguugcagaaagugaugggaugguuuaucugaagccuggagaaaaguguauugaggcagugcacuuuuuuuguacucuguuacauauguguaguacuaaguuacuccuuucagaguuaguuccuccaucagguuuaucucguaggguuuuugcagaugggaauucauaaacuuuuguacacuaagagggaaaguagcggaauauaguaaaaucugccuauuuuuagguagugugagaauaaaagccuccauuaucugcacaaaguccugugacaacaauuuaucugccucauccaauacuaccaucuggacaugaucaaccuuuucuaggcauuucuugauaagauccaggauucugccagggguagcaaucaccacaugcccuguaucaucaagccucauuacgucaucccguaaauugguuccuccugugguugccaucacuuuggccccucccauguguuugcugaccuggaugcaaaucugacugaccuguagagcaaguucucuagugggaacaaucaccauugcuugaauauuguccuucuucagguccagccuuucaaguaaggggaugagguaggcaccgcuuuugccuguuccauuuuuugcucuagcuaagauaucccuaccagauaaagcaaugggaaugcucuccuccugaauagaagaugguuuuuucccagcccauuucaaaaauuccuauuagcaacucucguuucaaacaguaaucuucaaacucauuuccuuuuguggaggucacauccagaguuuugauucuuagauccuuuggagggaguuuuaaugucuuuccagucaucaccaggucaucauuuauaaccuaaguucaguggcuucaacaaacucuucuggccuuuaugaacaucagacaugcuuaaucguggcggccaugcucugggcuugcugcggagugccguuauugauuguguugguguucuucaacugguucaucuguggcugugugcccccuccuccagggccagcacuggcuuucacagggccccucagcuggccguucugacuggauagacccaugauaacaggguucucuguucuggccgugcucaugcuuuguuagcugcacaggugucucuuucaaacuucaaacuuuucaaagucaguagagaaacuguaauaacaguuuaugaggcucuccaaaaugaagagauaaauaaguccugaucaauaauaagaguccuuuauugcaguucaggcaagcaccuguaagucucucaau

SEQ ID NO: 669 - RNA, 1438 nt, Mus musculus
caugucuaaaucaguaucucccaaggagccggaacaguuguggaagcucuucaucggagggcugagcuuuggaacaaccaaugagaaucugaggagccauuuugagcaauagagaagaguaaccgacugugugguaccgagagauccaguggcuuuagauuugucacacacgccacuguggaggaaguggaugcugccaugaaugcgagaucacacaagguggaugagagagcuguggaaccuaagagagcugugucaagagagagagaccaggugcccacuuaacugugagaaaggucuuuguuggugguauuaaagaagacacugaagagcaucaccuaugagauuauuuugagcaguaugggaagauagaagugauagaaacuaugacugacagaggcaguggaaaaaaagagggacuuugcuuuugucaccuuugaugaccaugacucuguggauaagauuguuauucagaaauaccauacugugaauggccacaacugugaaauaagaaaggcucugucaaagcaagagauggcuagugcuucauccagccagagaggucgcagugguucuggaaacuuugguggugguggugaaggcgguuuugguggcaaugacaauuuuggucaaggagggaacuuuagcggucaugguggcuuugguggcagccgugguggugguagaugugguggcaguggggguggcuauaauggauuuggcaauaauggaagcaauuuuggaggugguggaaucuacaaugauuuuggcaauuacaacaaucagucuucaaauuuuggaccuaugaagggaggaaacuuuagaggcaggagcucuggcccuuauggugguggaggccaguacauugcuaaaccaggaaaccaagguggcuacggagguuccagcagcagcagcaguagcuauggcaguggcaggagguucuaauuacagccaggaaacaaagcuuagcaggagaggagagccagagaagugacagggaagcuacagguuacaacagauuugugaacucagccaagcacagugguggcagggccuaccugcuacaaagaagacauguuuuagacaauacucaugugugugggcaaaaacuccaggacuguauuugugacuaauuguauaacagguuauuuuaguuucuguucuguagagaguauaaagcauuccaacaaaagguuuuacuguagaccuuuuucacccaugcugcugacugcuaaauguaauugucugaucaugacgcugaauaaaugugacuuuauuuuuaauguguuguguaaaguuagucuacucugaagccaucuugguaaacuuccccaacagugugaaguuagaauuccuucaugguggugccaaguuccauuuggaauuuauuuaugguugcuuggauggagaagccauugucuucauaaaccuugguguu

SEQ ID NO: 670 - RNA, 1811 nt, Mus musculus
gcggaaucaauugcagggagcuaugcaacaauucaaccaagauaccucuauuuggcuucagugguagcuucagaaaaugaccccuauggucccuuaccaccaggcugggaaaaaagaguggauucaacagacagacuuuacuuugugaaucauaauacaaaaacaacccagugggaagauccaagaacucaaggcuuaccaaaugaagaagcccugccagaaggcugggaaauuagguauacucgggaagguguuaguacuuuguugaucauaacacgagaacaacaacauucaaagauccugggaagucauugguaacuaaaggugguccacagauugcuuaugaacgcagcuuuagguggaagcuugcucacuuccguuacuugugccagucuaaugcacuacccagucauguaaagaucaauguguccgacagacauuauuugaagauuccuuccaacagauuauggcauuaaaaccauaugacucgaggaggcgguuauauguaauaucuagaggagaagaaggucuugauuaugguggccuugcaagaaaaugguuuuucuugcuuucccaugaaguuuugaauccaguauauugcuuauuugaguaugcaagcaagaauaacuauuguuuacagauaaauccagcaucaacuauaaauccugaccaucuuucauacuucuguuuuauugaucgcuuuauugcaauggcacuguuccauggaaaguuuauugauacugguuucucuuuaccauucuacaaacguaugcuaagcaaaaaacguacuauuaaggauuuggaaucuauugauacugaauuuuacaacucucuaaucuggauaagagauaacaauauugaagaauguggcuuagaaauguacuuuucuguagacauggagauucugggaaguuacuucacaugauuuaaaguugggagguuccaauauccuggugacagaagaaaacaaagaugaauguauugguuuaaugacagaauggcgcuuuucucgaggaguacaagaacagaccaaagcuuuccuugauggguguaaugaaguuguuccccuucaguggcuacaguacuuugaugaaaaagaauuggagguuaugcuguguggcaugcaagagguugacuuggcagacuggcagagaaauacuguuuaucgacauuauacaagaaacagcaagcaaauuauuugguuuuggcaguuugugaaagagacugauagugaagugcgaaugccacucuugcagcuugucacuggaaccugucgcuugccucugggaggauuugcugagcucaugggaaguaaugggccucaaaaguucuguauugaaaaaguuggcaaagacaccugguuaccaagaagccagacauguuuuaaucgcuuggaucucccaccauauaagaguuaugaacaacuaaaggaaaaacuuguuuuugcaacagaagagacagagggauuuggacaagaaugacugacuugucuuggagaagcucuugcauuuaaauaccugagccaagaacaagugcacagauaguguguauaagcugcucauucuguacagugaauuuuaugaaccuuucaaagaauaaauguuuuccguucuuccacagaaauaugcaaaccauuucaucauuuucuacuuuauuuauuguucccuuuaaaugacuggccaggaagaaaaucauccuuaaauuuugacgcaagcaagagaauuuauuuaaaaguauauaucuauauaaccauauaugacaguggcucuagagcgccagguguauuaaacaugacagcuguucauucacac

SEQ ID NO: 671 - RNA, 9991 nt, Mus musculus
cucuacaaauaaagcgcuuuauuuauacagucucuccaggcccagaucucugccgcccuaccccaaccucuuaagaggaggacugaguaauuccagaggagccaggaguggcugguccacaaggggucaucccgacagcugcagguccugaguagcugagccagguagagagcaaaggcacgaggcccuggacauuccaugccaaggcaaaggccagaaccaccgaacaaggugguauggguuagcacaccagggucagcuuccugggaucaggccaaggucuguaccagcagcaccacagcucugcucauaggacggcggggccucuguggggagaaagaaggaucuacaaggggcuuagggcauccucauuuucucaucccagucccugucaguuccacucaccauagggguagccccaugaacuguacucuggagggaggaucaaggcgcuggugguggguacugggcccgcagagccuucugcaaaguaggggacaguggcaccuauagagaugcacaagggagggugcagagaaugucuagcagggcuuccaaccugaacccagggcucagugguggugacagacacagaacccaagggagccgacaguggcugcugcugagaguggcucuugguggagagagaaacugggucugagaagugagggccacuagccacugccucagccucuuccugggguggugcagagggcaccacuagggauagggucccaggagaagacucucggccuggacagggacucaguggaguuugguucacagcaauauugccaacaaauagugggagagucacgguggccucaggugccuucauggagaccuggaaaaauguagguauugaggagucaggccaaggccaccuagccucaggccacccagcccugggcaacaccaaaccugaagguaauagucgauauggauaaggcugcagccaggcagggcugacuggggcagggcaggcaccaggaucuguucuugccacugagcacgccuccaggccuugacaccuguacccuccaccucugcaaugguccgcacaucauagauccagcgcuuggccuuauaggauaccuucugaggaaagacuugacugugagcuugggcaggccagcacccaccccuucuguuucaugggaaagggacaggcucaggaagccagauggcucugaccuguagcaagcuggccaccacagggcugguguccuugccugacugguucucaaugucagccugcagccgcagcaccugucccaccacauagccacgaaggucagugcuagcugugagaaccacauugccagucuucaccagcuuauaggagaacuucuugguaguggaggccacauuggguugcuugaagagaaaaggggaaagaguuuaucaaacgagcacagacaagacucaggcugcucuagacagcagcaagcagcuuaagacagggcuugguugccugguccaagaagguugaaggcaaccgaggaagccucucuguuccauccuuaccucaauaucugggaugcuguucagguucaaggggcucaggauguagaacacgaggcuacauuugugauccuuggaaaaacguggagugucgauggacgcccucaccugguguacaaucuucccaaagggucccucaaaagaugugggugcuguggcuacagagauaauagggcuuggcugucacccagcaccucccaccgugggucucaccauuucaaggcugcuguccccacaagcuuuccacucaccaggaagcaggaacugaaaagggaaguugugcucuccagccggcagacuuccuacagagacaaaaaggaggugggagcaaaccagaggaaauccauagcggccacagugccagaccagaaguaaacagugcagcccaccaguccacacuaccugucuccagcacuauagcagcaugaccauagcaggagcuacaggcuacguacaagggcuuguuuuaaacgaaaguguggggcuggaaauguaguuaguagaguguuugcuuagcacacacaaagauuuaguucaauuccaaggacuaugcaaaccacauaugguagcacaccccugggagguggaaggaggaaaucagaacuuuaagggcauccucuguuaaauagcaaguucaaggccagccuggcugcaugaaaccuugucucaaaagugaauaaauacaaauuuuaaaauaaaauaaaaaacagggaugacagucauaacuaagcaucagaguccacccagacccagaaagugggaauccaagagacgguugcagggaggggaaaggacaggcugacccccuccagucaagggcugccccugugaucacugcuggcucucacacucacccuugucagccagugacagggagcuguugaaguagcucuccuccaccacccaugccccaucguuggccuugguggagaccccacaggaacccaugcaggucacccggauagcuguaaggggaagggugccauaagcuuaugccagcugauggcauggcucuucccuguccccagcacaggaucucauguaggucugaaagugcccacaggucaagcagccuccauggccgaaggccaagcagccgggucaucuucccaagaguaccuccuggccauccccagucuugguguucugccagggcaccaggcugguaaggaaacugauaggcaguguuucauccucccugcagacacggugggaagccuguauucuccuagauaaucccugaguuacccucaaauugguuaaaucagccucuagccagaccuauaaaaacccagccacccuuuuuucaugaugcaaaucaguuuggucuggagaugccccuucagucucuugaaagcuaaugccagcccugucccugcaggaaugcagucagaccugucugagugagucaacaauccagcccuggaaggcaaauccugauuuccuuccugaacaguagugccuaggaggcugagguucugcaccaugagguaguugguccucccccaucugugggaguaucccagagcaggaaccacuagagacaagagcucacuuuccuguuuaacaaauacaaccuggcccuacugugcucagguagcugcagcugagugagagagcacagcuaaaacuggucacaggcgaggcagcucaagcaagauauaggugggagccaagagcggcacccugaaguaacacccugcuuccugcagaguugggucaugguuucagcccucuucccagacuuacuugacagggucacaggaggggaggauuauucaaacucuucaucuuugugacaaagccgcuaagcaagaacaaagaaauccaaccaccuagaaguugaucgcaccugccucacggauagucucccucuauuaugguccgggcauccuguuggucaccccauaaacuuuauccucuaaaucuuuggcucauucucaaacccacacagcucuccacaggugcacucugauauguuuuguaaaguguggcaguaugguaccgauuggagaaggugccucagcgggcccauacugaggcaccccucccccugagguaccugccaugggaugggucuaguauagaauagggguugagaagggaguagaggcagagaaguggagggggagggagggagggagggagagggagagaaagggggagagagagagaggggggggacaccagcuguaaacagguggaagaggaagggagaaaggggucagagagagaagagaggccaaacaguccuuuuuauagcaagccaggccuaccuggcuguugcuagguaacuguuggguggagccuagagcaaaugcuaacuugcaaacacacucccucaccugauggcugccaaugccuguuccuacucuugagacuuccugcauuccugcugugcuacucuauguccuuggaagugccaaugucugucugucacccuccauuucagcccaaccucacaacucuaaccuccaaccugguuugaaauacacacacgccugccaugaccucugacgacaaauccucaaguugucucacccuggaaucugaacacuaguggcaccuauaggccaggaaauaguucuugagaugacaggguaagcagagguucaaagaucugcuagaggguucaagaugcuucacaauggaaacauguccaaaaggcugaucggccccacauuagauacaaaaaaagucugggggucucaguuuaggccagaugcugccauagugcuaugagggugccuacagugaauggcacagugcuauucaaauucuucauucucaauguaggagcaauagcaaacugguugcuuucgcuguuuaguucaggggcgguuuguuauuugaaugaccuuuuguagcacuagacaacuggaaccaauacccagccacacuagaaaucaggggaaacccaggugacguacauguuuacuacucagaaugacaaccgauaagugcuuugaucgguguuggggagggagauggagaagucacacagugacacaaggccagcuucuucuguuugcaccuguacaugccaggacaccuaucaggucuccaguccuacacugcuucaucaggagucucucacagcacugcucagaauaacaaucaagcacccagucuggaccuucuacaguucaggaaaagaaguaugagaccaccagauuccaggaaaacaagccgcauccaaacuggaaguagggggaucgcccucugaucuucccaaugccaggcauuucccauacuacauggcuuuuaggaacacccugccaguguggccauccuccagccccugagcugaacacauccugugucacuuacucucuagugagaaaugacuguggaaaagggcuugcaaacaccaaguguucugcuucccccaagaaaacauuuggggcuucuccuuugccucaguagugucacaauccaaguguaaaaauuucuccagaaaauuccuccaagaaccauguacacuggccaaggacaaugccagcagccaaguauguaccuucucaaaucacuggagcaggaaaaacaauguacuacuacauaagcuacauaaaucguggaaaugagggaguucugagcauacuagaugggcucucugcugcugcugcuggccacuagacauggcucuuuuuaaauaauguuaugcugcuucucaguacuaucuccacuguccuaccucuccacucucaugcaaagguaucugggaagcaaccacggcccucucaggcucauacccugcagcauagccaggaaagcaggcuaaguguauucuaccaaauccuccacuacagagcaccacgauacagccuacagaacaaccuauaccuaaaggugccaucuaaguauaaaaaacguuuccuaacaguguuccuaacuauaauaaaaggcagucaccacucacugaauugacuagggaccaccgaacuagcagguguucaccacuagagacuggaggcugcuuuuuuuuuccuuuuuuuuuuuuuucuauuuuguuuuguuuuguuuuguuuuugagacaggguuucucuguguagcacuagcuauucuggaacucacucuguacaccaggcuggccuugaacucacagagauccaccugccucuauuccccaaagugcugggaaggcgugcuccaucucguagcagcucugcuuugcuuuucuuuucuuuucuuuucuuuuucuuuuuuuauuuucuuugucuuuaagguuuuuuguuguuguuguuguuuuugguuuuucucccccccccccuuuucuuuuucuuuugguuuuucgagauaggguuucucuguguagccguggcuguccuggaacucacucuguagaccaggcuggccucgaacucagaaauccaccugccuuugccucccgggugcugggauuaaaggcaugcaccaccacgcccggcucuagcucugguuuucuaaagaaaaucaugguguguguuuuguuccacagagaugucuggcacuuucuucccucauggaugcuucuaccuuccagcaguuccuuaccaugcaccaugauaaugaagacauuuccauucuucuucugguuccaaagaucuugaaccugaccauccccaccagcuaacacacccugucauuaaaucugugcuuguuuugcuuccaauuguaccauaaaccaacaaggguugcuaccucugggguccugugaaaccacagcuauucuaugaaaaacagagccaaacuggagagagcuuaggaguauuuuugggguuguuuuuaaagauuauuuguuguauguacaugaguacacuguagcugucuucaaacaccagaagagggcaucagauccauuacaaaugguugugagccaccauguauuugcugggaauugaacucgggaccucuggaagggcagacagugcccuuaaccacugagccaucuucccagcccugagagcuugggaguuaagugcacuuguuccucuugcagaaaacccaaauuccauucccagaacccagaaccaccuuuaacuccaggucaagaguguuugaugcccucuucuguacucuagggcacauaagcaaguaguguacagacacauaugcagacaaaacauauacacacauaaaauaaaaugaauaagucuaaaaaagaaaaacagagcuggagagauggcuuggugguuaagaacacugagugcucuuccagagguccuaacuucaauucccagcaaucacaugguggcucacaaccaucuguaaugggaucugaugcccucuucuggugugucugaagacagcuccaagguacucacauacauaaaauaaggagaccgaggauuggaggugcauccaugcaucgacacucagaagccugugucaggauugcaaguuugagaucagucuggguagcauagaaagaugcuguguaagccgggcagugguggcacacaccuuuaaucccagcacuugggaggcagaagcaggcagauuucugagccuggucuacagaaugaguuccaggacagccagagcuacacagagaaacccugucucgaaccccccccaaccccugcaaaaaaaaaaaaaaaaaacaacccaccccacccccaaaaaagaaguaccuuuagcugggcguagugacacacgccuuuaaucccagcacucgggaggcagaggcagguggauuucugaguucgaggccagccuggucuacaaagugagcuccaggacagccagagcuauacagagaaacacugucucaaaauaaaaaagaaagaaagaaagaaagaaagaaagaaagaaagaaagaaagaaagaaagaaaggaaggaaggaagggcgggcgggccaaaguaguggugguguaugccuuuaaucccagcacucgggaggcagaggcaggcagauuucugaguucaagaccagccugaucuacagaaugaguucuaggacagccagagcuacacagagaaacccugucucaaaaaaaaaaaaaaaaaaaacaaaaaaccaaaaaccgggcuggagagauggcucagugguuaagagcacugauugcucuuccagagguccugaguucaaaucccagcaaccacaugguggcucacaaccaucuguaaugagaucugaugcccucuucuggugugucuaaagacagcuaagguguacucauauauaauaaauaaauaaaucuuuaaaaaaaaaacccacaaacaaacaaacaaaaaagaaagaaaagaagagggcugggaguuuagcucaguaguacacuuauugagcaugcucuaaguuaaauucccagaaccaagaguuagaagaagaaaagcaagcagaaagcaucuauccagaauugggguauggagagccauaaggaaaauacaguaggcccuacugcuguccuggggcagcugcaauccauagcaccucugaggcggcuaguauccucucagaugggacugaaccauugucaguccuuagacaaguaccccaugaccaaaacugaaaauccuaagguagugaagggguggggagguggggcucuucuacugggucuagcagaagugcagcaaguauccuuugaaugaaagaaaauauaagaaccaugguuaucuccaucccaagcaggacugagggaauuuccagaguggccucuacacauacaaucucaacugccagcaauauaaauccaccuuccagccccagcccaugauccugggcacuuucugcaguugggaccaucaugggggcucucuuggccccuaucaggucagcuguccauuuacucucuaacugcuacaagccagaagauauccuuacacuguauuuggcaauagccuaaccuguucaccccaugucuugucaggagaaaauaacagaaaagaaaaacugcauggcuaguucuaaauaggaccucucucuguuguaucacucaagcucacgagccuguggccuguaccauguuccccucagccaauguacacuucuuguaccuuucuuagauccaggaggagcugaccuaucaugcuguaugccucuacaaaaucaacagcagcuuucacccagacuacauacucuaaauaaagauagguaaugcgaucaugaccagaagccucgacaagaucagggcuugacaggcacauacaauccagauuccuucucgaccuggacaacaaacaccaaguccagguccaggcagcuguucaucugaggccuagaauggcugaggagaauagcucuccguccucagcagacaccauuaguguguguggacaacugugguuuggccaugcagccacgcaguucucaaagaagacaaaaauaaaagagcaccaagcaaagacauccauauaaucuugcaaucggugccagguagaggccacaacagugcccaccuggucccagggaguucagucaucaaaucccacacagggcccucuauucguggauccagcaccaacgaggcugcaccugagagugcccuggcaauagcaaagcagcaaccugauccccaucagcccuacagucucagaucuaugcaucagcagaggacucagcucagcucccacaaggccuuaggaaaggagcgcgaggggauugcccgguggaacagggccccuugccagcaauuacaaucuuuaagcugaaagcaagaagguacccuguggauccuggugggaaccugcccacuuggaccagaacugucuuugaagaagguccugcauaggagucuggagacaaggaaaugagagguccuagagcacauuagguuccaggugggggcccagcaggugcacagugcagcggaccuuggacaacugaacaagggaagacugaaggcccgcaugcuucuacugccaggguugccugggcauagugaaugaacaagcacuuaggcccuugcacagacucuggccucuuaggcggagagcacaggauggggcagaugcggaagaacugggccaccgagcugcccgccccgcccugcccuccgugagccucccagaacugccuguuccuggugcccgcgguuccgucguaacccggggcuuccuggagacuaagaacccagucgcagagcccacugaccgcacaguucccgagagccccgccccaccgcagguaagaacgcgucuacccacuucccggaggggaccccgcgcccaccucggaagggcaguggcgcucccaggcgcaagugcacggucccagccagcggcuccccaggaccguagacgacgcggcccugacucaggcggaucucgaagagcugcacccuccccauaccgcggucucccgcgccgcggucugacgccugcuagaguaguggcuucgaggcccgccccucuuccccuccccgacagaggacacgcccaggccgcaggacccgccuggaccggaauacuagcugcugcccccccaccccccaagacccaccucaucccaaagacccgccccuuucugauccaaggccggccuuc

SEQ ID NO: 672 - RNA, 9991 nt, Mus musculus
gaaggccggccuuggaucagaaaggggcgggucuuugggaugaggugggucuuggggggugggggggcagcagcuaguauuccgguccaggcggguccugcggccugggcguguccucugucggggaggggaagaggggcgggccucgaagccacuacucuagcaggcgucagaccgcggcgcgggagaccgcgguauggggagggugcagcucuucgagauccgccugagucagggccgcgucgucuacgguccuggggagccgcuggcugggaccgugcacuugcgccugggagcgccacugcccuuccgaggugggcgcgggguccccuccgggaaguggguagacgcguucuuaccugcgguggggcggggcucucgggaacugugcggucagugggcucugcgacuggguucuuagucuccaggaagccccggguuacgacggaaccgcgggcaccaggaacaggcaguucugggaggcucacggagggcagggcggggcgggcagcucgguggcccaguucuuccgcaucugccccauccugugcucuccgccuaagaggccagagucugugcaagggccuaagugcuuguucauucacuaugcccaggcaacccuggcaguagaagcaugcgggccuucagucuucccuuguucaguuguccaagguccgcugcacugugcaccugcugggcccccaccuggaaccuaaugugcucuaggaccucucauuuccuugucuccagacuccuaugcaggaccuucuucaaagacaguucugguccaagugggcagguucccaccaggauccacaggguaccuucuugcuuucagcuuaaagauuguaauugcuggcaaggggcccuguuccaccgggcaauccccucgcgcuccuuuccuaaggccuugugggagcugagcugaguccucugcugaugcauagaucugagacuguagggcugauggggaucagguugcugcuuugcuauugccagggcacucucaggugcagccucguuggugcuggauccacgaauagagggcccugugugggauuugaugacugaacucccugggaccaggugggcacuguuguggccucuaccuggcaccgauugcaagauuauauggaugucuuugcuuggugcucuuuuauuuuugucuucuuugagaacugcguggcugcauggccaaaccacaguuguccacacacacuaauggugucugcugaggacggagagcuauucuccucagccauucuaggccucagaugaacagcugccuggaccuggacuugguguuuguuguccaggucgagaaggaaucuggauuguaugugccugucaagcccugaucuugucgaggcuucuggucaugaucgcauuaccuaucuuuauuuagaguauguagucugggugaaagcugcuguugauuuuguagaggcauacagcaugauaggucagcuccuccuggaucuaagaaagguacaagaaguguacauuggcugaggggaacaugguacaggccacaggcucgugagcuugagugauacaacagagagagguccuauuuagaacuagccaugcaguuuuucuuuucuguuauuuucuccugacaagacauggggugaacagguuaggcuauugccaaauacaguguaaggauaucuucuggcuuguagcaguuagagaguaaauggacagcugaccugauaggggccaagagagcccccaugauggucccaacugcagaaagugcccaggaucaugggcuggggcuggaagguggauuuauauugcuggcaguugagauuguauguguagaggccacucuggaaauucccucaguccugcuugggauggagauaaccaugguucuuauauuuucuuucauucaaaggauacuugcugcacuucugcuagacccaguagaagagccccaccuccccaccccuucacuaccuuaggauuuucaguuuuggucaugggguacuugucuaaggacugacaaugguucagucccaucugagaggauacuagccgccucagaggugcuauggauugcagcugccccaggacagcaguagggccuacuguauuuuccuuauggcucuccauaccccaauucuggauagaugcuuucugcuugcuuuucuucuucuaacucuugguucugggaauuuaacuuagagcaugcucaauaaguguacuacugagcuaaacucccagcccucuucuuuucuuucuuuuuuguuuguuuguuuguggguuuuuuuuuuaaagauuuauuuauuuauuauauaugaguacaccuuagcugucuuuagacacaccagaagagggcaucagaucucauuacagaugguugugagccaccaugugguugcugggauuugaacucaggaccucuggaagagcaaucagugcucuuaaccacugagccaucucuccagcccgguuuuugguuuuuuguuuuuuuuuuuuuuuuuuuugagacaggguuucucuguguagcucuggcuguccuagaacucauucuguagaucaggcuggucuugaacucagaaaucugccugccucugccucccgagugcugggauuaaaggcauacaccaccacuacuuuggcccgcccgcccuuccuuccuuccuuucuuucuuucuuucuuucuuucuuucuuucuuucuuucuuucuuucuuucuuuuuuauuuugagacaguguuucucuguauagcucuggcuguccuggagcucacuuuguagaccaggcuggccucgaacucagaaauccaccugccucugccucccgagugcugggauuaaaggcgugugucacuacgcccagcuaaagguacuucuuuuuugggggugggguggguuguuuuuuuuuuuuuuuuuugcagggguugggggggguucgagacaggguuucucuguguagcucuggcuguccuggaacucauucuguagaccaggcucagaaaucugccugcuucugccucccaagugcugggauuaaaggugugugccaccacugcccggcuuacacagcaucuuucuaugcuacccagacugaucucaaacuugcaauccugacacaggcuucugagugucgaugcauggaugcaccuccaauccucggucuccuuauuuuauguaugugaguaccuuggagcugucuucagacacaccagaagagggcaucagaucccauuacagaugguugugagccaccaugugauugcugggaauugaaguuaggaccucuggaagagcacucaguguucuuaaccaccaagccaucucuccagcucuguuuuucuuuuuuagacuuauucauuuuauuuuauguguguauauguuuugucugcauaugugucuguacacuacuugcuuaugugcccuagaguacagaagagggcaucaaacacucuugaccuggaguuaaaggugguucuggguucugggaauggaauuuggguuuucugcaagaggaacaagugcacuuaacucccaagcucucagggcugggaagauggcucagugguuaagggcacugucugcccuuccagaggucccgaguucaauucccagcaaauacaugguggcucacaaccauuuguaauggaucugaugcccucuucugguguuugaagacagcuacaguguacucauguacauacaacaaauaaucuuuaaaaacaaccccaaaaauacuccuaagcucucuccaguuuggcucuguuuuucauagaauagcugugguuucacaggaccccagagguagcaacccuuguugguuuaugguacaauuggaagcaaaacaagcacagauuuaaugacaggguguguuagcugguggggauggucagguucaagaucuuuggaaccagaagaagaauggaaaugucuucauuaucauggugcaugguaaggaacugcuggaagguagaagcauccaugagggaagaaagugccagacaucucuguggaacaaaacacacaccaugauuuucuuuagaaaaccagagcuagagccgggcgugguggugcaugccuuuaaucccagcacccgggaggcaaaggcagguggauuucugaguucgaggccagccuggucuacagagugaguuccaggacagccacggcuacacagagaaacccuaucucgaaaaaccaaaagaaaaagaaaagggggggggggagaaaaaccaaaaacaacaacaacaacaaaaaaccuuaaagacaaagaaaauaaaaaaagaaaaagaaaagaaaagaaaagaaaagcaaagcagagcugcuacgagauggagcacgccuucccagcacuuuggggaauagaggcagguggaucucugugaguucaaggccagccugguguacagagugaguuccagaauagcuagugcuacacagagaaacccugucucaaaaacaaaacaaaacaaaacaaaauagaaaaaaaaaaaaaaggaaaaaaaaagcagccuccagucucuaguggugaacaccugcuaguucgguggucccuagucaauucagugaguggugacugccuuuuauuauaguuaggaacacuguuaggaaacguuuuuuauacuuagauggcaccuuuagguauagguuguucuguaggcuguaucguggugcucuguaguggaggauuugguagaauacacuuagccugcuuuccuggcuaugcugcaggguaugagccugagagggccgugguugcuucccagauaccuuugcaugagaguggagagguaggacaguggagauaguacugagaagcagcauaacauuauuuaaaaagagccaugucuaguggccagcagcagcagcagagagcccaucuaguaugcucagaacucccucauuuccacgauuuauguagcuuauguaguaguacauuguuuuuccugcuccagugauuugagaagguacauacuuggcugcuggcauuguccuuggccaguguacaugguucuuggaggaauuuucuggagaaauuuuuacacuuggauugugacacuacugaggcaaaggagaagccccaaauguuuucuugggggaagcagaacacuugguguuugcaagcccuuuuccacagucauuucucacuagagaguaagugacacaggauguguucagcucaggggcuggaggauggccacacuggcaggguguuccuaaaagccauguaguaugggaaaugccuggcauugggaagaucagagggcgaucccccuacuuccaguuuggaugcggcuuguuuuccuggaaucugguggucucauacuucuuuuccugaacuguagaagguccagacugggugcuugauuguuauucugagcagugcugugagagacuccugaugaagcaguguaggacuggagaccugauagguguccuggcauguacaggugcaaacagaagaagcuggccuugugucacugugugacuucuccaucucccuccccaacaccgaucaaagcacuuaucgguugucauucugaguaguaaacauguacgucaccuggguuuccccugauuucuaguguggcuggguauugguuccaguugucuagugcuacaaaaggucauucaaauaacaaaccgccccugaacuaaacagcgaaagcaaccaguuugcuauugcuccuacauugagaaugaagaauuugaauagcacugugccauucacuguaggcacccucauagcacuauggcagcaucuggccuaaacugagacccccagacuuuuuuuguaucuaauguggggccgaucagccuuuuggacauguuuccauugugaagcaucuugaacccucuagcagaucuuugaaccucugcuuacccugucaucucaagaacuauuuccuggccuauaggugccacuaguguucagauuccagggugagacaacuugaggauuugucgucagaggucauggcaggcguguguguauuucaaaccagguuggagguuagaguugugagguugggcugaaauggagggugacagacagacauuggcacuuccaaggacauagaguagcacagcaggaaugcaggaagucucaagaguaggaacaggcauuggcagccaucaggugagggaguguguuugcaaguuagcauuugcucuaggcuccacccaacaguuaccuagcaacagccagguaggccuggcuugcuauaaaaaggacuguuuggccucucuucucucucugaccccuuucucccuuccucuuccaccuguuuacagcugguguccccccccucucucucucucccccuuucucucccucucccucccucccucccucccccuccacuucucugccucuacucccuucucaaccccuauucuauacuagacccaucccauggcagguaccucagggggaggggugccucaguaugggcccgcugaggcaccuucuccaaucgguaccauacugccacacuuuacaaaacauaucagagugcaccuguggagagcuguguggguuugagaaugagccaaagauuuagaggauaaaguuuauggggugaccaacaggaugcccggaccauaauagagggagacuauccgugaggcaggugcgaucaacuucuaggugguuggauuucuuuguucuugcuuagcggcuuugucacaaagaugaagaguuugaauaauccuccccuccugugacccugucaaguaagucugggaagagggcugaaaccaugacccaacucugcaggaagcaggguguuacuucagggugccgcucuuggcucccaccuauaucuugcuugagcugccucgccugugaccaguuuuagcugugcucucucacucagcugcagcuaccugagcacaguagggccagguuguauuuguuaaacaggaaagugagcucuugucucuagugguuccugcucugggauacucccacagaugggggaggaccaacuaccucauggugcagaaccucagccuccuaggcacuacuguucaggaaggaaaucaggauuugccuuccagggcuggauuguugacucacucagacaggucugacugcauuccugcagggacagggcuggcauuagcuuucaagagacugaaggggcaucuccagaccaaacugauuugcaucaugaaaaaaggguggcuggguuuuuauaggucuggcuagaggcugauuuaaccaauuugaggguaacucagggauuaucuaggagaauacaggcuucccaccgugucugcagggaggaugaaacacugccuaucaguuuccuuaccagccuggugcccuggcagaacaccaagacuggggauggccaggagguacucuugggaagaugacccggcugcuuggccuucggccauggaggcugcuugaccugugggcacuuucagaccuacaugagauccugugcuggggacagggaagagccaugccaucagcuggcauaagcuuauggcacccuuccccuuacagcuauccgggugaccugcauggguuccuguggggucuccaccaaggccaacgauggggcaugggugguggaggagagcuacuucaacagcucccugucacuggcugacaagggugagugugagagccagcagugaucacaggggcagcccuugacuggagggggucagccuguccuuuccccucccugcaaccgucucuuggauucccacuuucugggucuggguggacucugaugcuuaguuaugacugucaucccuguuuuuuauuuuauuuuaaaauuuguauuuauucacuuuugagacaagguuucaugcagccaggcuggccuugaacuugcuauuuaacagaggaugcccuuaaaguucugauuuccuccuuccaccucccaggggugugcuaccauaugugguuugcauaguccuuggaauugaacuaaaucuuugugugugcuaagcaaacacucuacuaacuacauuuccagccccacacuuucguuuaaaacaagcccuuguacguagccuguagcuccugcuauggucaugcugcuauagugcuggagacagguaguguggacuggugggcugcacuguuuacuucuggucuggcacuguggccgcuauggauuuccucugguuugcucccaccuccuuuuugucucuguaggaagucugccggcuggagagcacaacuucccuuuucaguuccugcuuccuggugaguggaaagcuuguggggacagcagccuugaaauggugagacccacggugggaggugcugggugacagccaagcccuauuaucucuguagccacagcacccacaucuuuugagggacccuuugggaagauuguacaccaggugagggcguccaucgacacuccacguuuuuccaaggaucacaaauguagccucguguucuacauccugagccccuugaaccugaacagcaucccagauauugagguaaggauggaacagagaggcuuccucgguugccuucaaccuucuuggaccaggcaaccaagcccugucuuaagcugcuugcugcugucuagagcagccugagucuugucugugcucguuugauaaacucuuuccccuuuucucuucaagcaacccaauguggccuccacuaccaagaaguucuccuauaagcuggugaagacuggcaaugugguucucacagcuagcacugaccuucguggcuauguggugggacaggugcugcggcugcaggcugacauugagaaccagucaggcaaggacaccagcccugugguggccagcuugcuacaggucagagccaucuggcuuccugagccugucccuuucccaugaaacagaaggggugggugcuggccugcccaagcucacagucaagucuuuccucagaagguauccuauaaggccaagcgcuggaucuaugaugugcggaccauugcagagguggaggguacaggugucaaggccuggaggcgugcucaguggcaagaacagauccuggugccugcccugccccagucagcccugccuggcugcagccuuauccauaucgacuauuaccuucagguuugguguugcccagggcuggguggccugaggcuagguggccuuggccugacuccucaauaccuacauuuuuccaggucuccaugaaggcaccugaggccaccgugacucucccacuauuuguuggcaauauugcugugaaccaaacuccacugagucccuguccaggccgagagucuucuccugggacccuaucccuaguggugcccucugcaccaccccaggaagaggcugaggcaguggcuaguggcccucacuucucagacccaguuucucucuccaccaagagccacucucagcagcagccacugucggcucccuuggguucugugucugucaccaccacugagcccuggguucagguuggaagcccugcuagacauucucugcacccucccuugugcaucucuauaggugccacuguccccuacuuugcagaaggcucugcgggcccaguacccaccaccagcgccuugauccucccuccagaguacaguucauggggcuaccccuauggugaguggaacugacagggacugggaugagaaaaugaggaugcccuaagccccuuguagauccuucuuucuccccacagaggccccgccguccuaugagcagagcuguggugcugcugguacagaccuuggccugaucccaggaagcugacccuggugugcuaacccauaccaccuuguucggugguucuggccuuugccuuggcauggaauguccagggccucgugccuuugcucucuaccuggcucagcuacucaggaccugcagcugucgggaugaccccuuguggaccagccacuccuggcuccucuggaauuacucaguccuccucuuaagagguugggguagggcggcagagaucugggccuggagagacuguauaaauaaagcgcuuuauuuguagag

SEQ ID NO: 673 - RNA, 17773 nt, Mus musculus
uccagccugugcaugaguguuuuauugugccuggugcucccagaggucagaagaggauauuggaucaccuggaaguaagaguuacagacagcugugugccaccuuuguaagugcuagaagagcagagagcacuaguaaccccugacccacuucuggucugcagccccuauaguuuugauuuuuugugauuacacagauaauauugugcacauguggagaucacaggacaugcagaagcuggaucucucaucaugugggucccagggauccaacucuggugucaggcucugcaggaaguaccacugagccuucuugcuagcccuacagccccucuuuuaaaacucucaccuuauaaaauuaguagaaguuauuuccuaaacagaaguuuuaccuuuuuuugguacuggaaguggcacuauccaggaacacaaacuugaauuacuuguuaugguccauaucacucaucacuuaaucauagcauuaauaacuuauuaguucuuaugucuacauagauggcuucuaugggaacacagacuauggagcuaucaagagucccauuuugauugucuuaucuggagagagcauuggaaugugucuaacccucaguaugauacacaaguguucagaagagaaaauguuauuuuuuuaaaugaaguuccaucacauacagggacuuacacauggcagacaaguuaugguuuucuagcacugaacuguauucccagcuaucuugugcuucccugggccuauauauuucaggcugaucauaagcuuacuauguagucuaagcugguugggcuuugaacuuaagauccaccuaccuaagcuucccaaaugcugagcucacagcucuuuaagacgggcuguggugauugaucccuuuaaucccagcacucaggaagcacaugaagacggaucucugucaggcugagggcggccuggugaucuacauagcaaguucuaggacaucaagacucuugucuccaauaaaaaagaccuuacuacauagcccaggcuggacugacuuguaaccccuucuuagucuccuaaguguccaauacuaccuuguuugcuucuauguauacaugaguguggcagauagggguuaaccucagcugccauucacgauagccugucuugagccacggucucuugcugggauuugagguuagcugacuagucuagacuuggcugggcagcaagccccagagauccuguugucuccuuccuauugcugagauuauaaguaugggcuuaacuugggucuucaugaauacauggugagcaauguuuuuuuugguuaccauuaaagggaucacuucucaacugcuggcccaauuauaaauaaaagguguuaaauauaaggguuagcuaagucuuaaaugggacaaauaaugucucaggggcuaugaugaaucagguagacuagacuggucaugaaagcaggugacacuaacugcucuugugacuuccaucuuagggcucuccuuggggauggcuacuuucacccaacaggaacuacccucaccuuggagccagagaagugugcccccagacuugacuugguugggauuuguuaugaacucuauagcuacugcauggagucugcccugcagcacacuucaaugacuugauucaaaacacauacuguacgagacacuaaaggcauuuaauagaagugcgcuaggaagcugccccuacucuuugagacaauaagaauccaaggcuuggucaguacugucuccacuuuguagacaaacuuuuggccucucucauggucuucuagcgugggaaauucuuaggauauaauuggaacagcuugccuuccugugugggcucgaagccguauuucuccagguuguuagcaucaaaugucccuucuuuaaagucuuuuucgauagcgggugcaacuguuuccuggaagagcgcuuuggcggucagaggugugucuaugccugcaggagcucgguaauuaacguagggcuugagcuugaagcccgucaaguccgggacgacaaauucuggaaccauuucuuuuauuugcacaaacuuccuaucagaaguauagaugccuguuuucuuggcaccccgacucuuagugaaggugcgugguccccgcuugcuuguccacuugcucauccugucagcuccccgcaccaggccuugagucacggcagucaggaaacccaugcugggcucuggauaaaucagcucugaaagaacaaggaaggcagcugagggaaucaaucagagccagaggaacuuacccagaaccggagagcccaagagcaaagauggcuguggugccugugggagccgaagauacgagaagccacgggcgcagaggaccggcccggaaagaucccggaccccgaagaagcccgugcagguggcgccaacuggaaacgcucauaccgaccugggcugacggcucuagagcucggcccgcaagggagaaagggagaacccuuucgaccugagacagcucagacacgguuuccccagccugagccguuuaaaacaccgccugaccggucacuccuuccaaggcacagcaagguccucccugcguuuccgaccguaggcggggucagacacuccguagcaagagccucgccgacuggucaccagggcgcccaaugcccagccucagccgagcggagggggugcggcccuggaggcuaagccaauccgcgcagucgcgcagagccggauguggaucgggcgcgcgccgcucugcucugucgccuugaggcgggaggugguggucgggcucuagccuauggagcggucgcucuuagcugucgucagccccacgacagaaggcucacaaccgcagcgccuuaguccggccgugggacuggugcgagcaucauccgugcugcccuaggugcugggaguaggggcuugcggacccuccgagucacuuucgacccuugguuucccgaacugucgcgcuaucgaggaccggccagcgaccggcggucuaccccacagucuggcgcguggccaagucuaugugguccucuaguuaaucaucuuuggucccaccacacgcaccgagccugugaugucguccacacgcugcccgcuguggcugggucucuuuucacccuucaccucucuccuucgauacccgguccucuagucccucccuugcucuccucggggguagggguguuacuccucggcuauaaccaucuccucuucccucacuccucuugaucgagaccccuucuaggcugggaucuuuucugugccucuacaccgcguucuuuaucuuacccccuugccuacaucacuccgcucgggugaggcccacccucuagcuggucacauuucccugucgcuugccuccuucuucucuguucugcuuugcucuugugccacuuucuuagcugucccaccagucucagcugucccaccucccugaacugucagccacuuuacacuucuggucuccuccccuaacuccaccucccaaccccagacggccguccccacguggccgcuugaucccugacugugcugcucaacuccccaccccccaccccaaccccgggcagcaguuguggguuccccuuagaccacgugagggcuguuuacaggagacggaagcacacagagaaagcagacgcuucuggaaaacaacuuguuuuggagcacagaguucugaagucucuuccaauaagagcguuuguguggaaaggagcuggcaagacuggaacuacagcuguccugcuguaaagguucggguacagcaguuugucucagccugucuccuuuucgcccuccacauugcuuugcuuucagucaugcagaaugaggaagaugccugccuugagguagguagaccagacaugggcgagaccaaaacccuuaaaguccccagacggagcauuuacagagaucagaggacccuuucccucaggugucuaccgaggcuuccugaagaucuaggggaaugugggaguggugacagguauuucccugucccgagcuugacacuuguugcuagacaaugguucuucacagugugggcuauggaacuuggcuguuagaucaucaugaagcuuucuuuccccccucuuguuuuuguuucgagacaggguuucucuguguagcccuggcuguccuggaacucacuuuguagaccaggcuggccucgaacucagaaauccgccugccucugccucccgagugcugggauuaaaggcuuccuccaccacgccuggcuuucuuuuccccucuuaaaaucacaguuguuacuuccuguuuucucuuaggacuuuuguauuuuagagucuuuuuaucaguccaacacuagccacaucccaaaagccauuauuauuauuauuacuauuuugacacaaugucucucuacaucuguggaacucacucuagaaaagaaugaccuugaacucguguagagaccugccugccucugccucccaagugcugggauuuuuuuuuauaagcaagaaaaguaaauccauaagaauaacuguaaaaagcuaaacaggcugggaugguccacugcggcagacuguaccuaggugccuuuccuuagauaaaguaaacuccgaagaacauagagggcgugguugcugugcucuugugcaccccaguugauauggucaugagagcugagcuggggcaguggagaagggaggugagugccucaguuuugaaaccaaaaacauacuggcucuauacacuguacaacagggcucuggcugacaauagacggugugcaauagugaucccacagauuguaucaguuggugggguaauaguaccuugugacacucgcaccuugugacauucacaccaugaggaaguagccuaagaacagacugggccagucugugguggccaaugccuuuaauuccagcacugccaaaacaaacaaacaaacaaacaaagaacauacugguuuuguuuucgagacaggguuuuucuguguagcccuggcuguccuggaacucacuuuguagaccaggaucuccuugaauucagaaaguucuccaccugccucugccuucccauugcugggauuaaagacaugcaacaccaacuccucuggaacauacuuaguggaacauguucguccucauccuuaaacaauacucaauuguuugccuccugaacuaagaucacaaggaugaguuuucuaggcaacccacuuacucuguuaggaugcagaacugugccuuuggaguucuuuguugugugaccuucagcucuccuuggguuucuggagggauugcugagucugaggcaugcuguuuauuuuuaaggcuaggcuuugguaauuagaagauagguagaagcugcaaaggauggguaaaugggccccuacacuauucaguuccuaacuuuuugggagaaagggguggcuggauauuggaggacucagggacagaugcaggucugguuuuuuuuuuuuuuuuuugucuuuagcuuuuggggacagcgucuauugugggucaccccucacccuuacauucugaguuuuuacuucccugccgccuucccuccccuggaucugguccuuagacaucuaaaauccugucaaugccuucuuggagaccacagguggcagagacaggauucucuuugagaaguaaacugacauuguaugucucaauuuccagauggaucuuuccuuggggcuucuuuuuuguccagcguccuuuuuugcuuugaagacugcauuucacugguugcuuaggccgggcuugaacuccuaggugaauaugauccucuugccucuuccuuucaaguaguucaugguauacuuuuuuuuuuuuuuuuugguuuuucgagauaggauuucucuguauagaccuggcuguccuggaacucacucuguagaccaggcuggccucgaacucagaaauccaccugccucugccucccaccaaaugcugggauucaaggugugugccaccacugcuauacucuugacgcacucucaggaguuucugagcauucauucugauuggcuuucauggauugugggguuugugauccuaguccuauuggcauccagaggaaccaagacauagcuuugaccugcccuaggcuuacuucuugaggacuggagagccagaagucggguuuauuauuugccaguagcaaagugcuacccaucccagugccaaaagagacagggugcugcuuuucuguccuuacaguugagcucagagggucucagcaccccugcaagaauugaucuuuuuucuaaaauuaaaaauauaguuauuugggcuggagagauggcucaacaguuaaaaacacugauugcucuuccagagguacugaguucaauuccccaaaaccacauggcggcuuauaaccaucuguaaugggaucugaugcccucuucugguguguaugagcaacaguguauucauauacuuuaaacaaaaaaacaaacaaacaaaucuuaagaaaaaaaccaaacaagcaaaauuuaaaaauauauauauauaguuauugggcuagagugauggcucagagguuaagaacacuagcugucagagacaaaguuuggaguugugacgaaaggauggaccaucuagagacugccauaucuggggauccaucccauaaucugcuuccacacgcugacaccauugcauacacuaacaagauuuugcugaaaggacccagauauagcugucucuugugagacuaugccagggccuagcaaacacagaaguggaugcucacagucagcauggaucacauuggauggaucacagggcccccaauggaggagcuagagaaaguacccaaggagcuaaagagaucugcaacccuauagguggaacaacauuaugaacuaaccaguaccccagagcucuugacucuagcugcauaugugucaaaagauggccuagucggccaucacuggaaagagaagcccauuguacacgcaaacuuuauaugccccaguacaggggaacaccagggccaaaaagugggaguggguggguaggggagugggggggaggguaugggggacuuuugggauagcauuguaaauguaaaugaggaaaauaccuaauaaaaauacuuaaaaaaaaaagaacacucuagcuguuuuuccagagauuuggaguuuaauucccagcaaucacaugguggcucaucaccaucuauaaugaaauuuggugcccuccucuggcaugcaggcagaacacucuacauaagcaaauguuuaaaaaaaagacaaguauaaaucaaguuauuacauuucuuuguauauguguguaacuuugagaagguaauagcaucuacauaguguggaggugagagaacagcuuauggcagucuguucugucuuggaccguaggacuuuccaggauaacacucagguccucaggcuuggcugcagaugccuggucugcugaguugucugguaagccccaguucucagaaaucuucaggguauugauuuccuuccuagcuucugacuuacuuuuguucucuaaucaagcucagacugagaaauugggccccuugucuguccagccugacuucuguucucuccucaggcuggcuacuguuuggguaccacccugagcuccuggaggcugcauuucauggaggagcagucccaguccaccaugguaaucccuaugggcugcccaggggaugggcccugauaggccugcagcuauguucagccuugcugacccuccuguuaucucccauccuguguagcugauggggauuggaauuggcgcccuccuuacccuagccuucguugguauuaccuucuuuuuuguauacagaagagugagaagauuacgugaguaucuugguuuggacucuggcugagcuguggggcuuuggcugcauuuguguccuaugagauguuuagagcuucuugaagcuucuguuaaaggcuuauuggaaugugcgugccuacuggagcucagguugacauucccagucuguccauagccuuuucugcucucuccaaagcuaggauccaguaagaacaguagaaacucuggauucuucuaagaugagucuauguuacugcuuucccagcugucggagcgguagccaaggacaggguagaacaugguuugucgucagcaccuucaccuucagggccuuucuugcgcuuguaguuuauuguaguugcaaccauuuucagcauacagccauucaaggcuagucacccggaccccugcuguuucacaugcucccgcuuuccucucacaggacgggcagaacccacuccucaguacagguuccggaagagagacaaaguaauguuuuauggccggaagaucaugaggaagguaacuuucauggaagcccuggguugcacaagaugguggugagagucucuucugaagaguccuugguggaauggggaucugcugcuagcuagcaagcccucaagguccugaucucucuagcuccugauacacgcugccaucugcucugcuuaggagaugguuuaagucauccugaguauuaucuaccuccccguaagaaccaacacguuugaccuagaaauaccucacuugcccuggaggcagccagaggggcaugguauugguggauguggaucuggcuugaaacacgugaacugccuuagcggacagggacacucgggcuuucugaagugcugguuuguguuaacaagaaauaggauaggaaagugcuuuucagaaauauuccuggguauagaauggacaggcacagagggcuuguguuugccccaagguggguggucacugccagauugggaaaggugagccaaaggacccaccucccgggaacgccgguagaccagugccaucccuaaugaccacaguuauccuaagguaaaacauuguggcuucuuuucuauauuugugggaguucucgauccuaacucuguaguccuccugcacugagggucaggggcugguggcuagggaugagcaggcuggccugaguccuuguucaccuuugauuaguugccacagcuggucccuucugcuuccucccucuccccucaggcuuggcuuggcaacuucagggcaguaggacuauucugugggguuuaugggucugugaggugugcucuuguccaaaugguaucccuuuguccuggacugcucuaucuccuucaagaaacccggcggguaguggggguuggugagaguaacaccuaguaacucaggucagcacgguagcaaaucauagccagguccaggggacagacagacucugaggcggagggcuuagaccuugccagucagugucagcacccugucuuucucuugguucugcaggugaccacacucccccauaccuugguugggaauaccucugcaccccggcagcgagucaggaagaggaccaaagugcugucuuuagccaagagguacuaagggauccccucagguccuucccccugcuguggcuccccucaugucaggacacgccaaggcagaugcuucuucaggcuuugaaguuuggguauuggguauccaauaguauuggguuuaggcuccaucaucucuuacuuaagugucucugcuuugcaggauucugcgcuuuaagaaagaguaucccacuuugcagccaaaagagccuccgcccucccugcuugaggcugaucuuacagaguuugaugugaagaacucucaucugccaucagaagucuuguacauguugaaaaauguucgguaagucaguggaugggcugcuggagggcucugucuagggcaugucucuggaggcauccacuuuccuuccuuggauugucuuugaccuggccuuccuaugucggggguguuggcaaagucuguuuucuucccaccuugggacugcugcuuccaugcuucaugguagcagaaauguucaacagagucagggugcuuggccucggguggucagcucgccgauuagcuguuccuuccuguucuacucaauaauaguuggcagcacuuuuauucccagugucaaacucaagaauaagugugagaaguuguguaugggugagaaacugcaagcuggcucccccaccacacccucccccagcacucucucaccuauccuggcaggcucuugcuauguagccuaagcuggccuucagcuugcaauccugugccucauccucccaaaugcugacauccacauaccauucugucagcuugcuuuuuuuuaaagguacauuauuuuuaacuuuugaaauauuauuauuuggggggggguauguaagugaagacagguacacaugggccacagcauguguguggagauuagaggauaguuuucccuuuccaucuucauguugugugguuugaggaagaaaggccccaacaggcucauagauuugaauucuuagucauaagggagcagcacuauuucagaaggauuaggagguguggucuuguuggagaaggcuugucauuggggauggacuuugagguuucaaaagcccucccuccccaccauacaugucuguggaucaggauguagcucucagcuacugcuccuguaccaugcaugccaccaugcuuucuaccgugaucauaauggccuguaagcacgcccucggauucuucuguaagagcugcaggguaguggugucucuucccagccuuagaacagugacugaggggagagggcauaggggacuuucagagaggaaacuaggaaaggggauagcauuugaaauauaaaugaagaaaauaucuaauuuaaaaaaaaaaaaaagaacagugacugagguaugugggcucugaggauugaaccucauggcccacaucacugggaggggcuuugccuucuguucuguguuugacuuacauuacuacucacagugagagauauucgagcugauuaguuaucuuagaaguuuaaaauucugauugccuagaaugccagaugagcugaaucagccuuauagagcucugggccagcccuggccuuauuguuaguggggacaguggccuauaucccuuacucuuccuugagagcauuuguucuguuuguugcaggguucuaggccacuuugagaagccacuauuucuggaacuuugcaaacauauggucuuugugcagcuacaagaaggggagcacguauuccaaccuggggagccugacaucagcaucuaugugguucaggacggacggcuggaggucugcauccaagacgcugugagugaguggccagggugggguggggcaggggccugagcucuuagcugucuaucauuguaaagcuuugaauagcuguccaucaaaaaguuaguguauuggaauuggaaagguggcucaaugguuaagaacacuggcuguucuucaagaggacccucccagcaccuacauggcagcucacaacugucuguaacaccugucccacgggauccuacaccgucacacagauacacaugcagucaaaucaccaauguacauuaaaaaaaaguguaaaaauuuaaccuuaguucuuuggaaaaaaucaacggucuuauucaguguucgaacacagcuguuauuuuuauuuuaacaacacaauacacacacauacauacauugagacauuuucauucaauaguccaaggacaaccuagaacucacuauguagcccaggcugucauugaguucauggcaauccuccuaccuuggccucuugagugcugggauuauaguccugagccaacacaccugacauauuaucuuucuuucuuuguuuuuuuuuuuaauaagauuuauuuauuuuuauauauguguguacguugucacuaucuucaugcauacccaaagaggguaucugaucccauuacagaugguugugagccacuaucuguuggcuggugggaauugaacucaggaccuuuggaaaagcagucagugcucuuaaccgcugagcuaucucuccagccccugacacauuauccuuaucauuaggcacauacaagucucucauucaaaaauauuguaauuuuuauugauaauaacuaaauuugguuauaguuuucuacaguggccucauuuguagucaguuuaacuaauuaauuuaagcuguguauugggaagcuguggcuggguuuggcaggauuuuuuucauuaguccucuacugugcaugcaggugcaugaguauaugugguaggcuucccauugcuguuauaaaacaugacuaaaagcaacuuggggagggaacgguuuauuucagcuuauaguuccauaucacagucugucaucaaagaaaggcaggacaggaacucaagacaaaaacguagauguaggaacugacaagcugugcugugguaagcaugcugcuuacugccuuuccccucagggcuugcucagccuucugggauuuuguuucuuuguuuuguuuuauuuuguguuuuuuauaguaccucaaaccaccugcccaggggugacugguggcugugagcuggacccucucacaucaaucaucaaugaagaaaaugccccacaggcauugcccacaggcaaucugaugggagaauuuuuuucucaguugagucuccuucuuuccaagugacucuagcuuguaucaaguuggcauuuggauagccaacaccauauuuguguguuuaugugggugcguuguuucucagaggcuaccuaccuuuuucauuuuaguucacuuugagacaguaucucacuauguaguccuggcuggcuuggaacucacucuguagaccaggcuggucuugagcucacagagaucuggcugccucugccucccaagugcuggcguuaaaugcaugugucacaaugccuggcuaccuuguuuuuuggaacaggguuucugaaauccccaagugggccagucugacuugucagugagcaccacucaucugacuauuguccugucccuagcacugggucacagaugcacaccaacaguccagauauuuaacauuuucaauuacuauucucugugugugccauggugugcacauguaaaggccagagaaaagcuuuuaaaaauguguucucuucuuuuacuguggggcuccaggggucagacgcacgcugucagucuugcaggacaggaccuuuaacugcugagucaucucacugggccauacuugacauuugagggcauuuggggcuaggggucucacuaucugugacaauucaauauuaugaaaauaagccgggugguggugguggugucuguggcgcacgccuuuaaucccagcacuugggaggcagaggcaggcagauuucugaguucaaggccagccuggucuacauagugaguuccaggacagccagggauacacagagaaacccugucucgaaaaaccaaaaaaaaaaaaaaaaaaagaggaaaaaaaagaaagaaaauaaagguuacuuuuaaagagacuagaacuuguucuggaccucauauccagaguugauaauauacugugagcugauauaagacaauacugauacccuguuuguuuagccugccuuuaagagaacaauguugggccgccgcagccaucuuccaguaacucgccaaaaugacgaacacaaagggaaagaggagaggcacccgguacauguucucuaggccuuuuaggaaacauggcguuguuccuuuggccacauacaugcgaaucuacaagaagggugauauuguagacaucaagggaaugggcacuguucaaaaaggaaugccccauaagugcuaccacggcaaaaccggaagagucuacaaugucacccagcaugccgugggcaucauugucaacaagcagguuaagggcaaaauucuggccaagaggaucaaugugcggauugagcacaucaagcacucaaagagcagagacagcuuccugaagcgggugaaggagaacgaccagaagaaaaaggaagccaaagagaagggcaccugggugcagcugaagcgccagccugcgccacccagagaagcacacuuugugaggacuaacggaaaagagccugagcuguuggagcccauuccauacgaauucauggccuaauguacacaaagaaauaaaauaccagcaccaggaaaaaaaaaaaaaaaaaagagaacaauguuaauagccacccuuacuugccuuggauuucccacgcaucaacuuuuacaagcuaagcuaauguauagcuguaguuuuacauuauuuauucuuccauaccccugacccacaaauaaugcuugaauguauauauaaguaaguaucauguguucaaggcaacauguaacccuggcuggcuuggaacucacuauacagaccaggcaggccuguaauucucagagaucuaccugccaagugcugggguuaaaggccaccaccacccagcguuugguauauagguauguauuuuaauauuuaucaucuucuuucaagcuuaugaagugagcaagugauugugagacccugaagugggugcuggaacacaacuucuguauucuguagaagcucagccagugcucuacuguugagcuauuucuguagccauguuuauggugucucuuaauccugcugacuccagcaaggcucgugugcucuucucugaugcccgcuuuauaucaacucaaagaucagaucuuguaugccaccuguccugggggccagcugggccucuuugcccuguacugacaccugucaaucuguucucuaagcacaggauggcaccgaagugguggucaaagagguccugccaggggacaguguccacagucuccucagcauuuuggaugugaucaccgugaguaucccccacugugucccugccauaggugcucgggcaucucuagcuagcccuccaggucagugcuuccugucuugcuagaccucauaugaguucuguucuguaucuauacaggugagaggggcugucuaggaugagaaaggcccucacucuguaguuaaggauaugucugugggaacagcuuugacauuggguuuaagauagaauauauuuaguagggcuuuggugguccuuucuauuuccucuuugucugucugucugucugucugucuuucucugucugguucuaggcuugccucgaacucuugauucucccaucuuugccuccagaguccugggauuacaagugucugcuacugcccccaacauucuucacucuuucuuucuuuuuuuuuuuuuagauuuauuuauuuuauuuuaugaguacacuguagcugucuucagauacaccagaagaggcuaucagaucccauuacacaugguugugagccacuaugugguuacugggaauugaauucaggaccuugggaagagcucuuaaccgcugagucaucucuccagccccauucuucacucuuugugucuuauuauaucuguucauauacagacaugaacagaacaaucacaaaagcaguaucucucucaucugcugggcucaaagguaugggccucugugccuggcuggcuaccucucuuguugcuaaugacugaaacacuugacagaagcaauuaaggaaggcagggcucuuuucagcucagcgauuaaaggugugacccauugugauggagaaggaaugacagcaggggugugagaccauaccccugacaaaaugcugccacauucaagguggggcuucccucuaaauuaaaaccuuucacagggcagugguggucuuuaaucccagcacuucagaggcagaggaaggcggauuucuuccaggccagccuggucuacacagagaaaccaaaaaccaaaccaaaccaaacaaacaaaaacaaaaacaacccaaauguuuauagaaacauucucuuauauacauggaggaguguguuuugauggugauuccaaaucuagccaaguucacuaugaagguuaaccgucacaccucuuuucuagauuguguuaugcagaaaagcuaaguagagcuuuauguggggguauucagaccugcugaaccuaggagcccaagacauuguacaggauuacaugaagagccucagugggacccacugauccaugauccauaguugccuacaugcaaauaugcugggguaucuuuugugucuacacugcugccuaucaggcaaagacugcuuagucuuguuugguggccuagagguaugaauggaaccucugugucuuacugugccccacuugaccugaguugggguuguugcuugcccaaggaaaaaagauguccaucuuugagugucuuugaauugcuuucgaaagacugaugcuuggcugugaggaagcuacuaacaugagcucaugugugccuggugcuggagcucacucugaggaugcuccagauguguaggacuucagucuguaugggguagguagaccaguuagccacuugauaucugcaucauuccuccauccugcuagcuaccuuuucuuuuaagcaaaaaauuuuuaucuaacuauggcauggaccuuucuuuguaccucuuugauccuggucucgugguuuuuaaacugaaugucacuuauuccagcauaugaugaauaugcugaggaaguagguuauggcuggggccaaggccaggguuucuccugaauugacuaucccacuguguacacaucaggcccuucccaagaggaggagucuaucuuccaagacuggacaggguagaaggggaugacccuggagagaagaugaccacuauauuguuauuaccuggucauuuuucagucucacaacauguuuguagcuauuaaaauuaaauuaaauuuuuuugauuucuuguuuuguuuuuguuuuuuggacagcccuggcuauccuggaacucacuggccuccaacucacagaguuuugucugccuuugucucccaagagcuuguauuaaagguaugcaccacaccugaaaagaguuuagaauuuuuacaaaauagcauguacagacauuuuaggaugcacuugcuguuucauaaacgacaauccucugucugcgcugcaaccuuccaacucucggguucuuuuaacacguguguuuuauauguguucugucuuaggcacacugucuucuuuucuggagaacggagaagaaacccucuugccugcccauauugcucucacugcuucucccauccccuuguuucuaaccacagggcuaaaacuaagacuccauacaugccuuucacagcugagccacagaguuucccagggaaacugguugcuugucagcuuuuguucucuugcaguuaacacuacagagucugcccuggccugugcuccaugaggagcacuuuucucugggaaaccguccuaccuuccccauccugccaucucaugcuaccuggaauucccuguacucugcuggaaggaucuccuauuuccuccucaucaucauccccuuucucguuuugguggugcaaacccucuguuagcuuccugaagaaggugcaggagacacauauuugugagaucuuacaaauauagaacuagucuuccuuaucuuucucuuaaaccuacuauuauauguaauuuacuacaugcaauuuaacuguaauuuguguguguguguguguguguguguguguguauuugcauguauguguaugagacuuagccugguuuucuauuguuuuccauugaagagcuauuuuuuuucccaaggcaggguugagaucacaucagugguggcaugucacagguuugugcuagguauugacuccgguugucacaagacacucuguuugcuaaaaaucuccuucacucaacugguaauuacauggauuaaauaugaaaagaaagaaggcacuuaaaaacuaggaaugauagcacacaccuguaaucucagcagucuagaggc

SEQ ID NO: 674 - RNA, 17773 nt, Mus musculus
gccucuagacugcugagauuacaggugugugcuaucauuccuaguuuuuaagugccuucuuucuuuucauauuuaauccauguaauuaccaguugagugaaggagauuuuuagcaaacagagugucuugugacaaccggagucaauaccuagcacaaaccugugacaugccaccacugaugugaucucaacccugccuugggaaaaaaaauagcucuucaauggaaaacaauagaaaaccaggcuaagucucauacacauacaugcaaauacacacacacacacacacacacacacacacaaauuacaguuaaauugcauguaguaaauuacauauaauaguagguuuaagagaaagauaaggaagacuaguucuauauuuguaagaucucacaaauaugugucuccugcaccuucuucaggaagcuaacagaggguuugcaccaccaaaacgagaaaggggaugaugaugaggaggaaauaggagauccuuccagcagaguacagggaauuccagguagcaugagauggcaggauggggaagguaggacgguuucccagagaaaagugcuccucauggagcacaggccagggcagacucuguaguguuaacugcaagagaacaaaagcugacaagcaaccaguuucccugggaaacucuguggcucagcugugaaaggcauguauggagucuuaguuuuagcccugugguuagaaacaaggggaugggagaagcagugagagcaauaugggcaggcaagaggguuucuucuccguucuccagaaaagaagacagugugccuaagacagaacacauauaaaacacacguguuaaaagaacccgagaguuggaagguugcagcgcagacagaggauugucguuuaugaaacagcaagugcauccuaaaaugucuguacaugcuauuuuguaaaaauucuaaacucuuuucagguguggugcauaccuuuaauacaagcucuugggagacaaaggcagacaaaacucugugaguuggaggccagugaguuccaggauagccagggcuguccaaaaaacaaaaacaaaacaagaaaucaaaaaaauuuaauuuaauuuuaauagcuacaaacauguugugagacugaaaaaugaccagguaauaacaauauaguggucaucuucucuccagggucauccccuucuacccuguccagucuuggaagauagacuccuccucuugggaagggccugauguguacacagugggauagucaauucaggagaaacccuggccuuggccccagccauaaccuacuuccucagcauauucaucauaugcuggaauaagugacauucaguuuaaaaaccacgagaccaggaucaaagagguacaaagaaagguccaugccauaguuagauaaaaauuuuuugcuuaaaagaaaagguagcuagcaggauggaggaaugaugcagauaucaaguggcuaacuggucuaccuaccccauacagacugaaguccuacacaucuggagcauccucagagugagcuccagcaccaggcacacaugagcucauguuaguagcuuccucacagccaagcaucagucuuucgaaagcaauucaaagacacucaaagauggacaucuuuuuuccuugggcaagcaacaaccccaacucaggucaaguggggcacaguaagacacagagguuccauucauaccucuaggccaccaaacaagacuaagcagucuuugccugauaggcagcaguguagacacaaaagauaccccagcauauuugcauguaggcaacuauggaucauggaucagugggucccacugaggcucuucauguaauccuguacaaugucuugggcuccuagguucagcaggucugaauacccccacauaaagcucuacuuagcuuuucugcauaacacaaucuagaaaagaggugugacgguuaaccuucauagugaacuuggcuagauuuggaaucaccaucaaaacacacuccuccauguauauaagagaauguuucuauaaacauuuggguuguuuuuguuuuuguuuguuugguuugguuugguuuuugguuucucuguguagaccaggcuggccuggaagaaauccgccuuccucugccucugaagugcugggauuaaagaccaccacugcccugugaaagguuuuaauuuagagggaagccccaccuugaauguggcagcauuuugucagggguauggucucacaccccugcugucauuccuucuccaucacaaugggucacaccuuuaaucgcugagcugaaaagagcccugccuuccuuaauugcuucugucaaguguuucagucauuagcaacaagagagguagccagccaggcacagaggcccauaccuuugagcccagcagaugagagagauacugcuuuugugauuguucuguucaugucuguauaugaacagauauaauaagacacaaagagugaagaauggggcuggagagaugacucagcgguuaagagcucuucccaagguccugaauucaauucccaguaaccacauaguggcucacaaccauguguaaugggaucugauagccucuucugguguaucugaagacagcuacaguguacucauaaaauaaaauaaauaaaucuaaaaaaaaaaaaagaaagaaagagugaagaauguugggggcaguagcagacacuuguaaucccaggacucuggaggcaaagaugggagaaucaagaguucgaggcaagccuagaaccagacagagaaagacagacagacagacagacagacaaagaggaaauagaaaggaccaccaaagcccuacuaaauauauucuaucuuaaacccaaugucaaagcuguucccacagacauauccuuaacuacagagugagggccuuucucauccuagacagccccucucaccuguauagauacagaacagaacucauaugaggucuagcaagacaggaagcacugaccuggagggcuagcuagagaugcccgagcaccuauggcagggacacagugggggauacucacggugaucacauccaaaaugcugaggagacuguggacacuguccccuggcaggaccucuuugaccaccacuucggugccauccugugcuuagagaacagauugacaggugucaguacagggcaaagaggcccagcuggcccccaggacagguggcauacaagaucugaucuuugaguugauauaaagcgggcaucagagaagagcacacgagccuugcuggagucagcaggauuaagagacaccauaaacauggcuacagaaauagcucaacaguagagcacuggcugagcuucuacagaauacagaaguuguguuccagcacccacuucagggucucacaaucacuugcucacuucauaagcuugaaagaagaugauaaauauuaaaauacauaccuauauaccaaacgcuggguggugguggccuuuaaccccagcacuuggcagguagaucucugagaauuacaggccugccuggucuguauagugaguuccaagccagccaggguuacauguugccuugaacacaugauacuuacuuauauauacauucaagcauuauuugugggucagggguauggaagaauaaauaauguaaaacuacagcuauacauuagcuuagcuuguaaaaguugaugcgugggaaauccaaggcaaguaaggguggcuauuaacauuguucucuuuuuuuuuuuuuuuuuuccuggugcugguauuuuauuucuuuguguacauuaggccaugaauucguauggaaugggcuccaacagcucaggcucuuuuccguuaguccucacaaagugugcuucucuggguggcgcaggcuggcgcuucagcugcacccaggugcccuucucuuuggcuuccuuuuucuucuggucguucuccuucacccgcuucaggaagcugucucugcucuuugagugcuugaugugcucaauccgcacauugauccucuuggccagaauuuugcccuuaaccugcuuguugacaaugaugcccacggcaugcugggugacauuguagacucuuccgguuuugccgugguagcacuuauggggcauuccuuuuugaacagugcccauucccuugaugucuacaauaucacccuucuuguagauucgcauguauguggccaaaggaacaacgccauguuuccuaaaaggccuagagaacauguaccgggugccucuccucuuucccuuuguguucgucauuuuggcgaguuacuggaagauggcugcggcggcccaacauuguucucuuaaaggcaggcuaaacaaacaggguaucaguauugucuuauaucagcucacaguauauuaucaacucuggauaugagguccagaacaaguucuagucucuuuaaaaguaaccuuuauuuucuuucuuuuuuuuccucuuuuuuuuuuuuuuuuuuugguuuuucgagacaggguuucucuguguaucccuggcuguccuggaacucacuauguagaccaggcuggccuugaacucagaaaucugccugccucugccucccaagugcugggauuaaaggcgugcgccacagacaccaccaccaccacccggcuuauuuucauaauauugaauugucacagauagugagaccccuagccccaaaugcccucaaaugucaaguauggcccagugagaugacucagcaguuaaagguccuguccugcaagacugacagcgugcgucugaccccuggagccccacaguaaaagaagagaacacauuuuuaaaagcuuuucucuggccuuuacaugugcacaccauggcacacacagagaauaguaauugaaaauguuaaauaucuggacuguuggugugcaucugugacccagugcuagggacaggacaauagucagaugaguggugcucacugacaagucagacuggcccacuuggggauuucagaaacccuguuccaaaaaacaagguagccaggcauugugacacaugcauuuaacgccagcacuugggaggcagaggcagccagaucucugugagcucaagaccagccuggucuacagagugaguuccaagccagccaggacuacauagugagauacugucucaaagugaacuaaaaugaaaaagguagguagccucugagaaacaacgcacccacauaaacacacaaauaugguguuggcuauccaaaugccaacuugauacaagcuagagucacuuggaaagaaggagacucaacugagaaaaaaauucucccaucagauugccugugggcaaugccuguggggcauuuucuucauugaugauugaugugagaggguccagcucacagccaccagucaccccugggcaggugguuugagguacuauaaaaaacacaaaauaaaacaaaacaaagaaacaaaaucccagaaggcugagcaagcccugaggggaaaggcaguaagcagcaugcuuaccacagcacagcuugucaguuccuacaucuacguuuuugucuugaguuccuguccugccuuucuuugaugacagacugugauauggaacuauaagcugaaauaaaccguucccuccccaaguugcuuuuagucauguuuuauaacagcaaugggaagccuaccacauauacucaugcaccugcaugcacaguagaggacuaaugaaaaaaauccugccaaacccagccacagcuucccaauacacagcuuaaauuaauuaguuaaacugacuacaaaugaggccacuguagaaaacuauaaccaaauuuaguuauuaucaauaaaaauuacaauauuuuugaaugagagacuuguaugugccuaaugauaaggauaaugugucaggggcuggagagauagcucagcgguuaagagcacugacugcuuuuccaaagguccugaguucaauucccaccagccaacagauaguggcucacaaccaucuguaaugggaucagauacccucuuuggguaugcaugaagauagugacaacguacacacauauauaaaaauaaauaaaucuuauuaaaaaaaaaaacaaagaaagaaagauaauaugucagguguguuggcucaggacuauaaucccagcacucaagaggccaagguaggaggauugccaugaacucaaugacagccugggcuacauagugaguucuagguuguccuuggacuauugaaugaaaaugucucaauguauguauguguguguauuguguuguuaaaauaaaaauaacagcuguguucgaacacugaauaagaccguugauuuuuuccaaagaacuaagguuaaauuuuuacacuuuuuuuuaauguacauuggugauuugacugcauguguaucugugugacgguguaggaucccgugggacagguguuacagacaguugugagcugccauguaggugcugggaggguccucuugaagaacagccaguguucuuaaccauugagccaccuuuccaauuccaauacacuaacuuuuugauggacagcuauucaaagcuuuacaaugauagacagcuaagagcucaggccccugccccaccccacccuggccacucacucacagcgucuuggaugcagaccuccagccguccguccugaaccacauagaugcugaugucaggcuccccagguuggaauacgugcuccccuucuuguagcugcacaaagaccauauguuugcaaaguuccagaaauaguggcuucucaaaguggccuagaacccugcaacaaacagaacaaaugcucucaaggaagaguaagggauauaggccacuguccccacuaacaauaaggccagggcuggcccagagcucuauaaggcugauucagcucaucuggcauucuaggcaaucagaauuuuaaacuucuaagauaacuaaucagcucgaauaucucucacugugaguaguaauguaagucaaacacagaacagaaggcaaagccccucccagugaugugggccaugagguucaauccucagagcccacauaccucagucacuguucuuuuuuuuuuuuuuaaauuagauauuuucuucauuuauauuucaaaugcuauccccuuuccuaguuuccucucugaaaguccccuaugcccucuccccucagucacuguucuaaggcugggaagagacaccacuacccugcagcucuuacagaagaauccgagggcgugcuuacaggccauuaugaucacgguagaaagcaugguggcaugcaugguacaggagcaguagcugagagcuacauccugauccacagacauguaugguggggagggagggcuuuugaaaccucaaaguccauccccaaugacaagccuucuccaacaagaccacaccuccuaauccuucugaaauagugcugcucccuuaugacuaagaauucaaaucuaugagccuguuggggccuuucuuccucaaaccacacaacaugaagauggaaagggaaaacuauccucuaaucuccacacacaugcuguggcccauguguaccugucuucacuuacauacccccccccaaauaauaauauuucaaaaguuaaaaauaauguaccuuuaaaaaaaagcaagcugacagaaugguauguggaugucagcauuugggaggaugaggcacaggauugcaagcugaaggccagcuuaggcuacauagcaagagccugccaggauaggugagagagugcugggggaggguguggugggggagccagcuugcaguuucucacccauacacaacuucucacacuuauucuugaguuugacacugggaauaaaagugcugccaacuauuauugaguagaacaggaaggaacagcuaaucggcgagcugaccacccgaggccaagcacccugacucuguugaacauuucugcuaccaugaagcauggaagcagcagucccaaggugggaagaaaacagacuuugccaacacccccgacauaggaaggccaggucaaagacaauccaaggaaggaaaguggaugccuccagagacaugcccuagacagagcccuccagcagcccauccacugacuuaccgaacauuuuucaacauguacaagacuucugauggcagaugagaguucuucacaucaaacucuguaagaucagccucaagcagggagggcggaggcucuuuuggcugcaaagugggauacucuuucuuaaagcgcagaauccugcaaagcagagacacuuaaguaagagaugauggagccuaaacccaauacuauuggauacccaauacccaaacuucaaagccugaagaagcaucugccuuggcguguccugacaugaggggagccacagcagggggaaggaccugaggggaucccuuaguaccucuuggcuaaagacagcacuuugguccucuuccugacucgcugccggggugcagagguauucccaaccaagguaugggggaguguggucaccugcagaaccaagagaaagacagggugcugacacugacuggcaaggucuaagcccuccgccucagagucugucuguccccuggaccuggcuaugauuugcuaccgugcugaccugaguuacuagguguuacucucaccaacccccacuacccgccggguuucuugaaggagauagagcaguccaggacaaagggauaccauuuggacaagagcacaccucacagacccauaaaccccacagaauaguccuacugcccugaaguugccaagccaagccugaggggagagggaggaagcagaagggaccagcuguggcaacuaaucaaaggugaacaaggacucaggccagccugcucaucccuagccaccagccccugacccucagugcaggaggacuacagaguuaggaucgagaacucccacaaauauagaaaagaagccacaauguuuuaccuuaggauaacuguggucauuagggauggcacuggucuaccggcguucccgggagguggguccuuuggcucaccuuucccaaucuggcagugaccacccaccuuggggcaaacacaagcccucugugccuguccauucuauacccaggaauauuucugaaaagcacuuuccuauccuauuucuuguuaacacaaaccagcacuucagaaagcccgagugucccuguccgcuaaggcaguucacguguuucaagccagauccacauccaccaauaccaugccccucuggcugccuccagggcaagugagguauuucuaggucaaacguguugguucuuacggggagguagauaauacucaggaugacuuaaaccaucuccuaagcagagcagauggcagcguguaucaggagcuagagagaucaggaccuugagggcuugcuagcuagcagcagauccccauuccaccaaggacucuucagaagagacucucaccaccaucuugugcaacccagggcuuccaugaaaguuaccuuccucaugaucuuccggccauaaaacauuacuuugucucucuuccggaaccuguacugaggaguggguucugcccguccugugagaggaaagcgggagcaugugaaacagcagggguccgggugacuagccuugaauggcuguaugcugaaaaugguugcaacuacaauaaacuacaagcgcaagaaaggcccugaaggugaaggugcugacgacaaaccauguucuacccuguccuuggcuaccgcuccgacagcugggaaagcaguaacauagacucaucuuagaagaauccagaguuucuacuguucuuacuggauccuagcuuuggagagagcagaaaaggcuauggacagacugggaaugucaaccugagcuccaguaggcacgcacauuccaauaagccuuuaacagaagcuucaagaagcucuaaacaucucauaggacacaaaugcagccaaagccccacagcucagccagaguccaaaccaagauacucacguaaucuucucacucuucuguauacaaaaaagaagguaauaccaacgaaggcuaggguaaggagggcgccaauuccaauccccaucagcuacacaggaugggagauaacaggagggucagcaaggcugaacauagcugcaggccuaucagggcccauccccugggcagcccauagggauuaccaugguggacugggacugcuccuccaugaaaugcagccuccaggagcucagggugguacccaaacaguagccagccugaggagagaacagaagucaggcuggacagacaaggggcccaauuucucagucugagcuugauuagagaacaaaaguaagucagaagcuaggaaggaaaucaauacccugaagauuucugagaacuggggcuuaccagacaacucagcagaccaggcaucugcagccaagccugaggaccugaguguuauccuggaaaguccuacgguccaagacagaacagacugccauaagcuguucucucaccuccacacuauguagaugcuauuaccuucucaaaguuacacacauauacaaagaaauguaauaacuugauuuauacuugucuuuuuuuuaaacauuugcuuauguagaguguucugccugcaugccagaggagggcaccaaauuucauuauagauggugaugagccaccaugugauugcugggaauuaaacuccaaaucucuggaaaaacagcuagaguguucuuuuuuuuuuaaguauuuuuauuagguauuuuccucauuuacauuuacaaugcuaucccaaaagucccccauacccucccccccacuccccuacccacccacucccacuuuuuggcccugguguuccccuguacuggggcauauaaaguuugcguguacaaugggcuucucuuuccagugauggccgacuaggccaucuuuugacacauaugcagcuagagucaagagcucugggguacugguuaguucauaauguuguuccaccuauaggguugcagaucucuuuagcuccuuggguacuuucucuagcuccuccauugggggcccugugauccauccaaugugauccaugcugacugugagcauccacuucuguguuugcuaggcccuggcauagucucacaagagacagcuauaucuggguccuuucagcaaaaucuuguuaguguaugcaauggugucagcguguggaagcagauuaugggauggauccccagauauggcagucucuagaugguccauccuuucgucacaacuccaaacuuugucucugacagcuaguguucuuaaccucugagccaucacucuagcccaauaacuauauauauauauuuuuaaauuuugcuuguuugguuuuuuucuuaagauuuguuuguuuguuuuuuuguuuaaaguauaugaauacacuguugcucauacacaccagaagagggcaucagaucccauuacagaugguuauaagccgccaugugguuuuggggaauugaacucaguaccucuggaagagcaaucaguguuuuuaacuguugagccaucucuccagcccaaauaacuauauuuuuaauuuuagaaaaaagaucaauucuugcaggggugcugagacccucugagcucaacuguaaggacagaaaagcagcacccugucucuuuuggcacugggauggguagcacuuugcuacuggcaaauaauaaacccgacuucuggcucuccaguccucaagaaguaagccuagggcaggucaaagcuaugucuugguuccucuggaugccaauaggacuaggaucacaaaccccacaauccaugaaagccaaucagaaugaaugcucagaaacuccugagagugcgucaagaguauagcagugguggcacacaccuugaaucccagcauuuggugggaggcagaggcagguggauuucugaguucgaggccagccuggucuacagagugaguuccaggacagccaggucuauacagagaaauccuaucucgaaaaaccaaaaaaaaaaaaaaaaaguauaccaugaacuacuugaaaggaagaggcaagaggaucauauucaccuaggaguucaagcccggccuaagcaaccagugaaaugcagucuucaaagcaaaaaaggacgcuggacaaaaaagaagccccaaggaaagauccaucuggaaauugagacauacaaugucaguuuacuucucaaagagaauccugucucugccaccuguggucuccaagaaggcauugacaggauuuuagaugucuaaggaccagauccaggggagggaaggcggcagggaaguaaaaacucagaauguaagggugaggggugacccacaauagacgcuguccccaaaagcuaaagacaaaaaaaaaaaaaaaaaaccagaccugcaucugucccugaguccuccaauauccagccaccccuuucucccaaaaaguuaggaacugaauaguguaggggcccauuuacccauccuuugcagcuucuaccuaucuucuaauuaccaaagccuagccuuaaaaauaaacagcaugccucagacucagcaaucccuccagaaacccaaggagagcugaaggucacacaacaaagaacuccaaaggcacaguucugcauccuaacagaguaaguggguugccuagaaaacucauccuugugaucuuaguucaggaggcaaacaauugaguauuguuuaaggaugaggacgaacauguuccacuaaguauguuccagaggaguugguguugcaugucuuuaaucccagcaaugggaaggcagaggcagguggagaacuuucugaauucaaggagauccuggucuacaaagugaguuccaggacagccagggcuacacagaaaaacccugucucgaaaacaaaaccaguauguucuuuguuuguuuguuuguuuguuuuggcagugcuggaauuaaaggcauuggccaccacagacuggcccagucuguucuuaggcuacuuccucauggugugaaugucacaaggugcgagugucacaagguacuauuaccccaccaacugauacaaucugugggaucacuauugcacaccgucuauugucagccagagcccuguuguacaguguauagagccaguauguuuuugguuucaaaacugaggcacucaccucccuucuccacugccccagcucagcucucaugaccauaucaacuggggugcacaagagcacagcaaccacgcccucuauguucuucggaguuuacuuuaucuaaggaaaggcaccuagguacagucugccgcaguggaccaucccagccuguuuagcuuuuuacaguuauucuuauggauuuacuuuucuugcuuauaaaaaaaaaucccagcacuugggaggcagaggcaggcaggucucuacacgaguucaaggucauucuuuucuagagugaguuccacagauguagagagacauugugucaaaauaguaauaauaauaauaauggcuuuugggauguggcuaguguuggacugauaaaaagacucuaaaauacaaaaguccuaagagaaaacaggaaguaacaacugugauuuuaagaggggaaaagaaagccaggcgugguggaggaagccuuuaaucccagcacucgggaggcagaggcaggcggauuucugaguucgaggccagccuggucuacaaagugaguuccaggacagccagggcuacacagagaaacccugucucgaaacaaaaacaagaggggggaaagaaagcuucaugaugaucuaacagccaaguuccauagcccacacugugaagaaccauugucuagcaacaagugucaagcucgggacagggaaauaccugucaccacucccacauuccccuagaucuucaggaagccucgguagacaccugagggaaaggguccucugaucucuguaaaugcuccgucuggggacuuuaaggguuuuggucucgcccaugucuggucuaccuaccucaaggcaggcaucuuccucauucugcaugacugaaagcaaagcaauguggagggcgaaaaggagacaggcugagacaaacugcuguacccgaaccuuuacagcaggacagcuguaguuccagucuugccagcuccuuuccacacaaacgcucuuauuggaagagacuucagaacucugugcuccaaaacaaguuguuuuccagaagcgucugcuuucucugugugcuuccgucuccuguaaacagcccucacguggucuaaggggaacccacaacugcugcccgggguuggggugggggguggggaguugagcagcacagucagggaucaagcggccacguggggacggccgucugggguugggagguggaguuaggggaggagaccagaaguguaaaguggcugacaguucagggaggugggacagcugagacuggugggacagcuaagaaaguggcacaagagcaaagcagaacagagaagaaggaggcaagcgacagggaaaugugaccagcuagagggugggccucacccgagcggagugauguaggcaaggggguaagauaaagaacgcgguguagaggcacagaaaagaucccagccuagaaggggucucgaucaagaggagugagggaagaggagaugguuauagccgaggaguaacaccccuacccccgaggagagcaagggagggacuagaggaccggguaucgaaggagagaggugaagggugaaaagagacccagccacagcgggcagcguguggacgacaucacaggcucggugcguguggugggaccaaagaugauuaacuagaggaccacauagacuuggccacgcgccagacugugggguagaccgccggucgcuggccgguccucgauagcgcgacaguucgggaaaccaagggucgaaagugacucggaggguccgcaagccccuacucccagcaccuagggcagcacggaugaugcucgcaccagucccacggccggacuaaggcgcugcgguugugagccuucugucguggggcugacgacagcuaagagcgaccgcuccauaggcuagagcccgaccaccaccucccgccucaaggcgacagagcagagcggcgcgcgcccgauccacauccggcucugcgcgacugcgcggauuggcuuagccuccagggccgcacccccuccgcucggcugaggcugggcauugggcgcccuggugaccagucggcgaggcucuugcuacggagugucugaccccgccuacggucggaaacgcagggaggaccuugcugugccuuggaaggagugaccggucaggcgguguuuuaaacggcucaggcuggggaaaccgugucugagcugucucaggucgaaaggguucucccuuucucccuugcgggccgagcucuagagccgucagcccaggucgguaugagcguuuccaguuggcgccaccugcacgggcuucuucgggguccgggaucuuuccgggccgguccucugcgcccguggcuucucguaucuucggcucccacaggcaccacagccaucuuugcucuugggcucuccgguucuggguaaguuccucuggcucugauugauucccucagcugccuuccuuguucuuucagagcugauuuauccagagcccagcauggguuuccugacugccgugacucaaggccuggugcggggagcugacaggaugagcaaguggacaagcaagcggggaccacgcaccuucacuaagagucggggugccaagaaaacaggcaucuauacuucugauaggaaguuugugcaaauaaaagaaaugguuccagaauuugucgucccggacuugacgggcuucaagcucaagcccuacguuaauuaccgagcuccugcaggcauagacacaccucugaccgccaaagcgcucuuccaggaaacaguugcacccgcuaucgaaaaagacuuuaaagaagggacauuugaugcuaacaaccuggagaaauacggcuucgagcccacacaggaaggcaagcuguuccaauuauauccuaagaauuucccacgcuagaagaccaugagagaggccaaaaguuugucuacaaaguggagacaguacugaccaagccuuggauucuuauugucucaaagaguaggggcagcuuccuagcgcacuucuauuaaaugccuuuagugucucguacaguauguguuuugaaucaagucauugaagugugcugcagggcagacuccaugcaguagcuauagaguucauaacaaaucccaaccaagucaagucugggggcacacuucucuggcuccaaggugaggguaguuccuguugggugaaaguagccauccccaaggagagcccuaagauggaagucacaagagcaguuagugucaccugcuuucaugaccagucuagucuaccugauucaucauagccccugagacauuauuugucccauuuaagacuuagcuaacccuuauauuuaacaccuuuuauuuauaauugggccagcaguugagaagugaucccuuuaaugguaaccaaaaaaaacauugcucaccauguauucaugaagacccaaguuaagcccauacuuauaaucucagcaauaggaaggagacaacaggaucucuggggcuugcugcccagccaagucuagacuagucagcuaaccucaaaucccagcaagagaccguggcucaagacaggcuaucgugaauggcagcugagguuaaccccuaucugccacacucauguauacauagaagcaaacaagguaguauuggacacuuaggagacuaagaagggguuacaagucaguccagccugggcuauguaguaaggucuuuuuuauuggagacaagagucuugauguccuagaacuugcuauguagaucaccaggccgcccucagccugacagagauccgucuucaugugcuuccugagugcugggauuaaagggaucaaucaccacagcccgucuuaaagagcugugagcucagcauuugggaagcuuagguagguggaucuuaaguucaaagcccaaccagcuuagacuacauaguaagcuuaugaucagccugaaauauauaggcccagggaagcacaagauagcugggaauacaguucagugcuagaaaaccauaacuugucugccauguguaagucccuguaugugauggaacuucauuuaaaaaaauaacauuuucucuucugaacacuuguguaucauacugaggguuagacacauuccaaugcucucuccagauaagacaaucaaaaugggacucuugauagcuccauagucuguguucccauagaagccaucuauguagacauaagaacuaauaaguuauuaaugcuaugauuaagugaugagugauauggaccauaacaaguaauucaaguuuguguuccuggauagugccacuuccaguaccaaaaaaagguaaaacuucuguuuaggaaauaacuucuacuaauuuuauaaggugagaguuuuaaaagaggggcuguagggcuagcaagaaggcucagugguacuuccugcagagccugacaccagaguuggaucccugggacccacaugaugagagauccagcuucugcauguccugugaucuccacaugugcacaauauuaucuguguaaucacaaaaaaucaaaacuauaggggcugcagaccagaagugggucagggguuacuagugcucucugcucuucuagcacuuacaaagguggcacacagcugucuguaacucuuacuuccaggugauccaauauccucuucugaccucugggagcaccaggcacaauaaaacacucaugcacaggcugga

SEQ ID NO: 675 - RNA, 4204 nt, Mus musculus
gggucagucagccagaccugcccccacuggugguuccguucagcccaagcuccgccugccagcaccccugacucacuuccuuugcaucuaagcggaaaccuccccagagcuuccccuguuccugucccuggggaccugcagaaguuguuaccccuucaagccugaguugggccagccagacccuggcccacccaccucaccgauuggguggaagacuagcauuuccugcuuccugaguugcuggcuccuggccuuggaagggaguggcugagcuggaggagccugcgcagcugcagguagguagcugcagauauggagagcuucaggccagccuccucagaggcaaggcuuuaauccuuccucggcucuuguucauuuuucugcucuuguguucucugggaggauggugagggaccccagauuugggcuuggaugggagcuaagggugggaguggguuggaaggccuagguugugacuagggacagugcuagaauccauucucaaaaccaugaaaguuugucugcauauuccaccaacuguccuaaguauggggagagucucaacucuuagggguacugaguccucuggaacaaggugccuacuugggaccuguaaagccuuugacagucugauaggugcuggguguguuugugcaggguccaauuugaccauucuauaacccuaaucagugacaacgagccuucuguuuauuccucuaagagggaggucaacaguaugauaaauuauacaccucgccccacccccgcacuuccucacagccuaggccuuuucggagaggacccaagagauuugcaugcguuggggcccuccugcugagagccgggcuuccugguuaguggaacuagcgaggcggggccaguauuuggccggaaaguaccuuaaggaaccccaagaggguaagaucggggacucacgaagucuucccauuuuucuauugcagggaggggaacuacaugcccagcauagguccugaaccauggaccgcagccauccuagccuagagccccaggccaagggaccaugugugauagcgccagugcgcgccgugcuccgucugcgccgccgagucugcguccugcgcaagaggcgccucuugcagccaggcacugagccggacucugggacagggacacuugggcccaccggcagcuugggcacucuacgugccgaccuagaccaaccuaaauucuucaccuucgacagccugacagagcugacuucuaggacaccccgcaagaggcgcaggcguagucggguaguucucuacccagaaaccucacggaagugccgaccccgcacagagcggcagagucgugcacagcguugucugcugcuucuuguagccauugugggguuccagguucucaacgccauugagaaucuagacgauaaugcacaacguuacgaccucgacgggcuggagaaggcgcugcagcguucuguguuuggacagccagcugcugugggccgcaucauggcccugcugcgagacuaccuggcuacacaugugcacagucaucccuugcuccuggcacugcacgggcccagugguguaggcaagagucacguggggcgucuguuggcgcgccacuuucgcgcagugcuggaagauggugcuuugguucugcaguaccaugcacgauaucacuguccagagccacgcccgguucaggacugccggaaggagcuggcacagcgaguggcagaugugguggcacaggcugaggccgaggagaagaccccucucuugguccuggaugaggcugaacucuugccaccugcgcugcuagaugagcuccacgaccuccugcagccacagcguucgcaccauuuccacaaugcuaucuauguacuccuaaguggcgcuggugguauagagaucacacacuuugugcugcaaaaugcgucacggauguugcccccacuccgccauagcgcaggcaguacucagacugaggaaucuccagcccaggaguuacucaccagucuucgagagcuccuggcccgagaacacccucuguggcacacugcagccaucgugcccuuccugcuacuggacaagccggauguggucaacugcuucagagaggagauggcaggggagggcuuuuuuccugagcaggcacuggcagaacaucuggcagagcagcucagcuacuaccauguugcuggacaugaauuugccaucaccggcugcaagcagguaguagcuaaggucaaccucuuacagcacaagccugcacaugcuggacacuagccagugggcccaggcaaucggaacuguugaagaaaacaggaaggaugucaggugacuuguccccaagcugguucaccccaggagcuagggaggcugaugcaguggcuuagcucugagcuccacguccguccucuucaccccugagccuugagauucccuaaggucaccaggaaaguagcuaccuucccauauggagucuuccccauacccccagcucccacuauguccaucauaucccagagacaugugauagggcuucccauaacccuaggaaguagccaggguuaugguagauuaucucagagggugugaggcugcgguaggauucugguccucuggaacauguggcagccuccaugccucucacaaacucccaaccaccccuugaaugccuccuuagcuuagaggccacgagguggggacagcuucucugucugugcacgucucuaggccugccucagaaggaaguuagaugucugcaagccagugaguagaucauggaauucuucagaugcucuggggcaugaaccuaagaggagacccacccucgugagacuggcugccuguuugccccagagacagacauguagaauggcguuggaaucagcuacaagguucaggguccugcucaccagaagagacccgagaggagagaccucuaccuccagggagaugaugugucuucaccacccuggggagaccugggaaaccaccaagcucagguuucccaagaaaggcucacuggacuccagucuguccuacugcugaggaacucacuggccccuucccuucccuggcucuggagugacagcgguugaguccauagcaaacugggagccuuggaagugaacccugcuuugaggcugacucgauguaggaagcaggaaacaagcaugaggcccagugggguggggucagucugugcugugugguugccacaguuacacgugggugagguucccuguagccuuuggcaguccuagguucaaccucuccauuugcuuggaauuugcaaggcagaaaggaggcuucuuaguacucuggccgugucugugcugccaucuuguggcugcacccagacuuugccugugaaugcucaucagucuggguuagaaagcggugccucccaaaguguggcuugagggcacacaggaaguggugacacuagaagcgauuagagaggaggagccccucaaugggggugauaugucccugcccacgcuugggggagaacugcugcaaaacuacccagucuuagguuucccuagagaggauugcuaguaggcuccaguggaggucccguuugccgugcguggucugaggaucuggugcaugaccugcugaguuuggaugcuguucaguucuugcaggauuaugccaagaaggccccuaggguugucaccugaaaaccuaccuggaaguguccccuacgcagccaaguguugcuuguagucauucacuuaccaucuacagagcgacuaagugaggguacaaacccgagcagcaucuccucuuuauuuauuuauaaaaucgugcacuucuaaaauaauuucauggaggcuaauuucaggucuaaagaggccuguacacucagcacugagcagguugcauugugcccaugaauaaaccgcagcucaaaucuacccacccaccuucuuuucuuuucugacugucuaugaauugagaaagggguauuaaaaccuguuaauggcugggcuggugagauggcucaguggguaagagcaccggacugcucuuccgaaggucaggaguucaaaucccagcaaccacaugguggcucacaaccauccguaacgagaucugacucccucuucuggagugucugaggacagcuacaguguacuuacaauaaauaaauaaauaaaucuuaaaaaaaaaaaaaaaaaaaaccuguuaaugguaaa

SEQ ID NO: 676 - RNA, 2427 nt, Mus musculus
auacauuuuaaaaacguucuuuagugagaucugugucuggguguggaagaaaguauggagagagcucuggagaaauugcuauuacuagcugcagggcaaggcuccugaagggggcuacuucuaaguaggaaggcagaucaacagugcugagggaaccaucauugggcaggggcuagggugggaaggcuuugggcguggguucucagaacacaaguuaccaaacccaguugacucuucaggucaaggcuccaggggaguagggccagugucuggugagcugauucccuggguccuaccucagugggcuaggcaaggcugucugcagacaggugucugcaccccagguucugacuucccaucccaucccaauaguuccucagcccagcaagcaucccugauccucagguagaugcuggaccuuaggugaguggauuagauugucccacauugccuuuuccuauucuauccuaggucagaaagcuuaggguuaguucccagacugccauuucaauccugaagaaaagaacaccacgcaggaacagagaaagccagaaauaccagggaagcagaaagccacauauucaagacagcccauugggcaaaggaugggcaaccaggcacaccagagaccacaguucagaagaaucauuugcaucuugguauaguggggugaaaggggacucugggaagacucuucuuguuggacagccuaagccagaagagugggugaggggugucuagaggaucagaaagccggcuauagacaaagaguuccaaaggaagccuugguaagccucaagagaggucagcuuugcaaccuauacccgaugggccuauagugugcagaaagggccugugucguggcgcuugggucugcgcacuccuugaauaacuacuccaggcgaagaugggaagcgugaguuguagcagucuuccacguaguaggcagcuggaccugggguuccggcugcagagagaaugagcugacccuagucgucaccccagcaucccuccccucccuugcggcccaagccccacuccaaccccaagcaggccaagacucuuuuucuaugucuuccuuacaggagcugacccaggaugcaaacgcaggagaccggcucauggagaaggcaggugagcgugugcucugcagacgguacccaggaaggauguuauagguguuggggcugggucgcuucucgccagagggcuuugagguaggcaagagugggguauagcuacaaggaccucgggcucggagcaucccugggcggaagcgacucuccggcauuuugacaacagagcgauggcggucuccaaagcugaaggccgggaaggcaggcuggcucagcggcguguacucggcgggugauggccacuaugaagagucaggacgcugcaaccuccuugcccagcuucaucuuacuauccuccuaggccugauccaugcuuuugugcuuuccuagcuccugguucucccucuacgccaaacccaggcauguagccccucccacaggcaucugaccccuccuuuccucacuuccuccucaccuucaacaccccuaccuccucaaggcggccccuucucuuacucuuccucuaccuggcccacauagugucccuaccuuugucucucgguugaagucggucuucugcaugaaggggcuuucacuuuggagccacauggucugccaugcccugcggccaccacccucugcaguggggcggauggucgguggggagguuuucagggcaagagguucccauucccccaguacaggcaggguugugggggcaugcaccucgaaccggguacuugcgaccgaugguguauuggggguguggagaggccucucgcagagacauauugggcaccucguacugggcugggccagggacauccagguccaucaggauuggaggacgucucucgagcccugaugcaaaaggcaagcucuugacccauuucuucgcagaaagcuauuuccccagcccccauuuuggccuggggagugaagacccucacucacacagcucucucagagucccugugcugauagguguggacucauugggggcgccuauucuuaaccugaagccacuugaggaucucuucaucuuugggugccacaucucaucccaggcagucuccagcuccuggucccaccauaacacagcagcagcacugggccugcaaggaagccaacagccacuguucauccaucccaaaggucuucccacuggguugucguucccaccccacccccaucgacugcccucugaaauuacugggugggaugaagagguuucugacucagggggccccgaguccaguguuugccuccauugauguaaaaauuugccaggaauuucacagccuucugaucaaaguucauucuggggcuugggcuccuuggccagagagca

SEQ ID NO: 677 - RNA, 2427 nt, Mus musculus
ugcucucuggccaaggagcccaagccccagaaugaacuuugaucagaaggcugugaaauuccuggcaaauuuuuacaucaauggaggcaaacacuggacucggggcccccugagucagaaaccucuucaucccacccaguaauuucagagggcagucgauggggguggggugggaacgacaacccagugggaagaccuuugggauggaugaacaguggcuguuggcuuccuugcaggcccagugcugcugcuguguuauggugggaccaggagcuggagacugccugggaugagauguggcacccaaagaugaagagauccucaaguggcuucagguuaagaauaggcgcccccaaugaguccacaccuaucagcacagggacucugagagagcugugugagugagggucuucacuccccaggccaaaaugggggcuggggaaauagcuuucugcgaagaaaugggucaagagcuugccuuuugcaucagggcucgagagacguccuccaauccugauggaccuggaugucccuggcccagcccaguacgaggugcccaauaugucucugcgagaggccucuccacacccccaauacaccaucggucgcaaguacccgguucgaggugcaugcccccacaacccugccuguacugggggaaugggaaccucuugcccugaaaaccuccccaccgaccauccgccccacugcagagggugguggccgcagggcauggcagaccauguggcuccaaagugaaagccccuucaugcagaagaccgacuucaaccgagagacaaagguagggacacuaugugggccagguagaggaagaguaagagaaggggccgccuugaggagguagggguguugaaggugaggaggaagugaggaaaggaggggucagaugccugugggaggggcuacaugccuggguuuggcguagagggagaaccaggagcuaggaaagcacaaaagcauggaucaggccuaggaggauaguaagaugaagcugggcaaggagguugcagcguccugacucuucauaguggccaucacccgccgaguacacgccgcugagccagccugccuucccggccuucagcuuuggagaccgccaucgcucuguugucaaaaugccggagagucgcuuccgcccagggaugcuccgagcccgagguccuuguagcuauaccccacucuugccuaccucaaagcccucuggcgagaagcgacccagccccaacaccuauaacauccuuccuggguaccgucugcagagcacacgcucaccugccuucuccaugagccggucuccugcguuugcauccugggucagcuccuguaaggaagacauagaaaaagagucuuggccugcuugggguuggaguggggcuugggccgcaagggaggggagggaugcuggggugacgacuagggucagcucauucucucugcagccggaaccccagguccagcugccuacuacguggaagacugcuacaacucacgcuucccaucuucgccuggaguaguuauucaaggagugcgcagacccaagcgccacgacacaggcccuuucugcacacuauaggcccaucggguauagguugcaaagcugaccucucuugaggcuuaccaaggcuuccuuuggaacucuuugucuauagccggcuuucugauccucuagacaccccucacccacucuucuggcuuaggcuguccaacaagaagagucuucccagaguccccuuucaccccacuauaccaagaugcaaaugauucuucugaacuguggucucuggugugccugguugcccauccuuugcccaaugggcugucuugaauauguggcuuucugcuucccugguauuucuggcuuucucuguuccugcgugguguucuuuucuucaggauugaaauggcagucugggaacuaacccuaagcuuucugaccuaggauagaauaggaaaaggcaaugugggacaaucuaauccacucaccuaagguccagcaucuaccugaggaucagggaugcuugcugggcugaggaacuauugggaugggaugggaagucagaaccuggggugcagacaccugucugcagacagccuugccuagcccacugagguaggacccagggaaucagcucaccagacacuggcccuacuccccuggagccuugaccugaagagucaacuggguuugguaacuuguguucugagaacccacgcccaaagccuucccacccuagccccugcccaaugaugguucccucagcacuguugaucugccuuccuacuuagaaguagcccccuucaggagccuugcccugcagcuaguaauagcaauuucuccagagcucucuccauacuuucuuccacacccagacacagaucucacuaaagaacguuuuuaaaauguau

SEQ ID NO: 678 - RNA, 2621 nt, Mus musculus
cagccaugcaggacaacuaugcacugacauucgguaacagcacccgaagagccuaucagaaggaauuggacaggcgaagccacacacuaugaauugcuuuaauggugguaucuguacaagugaugucaggacacaggacagcaaaugcacaguggacauggcuagcagacaggcugugaaugaauaaagaguucacacugcucccaugcuuuagugacuaagacagcucuaagccaccuccuccucagccuccuccucaaacucucccucuuccucagcuguagcguccugguacugcugguacucggacaccaggucguucauguugcucucagccucagugaacuccaucucauccaugccuucacccguguaccaguguaggaaggccuugcgucggaacauggcugugaacugcucugagaugcguuugaacagcuccugaauagcggugcuguugccaaugaagguggccgacauuuucaggccccgagguggaaugucacagacagcugucuucacauuguuggggauccacucaacaaaguagcugcuguucuuguuuuggacauuaagcaucuguucguccaccuccuucauagacaugcggccccugaacacggcagccacagucaaguagcgcccaugucuuggaucacaggcagccaucauguucuuggcaucaaacaucugcugggugagcucaggaacugucagggcacgguacugcuggcugccccggcuggucaagggggcaaagccaggcaugaagaagugcaggcgagggaagggcaccauauuuacagccaguuuccgcaggucagcauuuagcuggccagggaaucgcaggcaagugguuaccccacucaugguggcggacacuagaugguucaggucaccguaaguggguguggucagcuuuaggguucugaagcagaugucauaaagugcuucauuaucaauacaauaggucucaucuguguuuucaaccagcugguggacugaaaggguggcauuguagggcucaaccacuguguccgacaccuugggggaagguaccacacugaagguguucaugauucugucuggguacuccucccggaucuugcugauaaggaggguacccaucccagacccaguccccccacccagggagugggucagcuggaagcccugcaggcagucacagcucucagcuuccuuucucacaacguccaacaccgagucaaccagcucugcaccuucuguguagugccccuuggcccaguuguucccagccccacucugaccuguaagagaaaacaguaggucacacuaaguaugugcccaaggggccaaaugacaugaggugacacugaauaaaguguacagacccaaaacaaucugccauguuaaaaaaaaggggagagggggugcugugcauaauggcacaagcuuuuaaucccagcacuugguaggcagguaguucugaguuuaaggucagccuggucuacaguuaaagaggccaggcagggauacauagauuggggauggggggugggggagaccagacggagauguacagaacacacuagagcuaagacaguaaauacuuccaaaggcaccccugccaauguucaaggagaguacagggccccugccacuaggucaggucuucucauacucucuacuagcaacuaaucuacccgcagucaguuggaccuuccuccuaaagcugcuuucggccaagggauugagugacucagagggcaagaaaguguacaccugguggcuauuaaggaagaacuuuaggucagccccuugaccuuugagccucauggguagcaagcccguccacaccuccaccacacucaccaaagacgaaguuaucaggucugaagaucugcccgaagggcccugaacgcaccgaguccauggugccgggcuccaaguccacgagcacggcgcggggcacauacuugccaccugguugggacagggggacgucaagugugcucaaacuggaaggguggugaggaggauggaugggguagaggagccuuaccgguggcuucguuguaguacacguugaugcgcuccagcuggaggucgcuaucuccgugguaagugccagugggaucaaugccaugcucgucgcugauuaccucccagaacugcaagggagucgggcguuagcugagucacgccggccggccggugcgcuccaaggcagccccgccccggaugggugcggcaggcccucccccucccuccagucucaggagcgccagggcgacgaaucccuaagggccgcgcaccguccgccccaccgacaccagccaccggcgcuacgucucggcccagcguacgccgguauccaggacgcaaugaagggcgacgcuccgggccgcuuccgccaucuuccccggcuggcugucccaguggcgucuggcucgcagaaaccuagccuccuaccuuggcgccaaucugguugccgcacugcccagccugcaggugcacgaucucccucauggcggcggcgacugcggaacagcuguagaagaggagcacuucgggaggagcaggcgcacagagugcuacaaccgacgcucugccaacauuuauauaccucuuaugacccg

SEQ ID NO: 679 - RNA, 2314 nt, Mus musculus
cacucuagcuugaugcugccaccaccugccuccugccgucuugcccguguagauaguaaugcgaacccaaggagggagccaugagguguccaggguccccacccccuccuccaacaauccucuagcuuggaauagcuuucuggugaagcggaugcagguaagagaagccugggguucaggaaggcuaggggugggguuaagcaggaggggccaccgagggggucucaacagugggauagagugcuguuucagccaaugaccacagaaacaagagauaugcccagacuuuaugagagcccaagaccgccaccuucccuccagguguguaggcacugacuuucuggagaggcauucgggaggccagcaugggucaaacugucacauaggugggcacaggugaauuguagcuugugcuguugcucuguugguucccucauacugucccuaggaugcugcagccugaaggccucuaugccuuggaggaggggacagcccugacagccucacggaaugacugcaucaucugcuacucugccuaugaccucucaguacacuugccucgacgucucuacuguggccacaccuucugccaggcaugcaugcagcggcuggauaugccagcccacgaacaacacuggauccccuguccacagugccgacaaaguaccccugugccccguggaggggugaccauguuggaccuggaccuggcugccuucuuggcagucaaagcugaacgggaaccaucaaaaauagaacccagguccucugucccccucaaaaucagcacuaccaucacucagcagccagcuggacucuaccccaccuugggcccccaaccccacuucccucagccuggaugcugcugcugggguuggggaagacugugcugguaccccccugggaaccccgaagucuaaauucuggccauccccacccccacaaaggaaacucugcuuaguaguuugucuaccuuggaucguacacaaugcaaacagaacagccugcuagcaagacaacucuccuaugacuguacacaaccaaauauaguggugucaccuugaccaggaacauuucgagccauagccuaaggucagagucaauggccauggugccauaagacugcacacuaggcuggggaacucccauucuacuggccuagauucucguaccccaaaguagucugacucuggcuagccaacauccugcugucuaugccucuuguaaacccaggacucagcugagagaauggcucccaagagucugugggggugaguguaugggccugggcagggccaggcuauggguguauguaaguggcuggcaucagaguaggucuuccucucuauaaacauccagagguaugaaucaggagcgagggcaaguugccuccucuauuccuggagucucauguguuacugucuauccaacaaugcucacugagcucuguucucugucugcagcacagguaccaaagaggggugcaauggagggcuagcucugacaaggggucuugacugagaucucacugcucauuauccuaucucaagacucucagcuuucaucuaccacuggugacuauaauacagacccuuuaguaggugauagaggcuacagaugacugacaaccccaagaccaaagcuguaagcuuccauccugcuagaaaggcuguauucaggaggcccugggaggagccuccugggcaguggaugggaggcuagagaauuugcugaauagacauuaagaagacuccuucccugggcaaagucccucaagcagcuagguugggcagugagcagagaaggcugcuggaacuugcaggggagggccuaguccucaucccaaggucuggaaagggccugauccacaaaaagggacauuucacaugcaugugcagacaggacagugcucaacugggaaaagauacucagauaagggucgggcaaugagcucugcccaccucuuuccaugcagauagagacuccaaguccuggacccccugcugggcuccccagaaagcccuucuagaucuggccccacccuuaaacucagauuugaaucugcugaccucagagccuccgugcauucccaggccaccugaggaaauccaucuuccacgcccaccuggugcaaagggcuucucucuugucucucugucaggugcugagaugaacaugauaagguuugcagaguucgcaacccagaaggacggagaagggcaacuuucuugugggguuucuaggcagccccagccagaaugacagcauccugccugggugguguagaauguccauuaaauguauccaaugccua

SEQ ID NO: 680 - RNA, 1894 nt, Mus musculus
caaacuuuggcaaagaguuuuaauggcaaaguuggcugcagcgacaaugccacgcaggguagggccagaagccacagugggcaagaaagggucagcgggcaacaggacaaagccaguucccugaagaagcggcgagcaaggaccugcaggcaguagugggcagguggacacuacaugauggaacaggcagauaguggguuccgcacauggcaggugcaugcagcuccacaguacugccggaaggucugguagcagcugccuucagauucacccccccacuguccaccggauggggcagucagggcuucagguggcaagcggcucaggauggauguguugacagccagugcagccaggccauagucagugaagagcacagucucacgguggcaggugggacaggagaugaacuuguacuuagggcaagacucauaaagaaucugcaggcacugcucacacacggagugcaggcaagacagcacacggggccgccguugagugacguuguauguaugcccacagguggggcauuccaggggcucaccugcuaucacuggcccagacgaugaaggugcagaggcuguugggccaggucgaaucacauacugauuuacaaugaccucauccacuggugccacccgggggaagcccaacucagaacugccuuugcggggccgccuuggcaaggguggagugugggaugcuccuuccaagguaggcaugucccccccacaugccugguugacaaugaucucugugucugagggccaagcacgcuugggugccagagugggagugggccugggugcaggagggaagcaggggguggccgccgggagcucagggaacuuuucaggguggacaaucuucauggccuccauuuugaggaugacaugggggccuuucaggcaggacaugaggaggcccggccauccacugcccaccucaggcccagggucagcuggcauccggcucucuacagucagacuggacguuggcacagguggggguguuggguggggccgugggggaagagaaggggcugcauccugguccugccaggccuggugaggaccacgguuacucuguggacugcaaggggcagccggugacagcuuggagggcaaccccccucccaguggccacaauggcuuaucugauucaguccgaagaggaggaggaagaggagggggagggggaagcaggcggggacaaggggguauggguggcuguuuggggcucuggagcucacccagggucucugucugcugaagcuggcaagggggcguggaggggccuccuccuguagcagaggucagcagucccugggccgggacaucugggcaggcaggggcuaggugggccccauggcuccaggacagggcgcccagggaaggcagcuagccugaucccuggcugccagaggaccugggcugaaggcuccgcggcaacagcaauggagaggccugcaccaggccugagcugcgggugagagacagcgugagggcagcacggggcccaccucacucucgcccuugcccucgcccccauccuucacaaaggacagagugcccgaccucugacccugaccucauccgugggaucuccacggaacucugaacgcaacccccuccccaguauacucuccgagaccggacucacuguccggaggacugacuaugaaaauggaaaggggugaugucucuggcccccgccccucccccucccacccccgcucaccugccccagccuggcguuccccggcugcgccgccgccgcagcagagguugucucaaaggcaggcccggaugcggcgcucacaccuugcucuagugacuccgauagcucccgcggcuccaguggagaccucgggcgauggcgggcgcagacagca

SEQ ID NO: 681 - RNA, 13453 nt, Mus musculus
gugaaggaccaagaguuccuuuuaauggccacaaaagcaggauggggccaaagucuaacucgggagacucugagcugccaacccuauucacucuugcugaaacaggucccagcauauucuaagacaggcuacaggagauagcuuuaggguaaucuauugcccaaacauacaagcuuaggcugggguaagccuggcuucuuggguggcucaguuaccugcugcugggaauccaggcccuguaggguuaugguuggguggcuauagagggcaaaccuguuuguauucaugggauccaacaaaauacaugaaaggaugagccaauaugcuuuaauuuguucuguggguguuaggcagggaacgggcagggacugggcacaggaacauggaaauagaagcuguccaucuagggguugcacaggcaugaaugcuguagucagagccuggaaagggaacaucaguuggaauucuuaggcaggcgguagacaccugcagaauagaugagcugcuggucucggaccuucuucugcaaguagcccugcagcuccugcaggucaaucucagccagcgcagggccagucauuacaaacauccggagcaugcuguagauacgcuccagagagaggcucucuagguugguuaacauggccuggauguaugcccagaagagcuaggaacagaagccaggcaugguuaguuguccacuuauuuggcccaccccagcccaauguggaaauggccaacguaccaguagcuccucuuccuucuggucagccugggaggccaugccugagucacucucaucaucacugucaaucagcaccauguugucccuauccugaggccgcucuuccucaaugacagagaaagugccuggagguuccucccgcagcacacccuguugcagccacacugacaugcgucuucgaagcagugccacaggcaucuucaccaccuugcucaguuccuccaggguccagcuggcugugugcagagccauaggaugcagguaccgaagauuauaccugcuccaauaccuguuagcuagcuggacccccagacgcacguggauuguccuguguaacucauagguaaaaagaaugguugcuaccccuacacucugcugggggcuggggaaucuggcauguuaccuuauagcccaucagauuauagcaauagccccaagguaguguagucaaagcagagcagauaugguucuagggacucaccuugguucuggaaauacagcaagaccacugccuguacuggggucaccgcaacagacagggugcggucagcaagcuccacauccauugucaccaggcccagggugugcuuccaacuaaguguccgcauagccugggcaggaaucaucaauaacaguccaguggguuccaggcagguccagaugaacaaggcauaggcucauaugccaugcuaccaagcauggaauggcucuugcaccaaugccauuccuggcagguagguagucaacagcaagaccaggagaccugauuggagucccuggcuccugaacaaccaugauauaacugcugauaaauugugucccucucaugucucaguaccuuggaacaugaguuauuugcaaagagaguuaauguagauguaauuaguuaagaagaggucauccuggaguaggguagcccuuaaggcacagaagggagugguuaugagaggcauaaaguaugcugacauaucaaaagcugggaaagcaaaagaguaguuuuuuagaggcaacaggaggagcccaguccugccaacaccccaacacuggacuucuauuucccagaacuaaaacauuuuucuguuguuuaaaaccacucagccugugacuuugucuucugucugucugucugucugucugucuguaagacaggguuucucuguguagcccuguuaaaaaggucauaauaagugaagcuucugcuguauagauggcacaugccuuuaaucccagcacuugggaggcagaggcagguggagcucugugaguucgaggccagccuggucuacagagugaguuccagaauagccagggcuacacagagaagcccugucuaaaacagaaaaaaaaaaaaaaaaaaaaaggaugauucugguucuauguagggauacugcucuaaaaacaccuaaaauauagaaguuguuuguacaauggggaagcacaugaagguuaaaccuuagguugcuacaguuaacuggcacgacauggaagaugcagaugaugcuggugaaggcucaaggaaggauaagagcuauugcccauacuauagagaauaaugcugguagagaugagggcacugagaggaccugcugcugagagcucagauagaaacgaugagcaaacacuagacacugggggagcuggcagagaacuaccagccuguagcuagauguuugcugacaugagugugauuuguagauccacccggaacacguagcauauccaggaacauaccccuucccucacuuucuuuucuucauuuuuuaaauaaaagacagagccuuccucuauagcugaauugccuugaaacuuguuauauacaacacgcuagccucaaacuagcagugcugcugcugugccugccuccaaggcuggggugacaggcaucaccagcacacuuggcucaggaucacagucacuugauaaauuggauauuguacacuucauggaaagcaccaagauuuuggguguuaugucagcagcaaugcugacagucugaaugcagugacagagguacaggagagugcacacagggcugccaggaaagccaagggcaccaccaaggccugagccacacugucaacucugcuuuccgugguucagauuugcuuuaggcucaugauccuucuugcugccuuugggaacacccucuucugaacugggcuuguuuuaacaaugugcuuuggaucaaaacaaccucacagcaucaagguggagacgaaaccuacuucagauggauacgguuuuuuuuuuuuugggggggguccucacuauauagcuaggcuauauaaugaaccaccacccuucugcuuuagucuccugagugcuaggaucauagauaggcaccacccaucuagauuagaagagauuuuuaagaacugaugcugaagugguuaauuuuggagauauuggcuaauuuucucauguaaagacuauuaguuuuagaaccacaggcugccaugggccaaacuguaucucuucaaagagauaguaaguaaagcccaggacacugacucuagugacacuguaaguccuaucuccaggguccuuaaucugauauaacuaguaucccaagaagagggaaacagacauagagaaaacuuggacauaaagauaugcauuuaccaccugggcagugguggcgcacgccuuuaaucccagcacucaggaggcagaggcaggcggauuucugaguuggaggucagccuggucuauagagugaguuccaagacagccagggcuacacagagaaacccugucucaaaaaaacaaaaacaaaauaaagaaaaaggccauuuacuuagaucugccagggcuacugcaagaggcaggaaggaucguuucccuuagagcauucuggggcaauacaaugcaguaauacauuucuaaucugguaacccuguacuuugcagugucucauugagguggcacccgggacacugauuccuuugcucuaguggccaccugauggucugagacccuccaggaccccuguagcucuuaagggagaaguguaccaguaaacucacuuuacagauagaaaaggaggcaguaccaguggcuucccccaguuucagccaguuuagcuucccuaacacugguucuaaagccaugaccugcaaaaggguuacaauauacaggcugcacagucggucacccacagacccagccagauccuuuaggagcuuggcugaugaaagauaguggaauuguugccacaggccugaccucuuagcacagggguuugccagagccauuccaguaucagcaaaaauuaagauaaaugacacuagcauauggccauccuaacuauuuggaugugaucaacaagaugugacuaagccgcggcacgccuuuaaucuuagcacuugggaggcagaggcagguggauuucugaguucgaggacagccuggucuacaaagugaguuccaggacagccagggcuacacaaagaaacccugucucaaaaaagaaaagaaaagaaaaggaaaggaaaggaaaggaaaaagaaaagaaaagaaaagaaaagaaaagaaaagaaaagaagagggaaaagaaaagaaaagaaaagaaaagaaaagaaaagaaaagaaaagaaaagaaaagaaaagaaaagaaaaggaaagaaagaugugacuaagccucugggcagugguggcacacaucuuuaaucccagcacuugggaggcagaggcaagcagauuucugaguuugaggccagccuggucuacagagugagcuccaggacagccagggcuauacagagaaacucugucuaagaugugacuaagccaugucugggacccagggcaaaaacuuagcaaagccaacgaguaccucauacuaaaauaggucaaagcaacagcaggagaggauacucaguacacaguacuggccacucagauguccucaaccaggcugugguacucaguagacacacugccauggcauggaccaaaauagaacauacuggugaccaguaaucagacuuucaccuggugucaauagggccacaaagaccauaccuagacucuuucagaaacaaaaccaggcggugagguucucacagcuacugacaaaaacacugcccuucuuuuacuucccuagucagggccuuccaucuggguccuacuuugucaccccucaaguacucaaagggacucaucuaggggcacagauccucagccugaagccaaguaaggccuuccugauuacaggaacaugagacucacacuuuccucaucaggaacaagaugcugcagauguucccguggcacuccugccuguacuuuuuaccuaggugcuccuagcuggacccuaacagggucccacaugcuuuuucaguuagagucugccaccuagaugccugcauccuacaaccuucucacagcaucccugguccagagaacccacugggacacacacacacacacacacacacacacacacacacacacggucuagagugggacucuccaccugugugucagauucuggccucccaugccauaauugaccacaagcucaguaaggauccuugaacuuggccuuaucacucacagaauaccagcuucuacaacauuagggcucagcuaugcuacccagacauggaacacaugggcuaauucuauuguggggucugaugggaugaccagagauacauacuaccauuggccuacuggcguuaccuucaguuucucauacuucuugcaguaaacgucuagggcugcccugauguccucagggaccuccagcuucucaucuuugaagggaggccaaaauucacuggacaauaugacagcauagaccccaaaugguggcuguucuuccacaggccgcuucucauccuccucucggauauuggcauugaugcggcgggagucugccauguccuaagaaaggauaccuuaucaagagccugggccuacugguggugguaggcgcgacugcugaggcaguccuggguauuuaccuugagcaugaccucacagaagugcaugggggcuucaccaaagcgcagcuucaacagcuccacauuacgaaucucccuggaaggacaaaaguuuguccuuguuucugggaggggcugcacuaugacuccauuucaaccaguacccuaagcagacagcugggccagacaacccacccgcucaggauacccugggcugaagggaaggcaggaagcacaacacuaaggucagaguguggucguuuuggcugcuugagguuuggucuuuuguuacguauuguauguauguauguauguauguauguauguauguauuguguuguguugucucggggaugaggagauacucacaaacacgggugauaaguagccuugcuuguuaacuuaaaacuauugaauacaagaugccuaugaccuauagcugggcagaagagggguagacaagguuucaguuccugggcucggagucugaggcaggaccaugaggcgggaagagaggaggagguggggagaagauaccagaugaaucauaaaaacauggccaugagagcuggccaauaguaguuaagaaugucccagauaaaacauggcaaguuauaacucacgaugauuaauagggaaguagacauaauagcuuagagaguugacaucugcccagcucuaguguuuuaaagacucuguguguguguguguguguguguguguguguguguguuguaugucuuuuaucugggaacugaaugauauaagaugagguagaaacucccaauuaagauuaauuauuaccacaacauuuggccaauaggggcaguacuagucauuuguuuuuccccaaauacagaaugaaggcuuuaggucucagcgcccccuggaggucagcuccuugucuuaccucucagggcugaagcugaauugguggagaaggcgaucugcaaguagcgagcgguacucauugauaaagaggucuuugcugccauagaugcugaccagcaggcugaugaugucugaagaacgucgcuuggaacucgacuucacugcacaguguagaggaacuaguguauaucacuagcacuuugacaaggacagugacaccuuagaguucaccugcuagauacagcagucucgcacagccuuaggggcuugcucucaaugucccagacagcugggaauacuaugucuccagcagagcuaggggguugguuccuaaggcaacuguucugauaaacagugccuccuauuucacaaggauccuuacucagccauaaggaauagaacaaagggccuuggguuuuccuguaaaagguugaagaugcuguguucaugcuaaaacuuaagcaggacagagaauccacacccuaugauaacccagcagaguauggccaagcaaaagacgggaccuggccagaauaugccaccuuaauacauaagaaucaggaccaaaucacagacagggugggauaugcagacuucccaugaaucuggucucucagguaccuucuauagccagcuaagguagccagugaggaacauaacaaaccagcuaguguuaagcaagggccucugaacucugacccgccaaguuugaggcaauggcugcuucugauaugaccaggguuggguaacaacauacauaaccagaacccacugaccaccaaagaagcccaagaaaaggcagaggcgaagccgauagguaagcugaccuggaucagcauccacagggucagggacccaguccucgggcucuccagaaucauccucacuguccugaccggucuccaggcaggcagggucagucuuagacagcucaacagccaaguccccagucccaucugaguccccgguuagcccagccacaaucugccguacgguguccucucguguccugccaggauugaauguugcugucccugacaaugugcaugggcaucaugacaccugcuacagcccaugcuauauggcuguacagcuagcagguacuaaaugcaugcccaucuggauucauaaacguaaaaagcccagcacuacccugaaaaaagcagagucugagauacugagaagggcuuaaugaccagcuuugccaaggacucuaccagagcagucacagagguuccuaaggcugaagcuuuacagagaccaggccucuucacauugucagguuuggucaacaaggcugggcccuagauaagcuucucuuuguguggggguaggggaaacagccccuaccuuucacauucucucucucucuuauacauauacacacagcuugacacugugcaacagaguggacaacuacccaacacuagcaaaaggaaaaaggcucccuacccugagucaauccagcccuacccagguagagagagccucaugucuauggcaugucaagguuggcugucgcucugauucugcaaacaccagaggucagcagaaagagccaagugccaguggcacucaccucagguaucgacggaugggcucacaagccacuuccaggaugaccauagagggaucuagcacacguaaugccuugauggcagaaauguagagagugaugaugucacauguguugacaccuagagaguaagagccagauaucacacaacggccuggacagcagccuccugaaugccaacaccuccugaaugggcagcuuggcaacauggcugggugaucuaaacguuaccaugugcucauucaagcagauaacagugaguuaccuucuugccuucacccuaucuccguccauguauagacacagucucuagauuuuuuuuuucgagacaggguuucucuguguagcccuggcuguccuggaacuaacucuguagaccagguuggccuugaacucagaaauccgccugccucugccucccgggugcugggauuaaaggcgugcgcuaccacacccggccgucucuagaauuuuauagaagcagucuguuauaguuugaauuuagaaugcccccuacaugcuucgguuuuuuuucuuuuuaaaauuuauuuauguaugucaguacaccugucuucaaacacaccagaagacaacaucacacacauacauuagaucccguuacagaugguuaugagccaccaugugguugcuaggaauugaacucaggaccucuggaagagcagucagugcucuuuacugcugagcaucucuccagccccacaggcuuauguuuugaaugcuugauucccaacuugcagugcuauuuuaaaggcccaagagucuuuaguaugccagguguggugguguacuccuuuaaucccagcuacuagaaggcagagaaaggcagaucucugaguucaaggccagucuggucuacauaaagagacccugucucaaaaaaaaaaaaaaaaaggagccuuuaguauucagggcuuagcuaauagaaguauguuauuuccugaagacuugguuucuugucugucaccaaccgacauaccuuuuccauuaugauggacuauacucugagaucaagagaauauauccuucugcccuuaaguugauuuuaucauauauagaaacauaaaaaguaguaauauauaaacuuugcccuuaggaagcagccuauuuuaaaaagaccacaaacuuccccagaccaaaucaugcucugacuuccuccaaaagcucagaguuagcccggcuuucccaagacuucaaaacuguucaauaacaugcuccuuucucaggccgacaaauccagggcuaggaacuguaugugagcccugagggcuauuugaacggcaggccaguggccacacaauaccuggguggaggagucgagucucuagggccaccuugagggacacaagaaguugcugccucugaucuguccucuccaagcaguacuuaaggucuucaauggcuggccgggagucuggaaagucugagagagaaccguacaacagggauagguuaaguggaaagguguacuaagcacgaaaggacauacacagcacaagguacacaaccuggcagggcucagacaagagccaccuauguucuacugucagaguaacugucacuggaggcuaaucugaccauagaugacuuucucguuugaucugaaugacugcuucacugaaggaacacuuugcuaggccaaccaacuacucucucaauccacuguggaucauuagugcaacauuaaugugugagguguaguaacacuuaaagcuccaacagcugcccugacucacaccagucaucccucccaugguuuacaguuguagauagcucaacugucucaagcuguacuaguucuugggaaaauagaaauaaacaguguugucaaaugacaacaauugcaauuaaucaaaaaugccuucaaaucuuuuuccccccuucuaguuuuuugagaccacugagugucucuguguagcucuggcuauucuggaacucgaaccguagaccaggccagccuuaaacucacagauacccauccaccugccucugccucccgugugcugggauuaaacgugugugccccaacaccuggccgcaaaccuuuuuuuuuuuaauuauuuauuuauuauauauaaguacacuguagcuguccucagacauuccagaagagggagucagaucucgucauggaugguugugagccaccaugugguagcugggaucugaacucugaaccuucggaagagcagucggcgcucccaaccacugagccaucucaccagcccccaaaccuuaauuuuuaagauuuaaaauguuucuauauguauuugcuuacagggacuguuugccugcccauauguauagguuccaugugcaugcuuaguaccaguggagggcagaagauaguguuugauccccuggaaauggaguuacagauggcugugagcugcuacauaagugcucaaaacaacccgaguacucuguaagagcaacaagccaucuuagcugaugagccaucucuccagcucuacccuacauucuucuauauauugacacuugauuauaauaaccacacaugacauggggccaguccuaaguaggaaccaagaugaaagaaacaagaguggauaccuaggggcuggugacauggcucagcaguaagagcacugagcgcucuuccaggagucaugaguucaaaucccagcaaccacauggugguucacaaccauccauaacuagaaacaaauaaugccuaugggccagagcaagugggaccagagcuagagggagaagaagggggagguggauacuuagaagcaccugcucaaugcugaccuagacucugagccaugucagagggagucuaccaugcucaccacccugccaacagcagaagggaaagcaaaggcaaucacugggaaagguagcuccugaaaauuaagaggcaggaccaaccucggaugaugcugaaaagcuccucgaugcguaggguggcauagauacgguagaagaaucucuguacguggcagcgccaacgacgcaguguguucccagcuucuggagaaguuggucuggugggguuguccugaaggaacacuuugccaagccaaccaaccacucucucuauccacugugaaagaucauuagugugugagguguaauaacauuuaaaagcucccuucugacucaguaaccacacaccuuuggcaggacccuagaggugccccaaccuguguguagaggccagaaguaucaagucuacacucuacugcccaggaguuuccaaguuuacgacucuaggccaagacugcugggacacccacuuuaaucacuccccaucauggcuaauaugcauccacagcagauagacucuugaagaaugggaaguacggagugaagcagaaacaaggucuauggcuucauggggcugaaccuagcuucuucacaauacaaaccauaccucaacaguaugggcaaccagaagcauucacugggacacccuagcuccaugcuagaguguacacugguuacagguuaauccugaagggaacuguaggcaauggaaacuuguaggcaguggaaagaaaagggucucguaggccugucuugccacaccuaccugaggaaacucguuguagcuaccucugguccaggauuuaaaauuuuuauuuuaaaugcacgaccuauuuaguacauacgagauuuguucuugucaucaggauccaggacuggcuucuauagacagcaccaggauaaccucaaccaucaccacuccuggucaacuugccuacuguuugguaucaggucuaccacaacuccacuuuugccuuuaacaagaaacagaccagagaggugauucucaccuugugaaacucacgcaaaaaagagcgcucauacucuccucggcagcggucuuccauccuuucccgggucaccugaugcagggugguugucacggccucagcacaaacccgcuccagcagacugagccuaugccuagaaaagauccccgcucauggagaacccacaacacacaucugucccuuaccuaggagggcucuccccauaaagauacugcacacacacccuaugccuauguccaggacaguauaaacgugaugaacaauaaucccugguuacaaguaugggcaaaaaagacaucgccaguuagucuauaagcucuauugagaggucuuuugaauucaggacuaaugaagcuugcagagaaaccgcagcaugguuaggaagcaguacucacaggaccuggcucagcugguugaacugcuccagugccugccggcaccagcacugcugcuugucacugccacauccugcgcacagaggacucugcaaaagucgguaguaccugcggcgggcauaccggcuaucuagcucacccucuaguuccgggucugugcccccuucuccuuuucucuugcucugcauauagacucucaagaaacgaccauagaggcgcuggaccaucuccuggaauguccuagggguggaaaaaaacaggacuccccgcaacauagugugaacuuucucccgaagccccugagcuccagcgcccaucagcaagcccagacgaguccauuucucuaggaguucuaggcuaugcagauagggauccaagcggcuuuccagcagaccgaacgcauccaggagcagcccaaggcacuggggcucaucgacagaguuuucucgcagagcgauggcauuccagaacuccguggcaauauugccuugaaggucguucugcagcacuuccacgaaccacuccuccaggacagagugcagaccguguccccucagaaccuccaccgcugcacgaagcucuuccuccuuuggugggacugcaccgcugguccgggaagacgccuggagcacggaaaaccgugagcagaggggcggaauagggguaaagggagaggaggggcauggaaaaacccagcaaccgaagagcugccagggaaccaaacaaaucagguagcugaggaaggaggcaagcccacuacaggcaggccacggagcugugaggccccaaggguggacccccuaaaguaugcaaagucgcgggaaaucugcacaggcccgacaaccuuuccccggccucaccagccccagcgcggccggcggcaccagaccggugcucacaguauuccaggcaaccaagagcuccuguccaggccuagagucgcagucaucggaggcaauaauugucgccgccgccgccgccgccgccgccgccgccgccaccgccacacccucggccuccaucacuguccacaaaacagacccgcccaguagagcgcacggugaugacgcaag

SEQ ID NO: 682 - RNA, 1047 nt, Mus musculus
uagagguguguggugggguugggggcuggacauggcccccuguccccagccugaauccugcccagcuggcagcccccuuggccugauaugucugucccuuuugcucaucccugcuucaggugccuccucccaguagcccuccagccaaaaccccucccuuuuccagacagggcaagccauuuguguccuucaagggccacagggugggagguggaccugagguccuccacaggcaggugacuggccccuggucuuguggccuuguuucugcagcuggaaccuacugugaaugcagccuuggccucagccgugaggcccuuauugcccucauuguggugcuggcuggugucagugccagcugcuucugugcccucguuguuguggcgauuggugucuuucgggccaaggggugcgugagcuugggauugggcauagugggagugaggccguacuacugacccugggcuguuagucaugcuuugaggggccucuuccuggggugguaugacacgagaggcuggcgugugcugggugugaggguuguaggaagauguuccagggacuuucggcaugugaaaugagcauuucuccagaguucauaccugccuuugucccccucagugacacgugcccuggacacucggaaaacagguaagugugucagaggaagucuuaagggugagcuguguccucucucugcccccuucuggaagugcagcucacaguuggauugagagcaauguccucaagggcuggcuuccccuggguggccaaggucuuguuggaucaugcugauguagcucaucaugcagguugguggggcccuacggaguccaggaagaucgcauagaccugcacacgguacauguggagucccaccucauggacccugaucuggacguauccaugaugccguccuuggauggcccaggccucaugaccaugacugcuccucuagagccaccuccacccccuccuccuccucccccacuuccacaguaguggagagcaacuaggguggagaauuaaacaguauuuagugauuau

SEQ ID NO: 683 - RNA, 1278 nt, Mus musculus
aaugucagaaaauuuccggguuuugucuauuguugacgccuacagggaaugugaagggaggaucagggauuuggggagaguucucaaaguacggaggcacuucaggagcacuagaaacaaccugcaguccccuuaggcuuggauagcugcuguuacagggcucccagcauccuccagggagggugggcccucggggucuagcugucuccuuaguaaguggcgcaccguggugcggcggcggcggcggcgccgugcaccacaagcagugagcacggagcccaaugccaggcagauggccaaacuagcaaggaaagagaccggcccgagagcguagaccaccgccaggucucgcgcugcuagugacugagugcacuguuugaaggcggcauccggaaaagcugucaguaggcugagcgucuggagucuuggagacacgcagagcagggucucaguuucugcgggacacaggagcggcgucagauggcagcaauugcaccaaacauuauccguccugcgccccagauggcucaccugaggcuggacgcgggugcuuacgcagccaagugcaaaggggacgcagcgcacaguugcacguccagggguugccaugcaagcgcaacacaucgagggcaggcaaguuauucagcaaacccgccucgauugccgauagugaauuguccugcaggcugagcacucgcaguaauggaagcgggcccaggaucgaaggcuccaggagugccagccgguuacccgcuagggagaggaaacuaagcgcgcgcagcggcgcgaaggugccaggaggcagaguuuccagcugguuggagcucagguccagccauugcaacacucccagaccccagaaagcucgugcgugcaccgaccgaagccgguucucccucagaucuagguauagcagcgcgccugcauuggcgaaggcacccggaggcagcgcgcucacgcgauugugauccagcagcagugagcguacuugccagcucagguccgcugguaccgcaggcagcgcgagugcggagcaauuggccuugccgccuagugaacaugaacaugccucggggcauucgggggccaccggggauuuagaaggggcaguuccaauauccuccuggguccagacucgccucaacgacagcagcagcagcagagagaguugcggcggaagccgcgagaaaaaagaaccccgcaugugcggcuucgggcuuuggagucaaggugccccaaagccgucucagccucaccugcacaaguauuaacucuccu

SEQ ID NO: 684 - RNA, 7711 nt, Mus musculus
ggauuaggggugguuaugcgcgcccggugucccuggggcagaggggcagcgcgcugcugcgccccaguggcucggggaaggcacgcgcuuggacacugggagagcuagucauguacaagguugggugagugacaccggacugggaggcggauggcacucccuggugcccaaggugcggggcuccucucaagccagcgucugaggaagccuauuguggcugcagacagaagagaaggcucagcccucuuggagucuggagcccuagacaucugggagccagagagcaccccugggaagcgcugccacuagggcagugaaggcuagcccugggaaaggucggagccagcccagugaauggggugggaagggucgugggaggauugugcagcaggagagaaagagagauagagguggaagucagguugcagagagcaggcgcuggaggagggguggagggugaccuagcaagcuggggccaugggcccccacuguagcuugggguaguggcuggaggaaggauggggcugccauuucugcuccaggcuccuccgaccggggccacuuaggccccucaccccacugcucagagaccucagggcccugccucugccggagcgcccuguggcccugcccagccggcucagcucuggcccauccucagccgcucugguccgcaccuugguccugcaggggcugcccgccaggcagcagagcaggaggacgggaggcccagggugggcagucucuggggcgggugggcuucccucaggccuucccgagcagcaggacucaucaguguccuuggccgggcuaacugggcaggugggcgccuccgggggccucacaccacggugcugaccgagggaucugagagguugagcgggcccgugauaucagugggaugguacugcuguaaaauagaaauacacagacaaggcggcccguuagcuccgacgucgggggcacgcgcggggccgggacaggguggaccggccagccggccgaccggcgggcaggcgggcacggccugggggaggcugggggugcuccucccccgaccccgucgugcuccggggcucugcgugggccaggccgcugucccgugcgucugucugcgggggaggggcagaggagggcgggcggggcgucucagcucucccuaugacgggaacacagcugcagcuggcccuccucccucucaauagcgcgucgcggcagcacugugucuuuuugguuuugcaaagcgccgcguccacccccggugcucuauaaauaagaaccaacaaucaauaccugcuggccccgccggccaccagggaucccagcccugagcgcccagugcugcccuggcccggaccggccacaggacaggggcaaaggaucucagcagcuggaccgaccccaccccacccaaaggagcccccacccaggccucccucugaacagcacccagccccagagacaggguggaagcugggcuucccucccccacccagcccccagaggucaacccugcaggguggggccagcuccagauggcccagaagaacgggucccuggugcccagggaggcucagguaaagauugaacugagagcaaggccccagaaaggaaccacguagaucucugaguuguaccuggccagcuccagauggagccccaagacuuagugacauccacugaaaauggccugccaccugcaggacuuuugugccuuccccacuauggccaucuggccccaaaaguacagaucuucuucuucccugucagauuuccccuuccccacacaaauuccagcccacagcucccuuggcccugcucuuccaccccugcgcccccuaguggggguucugauucagaccuuguaacauagaccuugcccacuuucccuggucugggugacccugaagauaguguuuguaccaccagcuccuggagccucaaguuggugcaaaccacagauucuuacucuucauccccuuuuucugaaccaaggccuuuggagagcugagcagccaggccuugugggucucucuggagcacccuaguacauuuugcuuugugccaaauccugucaguaugccuuucuuccugggcauaggagcauaacuauagauccagauuccuugugggacacaagccccuugugggugacacuccccacugguuagagggcuuccugugggccuguuaaaggguaacgucauaggaucagggugacucuagcaaaaagcgagccugcuggaggacuuucuugugagcauguacugcuggugcggugaugugacgcugcccaagacagggaaccguuuucuggcucagaaggcagaaggucugacucugacaguggcccguggcagugcuuggggguuugagcgggaacacaguucuuagccuccccuucccggaccuccuucugagaaccuguuuugccuuaggugcucaggccccaggccuuucaagaacacccuauccaugcucagaucaccugggugcugcugccacaccuccaucagggaccuguucaccauggcaacaccccacuccccaccugacagucucccuguaaccaagggucaaugccaaugcuaggccccagucguccacccagauggacccaggcccggcccccagcccccggcccacacagagaccacauggaagaugcaacacgcauggcucuggugagacaggugagacaggugucuggggggcggggccaguggccagacagacggacggaugggacaucacagcuacacccugcagggcuguugcagggcaagaaugaaagcaucaagccccguguggagaaacagggaugaaacagacgugguguggccuccuggcaggggcagccugggacagggcuacucugguucccaggguccggguagcccagagaggcagugaggcugacugacugaccaacaacaugacacagcuuccagauggcgugugggucauggcauggggagagaggugggcagacuaacguggagacacauggggaagcugagggcaagugagggcuugaggagaggucuggagcguucuaaaggacagcacccuuuaauggguggagggugggugaaggacugacuuggcacagauggccaggguugaagaugggggcaggggugggaugguaagggagagggagacagacauggggcaaggggggagucagagacgcgggacuggggugcuuccccuuaccgugucuuuggaggaccuacgucucuugaagcuggaggccaggguggaggugauagcccuaaauguggcuuucuuuuuagggucgggcucugcucuaccacucuuucuauccuaaaaugaauauguauaagcgauuagacaacuaaggguggcggccacaccugcccuugccugcuccuuggggccgcugccaggccuggcaggucacucaggcccugacuccugccugccucacugugcugaaaagacggaccaacagccagacuuucaagaguggccucuucugcccgggguugggccuguccuugcuugugcugggucugggcuugggggguccugacggcacucuuccugggauguccgccuggcucccuggcuccuggguggcccuggcuuagaggcauccugaggaggaggagccucugaggacaggaagagcuuccccucaggccacaccagccuuucuguucagaggcugcugaccccaaagggcacacaccaggaaagggccaaggacccgaggaaauguccuguuggaguuggagugauagacagaggcagauccggggacgcuggccuggagucugauggccagcauggcccuggacaguuguggccagguccccaggggaccuguagggccaaaagcaagaauggguggaugagagguaugggggcuccaauagccccguccgcccauagcccucauugcaauguuaaugccagcucaggacacagcuccaggaagacacccagagaaagagaagagacaagugaaucggauccugaccauuggccacuagucuucaggccugugugagccucacugcccacccugucccuuucccuggugggcucugacaugcagccucauccccacuaaccacaaauccacacggauguggccugaggcagaucagcugcauuuagauuuggaaucacaaagcaagacacagcaugaaaagggguccccagauggugucagaggugcuuggaugauagaaggauaaugcaucucagguucacacaggagggcccuugucuuacccugccugcuugccuuccuauggauugggugccaguagcugaccuuggagacagaggggccgggcagaggcuugaagcagggugcauggcuucccuuggcccagcuuggcaguggguggccaccugcaggcagccccugccugugcugccccugugccuugggaacacucaccacugccccuggccauggcuccuagcaccaguccugcccaugagccagagccagugccacggccuguagggauagaguagggccguggccuggcggggcccuggacgccaggccucggaggguggccuguccuaccugcagguucuuccuccacacguucacggcugcaaaagccagcugcaucugcuuccuacgggcauccuugugucgcuuguaggcgaucucgaugaaaaugaggaagaucccagcuacgaugccuccagccaccagcaugaagaccccugugugaagggacccucagcagccugcccagaggcuagagccccaagagaauccaucccaggaucacggcagcauggaaggcgcaccugccauguucucaaaagugaggguggcaggggcauugcugcgggagucacauucuugauaccgaacccaugucuuauccaggucuuccaugaagccauucucaugggaccuauguaaggaaggggucaggaaaggcaaagcuggaugcagggauggggauaggaauagguggggcauucagggggaaggacugggagugggcgggacucacaggggaggcaacacuguggaccaggacuugcaguccaaauaaggcuuuuggagucggggaggucaguagccugggcugggcugguaauagggaaggcuuccccaugggguugaugccugguuuggguggaguggauccuuuaaggcuguuguaccacaccauacaguaucuaguuagcagcugucagccaggccagggguggaguaguuuggugugcuguggcuggagcauuggggacucucaacuuugugggaggcucuuggagcaaaguggagaagggagaggagguuuccagcauggggcagacucacuugaguauggacagggacacauuuugcuuccaggggcuguccuugcgcaugccgaugccaaagccggagcggaagaacagcucacccguggucaccagaucgcacuucugugaagccucaaacuccagcacagcugagucccagaugaaggcauggagcuugcugccggcagagucagggucaaaggagccccguguagccuguucaccccacccugcucacacugcagaagacagucuucacuuguguuugcugggugagagggcuccccuuuuccugucccuuuacugucccccccagccagggcggcccuuggucugccugcucacuugucccgcacagccuggauggccucagcugcacucucauaauugugcuucuccaugugccgguacauggugcucaacuccaccugccuccggaaguagauauccacagagcucuguuuuacaguugcauagaugaacuugucugagggguuucugagcugcagggacagagaccucaacuuguggcugcuccccaagcaccacaagaaacagacaccucccucuuaaccucuugauaccccacacacaaccugcaguccagaggccucacccuggggucauugaugccugugaugcgcuccucaggccuauccagcaccaggaaggcugccagguuggcaguguaggaagccacgaugaucauggcaaaaccagcccacaccaugccuaggauacgagcagagaaacuccggggggcaccugugggcagagacuugggucaguuccuggaaagcugggaaugcagccauccaggcccugggcuuaaccucaccuuccccaaugccagaguugagcaggacgccccaggaaaaccacauggcagaggacagggucagugcauccuccuccuccuccucgcuguucaccuuaaaucggccaaagggacugcggagggcaaagagaaggcgggagagagggcaggagaggcagcucugcccggcccugcuuaguucugccccccuacacaugcaggggucgggcucucugcacgugcucaccugaagcgguccagcagguacagcaucacggccaccacaugaacugacagccccaccagcagccacagugugcucugaaagggcugcaugaaugaguccagugugcuccgagggaucuccugcaggugaccaauggucggugucaccugggccuuccaugccccgucccauccccaccuggucccugccuaccuucuugaccagaauggucaggcccugguacuugaagggcuuggagaacucuauguacugcgcacgcucauuguuaauggucaguggagccacgaucaugucugcuugaccacugagcagcucucccaucauuccguuccacuccuuuuuguugcuguuguuuaccugcaacgagacagaaccgguggggcugcagauggaaugauuacaacuccuugaacaagaacucauggaccauaguaggcuuagcacauggggaguuugucuccugcuccacgucuaccuaacaucuaaagcccagcccaaccaccaggaccccgcuaaaaaggcuccacccagcccauagacuuugcccucucaguucacaggacucucccauuagccccuuuacuccauacccgcuccugugugccaaacuugccaucugccacaaggugcaccucguagguaaaauucaugguccgugccagcuugaugagcaggucaacgcagaagccauaacagcacuggggcacugugugacgugcugugagcaguuagggaauauuaacuguggguuccugauuuggagucccuucgcccugccacacuuugccuaguacucacggcuuccuggggaugugucauuaggccccguacagaucaccuucuugacagggucaccauugacugugaacuccucuuugcaugugccaucacucauugugggcuugacauacacgaaggguucuugguggauugucacuaucugcacggaaagauaagaacuagccggggccaccuggccuuggucauuuccaggugcuggcuccucagcacacagugaccuucuucuucauguuuuccagugcugcaguaaaucccaagccuaaagccucccucugauuuucagucaguccacauccuucugacauggcuaguauugccugccugcuacccuuggggacagauccaggucugggguuguggugaugcugaggcagggcacagacaucuauagccaccugcccugacucaucaaaaaaugcauccugcaguacugcgaccucuccuguggccccuuucucucaggcugcagcuuaagcuuauacauucuucuuuuauuuuucagauuuuuuaaaaaaagauuuauuuauuuauua

SEQ ID NO: 685 - RNA, 3133 nt, Mus musculus
cuucugaggugccaaucagccugcacucgccucugcccuggccauggcacugcugucaguuucuugguaccugucucaacagcagccuugucacgugagacuauggcuggcggugggggugggggcaggaauccuagaagcacaggagugacauagggucgggucgggcagagcgaaguguaggaagugauccccaaagggaugcuggggacgaucuggccaacacuguccucccauucaaaacucccagucuggagcucugggacauggacaagccaggccugcuauucuccauacagggcuccauagugucuggcucagcagagugggggaucugguggggauggaggaagcuuagcuaaaagcuuuguauaggcugaagcucugagugacccugcugggccacccuacccuggucugggcugggucauugcauccccagauuggaaggcuuggugagauggagaggaaccuuggcuacaagcuauagcuuugcccaccagagccugcuggaggggaaucaaacaagccuggaccugaggcugggacuagcuuuccuguuucuggaguggaugccaacccccugcccaccagccugccuguccacgccagggacacacagacuccuucccuuuccagacuggaaagcccccuccugggagagcaggaaggaagcaaccugcaacucuuccagcccuggaccuugggcugaaccuacaguucaagguuuguaugcucacaggucuuggcagggaaagauaagaauccccagggcacccucccccccgccccccaguccacugcagguagcuccugggucugcccuucagggcaagugcugacgcuccaucagacugugauggggcccuuuucugaggaugacaauucugagaacaaggcauuuuucuagagguggcagaacagcauuuugugaugcccgaggaucugggagcacagguccagcuuaaugagggauuggaggaaguggguaucaucauuacagggaggggccucuguggccuccugggaaaaugcaguugcucucuuuggguggccugggguuguguggugggcagaggacggaggugcucauugggggaagggaucacuucugcucagagugcucgcaagggccuuuccuuuuccugaaggcaagcaggccuccuccuccuccucuuccuccuucuccucuuccuccucuuucuccauaugccuagcuggucauuucuagggaccagcaugguugggaagggggccuugucuuggccuuccucuugucucaauucccucuuugagcagaagacggggugggugggguaggguuggauagugguugaugccaaagauugaagggguagggcggggcagaagugggaaggucccuggcuuccucaccuugguagauggugaggagccccagagguugagcugagcagcagcugugauuucagggugccucuguuggagaggcugcugugauuugaaaaucuucuuuccuuggugacaauuccagaaggcuccagaugaauuguauuggugagugccuggcccuuaagcagucccagcuggggaugauggggauuuaugggugucccugagccuagggugacagggccucuccuuuuuuuuuuauucugcuucaggguaccaccccaccaggaggcugcgggccuggggcggccuagcuggaggagcaacauucaugguaauuugguuuuucuggcuguggggaucagcuccuggaagugccccugugccucaguccacacucaccauccuuaucuggcacuggccuuucaccaaccggccgccagagcuaccuggugacaccugcacucgcuauggcauggccagcugccgucugagugcuaaccggagccugcuagccagugcugaugcuguggucuuccaccaccgugagcugcaaacccggcaaucucuccuaccccuggaccagaggccacacggacagccuugggucugggccuccauggaaucgcccaguaauacccauggucuccaucgcuuccggggcaucuucaacugggugcugagcuaucggcgugauucagauaucuuuguacccuacggucgcuuggagccucucucugggcccacauccccacuaccggccaaaagcaggauggcugccugggugaucagcaauuuccaggagcggcagcagcgugcaaagcuguaccggcagcuggccccucaucugcagguggauguguucggucgcgccagcggacggccccuaugcgcuaauugucugcugcccacuuuggcccgguaccgcuucuaccuggccuuugagaacucacagcaucgggacuacaucacugagaaguucuggcgcaaugcccuggcggcuggugcuguacccguggcgcugggaccuccucgggccaccuacgaggcuuuugugccaccagaugccuuuguacacguggacgacuucagcucugcccgugaacuggcugucuuccucgucagcaugaaugagagucguuaucguggcuucuuugcuuggcgagaccggcuccgugugcggcuccugggugacuggagggagcgcuucugcaccaucugugcccgcuacccuuacuugccccgcagccaggucuaugaagaccuugaaagcugguuccaggcuugaacuccugcugcugggagaggcuggaugggugggagacugauguugaaaccaaagagcugggcauccaggcuuuuggucaccauggcacuaccccaaggcuuuuccuguucagugagcaggaauucaggauauaaggagaaaacugggcugagaugcccuggugggcuuuagaguaggggcccaggauaagagacaaugaauuaaugaggagcauauggggaagguggcugagggucccugacuuaccuugacccauggcugaaggcuccaugcccauggcuggagcugggacccuacacuucuauagucaaggugcuuagccucaagguugcagaugcacccucuaguacucugggugcagacuguacacugggcgcaggggguuguggaaggacagugcagaugauucugggcuuuugacaccacaguucccccagggaaagaggcacuacuaauaaaaacacugacagaaau

SEQ ID NO: 686 - RNA, 3072 nt, Mus musculus
acccagggccaagucugauguuuaaugaaaagaccuaggacaacagagcuguaugaaggggugcuucuggggacagaaaggagagacuccaagagugcauucaggaugcucagaacucucugaggguagcccacuguccacagcuucuccacuagauggccuuaucgcggcaccucugcaguagauaaaaaccuuagcaggggcaggaaagaccuugaccacagcccuucacugcucugcccuacugaccacucaccguucaggauguguaauugguccgcagucucgcagaaaccuaggggcccaggcaguaguaagagggggucgggcgucacccaggagggucacgggcuggggacacucaccauacuugggaaagaaaagaaucugaucuucugucagguuggcuucccugacucgccgcucaaacacauccaggacagagucauucacuggcagugagcggacugugggguaggcagaguuccagugcuuucaacauggcagggaacccaggacacacagccaggucagcugugugucccugccccauccaguucccaccccaucccauguguagcuguucaucaagggugccuacugccaagaguauggggauagaaaaggaaugagaagggguguguguccaucuggggacgcccuguccaucaagguggaccuggaggaugcagagcacaggucaugugugaaaagcacaggccauguaugaucacaggacuaguccgcaccguauaguuucacagacagcuuccuucccuguuccagguacaggauggcaaagcucugauagucagucucagcaaccaccauaugcacugguccacgggcccgugagacugcggcagaaccacaacagcacaucaguccuuuccccucugccuccagcccagagcccucucccuugaugccccugccucaccuuggaacaagaagcggccagggaccccuguguucucaaagaguuggcguaccugccaacauaucccaucucuggggaggggaagaagguaugucauaagaggaggcacccagacucuaggaaccccaacccaggagaggccauaugggauagcuaucuaggccacagaagagcuagagaugagguuuagagucaggagggcagaguaagaugggcucaggggcugggaugaaguccugcugggacucacagcuuucggaaggugcugacagccauagcugcacccuggggagcugcgugcaaugugguggccucagcucggugucccugcuccugaagaaagcggcacgaagagcccacagccaccaggagccaugucccugcaaacuggaaguugacuaugagugcucaggacuggggaaauggggcacccuggaccaaucccgccaagcuaggcagguucuuauugcucuuuuaccuacccccacucacucccagauuuuaccuucugagcacugaaauugaccugggccuggauagugcugaugggggagguagacccaauaggcuuucgaguccuuuggcccagcgaacuggcugucaagagcagggugaagaacaacacagccccuggagacagcauggccaaccugcuacggacaguaggugacaggacagcgagguggaggggugcacuguccuaggucagaguccacuguccagugccacaggaagcacaguccaggaaguccacaucugucuuccgauuacugaaccccuaacccaagccaggguccauccuagaaccuagccuugauaggagcugggcauugugucccaagugcaaaguuaagaguugaccucugcaccccuauuuccacuuguggucagugcucaacccuaugcaugcaauaacugucuuuaacuccacaaccaacaagaacgugcucauaaagucacuuguucaaagcccagcagcagagagagcagaggcagagucucgaaccggcccagcugagccuggcucaauccuccguccuuuaggguagccaggagugaguacuguucugugagucagaacgcucggaaaguaagaguuugcgcaggcgcauaagaaacgcuggcugcuagucggagccugaggcgcaggcgcaagacggggaaggggggggggggggaacgguccaucgaugccucggggcucucagcgucgagccuggcgccuccauaaagacguggagguggagacuagagcggcggcggaagccgggcgcagcgcagcgggcagaggcaccgcggugagucccggcuuuggccccgccgugcucacucaccugugucaucugcccuguccccagucaccagccuugugccccauuacucccaguccugcauucaccagccuucugccaccuucggugucccuuguccccgaucguggccuucguuuauuuucucgggccuggucccggucaugggccucgcucugccuuguccuacuuuaacuggcuuuugucaccuucacgggcuuuguucacugucaccauauuuuuuuccugcaaugucuacacuuguacagccuuugguggccuuaucuggccagugauggccuuggcagguugacgucgucccaauccacccuccgguguucagugggugaaugaaggagcugcugcccacucuagcuaagcagcaaagcguggucccugaugucuccucugacauucagaaaccccaaucacucuuaaccacccuccuggccaggcugucuccugaguccagaacgacauaugccacuggcuagcaggaaccccuucucagaagaaagucagccuuggccugaaguccuauagcagcaaggucaaagacagggugggcugcuaaaccuuggaccugccaguuugagcagcccagaccuguuugcuugucuugugcucaccugccucccugugcccuguagcauuggggaaggcaucaaaggcccccaccuggaaaguggggcugccccccacuucgcagguucuaccuggccuaguaguacucaggggcuugcugucugguccagcaaguccuuugguguccuggagaauguaagguggugcaacguuacugccuggguccuucaagaagug

SEQ ID NO: 687 - RNA, 4727 nt, Mus musculus
ggaaggggggggggggggaacgguccaucgaugccucggggcucucagcgucgagccuggcgccuccauaaagacguggagguggagacuagagcggcggcggaagccgggcgcagcgcagcgggcagaggcaccgcggugagucccggcuuuggccccgccgugcucacucaccugugucaucugcccuguccccagucaccagccuugugccccauuacucccaguccugcauucaccagccuucugccaccuucggugucccuuguccccgaucguggccuucguuuauuuucucgggccuggucccggucaugggccucgcucugccuuguccuacuuuaacuggcuuuugucaccuucacgggcuuuguucacugucaccauauuuuuuuccugcaaugucuacacuuguacagccuuugguggccuuaucuggccagugauggccuuggcagguugacgucgucccaauccacccuccgguguucagugggugaaugaaggagcugcugcccacucuagcuaagcagcaaagcguggucccugaugucuccucugacauucagaaaccccaaucacucuuaaccacccuccuggccaggcugucuccugaguccagaacgacauaugccacuggcuagcaggaaccccuucucagaagaaagucagccuuggccugaaguccuauagcagcaaggucaaagacagggugggcugcuaaaccuuggaccugccaguuugagcagcccagaccuguuugcuugucuugugcucaccugccucccugugcccuguagcauuggggaaggcaucaaaggcccccaccuggaaaguggggcugccccccacuucgcagguucuaccuggccuaguaguacucaggggcuugcugucugguccagcaaguccuuugguguccuggagaauguaagguggugcaacguuacugccuggguccuucaagaaguguugggucugugguggggcagugcuacuuguacacacaaagagagaugcacacaucccuccccuccccccgcacaugcucagugcaguggaauucuccggugggcaguugguggggcuagcuaggacugccaugucuggaaccccagacuaucagucucucccugggguuggcgaugaggaggcuuggguucagagccgccacugguggguuucaggaccgucugggcagaaugucacgauggaugaggggggccugccccugcuccccgacagccuugucuaccagaucuuccugaguuugggcccugcagaugugcuggcugcugggcugguaugccgccaauggcaggcugugucccgggaugaguucuuauggaaggagcaauucuaccgcuacuaccagguggcucgagaugugccccgccacccaggucaguacacacaccccuaaaccugcuggcucagggcaggggcucauggcccaaggacacacgggccauauuggggaagagggagucucugugagcagaagggugcccccuguggcugagaccuaauuagugagucgugaguuccagagucccuacaaaacaucucccaguagccaugcugucugucggcucucaaucuugacuagugagggagccuugcaugcaggagugacacuauauugcccacagcggccacauccugguaugaggaguuccggcggcucuaugacaugguacccuguguggaggugcagacacugaaggagcacacugaccagguccugcaccucagcuucucccacucgggguaccaguuugccuccugcuccaaggacugcacggugaaggugagggugccucucccaugcagcagaacucagugggaagagaagccaauggugagagaagcagagagggccacauagugccuggaggccugcucuggaccacacaagacccaaagcuuagaacagcucuaaucucuagcucccagggucagcccucuacauugguacgaugucauaagagugggugguaaagaccuaggccaagguucuugccccaugaggacccagaacccucaauggagaagagucaggauuugcugugcugccagagugaacuggccugguaauuacccugcagccuuucuggaacagaucuggaacaacgaccugaccaucucacugcugcacagugcagauaugaggccauacaacuggaguuacacccaguuuucccaguucaaccaggaugacucacugcugcuggccucagggguguuccuggggccacauaacuccuccucaggcgagauagcugucaucagcuuagguaagugugggcauuggguugggcuaccugucccauugugcccugccagcagucugcccagcuguggccuuccccccagacuccuucgcccugcugucccgugugcgaaacaagcccuaugauguguuuggcugcuggcucacagaaaccagccucauuucggggaaccugcaccgcauuggagauaucaccuccugcucagugcuguggcucaacaaugccuuccagguucagaccgggacagggacaggcugggcagacaagugggguagggcagggaaauagagaagaaggcaugggcagggcugggcauggaagggcagaugcagagcccaggguaggcugcuccccagacauggcccucugaccagcacccaacuguuauccacaggauguggagucagagaaugucaacgugguaaagcggcucuuuaagauccagaaccucaaugccagcaccauccgcacagugaugguggcugacuguagccgcuuugauagcccggaccuccugcuggaugcuagcgaccaggcugggcuccccugccgagucuuugaccuagguggggacacugaagaagaggccacugacccagguuugcacacuucugguucugaccacgucaagaaagguuuacggcguguguuugauagcgucuuggauggacacggacagcuaucggauugugcacuggagaccaagguggcugagcugcuggcccagggccacaccaagccuccagagugcaaugacgcugacaccaggaauaaguaccucaucuucaccacuggcugccucacguacucaccgcaucagaucgguaauggugggcagggcagggcugggccugggacggucaccaaccacuguguugcuccccagaccagcaaguccauaggcaaagcuuggcucaugcauugagauacuguucugccuuggcacacuugauccuguguaagaguggugaaaacccaggcaggggauuggucagcaagugagcgggugcacaauugugcuuaagucugaguguagacaguguuuguggacucuuagggcuguucuuggauugggagugcccuggugguaauguccuugcaggcucuggaugaccccucacccuggucuccaugcaggcaucaagcagauccugccacaccagaugacaacugcagggcccgugcugggcgagggccggggcucugaugccuucuuugaugcccuggaccaugucauugaugugcaugggcacaucauuggcaugggccugucuccugauaacaggugggccuggugagccagguggggcaccacagcuggcccuguaucuaauagcaugcuuguaccuaagauguaugcuaucccuugcucagguaccuguaugugaauagccgugccuggcccccuggcucagugguagccgaccccaugcagccaccacccauugcggaggagauugacuugcugguguuugaucucaagaccaugcgagaggugaagcgagcucuucgagcgcaccgugccuacacacccaaugacgagugcuucuucaucuucuuggaugucagcagggauuuuguggccaggugugggcucaggugggcuccagggcuuggguaugggcuucagcaggugggugugggcucauccagaugcuaucccacaguggggcugaagaucggcauggcuauaucugggaccgccacuacaacaucugccuagccaagcugcggcaugaggauguggucaacuccguggcuuuuagcccccaggagcaggaacucuugcugacagccagcgacgaugccacuaucaaagccuggcguucaccacgcauuguucguguucugcaggcuccacgcccucgcccccgcccucgcccccgccccuucuucuccugguuugccagccauaggcgcugaaggcuucagugauuugagccauuggaaccuacuggggaaaaugguaccccgugguucuuuauugcacuggggcagaguagcucauagcagcaaugccuuaggaggggcagccugaccccaacacacacacacacacacacacacacaaaaccugcucacuuagccauaaggcuuagcacuaggguagcccuuguuggcagcaccagaucccaugcuagccucuuggcuagcuugggguacacaggucauugggaacccuguucuucaccuacccucuucccuuggguuggcagcucacacagguccaagcuggcuucugccuggguaccuuucauauucagccaaacccacacccuuggaugucuugaguguacccugggcagcaggccacaggcacuggucucugauaauucaguuuuugcuacugaguggccugcaguggacugugggugcugcaugcugcacuccugaacuguuugggccugaauaaacaguuggcaacagcacaug

SEQ ID NO: 688 - RNA, 12204 nt, Mus musculus
cacuauuccuugcuggcaugggugguggguucuuaggguccuauaggccagcuacaauauacccugccagguacauaauacauguauggagugcagccugaauaucuggguugcccucacuguguagagcauuuauucuugguacaaggaccccucuacccuucuccaucacaccagagggcaaagacaccagauagagaaagagcuggcgaagguaaauaugacucagucccuacauccaggcccacauguagacagucaggugcuugugagguuuagaugcugcaagagaugccaugucaggccaggucuggagggcucuguggguugcuggugauugauucugggaggguaacaugauccuaggaagaaggaaggaauauuggacagcugcuguugaaaggcagugugguucugacaggaugggacauggugucucuucccgcguccuggcccacuacugcuuuccccucauuaaacauggaggcaggaucucccaugugcccacauuuggugguuccuaccgcauugaagaggauauuggcaaagccagaggcugcugcaucuguacuccucuggccggggcagugcugcuucugcagccaaugccagcccccaaggcccaugagcaccaggaacaugaaaaagaggagggcuccuccaacggcaacuggcacagacacgggugcugccacuucaccugaggacaaagagggccaucugaaccuccacauaguucccaguucuuuugucagguucuguucccaggauuacugucaaggagugagccuggggcugccugaucccuccagugcuugcuggcgccaggauucuuguugaucuguaugcacaauucggcagaccuguuccaccucuuccucuggacauacaugaugguagccagugacugccacacccacugggguuucugguguaaccuggcaguuccuucgagauaguucuuacccaggaggagacaguaaaagcugauauagccccuguguucagcccgugaggcauaguggggagagcacagaacucagucuugguuccgcuggucucccgagcagggcacagcguacuuccagcuaucugggccgccagccuaagccuggcagggucagggcaagucuggccauccuggaguccagugcuuacccuggcuaggugaaggcugcuugcacuguuguccagccagguacugcacaucaucaauggcaaugggccccagagcuggcuggccacccagaguggcuucaaaaacaaucugacagagaagggaaaaucugaguaucuggagguacagacgagacggaagggaagacagcucaccugggaccucaccuggaacuccucagaguuggacaguucaaucuggacuuguagccacuggucccgcaagugcccacccugguaccacacagcuagcuggccucgggcacugcucaggagcacucucaacucacccuugucugagaguaaggaccaaggcaggucaggcuccuggaagaugccuuugugccuaaccugagccccuguuccccuauacccagggcccagccacucacagaaaugcucaggaaagcccauguaguaccagaagcggaggcaugagacuguuguugcuggcaguggcucacugcgcagccaggcugccuggcccccaggaccuagcacgcugguuucaaagaaagcaaaauggccuggaaaugagaaggggagaugcaucuguaucucgagcuugagggaaguugagugagcacugcccgguuuugugagaugguaccagcccaugcccugcuccagccaaugcacaccugcuucugugcccaggguaugguccacugaaggcuggggguagcgggaugggguggcuccacuacuccagucccagcuguacccgcccaggcugggccagggcagguggcuccacccacacaggccaguuucaaagucacaggaaccugcaaggaacuggcaggugagcauagcugccccagugaguagcacuacucccaggcagggcuagguggaagucagaguuuugguauagauauagugcuacucaggccauagcaagcaacucaccuggcugaggacagggcccaucuuggagggaaaugucaucuagagccauguaggaauauucuacaccagcagccacagccucaaacaccaccuauaggauacagagccacacagauccugcaggcagguccuggcaacccuugggaaauaagguggcucuccucuuuucugcucagguacucaccuuccaggcuugcucagccugcacauugacgcugcccaggcgccaggcagaucuaccaugggcacugaugcugagcucuugacgccuugugcucucuuccacguggacccucaaggugccuaaacaccaagaaccagcuagauucacugcccugguagcucccaguccuggacagggguccuucccuuuccuauagcuucucaccuggauuggggacgcucaugugguaccagaaggucagacaggcaggcugggacaggggcugguguuccucugaagucagagcggccacaugacccuugggcaguacauuugggcugguguccaccaccauguagugcccuuggggaagagagaccagcaucagcuugccuugcccugguuagcccuuucaacaaccuacccccacccccguuugcaauacaaaguaccuugggcugucccugugguauggucuauccaaggaccccaagaagcaaggccugaggcauuacucuggugcguccacagaccccagcccccuggggagaagccacagucagagucuucaaaggaacagcucuugggggcccagcaggggccaggccgcacagcuaugucauccagggccauugugccaugguacccauuccggaggccuucaaacagcaacugaggguggagagugguaauuggcaggggggguagugguggugguggggcgacccuacacuguuaccaagugcuaagcuugcccucaccugguacuuggugcuggccucuggcuggugaugaagagugacccaagccuggugccagcgguugccaugggugcccgaccgggaccacaguaguaugucuuccucccgcucccuccucauggccaggcacagugucccugcaaagaagugaaguuuagacgggaccagccccaacuccugcugccucgggaaaucgaacagaggcucugacagcugaggcgcucaccaaucuggggcccauacaggcgguaccagaagcugagacauuccuuggggacaacuggcaccugaggucuugugagcaacagggcaccuuggccucgagcagguggguccgugggauccaagaacaugaaaaagccuucagggaaggaaaacugagcuacagaaagacucagguugaccccucccaggccggagagacuccccuaccuuggccaguuguguggucaagcugagagccguggcuuuuuauacggugccagugggcaucugugagguggccuguaugccagcugcaggagucccguucaaaguuacaggagagcucugggggggggggggguaggggguugaggggggugaggucagcacugcugucugcccccuucccagcuguccuaagacaggauuagaggugggcuagguaguaaguagcuccuggguagggaugggagaugggccagagaaaccuuggucacuuucaguggucaccaugggguugcagucucucagagucacauuguccaccccagcccccugcuggccagggccauccaaguccaccagacugacaaacuccagcuuuaggcagauaggggagaacgacugucaguuaggggcuagcucaguacagauuucccaucuugcacugccagccucaccuggaacggccggcgccgugccccgagaauaaucuucuccucuguccagcucccgcugccgccgccuggggcuugccacagcagcucccggaagccauucuccaccacaaccagugccaagaagccugaugaagggaauuaguauggaugggggugggucauccuaagaaccugucugccaugcaggaggcuucuggggacugggaccagggacguguaauaccuugggggugacuuugaaaauaguaagccauguggaguucacagugagggccagaggggcccagagcaggugugagagcccgggccucagaucuuagcugcccccaggccuucugcagagauaggaagugcccugugggaagagcaggguaccccaucacugcucaggugccuguaauuuacaaacgcucugaggaggggcuccuguggggacgugcgggccucaccaggagcaucccgauuggcauccccggcaggcuugcucuucuccugggcuucaacccauugccacugcagcuucccuacacugauguccucccagcccccagcagaggcggacucaaagucuguggugccuguaacaacaguagccugcucugaaagcccagcagugucgcguucucuggccagcuugggcucccuaaacguguggagccaugcaggcucugacuggccucaccacacuuguguucauccucgcccucugcacagugcuucuggaaaucacacagcugcucagggggcacacacaggucaccacaggagagauguccuggcucacaggucugcuggggcagcuugauggaugucuggggauagagggcuaauggcacagguccagaaagugaugacugcaggguggacauagcuacaacagaauugaagucaggucagagugggugauggccuugcuucuccugggcaagccagggcagggccuugggcagcucaccuggaacaagcaugcaguggcuagacaugauaaggucgucuaggcccacgacgccuccuggacccgucuccccagcuagaaggaucugaggacagggagggcucagcaaggaccaaggacuauucuguccugucuucucucugguacccuccccaucuguuuacugcuauacuucauaaauuucccaacacucugagccucucccacugagcagucuucaggagugacuaaagaauccuugcuguucuccugugugugcucuaggccagacucccuggacccuggaucccacccccagaucucagucacugccugacuagccucacccgaaauggaugggcacuuugaaugucaacccggucucugacccaggcuguccccaguucuccauggcggcuucgaaguagaacagggaccugggggguguugagccccugugccugcaggaacagcuggaaguggcuggccucagacccgugcagguaguaauagaaggugaacuggaacagaagaaaucucagguugugaggggucucuggcaucuagagagucagaaaaggcaacucaguguaucucauuuucugacacauccagcucaccgagcaguuguuggagacugagccuuggaacucagggcuguagaggacagcaguggugccaggcuuggccacagagaugaggaagaagccuaugagaggccaaauaugggccagggucauugcaagaaguuggguggaaaaggccauggccagggccccuuggagaccucaccguaugcacuguugcggcugugaucucgguggggccaggcagggcucaccaugcugccagcacugugguuccggguccagcccucuaacugguuccacggucccaggccugucucaaagucaguggccaugugguggccuaaggagucagaguugggggggggggcucucagggccacugagcagggcuuucugcagucagauggcccuguuuccagggaaacaguggcugccccacccagauugaaggacucagaggucaaggucuagucucccauguucauucuguaaucccucacccugcccggcccuagauggccccagccucacugcagaugagugggucuucaucagaucugucuccacaguugucuucaccaucacagagcugguggggcuccacacaagccuuguucuggcaguggugaugccccagggggcaccuggccugagggacuggggugggaaauaguugacacacucucauucucuuuggccccaggauucggggggugggguaagguggggggagguguuguguucaggaaggugggcaaaagggggucucccagguuuggacaggaucgugugcagccuuacuggguagcccacagucccggaacuccacaucauccaaggccacagcgccccuguguguggcauuucggguggcagaaaaugucaccuggagagaggaacaguccuuaggaccaaaacccuccccacaguguccagccuggcagaccacccugcuuacuuugaagucacccuggaugcggccaguguucacugccagcuccugccagccagggccccaggguccugaggucugccauagagucagugucuccacaccaugggucagguccagccgcagcucagcgacaucuguaguauuuugagugguccugaggcaucuucagccccuggugucucccuccagucuaccagcuauaccuuggcccucauuuuggagcauccuccuguuucucuagcuaccuuuucuucacccagccuuuucccagagcuacucagcuuugggucucagggauccagagcauguaccucuagaggcaaugugguaccagagccucaguucacagguaggggcugccucacgcaugacaggagaacgcagagucgcaguagauggcuccuucccacuguggguucccacagccauauaccagccugguccagguugagagguuaggagaccagacaagaaaccaaguuaguagggaggggaugaguggacguggauucccuaggccuuacccaagucagugccauguguauggucagaaugaggcccaggaccaugcagcacugccccugcccggucucgaagccaucgauagccugaggugcugauguccugccagccacaggaguccugcucaaaguugcaggugaaggaggugcuugggauaguugaggcuccauggaaaccuaugagaguggguuaggggucaugggucugccuuuuauacuaccacucccugacacgcccaccggcccagcucaccacacugaguuucgucugaacagucuccacagucacacacaaaguugcauacagcuuugauggggcuucugcagugguuggggagccaggucuugccuagcgacugugcagcuggcaggguaacuguggggccagguaagcagagggcaaggugauuaccuauuuguguacauauauguguagugcaacaggcguuaaggucagaggacagcugaggugggaaucuuuuauuuccuuccaccauguggaaccuagggacugaauaaaugccaucacgcuuugcaacaaaugccuuuaccuuuugagccaucuugccagcccugauuggcuauuuugaacaguaugaauucuacauccagagaaaccucagaccugaacaggccaggauacuugucaacugacuuuggaguucagcccuauaagguuauauagagaggaaccugacauauaccaagaaccgccacaggggaucuacacugaaagucaacagaaugccuucccaccucccuagccccugcaugccagggacaggaaaaagggucguaagaaggagccacaugaccaggaacuagaagguaaccaguagggucguccccaccccccaccccccaagcagacacauagagccaggcacaugccuuuaaucucagcacuugggagguagaggcaggcaguucucuaaguuugaguccagccuggucuacagagcuaguuccgggacaucgaggacuacacagagaaauccuaccuuggaaaaucagaaaagaaaaagaaaaggggaaaaaaagaaaaaaggacgacacacugauggauagaugaccaagggacuuguacaaguucuacaaugggagcagcaggcaacggcucagagagccagggagauggucacuuaugauauccuguggccucuccucuaggacagggagauaagauuuaggugggcaaucugcagcccuguuggcuuguccugcauguccccaucacaccaacuagcaucaggcaacgguuuacucacccauaaacaggacccagguugaaagaagguggcuaggcaggcacauggccaggcuagaggaggucccaguucaagugaggcugugcagucuagaggagacuucucaguuaucaguccaccguggccucacaggcugacuuagcucucacugggaagggcucagcuccuuuauacuugcagccccuuggcuggguccccauccgaugaugacaggccaagcaucuagcuguaaaaguauuccuagagggggccucuacuuggcucuuucugaccaaaggucggcucuuggacauccugugugucuacccagcccugccuuacccuucccacugaaaguuucuauuggagcuuggaaaggcaggggaccccacucgcaaggcucuaagauucucuuggggccuacagccuacccuggugcaggucaaggacaucugggcagucugcucaguggcuacacauggccauccagcacaugguccagagcuuccucugcucugugcuuagggggaccagaucaggacaaacccaguaccagcagccugccgcuguggaccaguacaagucccauguugggguguggugucuucucuuucacagcaccuauaacucaagcugugccacucugccaacuguucugauuguguguguguguguguguguguguguguguguguguguguguguacugacacagggucucacuuagaccaggcuggccugaacuugcuacguagcugggaauaauuuccuucugcuuccaccucccaagugcugggaucauaggugcacuaguuuauaugguacucuagguugaacauggggauuuccuguuccuggucaagcucuaacagccgagcuccaucuuuagucuccuauucaucuuuaaaaacugcccugaguggccaaguguguggugcauaccuuuuaucccagcacucaggaggcagaggcagggcaauuucugugagucugaggccagccugguuuauaaagagaguucagggacacagagaaacccugucucaaagcaaaacaaaacaaaacaaaaaaaacgaacaaggggcuggagagaugccucagcaguuaacagcacugacugcucuuccagagguccugaguucaaaucucagcaaccacauggugacucacagcugucuguaaugggaucugaugucuguagacagcuacaguguacucauaugcauuaaauaaacaaaucuucagagaaacccugucuccaaaaaaaaaaaaaaaaaaaaaaggaggaaucuuuuaaaaaaaugaagcaaaacaaaaacuguucugagauaucaugugcugugugguuggugauuggaaaaagucuugaugagcccacaaacucauucucccaugaaaaggcccacagcugaggcaagaggaaugucagaguuaugaagaucuugucacauggaacuagaaucugccuaugacugacugacugagaccuuggggcuugucucgccuuaggucagcccccuagccuauacaggguaucucagcugcccccuagccuauacaggguaucucagcugcccccuagccuauacaggguaucucagcugccuccuagccuauacaggguaucucucucaguagugucugugugccgucuacagagcugacgaaggcuggcucaagucuggugagggaggccccagcccuggcucucccuaggacucacuauaauggcacaaggugugugagacuuuuuagagcagggguuaagcuggugccuacccacuguccuguauggugaagugggguuagugcagagaauuagaguguaaaugguccugggacuaagauccaucuaaguuaaagucccaagugaaggagacacaagcaugacuguuccugcgaucacucagggauaucaggcuuggccugagaacagaugaaaaauguagccugccagcuggcgggacaauggcugccaggacccuuuccuggugggacuccuggaugaacuacaggaagggggcacuugugggcaccccaggccuuagguggccaggaacugacuucuugugcaaggccuguggggcccccucccagauguccuuggggauagcagcuucauggaggaacaaucaagccauaaauggcugcaaugcaggggcccccuuaucugcaccuagggggcugagugugcaccaguaguucccagggccccugaagcugagcaggucuguccggugcaauccaaagguaaagaaggcaagacacaagucagggacuaguaggcauaucaaugcuuuuaauuccuauggaccagauuggucuggccucuaaggccuggcaggugcuaugcugccuaagguacaaaaggaaagcacagggccagccccucaaaacagaacacagcaagagcagagaccugacuuaguccggggggugggggguggggcagagcuucaguagccaucgucagcccaggugaccucauagucaggauacuuggcuuugaucuucucaguugaaacagagugcugggcacgaccguaacccuagagaaaggaugaccgccaguuugcuaguuuuuugcuuugggagcccacccagaagccgcagcaauagcagcccuggggaaaguuagcagauccuaccauccuaaucauacugggaucaugaugaggacugaagagcucuucaggugaugccugagggucuaagguggacuuuaugaaaaaggaucaacauagaacugugaauuugaccccaguacugguggcuccaagggccccuagagagucaggacacagacccaucaggaucuggagcaagucggggauguagcccaaggugucauuuggaaaacguggggaaaggaaaacccauucagcccuuaaguaaggguucuguagcuccaacuuucagagucccaaagguggccugaaugguggugugaggggugggguggggugggguggggguggggucaggcucacaaaggugagcuuugcagucuggcugagaccuggggacuggagcucaccauagaguagccauacacguguaucuuccuguccuggcucugaugggagaugcgcccgccgccuaggcacucacagucauagccauuccuuugcagcucgccugacacuuugucauagauguccgcugggguggggagaguggccucaggauaugcccuagccgcccuuguuggccccacacugaacucuagggcuggauauggggucagaagcuccagcucuugguggucuuuuucccagagaagaugagcccuucccccgcuggcaaaaagaugaacgggaggaagaagacacuuucgaagugagagacgggauuaagaagaucccagucauggcacuccuuucugcccaaaucccgacguuucuaggucagccuagcuauguguuaguacaagucaugauauauuagcagucacuacuccgcuaccagcaacuguaaggccccgccccuaaccuucgucccgccuccaagggcacagaggccccgcccucaccgugguacucagcccauuuguagccacgcacgauuuccuugcacuccuucgccggauccccagaaggcucugcuaaguggacucgaaucagcacauacuugaagacgccauccgaaucaaugucuacaucaggaaucugaccgagguccgccgccauguuccccgaagcgcucgaucucugggccccacagccccuuaccaaacccgacccaggccuaugcguagggaggcgggcccuuuggcagccacggccaaucccgugagggaaugcuuaccuagcccagagccucagccaguuguaccuccaaucugaggcacggacuggccaauugcaacccaguucuuugcagcuuugggaucgggcucaugagucccaguuaaaggagccgaggcauagguuaacccguggugcuguaaaucaacccgcugcagggcagcaaaaggaugcaaggacgcacuccgguuccacuccuggguccuaaggcuucaauccguaaaccauaaauccgaaguccucucuuccccaaca

SEQ ID NO: 689 - RNA, 12204 nt, Mus musculus
uguuggggaagagaggacuucggauuuaugguuuacggauugaagccuuaggacccaggaguggaaccggagugcguccuugcauccuuuugcugcccugcagcggguugauuuacagcaccacggguuaaccuaugccucggcuccuuuaacugggacucaugagcccgaucccaaagcugcaaagaacuggguugcaauuggccaguccgugccucagauuggagguacaacuggcugaggcucugggcuagguaagcauucccucacgggauuggccguggcugccaaagggcccgccucccuacgcauaggccugggucggguuugguaaggggcuguggggcccagagaucgagcgcuucggggaacauggcggcggaccucggucagauuccugauguagacauugauucggauggcgucuucaaguaugugcugauucgaguccacuuagcagagccuucuggggauccggcgaaggagugcaaggaaaucgugcguggcuacaaaugggcugaguaccacggugagggcggggccucugugcccuuggaggcgggacgaagguuaggggcggggccuuacaguugcugguagcggaguagugacugcuaauauaucaugacuuguacuaacacauagcuaggcugaccuagaaacgucgggauuugggcagaaaggagugccaugacugggaucuucuuaaucccgucucucacuucgaaagugucuucuuccucccguucaucuuuuugccagcgggggaagggcucaucuucucugggaaaaagaccaccaagagcuggagcuucugaccccauauccagcccuagaguucaguguggggccaacaagggcggcuagggcauauccugaggccacucuccccaccccagcggacaucuaugacaaagugucaggcgagcugcaaaggaauggcuaugacugugagugccuaggcggcgggcgcaucucccaucagagccaggacaggaagauacacguguauggcuacucuauggugagcuccaguccccaggucucagccagacugcaaagcucaccuuugugagccugaccccacccccaccccaccccaccccaccccucacaccaccauucaggccaccuuugggacucugaaaguuggagcuacagaacccuuacuuaagggcugaauggguuuuccuuuccccacguuuuccaaaugacaccuugggcuacauccccgacuugcuccagauccugaugggucuguguccugacucucuaggggcccuuggagccaccaguacuggggucaaauucacaguucuauguugauccuuuuucauaaaguccaccuuagacccucaggcaucaccugaagagcucuucaguccucaucaugaucccaguaugauuaggaugguaggaucugcuaacuuuccccagggcugcuauugcugcggcuucugggugggcucccaaagcaaaaaacuagcaaacuggcggucauccuuucucuaggguuacggucgugcccagcacucuguuucaacugagaagaucaaagccaaguauccugacuaugaggucaccugggcugacgauggcuacugaagcucugccccaccccccaccccccggacuaagucaggucucugcucuugcuguguucuguuuugaggggcuggcccugugcuuuccuuuuguaccuuaggcagcauagcaccugccaggccuuagaggccagaccaaucugguccauaggaauuaaaagcauugauaugccuacuagucccugacuugugucuugccuucuuuaccuuuggauugcaccggacagaccugcucagcuucaggggcccugggaacuacuggugcacacucagcccccuaggugcagauaagggggccccugcauugcagccauuuauggcuugauuguuccuccaugaagcugcuauccccaaggacaucugggagggggccccacaggccuugcacaagaagucaguuccuggccaccuaaggccuggggugcccacaagugcccccuuccuguaguucauccaggagucccaccaggaaaggguccuggcagccauugucccgccagcuggcaggcuacauuuuucaucuguucucaggccaagccugauaucccugagugaucgcaggaacagucaugcuugugucuccuucacuugggacuuuaacuuagauggaucuuagucccaggaccauuuacacucuaauucucugcacuaaccccacuucaccauacaggacaguggguaggcaccagcuuaaccccugcucuaaaaagucucacacaccuugugccauuauagugaguccuagggagagccagggcuggggccucccucaccagacuugagccagccuucgucagcucuguagacggcacacagacacuacugagagagauacccuguauaggcuaggaggcagcugagauacccuguauaggcuagggggcagcugagauacccuguauaggcuagggggcagcugagauacccuguauaggcuagggggcugaccuaaggcgagacaagccccaaggucucagucagucagucauaggcagauucuaguuccaugugacaagaucuucauaacucugacauuccucuugccucagcugugggccuuuucaugggagaaugaguuugugggcucaucaagacuuuuuccaaucaccaaccacacagcacaugauaucucagaacaguuuuuguuuugcuucauuuuuuuaaaagauuccuccuuuuuuuuuuuuuuuuuuuuuuggagacaggguuucucugaagauuuguuuauuuaaugcauaugaguacacuguagcugucuacagacaucagaucccauuacagacagcugugagucaccaugugguugcugagauuugaacucaggaccucuggaagagcagucagugcuguuaacugcugaggcaucucuccagccccuuguucguuuuuuuuguuuuguuuuguuuugcuuugagacaggguuucucugugucccugaacucucuuuauaaaccaggcuggccucagacucacagaaauugcccugccucugccuccugagugcugggauaaaagguaugcaccacacacuuggccacucagggcaguuuuuaaagaugaauaggagacuaaagauggagcucggcuguuagagcuugaccaggaacaggaaauccccauguucaaccuagaguaccauauaaacuagugcaccuaugaucccagcacuugggagguggaagcagaaggaaauuauucccagcuacguagcaaguucaggccagccuggucuaagugagacccugugucaguacacacacacacacacacacacacacacacacacacacacacacaaucagaacaguuggcagaguggcacagcuugaguuauaggugcugugaaagagaagacaccacaccccaacaugggacuuguacugguccacagcggcaggcugcugguacuggguuuguccugaucuggucccccuaagcacagagcagaggaagcucuggaccaugugcuggauggccauguguagccacugagcagacugcccagauguccuugaccugcaccaggguaggcuguaggccccaagagaaucuuagagccuugcgagugggguccccugccuuuccaagcuccaauagaaacuuucagugggaaggguaaggcagggcuggguagacacacaggauguccaagagccgaccuuuggucagaaagagccaaguagaggcccccucuaggaauacuuuuacagcuagaugcuuggccugucaucaucggauggggacccagccaaggggcugcaaguauaaaggagcugagcccuucccagugagagcuaagucagccugugaggccacgguggacugauaacugagaagucuccucuagacugcacagccucacuugaacugggaccuccucuagccuggccaugugccugccuagccaccuucuuucaaccuggguccuguuuaugggugaguaaaccguugccugaugcuaguuggugugauggggacaugcaggacaagccaacagggcugcagauugcccaccuaaaucuuaucucccuguccuagaggagaggccacaggauaucauaagugaccaucucccuggcucucugagccguugccugcugcucccauuguagaacuuguacaagucccuuggucaucuauccaucagugugucguccuuuuuucuuuuuuuccccuuuucuuuuucuuuucugauuuuccaagguaggauuucucuguguaguccucgaugucccggaacuagcucuguagaccaggcuggacucaaacuuagagaacugccugccucuaccucccaagugcugagauuaaaggcaugugccuggcucuaugugucugcuuggggggugggggguggggacgacccuacugguuaccuucuaguuccuggucauguggcuccuucuuacgacccuuuuuccugucccuggcaugcaggggcuagggaggugggaaggcauucuguugacuuucaguguagauccccuguggcgguucuugguauaugucagguuccucucuauauaaccuuauagggcugaacuccaaagucaguugacaaguauccuggccuguucaggucugagguuucucuggauguagaauucauacuguucaaaauagccaaucagggcuggcaagauggcucaaaagguaaaggcauuuguugcaaagcgugauggcauuuauucagucccuagguuccacaugguggaaggaaauaaaagauucccaccucagcuguccucugaccuuaacgccuguugcacuacacauauauguacacaaauagguaaucaccuugcccucugcuuaccuggccccacaguuacccugccagcugcacagucgcuaggcaagaccuggcuccccaaccacugcagaagccccaucaaagcuguaugcaacuuugugugugacuguggagacuguucagacgaaacucaguguggugagcugggccggugggcgugucagggagugguaguauaaaaggcagacccaugaccccuaacccacucucauagguuuccauggagccucaacuaucccaagcaccuccuucaccugcaacuuugagcaggacuccuguggcuggcaggacaucagcaccucaggcuaucgauggcuucgagaccgggcaggggcagugcugcaugguccugggccucauucugaccauacacauggcacugacuuggguaaggccuagggaauccacguccacucauccccucccuacuaacuugguuucuugucuggucuccuaaccucucaaccuggaccaggcugguauauggcugugggaacccacagugggaaggagccaucuacugcgacucugcguucuccugucaugcgugaggcagccccuaccugugaacugaggcucugguaccacauugccucuagagguacaugcucuggaucccugagacccaaagcugaguagcucugggaaaaggcugggugaagaaaagguagcuagagaaacaggaggaugcuccaaaaugagggccaagguauagcugguagacuggagggagacaccaggggcugaagaugccucaggaccacucaaaauacuacagaugucgcugagcugcggcuggaccugacccaugguguggagacacugacucuauggcagaccucaggacccuggggcccuggcuggcaggagcuggcagugaacacuggccgcauccagggugacuucaaaguaagcaggguggucugccaggcuggacacuguggggaggguuuugguccuaaggacuguuccucucuccaggugacauuuucugccacccgaaaugccacacacaggggcgcuguggccuuggaugauguggaguuccgggacugugggcuacccaguaaggcugcacacgauccuguccaaaccugggagacccccuuuugcccaccuuccugaacacaacaccuccccccaccuuaccccaccccccgaauccuggggccaaagagaaugagagugugucaacuauuucccaccccagucccucaggccaggugcccccuggggcaucaccacugccagaacaaggcuuguguggagccccaccagcucugugauggugaagacaacuguggagacagaucugaugaagacccacucaucugcagugaggcuggggccaucuagggccgggcagggugagggauuacagaaugaacaugggagacuagaccuugaccucugaguccuucaaucuggguggggcagccacuguuucccuggaaacagggccaucugacugcagaaagcccugcucaguggcccugagagcccccccccccaacucugacuccuuaggccaccacauggccacugacuuugagacaggccugggaccguggaaccaguuagagggcuggacccggaaccacagugcuggcagcauggugagcccugccuggccccaccgagaucacagccgcaacagugcauacggugaggucuccaaggggcccuggccauggccuuuuccacccaacuucuugcaaugacccuggcccauauuuggccucucauaggcuucuuccucaucucuguggccaagccuggcaccacugcuguccucuacagcccugaguuccaaggcucagucuccaacaacugcucggugagcuggaugugucagaaaaugagauacacugaguugccuuuucugacucucuagaugccagagaccccucacaaccugagauuucuucuguuccaguucaccuucuauuacuaccugcacgggucugaggccagccacuuccagcuguuccugcaggcacaggggcucaacaccccccaggucccuguucuacuucgaagccgccauggagaacuggggacagccugggucagagaccggguugacauucaaagugcccauccauuucgggugaggcuagucaggcagugacugagaucugggggugggauccaggguccagggagucuggccuagagcacacacaggagaacagcaaggauucuuuagucacuccugaagacugcucagugggagaggcucagaguguugggaaauuuaugaaguauagcaguaaacagauggggaggguaccagagagaagacaggacagaauaguccuugguccuugcugagcccucccuguccucagauccuucuagcuggggagacggguccaggaggcgucgugggccuagacgaccuuaucaugucuagccacugcaugcuuguuccaggugagcugcccaaggcccugcccuggcuugcccaggagaagcaaggccaucacccacucugaccugacuucaauucuguuguagcuauguccacccugcagucaucacuuucuggaccugugccauuagcccucuauccccagacauccaucaagcugccccagcagaccugugagccaggacaucucuccuguggugaccugugugugcccccugagcagcugugugauuuccagaagcacugugcagagggcgaggaugaacacaaguguggugaggccagucagagccugcauggcuccacacguuuagggagcccaagcuggccagagaacgcgacacugcugggcuuucagagcaggcuacuguuguuacaggcaccacagacuuugaguccgccucugcugggggcugggaggacaucaguguagggaagcugcaguggcaauggguugaagcccaggagaagagcaagccugccggggaugccaaucgggaugcuccuggugaggcccgcacguccccacaggagccccuccucagagcguuuguaaauuacaggcaccugagcagugaugggguacccugcucuucccacagggcacuuccuaucucugcagaaggccugggggcagcuaagaucugaggcccgggcucucacaccugcucugggccccucuggcccucacugugaacuccacauggcuuacuauuuucaaagucacccccaagguauuacacgucccuggucccaguccccagaagccuccugcauggcagacagguucuuaggaugacccacccccauccauacuaauucccuucaucaggcuucuuggcacugguugugguggagaauggcuuccgggagcugcuguggcaagccccaggcggcggcagcgggagcuggacagaggagaagauuauucucggggcacggcgccggccguuccaggugaggcuggcagugcaagaugggaaaucuguacugagcuagccccuaacugacagucguucuccccuaucugccuaaagcuggaguuugucagucugguggacuuggauggcccuggccagcagggggcugggguggacaaugugacucugagagacugcaaccccauggugaccacugaaagugaccaagguuucucuggcccaucucccaucccuacccaggagcuacuuacuaccuagcccaccucuaauccugucuuaggacagcugggaagggggcagacagcagugcugaccucaccccccucaacccccuaccccccccccccccagagcucuccuguaacuuugaacgggacuccugcagcuggcauacaggccaccucacagaugcccacuggcaccguauaaaaagccacggcucucagcuugaccacacaacuggccaagguaggggagucucuccggccugggaggggucaaccugagucuuucuguagcucaguuuuccuucccugaaggcuuuuucauguucuuggaucccacggacccaccugcucgaggccaaggugcccuguugcucacaagaccucaggugccaguuguccccaaggaaugucucagcuucugguaccgccuguaugggccccagauuggugagcgccucagcugucagagccucuguucgauuucccgaggcagcaggaguuggggcuggucccgucuaaacuucacuucuuugcagggacacugugccuggccaugaggagggagcgggaggaagacauacuacuguggucccggucgggcacccauggcaaccgcuggcaccaggcuugggucacucuucaucaccagccagaggccagcaccaaguaccaggugagggcaagcuuagcacuugguaacaguguagggucgccccaccaccaccacuacccccccugccaauuaccacucuccacccucaguugcuguuugaaggccuccggaauggguaccauggcacaauggcccuggaugacauagcugugcggccuggccccugcugggcccccaagagcuguuccuuugaagacucugacuguggcuucuccccagggggcuggggucuguggacgcaccagaguaaugccucaggccuugcuucuugggguccuuggauagaccauaccacagggacagcccaagguacuuuguauugcaaacggggguggggguagguuguugaaagggcuaaccagggcaaggcaagcugaugcuggucucucuuccccaagggcacuacauggugguggacaccagcccaaauguacugcccaagggucauguggccgcucugacuucagaggaacaccagccccugucccagccugccugucugaccuucugguaccacaugagcguccccaauccaggugagaagcuauaggaaagggaaggaccccuguccaggacugggagcuaccagggcagugaaucuagcugguucuugguguuuaggcaccuugaggguccacguggaagagagcacaaggcgucaagagcucagcaucagugcccaugguagaucugccuggcgccugggcagcgucaaugugcaggcugagcaagccuggaaggugaguaccugagcagaaaagaggagagccaccuuauuucccaaggguugccaggaccugccugcaggaucuguguggcucuguauccuauaggugguguuugaggcuguggcugcugguguagaauauuccuacauggcucuagaugacauuucccuccaagaugggcccuguccucagccaggugaguugcuugcuauggccugaguagcacuauaucuauaccaaaacucugacuuccaccuagcccugccugggaguagugcuacucacuggggcagcuaugcucaccugccaguuccuugcagguuccugugacuuugaaacuggccuguguggguggagccaccugcccuggcccagccugggcggguacagcugggacuggaguaguggagccaccccaucccgcuacccccagccuucaguggaccauacccugggcacagaagcaggugugcauuggcuggagcagggcaugggcugguaccaucucacaaaaccgggcagugcucacucaacuucccucaagcucgagauacagaugcaucuccccuucucauuuccaggccauuuugcuuucuuugaaaccagcgugcuagguccugggggccaggcagccuggcugcgcagugagccacugccagcaacaacagucucaugccuccgcuucugguacuacaugggcuuuccugagcauuucugugaguggcugggcccuggguauaggggaacaggggcucagguuaggcacaaaggcaucuuccaggagccugaccugccuugguccuuacucucagacaagggugaguugagagugcuccugagcagugcccgaggccagcuagcugugugguaccagggugggcacuugcgggaccaguggcuacaaguccagauugaacuguccaacucugaggaguuccaggugaggucccaggugagcugucuucccuuccgucucgucuguaccuccagauacucagauuuucccuucucugucagauuguuuuugaagccacucuggguggccagccagcucuggggcccauugccauugaugaugugcaguaccuggcuggacaacagugcaagcagccuucaccuagccaggguaagcacuggacuccaggauggccagacuugcccugacccugccaggcuuaggcuggcggcccagauagcuggaaguacgcugugcccugcucgggagaccagcggaaccaagacugaguucugugcucuccccacuaugccucacgggcugaacacaggggcuauaucagcuuuuacugucuccuccuggguaagaacuaucucgaaggaacugccagguuacaccagaaaccccaguggguguggcagucacuggcuaccaucauguauguccagaggaagagguggaacaggucugccgaauugugcauacagaucaacaagaauccuggcgccagcaagcacuggagggaucaggcagccccaggcucacuccuugacaguaauccugggaacagaaccugacaaaagaacugggaacuauguggagguucagauggcccucuuuguccucaggugaaguggcagcacccgugucugugccaguugccguuggaggagcccuccucuuuuucauguuccuggugcucaugggccuugggggcuggcauuggcugcagaagcagcacugccccggccagaggaguacagaugcagcagccucuggcuuugccaauauccucuucaaugcgguaggaaccaccaaaugugggcacaugggagauccugccuccauguuuaaugaggggaaagcaguagugggccaggacgcgggaagagacaccaugucccauccugucagaaccacacugccuuucaacagcagcuguccaauauuccuuccuucuuccuaggaucauguuacccucccagaaucaaucaccagcaacccacagagcccuccagaccuggccugacauggcaucucuugcagcaucuaaaccucacaagcaccugacugucuacaugugggccuggauguagggacugagucauauuuaccuucgccagcucuuucucuaucuggugucuuugcccucuggugugauggagaaggguagagggguccuuguaccaagaauaaaugcucuacacagugagggcaacccagauauucaggcugcacuccauacauguauuauguaccuggcaggguauauuguagcuggccuauaggacccuaagaacccaccacccaugccagcaaggaauagug

SEQ ID NO: 690 - RNA, 6315 nt, Mus musculus
guuauuagcagcagcuacauucaaguucuauuuuacuugguucgaaagcacuugcccuucucgucagaggcguucuugccagucugccgcaggagggacuguggagccccuggggagggcggcaggcggcggggcagcaaguguugcaagagcggcauccgggcaugugcuaagacaggggccaaggagagagagcuggagugucccggggacauccagucgaggguagcuggcgcgugugcacacccucgugcauaggugugugucccagguucuugcaauugaacuuucagagcuccuaagggcuuggggcuucuucuucucccaagauucuuggagaaucuggucgcaagcccucucugggucacacccuccacaaaguccugggcucagauccagguacggggucaggcaaggggcuuagggaagccuagaccucuccacaacacgucaggcuuuggcuucucucucagcuuggagugcagccagggcacuuuugcacacaggauuggauucggggcaggccucggcaccgacuccuuaaccguacccacacuugguggcucacuacuaagcaccuuuccuaguccaguuccuaauuagggacagcccuguuccuuacucauucccaagucauuccgugguaggagcugcucucaguaggguugucugcuaauucgucagcacacgcuucccaccucuccaucuucucuggaaggcagauuuuuaaggccaucuuguuggguagguguugggagcucaaauccuuacccagaucuuaacucugguugggucgccgcccacacugcuuccccugcucaggcuuccaucuggcaggguggauuguaccuuggccuuaaccugaaaauuccccaguauuccaacuugucuacaagugcccagacuaaggugagaguauugaaggacaggcggcacugguacguguacagugcuggcuacgcccauugccucaaccucauaggggugcacagggaguagcccucugagccugauacaccccagacaggaggguuaggggaagugcucgaaguaaggacaucgggcuuugguuaacauggauuucuggacuagaaggguuggagagcuauagcaagcacccacaacauacaccaacugaguuuguccccaugggaugaguguagcaggcagagcccagagguccucagucccaccccaccucccaguggggagcaccgagggcgaggaccgggcccuuggggagcccccucuccuugacuggcuuggggagagcccaggauguggaauuuggauggcccgguuacgaacagagaagaaaagaagcagcugguuggaaacgggacaggggugggggugggggcucccaggcaaaauuagagguguggaguggguggagcucagggcagagaauuuguauaagacuaaaggaggcccaggggauuuggaaggcgcugaaccaacugguccagacucugggggccuucgugauggaucaggcagggccugaguagaguaggcagggcucggggucggggccugggccuaauaguuccaugguucacaugaugucguccagcagguuggcgcuggcuacccaaucuagugcacgcggcuccgaugcagccaugaucaugcacaugaaggggcggccagugcgccgauccgugggauagaugguugugggcgugaagcgccgguuagcuuccacaaacucacagagcugcucauagacccgugggaauucguggcggaggaagacgccgcgcauucgaagcucacguuggauauggaugaaggcuacuucacgugcgcgccggccggccucaccuucuucguccaggcccgcaguaccuggggguggcgucaggaucaagguuuccauaucuggcucuccgccacgcgcaggaggaggacgcgucgggcugccagcggccagagccaccuuggcgaacuugcgcaccgugggcccaggagugcgcggcgcgggccgggcagcggcuccggggggugcagcgcuggggcccacagccacggacacgcuaagcaggaagcacucugccggcucauagagccuuccugcugccgccagcucucgugcauagcuacccaggggcgccgcauguguagccagcucacgcagcgacagguaggugggcgauaacagcaacccuucgaggccaaagcguaggaaguugucggcagagccugggcucgggaagcccaagaacagcacgccacggccucgcgacaggaauccgacgcgcgcuaugcgagagaaggcgcgaugcacugggcugcugucgcggcagaacugcagcacguggcggcacacgcugcccacgcggccguacacgcaacgcgccuugugcgcgucccaguccucucggcggcacagacgcgagcaguaguagguauagcagcuguggcacgacuugaaguagaggcaggcguugaacauggucucuguccgccggcagcgcgcguuggagcaggucaucaagucauccucgucugcgcugggcucgggggaggcguccgcugccucccccgagccggugggcucuucagugcugccagccgaggccgggggcgagcgcgauggcgccagcaggguggccccuccagggccugcagcccgugaguccagcaggcggcguaguuggcggccuaaaccuucggcggcaggcuccggggccugggcuggcgaccgugagucgaugaccaggucagugaugagcucguccagcugcucgaggcugcgcuggcggcuugaagcaggacccucagggaccguggauacgggcugccguggucggccuccaggcaauucccagcccuuggcagucgggcgauccacugagcgcaggucguugucugugaugguaaucucuggcgugacguaccaguugcggcccaggcucucucccgcgcggcccuucucugucagcgacgucucggacagcgacagugcugcauagcgucugggugagguggacaaauucacuacgacugguggacgccgaccuucaggggaugaaccccucguaucccgaaccucgcgucccaggagguucucauagcugcggccgcguccuagaggaucuucacgacgaggaccaggagcuaggauguugucccaggaucgagaguaguggcggcuaucgguggccagccggggugggcuugugccggugccgccgugccacgaggccaacagugguccaggggcgggaggcggcauuaccugaagggugcgguaaggccucggaccccagucagcccagggugggcugcugcgcgggugcggguaaguccgagccaguacaucgcguucucgguaccucccaaaguccucgguguagaaagugcgggcuccagggugcgcccggggcucuucugggacauaccggggaacgaaaggcauaccguaggcucgaguugucuccccguaguaggagcgggaggggggcuccuggaucgggaaggugcguacuucgccagcauaguagcugcccccacgccuuggacugggucuaggggguucuucggacaaguagggccuggaacaguagccaucaaagggaaggccggggcuugugguaaagcugccugcguagcccucuggcuccucgguguagaagaauugggugggaccuggaggcguugugaaggguugacugcggugcuccaaguagucccggggcccaggcaguggcccgucacaguacagaguucuggggucaguacaguacaagucacuggggguaggagugcgugacagggccacguggcgagggccgggaacugugaggccauggaacuguggagcugugcgagcccaggacgucgucucucuaggugcgcaagaucgcgagcuucgggcggcgugcugcagcacugccucguccggcuugauguccaaacggcagcggacaugggggacagguccagagggugguuccgguggugcgcagcggccugggguggcgcauagaggcgcgaugcguccggggccuccccgcuguggcuggagcuugauggggugcagcucauuagcgagagcucucagcgcaggauacgagggcucccggcgcggcgaccccuccacccgcacugcacgcugggcuucccgaccucugcguugcaguacgggcggcgaagcuggagcagucgccaggccuugggacgcacggggcgcgcucuuggaacgggugcggcgccgaggcucgcugucucugggucgggcgcgcgguggcgcagguucaggagguggcggcucugggugugucuccauggugggcucguccagugccucuaagaagucaaaacuacggcaguggcgcuuguugaaaggcgugggcgcagcaggccgggccacggaucgcucacauggcuggcguuuggacgugagcccuggguccaccaccuugauguccugguacacggucgacaccagcaaguccggcggguccgugcgggucaucuuaaaagacguccccaggcuggcagcuccagucacacggccuuucggggauuuugcccugggaggagauaccggucagggcagccuccucugcaccccaagcccuuuaccccaccccaccccacgugcugguccggcuuaccuggggcauaggggauggugcagccuuggcugcaggucauggucaaggcuucuggugcugccuccaugccuauguuagauguaccugcaggagaaagcucacaguccaugcgaccugugggguagaugggccaggagaauuuaggcuacuguggaccuucuuuguagagggaacuccugaguuaaaccugccaggcauucucucccccuacuagggucgguugggcaggcuuagguagaucaaagcgggacgugaucucagcacuacugcccucuggugccuacaguuggaacgaugcacuuuuagauuuccuuacagguagacccucugauaaugcagagucccaggugagucaaugaaugguuccugccugccgacuaggcugggcagagaacucuucuccuagcacucaaguccuuuuuaacuaagcguaaguccccucaacucgaugagguccuaggcagaggaaugaucccagaguuuucuugggucucaaaucccucuuccuuuugcauaaaucuuggaccccaguugcuugaaugaaacccaccaagcuugcuggaacagagaaggcuacagcaagacucuccugcuuugcagaauugcacauggacccuucccccacccccagugugugcuaaagccagguuuaggcuacagaaccacguggggccaugugagccacgaguucaugguguccuuccucuaagcugaaaacuaccacuaguguaccaagccaggaggcugcuagcuaggaggaggcagaggagagggcgggaaagccccuccccaggacagaguccuucccacucuggcuuuggaaagcuccauggaaacgugugguuguucaucccuggagcuaugggcugaaaacgaucuaggcuaauguucagaugugggccaccagugucuguggucuccagggccuggagcuggcuagagaaagaggguuuaagaaggcgaucacacacacacacacacacacacacacacacacccuccccccauaaugcaccuacucccaggacaucugcuccagaggaaguugagaguguguuggggccuggcaggacuuguaaguggaugggccuuucgggucucuaguccagguguacaaggggcuguuagaggggugcucuuuggagucagagcuacuaaguaccaaggcuuguuccaaacccagguucaugccgacccuauuaagaccccuuucauucuaaacucagugccaggucagaguuugggugagaugacagggucugaggcuccgccccaggaaggugacagucggcuuugcuggcugcagcugucaggagcagugcacugugacacacgcucccuuugggaugggguuggggcuugcucuuguauccuagguauuuugaaggcccuucccaaauagcaguccugcuuuggcccguccuggagcagccaucagcaagaaccuagucugcguugcuugggggcggggacuccucauccuuccgugcagcccccucccgugccaacagcuccacaugcugggcaguuuggcuuggccucuuaccuggugauuacuccacgagccgagcccgaguagucugcauagcccaggucggucccaguguguaccuggccccgcuauaaauauauauauauauauacauacacccgguaccagcagaagcuuggaggcagcagcugugauccu

SEQ ID NO: 691 - RNA, 34668 nt, Mus musculus
ccacaguaaaaucagagagcuuuaugguaugggucuggagugucuaagaaggugcccucugggcucaccugcgcaggcgcucagcgggcagaggcgcagcuggcacacaguggcagcccguuagugccucucccacaggagaagugguacauuguguucucuugccaggcuuacccagugcggggccugggccacuuugcaguagcagaugcugccaugcccuccugagugacacaugacacaucugugcucagggcaggacccugugccacucuggauccauggggaagaagguccacaacccaagccaugcuguggcucugggagagccccggaaggcaagcaggaguggggcuggguggugggcauuagagaagccaagcagccccacgcccugccucuguaaacagacccuggugggucccuucucggccccaggcacaucccugagaaacaccggggacugguugcagcucuuucugggaggccaggugauccaccaagccagcugcaacuuuauucuguccccucccucccugcagagcaggcuucugcuggguugaggcccagcaccugcagcgccugacccaagggccugaacaccaccaaggucuucugcacaaaaaacaauguagagugggccagaccacaugggggcagacauaauggcugggggacauagguggcagggugguccugggaaugugggugcauagacagcagccucccagccacuggcagcccaccucuucccagacaaucaauugcccuaggcauguuuagagcuccucauaguccccaccuccaggguggcggcugccaggggccccaccccccaggaaggcuuccagcucaucugcagccuucugcucuuugcuccgagggggcuuccucuucuucuuccgauccuccuugcccuccuccuuguccuugcucuucuuguguuugcuuuucuuuuuuguagucuuuucuuccuccugaaggucaugaagagcagaacuagagucaaugggcaacccacaaggcuaaaucccacauucuaggagccuggauggcuuggcuaguugggagguuagugacagaguagguaccucuuugcuuuucuucuucuuuuucuucuucuccuuagagggaaguuugcugucucuaucugcacagaaaaggacagcugagcuccuaccugcuaccacuuuguagaguuaggcagaggcacugcugcagagaccccauucccaacagggcguggucccacaggcaauuuauguauuuuugugguggugagucuugaacaagccuucaaguaauuucuuccccucccuauggggcugagaaccugacaguacaguccuaagcuguuugcugggcugacauggcccaaguccaaggacuucuccaggcagccugggccggcccgagauucccagguauucucccugcaguaaccuuuuauuagccugugugguuuuuuuucccccucccaaaagaauucugucccaaaggcuugggacaccugaaagcauggaauguagaacauuugguagaggugaggacccauagggaaccauggauagagugacagugacaguguuuagaugacuauucuggaccacacuugggugcacauuugccagcuggugugacaguuucaccaaucucacagcuaauuacuguggugaaaagagaaaccauaggcaauguaaauguaaacacaggaguaucacagacaaggaccucuaggauccagcagguuccaggcccuccuaccuucgucacugcuuuccuuaggucccaucuccucuaggcccagcccaaagagaucggagucauucuucagucugaaagcaccugggagcuuggaagguggagguggcugagcagggccaguguccucaucaguuacaucagagaggucuucucuuacuggaaaccugcccuggaaagagagcagcugguaggccgauugugcccugaccacuccgagggaucugggaaacaagguuggcaaguucacuuacgacuccaggggcuagggcuggaugggagggguaaccugacccagauucagaaagaucagcagggccuucauguggacaaugggcccucucccauggacucucauucacuuucuccagcaggcuucagccacacaguaaauaagaaaggauugugccucuggggcacuggagccaggaacauucuccugccucucgucaggcucugggaaacagaccuucuugauuguccucuagcucuggaaggauggugccugagcugcccagucagcaccuguccuuaccauucuccucuguguaucugauucaucacuuucaaagucugggucauccaugacgaaggacagcaucugggcagcaaugggccccucaggaucacucucugaugacaccuguuuguccuucccuuccuggggucuuucagagucaucaguggugagaccaucugaccacgguggcgugccucucgugggagcucucuucuuuuguggaugugagaccuugguggaggaccuucacauaagaagaaaugucaggaacucagaggccacccuggguugccaccucagcuggacauacucugggaaucccagcccauaccauuuagucucaggcucugagcauugcugaggggccacucuaggguggccugccaguccuucggcuuccuccucacuugagagacugauguucuuacugggcaugggauccgagggcagcagggauuugccaugugucuggucuucuauguccacaucauccuggaaaccugccaccauuggguucccuccuagggccuccccaucgucacugcaaagagggggggguaggcagucagagguucugagggggcuguguguugcugauuacccaccccacugccuguagagcugcccugucuguaguaccauaucccaguggcaagaccuucugggcuguuacagggguauucugcugucaagagggggacuaaauagugagggaagcacugccuaguugcugcuggucagugacagaaucagugggaggaguccagagagaagccccuaauuuauuuguuucuggaagggaagcccuuggucccauacaacauggugaugcuggagaugauaacagucacucaacauuugaucugugagagggaauaaucucaggcuuaacuguagacagauguucaagugucguuagaauucagagaagggacugagaagggcuagcugcaggaaauuagaccuggcuagggcuugcuucucugggucuauauggagacccagguggccuucacuauaccuuacacauagauugggccuucaagagugcccauaucccuagcagggcgugguggcacacgccuuugaucccagcacucgggaggcagaggcagguggaucucugaguucgaggccagccuggucuacagagugagguccaggacagccagggcugcacagagaaacccugucucgaaaaaccaaaaaaaaaaaaaaaaaagagugcccguaucccugauaggccaucugucaaggcuccugcuauccuaggaagauuuagcuuaauguucucuaguuugcuguggccauaaacucugccucagucccggguaaguccuuugucuguauuccccaggguggauggcaaugauuguacugagugggcuuugacaugaccuaagcccuucccucuguuccuccauuuguccucaaagcuaacugccaaccuaguaagcaccggaggcugugcccacaaugggguuuuggagacccagguaugaaugggauggggaagcucuguugcuugguccuugagguggacccugugcucagcucuaucaaucugacccuuaccugucacuauccugcuggggaccuuuggcuccaacuuucuugucuuuaggcacacuugugucuuccaggaagcuucggucaaggccaucuucagggacaaaauccucaacauucuggacucuugcuggagcuucgagagcuggagcuggcucuacagagaaaugcuguuucuuccuuaugugguccuugcccccaugcuaggcaagcccuaaaacugugccugugggauugggacuuaacaaggcaugcacccaggcucaagguccaggcuauuuuagaaccaggcuaaggacuggcuggcccaugugacuuuucaggggcauagggacauuccagugaggaauaugaagcucaagaugccagaagguggccccaaauucacaugagagagcugcucccaggcuuaccuggaggugaaggggucacuucugcagcuggugaggucccaaacagccgagagaugauacugcgacgcugggcuggagcuggggcuggagcugggguuggggcuggggcugaagaguguacagaggagggcauggccuccaaagaggguacaggagauggugcugagggacagguggaggagacaccuagagacagcugaggggcaggcuggggugugcuggggcuggaacucccuguggauacagcacuuggaggcacaacuggcgacugggagccugaggaugggcucugcccauuggcugccaaaggggaugcguggccucgacuucgagccuccaucauuucaaggaagcuaggaggggcaaaagggcauggagugaggaaccugcuucuucucggcccucuuuuuccaugguuuucaggcaucagugugucuuuuacauuuauauuuaggcagaggauagggccugucugccagucaacugucccgucccugguacccagacuaauuccuugccuauccugucucuuuagcacuguagcucccaagcccaugcucucccucugcacuggcauuuccucagccuggggaacugagcugcacagcagaggugcaggaccacccacuccuguggaaucuggguaggccaguagcuguuagccaaacaacagugaaguaguguggcugguuauggucagugaggaaguuagcaaucgcacacgaggaguggcucucaucacaggcaugugcugacccacacguaggaaccauaacguaugucuaagcacuuuguaaguucuguaggcuccaaaguacuuggggguguagagugccagagucgacacaacccaucuucaggaguaccuguccucacuuucuauaagaacugagaggggauguagggagacugaggcugcucccaggccagcauagcucaauucaaaguacuaguccaucuguuuuagaaaaauguugaucugacuauuaauuagcucauauuaauaauuauaccccaacaggugaacaggaagggcucugggcaaggacaaauagcauggacgcagguccuagaccgcugagaggagcugcugagcuguguuaguccgaugcuccccacacugcucuacacugaguacugcuaaggucuuggcugaaggacacucaggcugauuguauguggugcuuucuccacugccucauagauucagaccaaagucuggcacucagcucuuaucugugaacacuagggccuacuggcaacaggguacaggacccauccuccccgcucaggguagugaaggccagcauagcuguagaugcuagcucacguacaugcuguaguucugguccucgguuuccugcugcacugauagcuccucuaguguggcaucgaugucuaguugguuugucuccagcugccucaguagugucucccucuguagaggaaguagacaaaacugaguaugcuucuuccccauucuaccgccuguuccugugagagacaugaggucuggcugccugcaagcucagcuuuuauggcuuggaggauauaggucauggggaaccacaccagaaagugccaccuucugcuccacaucuuuggucacuagcauguuuuguuggcuacaauagccuaucaggccacaaaaccauggaaacaggcgcuuaaggugcaggggcagcucucggggcaacucuaggugagaagcucugccagguaagccuggguaaaccgcauacuuguagucggaugaacaaagcggaucaaaucaagucucugaguccagcugccaaggcugucagucaacauggcuucuugcauuuaaauuuaaucuuagccaggcggcaguggcacacgcuuuuaaucccagcacuugggaggcagaggcaggcagauuucugaguucgaggccagccuggucuacagagugaguuccaggacagccaggacuauucagagaaacccugucucgaaaaaccaaaaaccaaaaaaaccaaaaaacaaacaaaaaaaaaucuuaaaaaucagcagcuuuucaggcuguguaaggacuguguuccuaauuggaagaggcucugguggacaggcacugccuuccagagaaacagggcuugcccccggcucacagugggguccuuucagcacagagcaaacaaaucgaauagaaaaagugggaguuaacuacagaccaagagaccugggaguuguuuauacucugaaaaaugaaaagagauacacaagaacgaugcaaacaacacucaggauuaacaagcaggcauaccacagacugacgaggcucuacuuuaaaggugaacucgugcuauaccaagagcagccuagacagccacaucacauacauagcauacagucuauuuagaccuuacccugaauacugaccaauaacuggugauucaaauaauuguggagucaugguguuuuguuucucugugaagcccuggcuguccuggaacucauuuuguagcuaaggcucagagauccacuuacaucugccuucugagcagugggaucaaaggcgugugucaccacaccuaacuuuuguuguuuuuaauuuuuuugaaaauaagacugguuaauguuucuuguaccagggucuggccuugaacuagcuauauggcuaaagaugaugcugaacuuccuuuccuccugccuccacuuccucagugcuaugauuacagacugugccacacacgguuuguacaguacuagggacugaacccaggguaucaugcauaguaggcgaguaaucuaacagaguuacauucccacaucauuauuuaaugcauguaaauguuuugucugcaagcuacgucuguguuucacguacaugucuggugcucagaaaggcauuucagaucccuugacaacggacaguugugagccaacauguggaugcuguguauugaacugccauucucuagaagaccagccagccccuccaauauggaauguuucaauccaugggugcuuccagguacccacuacccugccagcagacaguggccaucagguucccugcaaauaaccauggaggaaagcuauacugguuugggucucagcucaggcuuuuagcaccaaugacuauucuggcaucccuuugugucccuugaucucccuuggucuaagucagugguaaagcuuucauagaauggagcaguaugaggaguuugguuaacgguuuccuccuaaacugaaacauccaugcugcagagcucuuuaaacaagaaggcaaacaacugaaaauaguuucaggaagucccugaaacugaccagauugacuaggcccuccuggcccaauaagcaauaaaagcugaaucucagagaagaaagguugcaagaagauccagaccagaccguugcaugggaaggcugugcagggugcuccagguucccagcuugugugagcugucacccaugcuugggugggcuuuggugaugcagucuuugauucauuucugcuccuguaaggaacuccucauucauauggauauaaguuaccccaacaaaacucauugguucaccaagcuggacucuggugguauccauacuuugggaucccuaacuggauugaggagacaagcauguuaucccaagcaugucuccccagaagaaguuuggugacucaacaggagucuucagccaaaaggccucuaguagaggcuccuaucauagccaccccugcaggaaccucacauuccucaaaaggaggaagagaggaggaaaggaaagcuucaccuuucuaagugaguuugaugucuuggauaaaguaugaaggguuccuaagagcaggggaggcuacagguacccagguccagaaagguagccaggccuguuuagccuuuucuuguucaccagagaccccauacaaagcuguuugucccaaaagggauguggaucagggauuggcccucucucuguucuuaugcuuagaacccagagccuuguuccaccuuccacagucuauugcucuccuagcucugagaagcuauagcguaccucaagaccagagacaaggaccagagcuuaagcaggguaggauucuggggagaaauugggacuaguuggaaccuuuagucuauagaaugauacugguccuuuggcuuagacaaauguagaaacaaacugcaggcaauagggacuggguggggauauggccauuuuuuuacuaccucugccaccuuuucuguuuuugagaaagggaguccaggcugcucuugaaccugugauauagaaaggaugacccugaaccucugauccucuugcuucuacuucccaaguacuggaauuacuggcauguaccacuaugaguuuuuggggugggucucccucuuauugaaccucuuucuguauccuuaaaccugaagugaucuuccugacucagccuucugagugcugggauuacagguuugugccuccacauacagccuuugccacuucuauacaucuagaagguuccaagaggagcacuaauuaaaaagcaggauaggugcagcucuucacccugaaggccacucuacuugccuccgcuguaucaggaaggcuagaugcuuguagcaaggguacagguuuuccuuuuuucaugagcuggccagagggccaugguucccagagcacagccagcacgugaauguagucacagaaacugcauacccuggaaccugccucuuguugaaagacuuguugugacugggacuuccuccauagcuaucuguuuaucugggaaaugagguaugcacuucaauuggugccccacaggggacaagggcucccucuacaggcuguacugacuuccaaugcccuuagagagcaggacauguuaccagacucuuggccgccacuaugaguacugugugugccauguccagcucauuacauacaucaguagccagcuuccaagaaggugcccaaggguguuaucaggcuuaggaagcagggcacuucuugugcagagucacaaaaaugaugguuacccuuuuguuuucccuaccuaguacgcacuuaccuguaguugcaaaaaugggauguugaagaacuuaugcagguacuuuagaccaaagcuguucuucauggaagauucagcauagcggaaauaggaggaaccuggaggucuguuuucaaagaaagauaaaggaacuugaugggcaguguagcuugacuucaaagucaagggucacaccuaagccuacgcaucccgccaccaagcuuccuucuggcagccagcuccuaaggauguuuuacagcauacuccucugggaguggucugaagaaccagacaagagccaggcaggccccauaguccuggcauauggucuucacaucuucugcagcauuaccaucucguggaaaccuggaauuccuuacccucucuggcuaggugcugucaucuuaucuccaacacaggauaagacccugccugugcugcccccaacaccaccagagcacgucacaggagcaaaagugguagcacccaccuguccagaugcucaaugaagucccgcacaucgucugguagaaugacucgaugcucgcccaugucacgguaguugcccagcacacacaccggcacauggguuggcacuuugggaagcucccggagaacauaauugaagguccuuugaaaagggagggaguguucugccuuagcugugugacccucagagagcuguauguacuaccuuuuuggucuaacuccccagagcacuugucaccucaggcaggguucagagaugaacaaaugcuacaaccuucagcugcaucucuggucacugccucucucagagagcaguuccccuacaccucaauucaaggugccuguucuuuugucuguaguugguaugacaccugucuauguugcuaugaauuggcuucaagggcuggugggguggcuugguggauagaagugcuugcugcugggcuugaugaccugaguuugaucuuuggggccacauggaaagagcugauucucauagccuguccucuggucuccaucacacaacccccuagccucccccuuccuucuaccccccccccaacugcccagagccucaccuguuuguagaaucacucugaacugagcauguccuaagguaaccuguccuucagcucugcuucacacugaggcugggguuguagcucauucacuucucccugcuuguuggcucuugccuccugguuaccaucacugaaguguccuuagugacgcguuugucucuaggacauuccuuauucugcaggguagaccauucugucuacaaagucuccaggucuccaggacugacuuaaugugggggugcccuguaguugcacuuuauaagccaucccaaugucuccaaauggcuugugaagccccagccaggacugggcuauagucagaggucgagcacuugcuuagcauaugcaagguccuaggcucacucuccaguccucaugcccugcuccccuccccuuccuccccaaccaugaguggcaguguauaccaauaaccacaguacucagaaagcucagguaagaggauuaugaguuuguggucaauuugggaaguauagucguuccagguuagacuaagcuacacagagaccuaguuucuauaaaaaucacuaacaccucccacagucagugcaaugagcaugacccagcuucccugccaagcaauuaagaacgcaacacguuuuuaacuauggcagcuucucuuguuuuugcugcauuugcuugaaacaucuccugccccuuuuauccuuauaagacacuugaagcgugcuugcuggcuugcaauggcagcagcugugugaacauggaugcuuccauccuucacgaucagugcucagacucuuaacagugucugcugacucccaggacaagcucaacuauuuuaguggagcccacaguuaagagacuuuuaauuguaaaaagacuuuggauuuuagaagagauggauauuuuaaagagauugaaauuuuaaaaauauguaaagacugugggacguuuaaaguuauuuagaucuuggggaugaauaagaauguaaggguugaggcuuucuagugauguguuugugugucaaguugacaaggggucaauuguacuggcuaguuuugugucaacuugacacaacugaaguuucacagagaauggagcuucaguuggggaaaugccuccaugagauccagcuguggggcauuuucucaauuaucgaucaagggggagaggccccuuguggguggugccaucucugggcugguagucuugguucuuuaagagagcaggcugagcaagccaggggaagcaagccaguaaagaacaucccuccauggccucugcaucagcuccugcucccugaccugcuugaguuccaguccugaccuccuuuggugaugaacagcaguauggaaguguaagcugaauaaacccuuuccuccccaacuugcuuuuuggucaugauguuugugcaggaauagaaacccugacuaagacagacccuaagacauggcugugguacuuguggucuuugugacaaggaccuaugaagccucauggcucucaaauaugcaucugugcauccuuccugagcuggcuuagccuccugccuacucuguagcccagaacucaugucuuuuggguccucgcuguucuuaagagcacuaccuaccccucuauaauacccccucuauaauaccccucuauaauacccccuuauagcuauagggucuugugaaguuagauugcaaagauucuaacacacuucaguggaguauagaggccuucaguguccaaaccuaaugucacaugggagaagccaugucucacauaauagaccaacagacuaccaucacccacacggcaaaacacacuguacauguacacaagagcacugcacucugcucuguacaugagaagaacagcuuuguauaugggugucuaugacacaaguguacugcugaacuggagcuuauggccuagccugccucuuguagcccccauagguuucuugcaugugacaguuaagcauauagguccccgaagguuggguagguuggagcugggccuaugaauacuguacagaggcuauagaaaguauguuauguagaugguggcucccaaggaucuaugaguucaggacccucaaaccacaaucaguggcaugcacagugcaaacuuuacucccaggcuuaggaugugcacauguuggaggcugguauaaucaagugggugacuauucuuaaauagcacaagugcaaagccuaagaagacaugguuccacuguacauagaugaugcacagaaaucuagcuggccugcucagcucucugcaaugagagucuuacaugauggaacacaacacuuuucucucuuuccaaucugaacacagauuccacacauuaauacugauagaacuguaaaagcagaguaaaacuuuccuucuuguaauggaguggguuuucuuuaaggcagaauagcacuauguagcccuggcuggccuagaacucgcuauguaggcuuugaacucaagagacccaccugucucugucucccauguucugggguaauaggugugcaccgccauguuuagcuaguauaguguucuuaagagacuguuuuucacagaggaagcaagucucuggggcccuugguuuuccugcuguugguuaaagaggguucccagucuuacagugguauguaaagcaguuucucacaauguccccugucaauggaguaugguggguuucaggaggcuugcaccugcucacugaaccucuggacccauuucucacuucauucuuuguccuuuguugucacucaucuuagauaugucuucuuggugaguuacugaguguguguauauauauguaugcguauuucugggagccccuccaauuaaacagguuacuugauucugacaaauuuuauaugguguuuucaggacagcaagguuguagaaggugacgcuccaucccuaccacuguuggcuauaagccugagccaacuccugccuacacucugcccgucuugugguaucaguaccucagcccccuaggucaggggguucugcucacaucuggcauaguaggcaguuccacacugagaggaaccgcacagcacuacaugaugaaggcaugcagcacugccuguuaucugcccucuuaccacugcuuagugaugucaaacaucaugaccacuccauuacaguucuuguacacauccagaaacucagcauccagggccaauucagacucugccuagaaacagaaggaagaaaggcuaagacugugucccuggccaaucccauacuuguggcccuucaaacaccugaaaaaugcagguuggggcuuuucuagucuuuuuuuguuuuguuuuguuuuuuucaagacgguuucucuuguagcucuggcuguuguguaacucacucuguagaccaggcuggccuugaacucagaaauccgccugccucugccucccaagugcugagauuaaaggcaugcaccaccacugccuggcuggggcuuuucuuaucuaaaagucauuucauuuugggaaaaaaaccuugaggaaacccuuguggguauacacaagguuagccgugggggcuggagcagugagcuccaucgcuacagagcaggccugccuuaggacuuccagaagaaagugcuggagcugucagcugccccuugagaugguuuccaggggaagaacaaaaaaggacacaugguguaacaaaccuggucacaccccagggcugggcagucacaggcuggggugggguggggugggguggggugagugggcgcgcagcuguucuuuagccaaacugcauuuaauauuauguuucugucuguauauaagggcuacuuucauuaaaaaaaaaaaaucuuuucuuuugguugcucaaaguguugggaauaaaugaccauuuagugcauggcuguaaacuagacucagagaacacaguagaauacagagcagaaagagucuaagguuagugugguggccugcaucugucaacagucaaucacaggcuagggaggcuaggucucuugcaguccuagcucuguacccaacagugagcacaacaaaugucaauggacaauuccaaacaugugcucagacagaggguccuacuuuaaaaucacuggguccucugcccccgacacacacagacacacauagaggacaggacuuguaggaagagggaucagaugacaggguaggagggagacagaagaggagguaaagaguaaacagaauauauaauauaugugaaugaaacugucaauaaaucuacaaaaaaaauaaaacuaugcaaaugguaaaaagaaacaaaacaaaacccaaccccaucaagaugaguucccgaacacauagcacaugggacagugcugggaaggggcuauguaucacuuaaacuuccagccucaaagagggagaaggcagggcagggaucucuaaaacaacuggaaggaaggauuacacaaacauguccacuguguucuagcuucuagggagcaagcaaagaccaccuggucucaccuguggugccauggccacaccuccaacauaugucagcacuuuaaagaacaaagucacaugacagagauguaaaauaugguuccuaauaggccauucacauggcaguucacugugaugucugugggaagcagagcaggcaccacguggggcaggcacccuaaacaggcagugacccugaaacuuaacccaggcagcaccgagucucaacaguaguuaaggacagucagugacuacugcaucuacagcauacgggauuguccaggaggccagagagugcccacaggcgccuugcucaugacacuggcacagacccaccugacaauguggcucaccuccugggggucauuuuccgucuucaagccaucuccucguuuuuuacacuuuccuuauuaaaagacaaacaaaaaauuaggaaugaaaugguugggcccaggauuugcauaaguggggaguauccuuccucagacuccuccuccccgccuuaaugccacgugggacugcacuccauucagccuugcaaucuaaaagagccuccugguagguccagacaccccucacucauguuugagagauacaaaacugugugaacuggcuaggcuggcagagcaggauaggaaaugcagcacuuagcagcugauaagacaggccgggaaggaagagucccuauccaggucugccuugaguaaagggguugcucaugacagccuggcucucauggaaucgugggggauggcaugauaaaggguuucuacagucaaagcuuggagaccaaaucugaguuccuuaaacagucccugcaucacuaagacacuggcacacucggagaaguguccguccagccugacacugccuguucaugguaacugaaguguuuuuaucuggcagacaaccacagguccuguagcagucugacacuggacucuagggacaacaagaugacaucacugucccuucuccuuuucaucuaaauguccaacugagcucuucacaaccuugggaauuccauagcagacaaauuaucuccugagaacaaacucagguucaugugcuuacacagaaccuccacagcacucugcaguccuuccugagcccccgucacacucagucaggucagccucucugcucagggcagugaugauucagccugaaucaugggaugaauggcaaguggcacaucagggcaugagccucuagcccaccagcaucuugcuguaagcugcuguaaaggguuugugggaaauaugcuuucccuuugaaagcuucugaacaagcacuagagagcucugccuccacaaagcuugagcugcugagcucaacugcuuggccaguucucuggagaacuuuccaaugcccuugagcccuuaguugcuuuaacuucucucacaucuaaagguccuuugcuugcuguggacacuauucaagaucauggggaugggggaggaaggagaggcagagguccuuucuuuccaacccucuacggugaagagguagcagcaggcgugaccaugcaggcacucccagaguuaggaccucugugcugggauucagccugacugcaucugagcagggaucugagcagagaucucagaguagggugguagagggcgugugagccuagcacagcaggaaaucagucuuccauggcuccugggcaguggaggugucgccucugcugcacgguuccugggccagcugaggguguaaaaugcuacuccaaagagcccugagugagagacugaggcuacugcauuauugucccaucugauauccagccccaaguucugaccccacucuucaaagcccugucuauaggacagugcauccgcugcagcagacugcagacguggagaccacagcugaggcaagaacuuaggaaggcgcugcagcagguccacagccugacuuaauggggucaugguuuguggagaacagcuggcguaagucacuugauggccucaugaggaugugacucuugcccucaguguauacauugauggacuucagguagcaggucaucuauuaauacuccaaagaugcacacaaaagcauucagagguguacagacacaccaaagccaucagagaggcucaauggauaggauucaacuaggcuguauuacugcuggaaucagagaaaaaacuggcuucaacuguucuucaacacuuggcccaaaaccauacucagaagggauuuggcugaggagggggaagaaagcacacccugugccaaaacaaaaaaaccaaaaaacggagcccugaagacacaucuucuggccaaguccuguaccuggaggacaugcagcacagcuaugcugaugaggccagugguuguaagaggucagaggucauguuuauuaugcuaguggcuaaauaggugaugcuaugccuguugggucagaggccugcaugcacacauacaaugucagcaccaaggaggacuaugaacuccuacccccagggucaaagaggaacauaagaccuaacauaggaagaaugagaucagauccugucauuagggccacucugaggaguucugcuguugaccucugcagguuuagaugaggcuggucucuguguggcugggucuaucgagguacucugacuuggggacccauucaguaagaaacgcuacauagagguugcugaccuccaccacaugcaugacagagauggguucaaguaagaacaugcaacuccagcuugccuucuuucuaaauccaauuaaaacugcuugugggcaaucucugaacgaaguccugcacgccccacgugcugccccagugugcucucgcuccacugacuuggccuuccgcacucagggugcacacuucuacugugcuggugcacugcacuuacacugucuagcucaauaauuagggccaccuccagugccagagggcuaagcagguagcuauaaacaggacccaagucagguaagagccuugugggcaucugccugugaaaacaaauucucauuagagaccacucacuggucacugucaaacaacauggcauuaggccaucaccuaguaaaagaacaacugacagagguacccuucugucucucucagagcagggcugccaagccacuaagacucuagggcucagugugacugugggugcagggcugacacaagaggaaauacacaggagggcuuugggaacagcgcuucauaagggucaucccucccaaaaugcucaaaagagaaaaguaugugugacaguuucacuguugaacauuuacucugccgaccagacaugggauggaagugaccagggcccagaacuuaguccacguagggaagggaucagauagggcucugauguaagccagaugcuaacaguuggcagcaaacccaacccuccuauacucuuuugacuugauaaagcuggugccugugacaugcuucugagccacaagugacucugugugacagagcuaaguaggacaugggacccaaggacaugcaaauaaggggugugugcaaaggggaggggccuuagagucuaucaugcauuaaggagauaauguaucuuaccuuugucaacuacaucccagacuucaacuuucacuacaucaucaguagcugaaacaagaaaaacucucaaauuagugcauuguaucauuccuucuaggaucccaaauggggccaggggcauuugguauuacuagcucccuggggccucugcaauacaugcuguaggguuuucagggcuauuccuccaggcccuggcaugagcaaugcauauauuagcccacagacaaagccaucacauaacaacucacacucagaagccugugggucccugggccacuucaggugcccuagcggaugcucacucucugggcagaugaggaaacagcacagcuguccaagucacaucucccccaagccuacuacuccuuuaccugacuggccaguacucagugagaacgcaggucaguugcaaaggccagagcugugaugggucaccugagcaggcccaggucaguuguagccccgacaccuacaucaccguccucagccuaccuggcccauagacuccuaaggcuuucucugauacuagacuuaaguugcaugagaacagaaaccauuuuccaaguucuuguuaacucuucaaccccuccucaguagcaauucuccauuuuuaggauguccuaagggcuaauggggcuguaaggaugguggagaccccagaacacagaaggggaagacaagaguuaaaauugucacucuguuccccaggggugagcacuugccauggaucacagaaugcauuccuaucagacaaagcagccauguauguugcugauguguauggguggaucugcuccuagagguggccagggaauucuagucuuugaagguauguccuugcuuccuuacuuguaaccaugaguauccugggccugaggcaccacagaggagaaaugucagauucaaaacccagaagggcugauucacaugcaaccuuaauuaauggggccucucacauggguaguauuuucucaguuucagaaaguaccuucuaggagccaggaaggcaggauacuacuauacuguacaggggaaaaguggcauugaacuauuauuggccuugaacucacuuuuguaguuccaauggaugcuggugaccuggaucuccuguguggggauguauucuuccacaaacuucuugcccugcagucgaugccacagagcugucuugcccguguuccugucaccccggaucacaaucuucacuggggcaaggaugggcaaagaaaagagaagggaagauuaaccagucauuuuuaaaaaacuuuaaaguaucccaucuguuccaugucaagguggaucccuauuuucucaggcgaguggcaugcaggggaggacugcgugaggauaccagcaguuccccagcgggucaauuccggcuuggcagacuuggcaagaacagaagccagggcugguagaggaggcagcacugaaguacuucaucagggccugggucuccuggaguuauauacucugaggaacugccaggggcccuaggaucagagcugggcugcagacuugagccaacaguguguagggcccaggaugguacccaggacauggcuuccugcugacauuucucaguccucaagcuugugguguaguuccgcaugucuguauccuaauucacucacuccaugguguacuaggccugaacucagcagguucuccugacuuugggcagggacgggcauguguuccaggaauggggugaacaggauggagugucgaccuuagguccgagaccucuuagagaaguuuaccacuagguguucccacagguaacaaaaagcuggagcugacccagugucagcgaagccaggagggacgagagcaaagcugaggacagacagacagacagacagaggaugaugagaugggcagggaaggcauggguguuagcaugguacuuccugggcagcaccaugagacaggcagaggcuaaucaugccaccgaaaacacccucgagagucuaaagcagcgauggaggcuuccagggcgggggggugggcgaggggaagcuuguggguuccuuuacccaccugcugcuuucuccuaggaugucuggucugccugcagucaagccucuccccauuuccaaaccaaagucuggcugagaauggcccccagugcacauaugagugaguggucaaacaguuggcuuaguugacugcuuaggaagauuaggagguguggcacugggauggggcuucucuuggccugcugcuuguggauaacauggaagcucucagagcuaugcccaccugcugccacuguaaggucccacugaaaaacaagcauucuuaaccacugagcucuacagcucuagauauaaauucuuuuuacguuuugcuuuuuaaaaaaaucuuuuauuuuuaugcauauguauguauggcugugugaguuucaugugccccaagugcaugcaggaucugagggcaucagaucccugagagaacuggaguuguauauagacaguugugaguuguagguacuggaaauugaaccuggguccuccggaaaaacauucagcgcucuuaaccucugagguaucucuacacacccaacccuuuaagacagccuuucuaugagccuugguuggccuggaguuagcuauguagaccucugccucuuaggugcugggauuaaaggcaugugcuaccauaucugguuguuuugccuuuuaagucacuaguccaagauuuaucuauuagucaucauacgaccgucucauauguucuguugaaugcaacagguucuuuuuaaaaaucugcucuuguuuuuuuuuuuugcauuuccucccuucuacuuucccaggacucccuauuucagacuuucaaauuacaaucuuaccucaaggacuuacaaguauaugggucucuugggacccauaaguuguaaguacuuucuuuuuuuuauuguuuuuucuagauuaagguuucucuguguagcucuggcuguucuggaacuugcucaguggaccacgauggccucagagaucagccugccucugccuccugagugcugcgaucaaaggcgugcgccaccacuaccugcagagagugcuuucuaauuuucagguaauuucuuucauugcaucauaaacuacuuggaaacuguugcuaucuggaucuuuaauuuccgcaucuccaaccaaaguccauccugccucugcugccugagugcuaaacuuuuacuuuuuauacauuaaucaucccacagcaacggagaauaaagaacugcuauuaagcuucaaaaagauagccgaaggagaugucugcagucucagcuacucaagauacugauaaaagaucaguugggcauacaaguuaacaguuugagcacaguaggcacuauuucagaacaaagccaaaccagaauacaaccuccccacuaucacucacugucacagaauacagagucuccccacuaucuaucacugucauccucagagguuugcugggacucuguuuugauggcuguccuuugguugagagguugggacagaggaagucaaguacagguaaccuguuucuggaucagucuguaucacccuuauuccaaacccauugcuucaccuugaagugugcaccagaugacaucacuagugagccaggccauagcucagcagucuucguaugcucagacuuccccaguauccuuuuucaucuuuuacuccuaccguuugcuguuauauuauagauguauccucccaaaagccauagggcccagcuagagggauggguuguuuggguuuuuuuuuuuuuuuuuuucuucuucuaauuucuugaaugcauugugucugcuaauagaaauggaauuuuucuuuuuuuuuuuccuuuugguuuuucgagacaggguuucucuguauagcccuggcuguccuggaacucacucuguagaccaggcuggccucgaacucagaaauccaccugccucugccucccaagugcacagauuaaaggcaugugccaccacugacuggcgaaauggaauuuuucuuaccacuucauuuaauaauguuuaggagcuggggauguagcucagcaguagugcacuuguuuaacaagaaccuagguucaaucuccaauaagaggagagagagaaaaagagauugaccacggcucagcagguaaagguucuugccaccaagcccaacaacuguaguuuaaugcccaggaggcacauaggagaaaaccaaaaagcugucuuuugccaugcaugcaucaaggcauaaaugcccucccaagaaauaaauuuuucaaaaugguauuuuaaguuacuagggcuggcaagauggcucagcagguaagagcacugacuguucuuccaaagguccugaguucaaaucuuagcaaccacaugguggcucacaaucaccuguaaugagaucugaugcccucuucugaagucaacuacauuguaccuauguauaauaauaaauaauaaauaaaucuuggggguggagcaagcagagacugagcaaguggaguuggguagggcugaccgaagcgagcagagguuguaaaguucaauuuccaacaaccagaugaaggcuaacaaccaucuguacagcuacagugcacucacauacauaaaauaaauaaaucuuuuuuaaaaaguuacuauuauaguuuccucccagccaucuuugccuuuuacuaaguuaggcaaacuuucccacaauuugccugguauauaauuggaaaaguuguaauguacacuuuaacauccacacuuacugugauaauaaagucaacacauuucugaauguaugccagcuacaguggugcaccccuuuaauuguagcacuugggaagcaaaggcaggcaggucucuaugaguucaaggccacucuggucuacaacgugaguuccagaacugccagaguuacauagagugaugccucccuccucccuagucuaaugucuuaacucugaucagcuccauucugggguaggggcugacuccaacuuuuucaguauuguuuaaaaaccaaaccaacccaauccaacccagucccccagucuauuaugaaaacauuaucaccagugacugacaacaagugcuuacucagggcuuacugcacucggaccuauuccuuugcuuaccuuugcuuuguaacucccacgucuaccuuugcagcuuaagcuccacuuaucuacagaacacccugcagugacuguuucugugagauccucugcucagccagcuguccaucccacacugaccaugagcacagcgcauucuggccugcgcagggccaggucaucagcucagugcugcucuuuaguauacucucuuuacucugguggcauaguucccucuuuuugcuucugaaauucagaccacucccagugaucuaugguuguuaaaauucugguuuucuuugaguuuguucuuuuuuccauugcuuuuuugaaacagggucucacuauguagcccaugcuguccuggauuccauuaggguccaaaaaggacccagcugccccugcuucccaagugaugggauuaaaggcucguccagcuuucccugccucaguuauucauucuccugacauauugcaaaagauuguugugcugccuucccgagccacccagacagcauucugcaacagacaauucaaaauguggagacucuuacaagaaucccgaaucuguauuuauuauauugcagguuuguuccuuuaaguaaggcaucuuggaaaauauggaagacuucagcucuucuagaccccuccucuuuagaaccccagggcguggguccaguggguaguaaguuuagaaagcaagaagcuccuaguucaggccuaauuucuagaauugggcugcaaauuaauacuauauaaaaauaacgaaagaauccaaacauagauuccaaagaacacaaaccacugaauauuugacucaauucucuuccucagucaagagaaauacaaacuuccaaguuaacacacauacacuguuugcuucuaaauuugcacaaaaaauccuccuaguaaguuucauaauguuacauuauuaccuaaauaucacugacccugugaggcacagcuuacagugaacuguguguaugugccagugcauguaugugugcgcgcacgcgcuucaaaaauguugcaguauagaaauaguuuagaaguaaacaauaucagaccacgacauugcccaagaaucuuuugauuguucaaccugcaaauggaaaaacucuaaagaggucaagagaaccgugugcuucucgcugcacaacauacauaauuuauaacgaagggcagagcggacuuuucuucuuguggggucagggaugcagaguuaagagccucuugaaauuaaaaaaaaaaaaaaagcauaucccuuacaaaacaaaaaacaaaaaaacaaaaucaaggcucaaggcccacaggcgaccgacuuucaggagccuccgacuuucaggagccucaagugagagcaggcgcggggggcggagaggaggcaggcacacgcagccccgcgcgcgcacccucggguuauguaauggucucucuccgcaggguacccgcgccaaucaggguccuccaccgcugcuccgcuagugucgccgcacagcuguucucuggaggucuccugucaggugaugucccucaaggaacgaccacuacucagaacccagggacccguccgccccuacccucugauucuuccagacccuaguaggcuggguggccgccccgggcccugccagccgccccggccugcccgacggcgcggcccgcacucacuguuauacugaacccccuuagcgaagcgccucugcagcgccugguucauggacugcagcccggcggggauguucuugucccggccuggggccugcuccgaccccaccagcuucuucaacgcggagaacauguuccugcuggacgugcgagccgggcuggccugcgagcucagcagcggcagcagcacagcgcaccccgcaccauguccggccggcccaggcuucccccgaggccggagcgggcgcggccucgagcgagguucuggggccucagccucuguggcuccgcuccggcuuccacggcccucggcgcggcagccaggcacccgucagcgccgccaucuuggcgccggcgcggcuacgggacgcuaaaagggacacguagccgccgcaugcgcagagagcgcacuaggucccgcccuuuucuagcaucuccaccucgccgccaccaacccccucugguccaacgaucagcuucccgguccucaagagucccgagguuucuccuuccucuaguguaguucuggaaaaauguuuauuucuguacuacagcccagacagguuuacuuuuucuucuuuuuggcucccuugagcuucgccucgaucagcuguugggccuguuucuuuaucuccgcccgcgaagggacguaacuaugguccacauccgcaaacuggaagguuucugaacaggcaagaaaaggaguggcugccacccucuuuccagaagccucccaccucuaccuguuggcguuugcugccauaggccaucuccugccgggagcucauuucagacauguaucaaugacuggagaccccugcccuaagucaccuaaggccaggugccagacaacuaggauuugccaagauuauccacacuagcuguccuuauccuuucaccccaccuugccucuguagcagaaauucuucuaaaaguucggucugggcucccuucuggcccaucccaugauauacgucccuuuugucucagaaaaagaaaccucuguaacgucuaucgauuaaaaccuuucccuucagcgcccagucaccauguaugccaucucuugucuugaguucagacccuaucuaguugcagcuauuguucuugucguccuucuccaucuuccuguggccggcauguagagccucaccuaucauguccuccucuggguccucaaagguaauucugguauuauguuucucuuuuagaguugaugacuccaaggugucccucaccuuugugucaaccugcagggcagcacccauuaucaucuuggagagcacaugggcuuuguggggaccccuccauggcccaggguuaccuccucauuucuggacaacguuugcaugcgcucagccagguagauaagcuuucccucacaauaauccagcuugccguacacaucaagaguguuagagacugcuauuucuuucugugggucagaggagcagcugguuuuccuguggucccacacagggacccuguacacagcaucuccuccccgggggcugauaccuggaagguuggcaaggugaugccgaugagccggauguagagguugucaauaccugucuggaugaccagcagcagcugcuggcccuuauucauguuguuuugggccugcuugagucuugcuucuuccucuucuagcauguucuucaucuucuucuggauagaguuaaagcuaugggggagguaagcacagcagugaggaggaggagggcacagcagugaggaggagaaggagggcacagcagugaggaggagaaggagggcacagcagugaggaggaggaggaggugggcacagcagugaggaggaggaggugggcacagcagugagggggaggugggcacagcagugaggaggaggaggaggugggcacagcagugaggaggaggaggugggcacagcagugagggggaggugggcacagcagugagggggaggugggcacagcagugagggggagggugggcacagcagugaggaggaggagggcacagcagugaggaggagggcacagcacugagggggaggagggcacagcagugagggggaggugggcacagcagugagggggggagggcacaccagugagggggaggugggcauagcagugagggggaggugggcacagcagugagggggaggugggcacagcagugagggggaggugggcacagcagugaggguaggcccacagggguccagaaccagguggcaacuucagggacucauaauuaagcgucaagcgggcagguccucaacucuucugcagaugaacaaauucacuggcaguggauaugugcagcuacuagcuuguaccuguggagccauccaggagccggggaacauacccaacagcgcugggagucugguggaacuugagcacagccuccucaaguucuagcuucuucaucagggccucuaacuguguccgccucuccucgcaauccuccaucuguagcuccagguucuccucuguauuuuucugagcuaggaagcggccagcuauguccuaaccagaccagggcagagagacacaggugugggcuugggaggcagcagggcuuccuagcccugguaucucgggggccccuuguaguagauagugcacauucuugguacuuggggcucagucaugacccugagugcuuuugggugcugagguuugugaggagcugggcagaaugguagccuguauauagccugguuacaucgcuuucaugguaggcagaggauaaauaaccucaccuaccaugaagacaccuuguaucacauucagucaagaugcuauggauggcgcucaaggccugacaaugggaacucaggagggucuaugacaaaagaaggccauaagaagcagcuguucgcuguggcugucaaguuggaaaggggcuagagcagaagcgagaggccagguuccuagcauuuggauuuucagauucugguaggcucuguccugaacauggaacaugguggggacaagccagccaugugcugaggauaucuucuuucuuuauuuuuuugagacaggguuucucuguguagcccuggcuguccuggaacucacucuguagaccagauuggccucaaacucagaaauucuccugccucugccucccaagugcugggauuagaggugugcgccaccaugccuggcccugaggguaucuucuuuucugagcuacauaccucaaaaaccccagacuuuucccaggcuugggauuaucauguuuggggaccuucaugggaggucuaaucuuugugaacguuuugcagaguaucccaggcccuggccuaacuuggcuaccaaguaccagggagacuuacccagaggugggagcacugcacagcagauuugacccucucuaccaaaguagucacuuuugucugguauuguaugucugcuacggaaguuuuucuuuucuucacugggcagagcagagaaggagggucuagucaguguacaggaauggcuaccucaggcuucagagaugucagugaggauggugggugccuucaugugaccuguaccuguaucugcucuccucagccugacccuucagaauacuuugggacuuuuucugagauuucaccagguaacugggcucuaguuguuagagauggcaucuuuguagccaccuugugccaaaggcugucagcuucuucagggagaggcagggagaggcagggggcugcuuccucacuuuagugaccauagguuauauguggccuaauggugaccuggcugggagaucuuagauauugcuggcuacuggagacuuugacuguacaaggcaaagagcugagacucacccuuuacguuuuccauagucaucagauuggaggggaaauccaagucccuccggcccugagaggagaaagaagcagaugaggaggagaaggagaggguccucccagcucuuccccauggggcguggcucgggauguacacggcgguacuucucgcuggucuccuuggugugaaucuugucuaugagcuucuucugcugguucagccgguucucccgggcucgucgcuccucgaugaagguugccuccccuugccucauguuccucuggagacaccagagagucaguggggaugguaucuuaccaaggauccucucagggucuugaagcccguggccaguuuucagucuucauaucaguggacuguggaagaaagcuggccauucuucuuacuggcuccacuauccacuuggguguuccuuugccucuggugccaggacuccuggcugacacaugcuguggcuuuucuuucuagcccagcugcucuauuuuucucugggcccuugccuuuaguuuaaucuccugacauguuccacuuagaacucauuaaauuagauguaacauaucuaaaaguaauucauccccuuuauucccaaaccuguuaucuccuacacucugccucugcagcugaaagccaccguccguccuugcuugcuuuugcucucucucacacuccugucacugaagcucacugugguuugcuuuugcucucuuauacauuccugucauuaacacuuacuguggucacccucuuaaagauuucucugugcccuuucugcuucuggccaccccaacucuuaugccagccuggccacacacccaggauuccugcucuggcaucuguaguuaaugugcgccauuauaaaacacaaucuauuuuugucuuguguuuuuguuuuuggcguuuuaagacaggguguagcuccuggcuguccuugaacucacgcuguagaucaggcuagccuugaacucagagaucugccugaguacugggauuaaaagcuugugccaccacaccuagcauaaaacaggaucugaccauguguucccuuaucugcucugaggcuguaagcaugagaacccuguugccuccacugacggggaagcgauguagauuucuguguauuaacccagaacaaagcuguggugauggcuuugacucuucugucccuucucuuucugagcuaugauuacccccgacuuugcugcuccuucagaguucauucaagcauauuuccuuggaaagccacccuggaaaccucggaaccucucugucucugccacagugaccuagauaggaugugguggauuccucgacgaauuccccacugcaggaggauagggcuggcuggcccucuaguccuaucucccuagaggcagggaucuugguacugacaaggucacuagaugcccucuguccuauccgcaucugucauggcuucugugcucagaugucccaugggcgagcagauuagcugggaggacugacaagggauuucuccauugagagaugauaggaaguaaaggcaugggaugugcagacgauaggcauaggaugugcagagagguccugcacaaggcaggaucaggggagccaguuggugccagacccccaacccuggggcugaccuugaccucaucaguaaucaucauggcaucuugggacaugacugucaugucugacagcuccgagcaguaguuggccaccagguucuggagcuugucuagcucugugggguacucugccagcaccuaugaggacaggcaaaggcaaaaauggucaugaagccguggauuccuuuccugccaucaucccauacugcuggcuuuccugggccuuuugguucucuuccacccuucaugcucagacuaugugagcccuaggacacgauagggguuacaacuguggcccagcaucugggcaagguacagagcacgagaaagaaguguucuagcauggguaggcauuggugaccuaugacucucacuauccaggacaagaggauauaaugacucaaagacccaccccaucgaaggccaacucuaaaguccaggaggguuugcuugggggacaucuuugaucugaaguggaaaagaggggcuugaaagauggguaugggggcuggagagauggcucagugguuaagagcgcuggcugcuugcucuuccagagguccuguguucaauucccagcaaccacaugguggcucacaaccaucuguaaugggauccaguggaacaaauaaaucuuuaagaaagagagagagaaaggugggcauagaacuagauagggcuccaagugaaggccgccucuaaccagccagcucugugaucuuguggucauaccuagcccuuuaaugguguugcugacuuugucaaagguuguuguuaggcugaauagagcuguaagguagcacacuugcaucaauggucaaggcagccuggggauugauaauacuuuacuuucaaaaccuauacaugcugaaucuuugccaauuuaaaaaaaaaguaugguugaacauggggauuuguuucaaguguguuuguuauggaaagaaaguucuacaaaggauaccccagugaaggggugugggaaggggugaacauaggaaagacaggggggcuuccaguugagcuuccagcaugagggucgggucagagggacagaccagagcaugauacugagauucuggcucaggcgugugaccucagcagggaaaagcugcuguaacugcucacacacgggcccuuccucccaagccaagccgcucauucaccucccuaucucgcgugagggugaggguauuaauuuuugccuggccaccuuuucaggucuguccaccauugugcucuuaggugccccugcugcccugaagcacuuucuccacuacagaugcucuugcucuaugagcgccauauugggagugcgcucagugagaguaaugaccguggcucccugggacuuccgugggucagucucuccuuccuccuggauucguagaaagcaggggagagccagauccaaagugggcaggagauugugugcucagcauauuaugggaagagggagaagagucuuuccugaagcauguuacaggauuuccugggggauggggggugggcauggcccaucuuggacccucagcguuccaaacuaagccauaucauauguaaaagaaagaauucugugacuuugugaugugugugaucauucacaucucuuuuugaaauagaguuucacuguguagcccaggcuggccugggaucuucccaucuuagccucuugagugcuaagaucauacauauaucugugcuaccaugcccaggcuuaagcccaaauucugggugcagcccauacuaugcuuguguggaacaacaaaaaugaaguucucagagguacauuuccacauacuuuaggacaaccucucgggcugccuggaggagagucgcaggcggggcuccggccaaggggcugauuaccuucuucagguaauccagcagcacuuuguacagcguguggauguucuggcugguggugaucuugaucaccgucuuuucaauguuguucuccaguuggcggauaaucuggugggggugggguuauggaaucauuggaaaagcuuggugguaagacccaccucuucauaaguucucaucagugugaaucgacugaacccagcccaggagggugagagggguggcgggugaggacgggggcuaggcuuucacacaaggaugcugggcucccucaauccugccucugauuucaggucgugcagaugaaauaauuaguguacaucuuauccaccucccagccaccauguugaaauggcuuugauucccagcgucauguuuacagcugugugauaaaacauuaacucaggucaugaguucccugcuccuuguuaguaaguuguccuguuuguauacacagccuuauaagggucuggcccacccgcaggucucacccuucugauguugccccaccccuccacuggagggcagcccaacagacuuacacugacgcucuucucgcugagcacugucuaaccagcggccccgcccuuauaacagaguccuugucugaaggggcuuuggucuccgcaacagaaucuccauauccuccaacguagacucaccccuucgaagccuauuuggcugagucccacuccucucgaaagcucccgcgcucaauuggagccccguccccggucaccugaagcugccgcaguucguccuuaguagcaucagguugguuccguaagcuggccagcuccagcugcaagcucuccaacuucuguccgcgucgccgaaccagguggaucaguauguuguguguauucacacggucaaagacguacuugcgcagcuucucccgagccaccuggguccgggagggcgcccgugcgugggugcgagagggagcgcugcggggaccccaggaagguagcaggcuggggacccguggcugccccacugagaagcaagagguggggacgcgcuuugccuucugccggcucuguagccuuuacugggggcgggccucggggaauggggcccgagaggggcaagggauccucucgguccucgccugccucguuaccuccaaaguacugcggccgugugccagccucauggacguauccuuuccgcaggccuuggagaugguccauugaucaugcuguggagcggcggcggcugagcuuggagucuggccccuggcacugauugcucaggcauaucccccagugccucuuacucgccgcuagcccagcaaggagaccguugguccugggaccccugagcagaccgcgcaggaccccuccaggcucaucccugcucuggugugaugggguccgcaaagagucucugcuguuggcgcuaagcacacuguguggguguuggggaaccugcccugggcaccuguuacagaggaacccaccccuucaggcccucugguccagagagauggguagggugugugcauaaguagccaccaccuaaucucaggcugcgaggugggggggggggggcgggggcggggcgggcuuuugcaccuucuuagccaaagcccagucuugggcuccucggcggagguugcugcgcaggauucccauuguagcuuuguucugugcugucuucuccuucacacccuggaucuggagugcccgacauuguucuguaggugguggagggaacaagauuuccagacuguaggguaaaaggacuggcugagaaucuccgcaaagcauccagagaggucaguggaauacugcauugcuuuugugaucauuuucucuccucucacccugcucuggccuucacaagcuuuccugcucaaaguggucaucugcuggccaguaaagagggugaggccaggaccaccaaggaagugggacacccuugucucuuucucuugcagagaaacaggcagaccucuccuugaccccuccaccuuugggccaauauugugggaaaugcacaggucaccccucagauggcaggcccuucugugacucugacccacugcuggggccuggguggguaguaggagggacagcugccugguagcggagcagagcggcagugcccagugugaggcucacccuggagccgagugaugguccuuagcuccguuaucugugccuccacagcugcuucauuguguaccuucaugguggccuaacggcccccccuuccagggguucugugugccucucacccuuccugugcaguugccugcucagauug

SEQ ID NO: 692 - RNA, 3486 nt, Mus musculus
cagggaacugcuggguguggcgcuggccaucuggugacacacaggaagugugccugguuuuaacuugcacuccuucucaggagaaaaagcugagccgugaggaauccaggcagugagggucuucacuucguucaucagugccucagccuccguccagagccagggagucaaggaguggcugcuguacccagagcaaugcaguggccuacgcugugggccuuuucaggacugcucugucucugucccucccaggcccugggucaggagagaggugccuguccaggugagaggggucugcucagaagugugggcacacacauaccugcauaugccugcacauguggcagcaggagaugggacauuuuagaagggcagccugaaaacacauccagagacaggcugcaugaaugcuaguggguacggagagcugugguuuucaaugcugcuccaaagccaccccucuuuuuuuuuuuucuaugcagauguuaaggucguaggucugggggcccaggacaaggugguugucauccaaaguugcccuggcuuuccuggcccaccugggcccaaaggggagccuggaagcccugcuggaagagguagcaaucuggaugggagagggauuccccuuagccuccccuuggcccagcucccuccaauccuaccuaggagaugagauccaguuuaguccuuguguuuacaggagaacggggcuuucagggcagcccaggaaagaugggaccugccggcagcaaagguaagagggaauucucacaugggucuaucugccuaagauccagacaggucuugagaguggugccaguagcaccugagcccacacaccauccuccccuauguccagaugcaugccugcccccuuccuacaggcugggcauucagaucucucuccuacaaguucugcucgcauggauggacacauagguggauacacacacacacacacacacacacacacacacacacugaagugaaaaagaaccagcacuguaagaaugccccuucugucuacaggagagccaggaaccauggggcccccgggaguuaaaggugagccuaguaaacaagucuccuuaggaagggaccaggaaggacagcuccacauggagcaauaugggauuagggucuuguuggcuuaaggggagucuugaauacaaagaaagguggguguucccagaagcacuacuucagggguccccaaagucuccccggaucauuaugcauaucagaauguugggggcucacagacuaggggagaggcuggaagcugggagggguacaggagaggauguggcaggauuccagcucugggacaaggcuaguaugcuguauuccuccaggggagaaaggcgauacaggagcugcgccaucucuggguaaguacaucccauagucucuucuaacguuuccagugucuuuacccucugguugugagugaagaagagugagcuucgggggcugaaguagcaugaagcaucugugggcccagccagccucccagccagcacccugaccuaucccaacucuggguauagucacagacaggacaaugcauaacagcagccaaacacaaaggagccuaauggggccagccaggaugggugugcugggcucuuuagcaggaggguacggcaccauguaugccaaguagaauauggagucuaggggaguuauaugugaugggaagggaccaaggaagaaaauaacacucaugacucugcccaggugaaaaggagcugggagacacccugugccagagagguaagugaccucucagcuggccccuccuacuuccugcucucaagaauacagcaggaccccacccagggaguauaccccagauacaggccaacccugcccacuuccccaugguacaggaccccggagcugcaaagacuugcugacacggggcaucuuccugacuggcugguacaccauccaucuuccugacugccggccacugacugugcucugugacauggauguggacggugggggcuggaccgugagugaggaggcucaguguggggcauaagagguuugcacacagcggccacacucuggagagcugaagucagggagagagcagagcaaccagggggaaaaaaaaaaaauaauguggugcuucacccuccagcgagacccaagcacugguggaccagaucuagaacucugugaagugaguuaagugggcgacaggaccccagucauaacagaugcaucaaaacaugucagcccugggccacuaucaucuaucaguuaccuucucaguccccuguacucccugccccugaaaacuauuccucacucaugagguucuuuauaagagugagaaaaacaaaacaaaccaacaaaaaccaaauaaccaaccaaagcccuggaccuagacauaucccucggguuccugcucuuaggaaccugauacccacaugcuccccugccccacgccacagguuuuucaacgacgaguggacgggucuaucgauuucuuccgagacugggacuccuauaaaagaggcuuuggcaaccugggcacggaguucugguuggguaaugacuaccugcaccugcucacagccaauggugaggaagcagucucuuggccaucaccugccuuccacuacgcugccuggccugagccuuuuccuuccuuccacccauccugcuagggaaccaagagcuccgaguugacuuacaagauuuccaagggaaaggcuccuaugccaaguacagcucauuccagguaucugaagaacaggagaaauacaagcugaccuuggggcaguuucuggagggcacugcagguaaaucacacagaaagcuuaaagcuauugguggggauggggaaaggggccugcaaguugccccuacccaucugggaugggcucugccuuggcccugagagcugacaggucugagucuuugcaggagacucccugacaaagcacaacaacaugucauuuacaacccaugaccaagauaaugaugcaaauagcaugaacugugcagcuuuguuccauggagccuggugguaccacaacugccaccaguccaaccucaacgggcgcuacuugucuggcucccaugagaguuaugcggauggcaucaacuggggaacuggccaaggucaccacuacuccuacaagguugccgagaugaaaauccgagcaucuuaaggugccccagucuccacccagccuuucagccauguccaggccauguggggacacugaagggagggaucucuagaaguugaagucugugugcuuaucuauugugggcucucuacacuccccucuggacacuguccagcccugacuacuaugcacuaauaaaggucagagaagcagaggccugaucacugugagagucugcagcaucgaagggcagcaggcaagggaggaccccacacauccaugguggccuugaggcugagacccagaaagccaccaauauagcagcaccaggaag

SEQ ID NO: 693 - RNA, 4054 nt, Mus musculus
agguuagaucuuuuaauuuuuuuuaaagaauucuguguuauggauuuucuuguuuguuugagccaaguucucacuauguagaccaggauauccuggaacuuacuauguagcccagccaugguaauccuccugccucagccuuccaauguaugagcugccuugacugcuuggcauuauguaauauuuaaucauaaaguguuuuagaaguuuaauucaugccuaaauuuaauguguagcucacacauauuuguaucuacauuuuagaaaauuugcaggagccauucauagaugcaagcaucauauacucauuacaggugugugggaugaugcuggagauggucucuguaguuaagaucucucgcagagauccagagguccugggccuuaguucgcagcacucacacagaggcucacacuguccugacacaguuccaggggaucagucuuccucuuugggucuccauggggacugggcauguaggugaugaugcacuuacauauaugcaggcaaaucauucauacacuuaaaaugauauaaauaaauaaaaaaaauaguguagcuuuaagaaaacccuugaagacccgaagcaaguaugccaccacagagauccuugaacgcggguuuauuacggacauuuccacaauagcuguuccggaaccaagguguccaucgucagaggaacggacaauaaagaugugguucguauguggaaguggaacauuuucagucauaaaugagagcaaagagugucauuugcaagaaauggauggaauuggagaguaucauauuaaaugaauuaagucagucucagagagacaagaucuuugcuuuuuucauccauggguucucgauuucauagguacaugaaaucacacguguuacaaaugacaugaaaguagaagagucacugggcgaacgaagaggacugagagguggagagguagacacuagcaggaaaugagugagaguaugcggagaauagguuaucugcguccacgaaaauguauccugugcacguaggaugcagcgccuauagccccucuccguaagguggcgcgauacuuugagcguggcgucuggcgacgagcugacgccuccucccuccgcugcagccggagaccgagccuggugaagggacugucgggauugucggaagugagggucugggaaggggagugguucggggcugcugcgcagcgcgccagguuuccgcagcagcccugcaccccuccgggucgccuccaaacgcaacgccgcgaccaugccccuccacgugagccucgcuaacggcaaccgcgaccuggacuaugacucggugcagccauacuucaugugcgacgaugaggaggaggacgugcaccaccagcagccgccgcagccgccagcgcccagcgaggacaucuggaagaaauucgagcugcugcccacgccgcgcccguccccgggccacgccgggcucuacucgccucccugcgaagcggucgccgugucuuucgcccccagggaccacgacggugauagcuucuccaucgcagaccugcccgagcugccaggaggagacgcggugaagcagagcuucgucugcgacccggaugacgagaccuucgugaagaacaucauccugcaggacuguauguggaauggcuucucggccuccgccaagcuggucuccaagcuggaccccuaccaggcugugcgcaaagaaggcaccggcgugagccuggccgccgacguggagccugcuacgccuccagacugcaccugcaacaccugagcgcacagcacggggggcuuuggacuguaagcuucagccauguuaacugccucaaauccugggcguaagagaacccuccccucccucuuuucuuuuuuaagcuugccacccuuccucacuccccuuaacagauuuguauuuguuuaaaaaaggaaucuuaaaguauaucaauuuuccaacaucagcuggacccuuaaguguaaauaacaucaauaaaaacgucuuaucaguuauacaagauuuuaggauaugaaauauaaaaagguauauuuuccuuucaaaagcugauucuuuuuuauuguuuaaagaaaaucaaaguaauucggaaauauguugagcccaugcuuaaaaaaaaaacagcuuuaugaaacauagcaaaauaaggaaccgaggagcuacagacaauacuacugcuaaaaguagacuaaaaguaagaaaggggaacuuuaugugaccaaaaaggaaaagaaaaaagaaagaggaaaagacaaaagaugagauagaugcauaaacaaaguuagauagacugagggguuuuaaacaauugauauaauuuuaaaaauaaaauaaagguacuacugaagcauagcaaaaaggugaaucaggagaggcaggaaaaaacaaacaaacaaacaaaaaaaaccuccagaguaccggugccucgccucucuggcuccucugucuuuagacacugcuggguguaugcggggagguggugugguggucaccugaaguggagacugucucuuacaauuuaggcuguugcugauccuacaagaaccaagucaacagcagagcugugaucauuagguacuuugcuugagcaaguaccagggcccacugcuggccacacuugacuuugcagucugagucugggcagcccucuuaccccucccccuccugagcuucuucaguuucuucacccaggagaagcugaaguucuagcugagaugaggguagugucuuccagguguguagggagcagggcaagcagucauggugcagagacggguguguggaccugucuuccuacuuucuaggccugcuaaaguggggucugugacugggauucaggacagaccacugcagcuccagagaacucagaccccacagggggacacucaaagcucaguaaugacacauuugccagcccaggcugugugcugccaaacugcagaguccucucaguugauaaggucagcugcaagcaacaaggaugggguccauucccccaugcccuccgcugcagagcccagcuuccugccagugggagucugugggcucucaauaccaguccccuauucucuacagcugccucccaggcucucacccuggagcccuguggcaggucucugaauugccaugguucccuguucuuggccucugagcuagaucagguuuaaacaagagguuccuucucagcagagauccuggccacagcccucagagcugggauacuguucuccacaucuggagcaccuggcuaggaaagugacugcuccuaacaagaacaacagcuggauuugugguuugacuugacuugaggauagaccaaccaggcucugugcacaaggccaccuugcugaccuuugccugagguucugacuccucccucuagaauagccaccauacuggagcuuggcuugacuauggaaaaggacuaggauuggcucaagacaccccaagagcaaguucucagcacaaaggggauugauuugccccagaggaacaaggcagggaguaagagacaaagccaagagcuagaggaugagagagaagcagggaaaagaacaagggagaggaggagggaugcuugucccggggcugcaggagauggggacccaugggagaugauggcaaagggcugcuucuugauagagaagggacagauguggcacaaaggcaaauggugauuuguaaagguaaaaugggaaacucaauguuaggauaagguaaaugauuuuauuuagguauguuaaccagggugcccaaagugggcuuugauagcuggauuucaauacuuugaucgcuggaucuuaguagucagccuaaggaggccaaauaaguggucacguaagggaaugggucuuaguggccagcuuuaggaauguaauauaauggcuuuuagcagggcagagggaaugggggagagggcaaggccggccacagucacacucaccaugcaugggcuggcuagagucccuucagcuugcuuccuucuguugaauggcaucuguuucuacacauucccagcuguccugucacugucuuccugagug

SEQ ID NO: 694 - RNA, 1145 nt, Mus musculus
gcugacgccuccucccuccgcugcagccggagaccgagccuggugaagggacugucgggauugucggaagugagggucugggaaggggagugguucggggcugcugcgcagcgcgccagguuuccgcagcagcccugcaccccuccgggucgccuccaaacgcaacgccgcgaccaugccccuccacgugagccucgcuaacggcaaccgcgaccuggacuaugacucggugcagccauacuucaugugcgacgaugaggaggaggacgugcaccaccagcagccgccgcagccgccagcgcccagcgaggacaucuggaagaaauucgagcugcugcccacgccgcgcccguccccgggccacgccgggcucuacucgccucccugcgaagcggucgccgugucuuucgcccccagggaccacgacggugauagcuucuccaucgcagaccugcccgagcugccaggaggagacgcggugaagcagagcuucgucugcgacccggaugacgagaccuucgugaagaacaucauccugcaggacuguauguggaauggcuucucggccuccgccaagcuggucuccaagcuggaccccuaccaggcugugcgcaaagaaggcaccggcgugagccuggccgccgacguggagccugcuacgccuccagacugcaccugcaacaccugagcgcacagcacggggggcuuuggacuguaagcuucagccauguuaacugccucaaauccugggcguaagagaacccuccccucccucuuuucuuuuuuaagcuugccacccuuccucacuccccuuaacagauuuguauuuguuuaaaaaaggaaucuuaaaguauaucaauuuuccaacaucagcuggacccuuaaguguaaauaacaucaauaaaaacgucuuaucaguuauacaagauuuuaggauaugaaauauaaaaagguauauuuuccuuucaaaagcugauucuuuuuuauuguuuaaagaaaaucaaaguaauucggaaauauguugagcccaugcuuaaaaaaaaaacagcuuuaugaaacauagcaaaauaaggaaccgaggagcuacagacaauacuacugcuaaaaguagacuaaaaguaagaaaggggaacuuuaugugacca

SEQ ID NO: 695 - RNA, 1145 nt, Mus musculus
uggucacauaaaguuccccuuucuuacuuuuagucuacuuuuagcaguaguauugucuguagcuccucgguuccuuauuuugcuauguuucauaaagcuguuuuuuuuuuaagcaugggcucaacauauuuccgaauuacuuugauuuucuuuaaacaauaaaaaagaaucagcuuuugaaaggaaaauauaccuuuuuauauuucauauccuaaaaucuuguauaacugauaagacguuuuuauugauguuauuuacacuuaaggguccagcugauguuggaaaauugauauacuuuaagauuccuuuuuuaaacaaauacaaaucuguuaaggggagugaggaaggguggcaagcuuaaaaaagaaaagagggaggggaggguucucuuacgcccaggauuugaggcaguuaacauggcugaagcuuacaguccaaagccccccgugcugugcgcucagguguugcaggugcagucuggaggcguagcaggcuccacgucggcggccaggcucacgccggugccuucuuugcgcacagccugguagggguccagcuuggagaccagcuuggcggaggccgagaagccauuccacauacaguccugcaggaugauguucuucacgaaggucucgucauccgggucgcagacgaagcucugcuucaccgcgucuccuccuggcagcucgggcaggucugcgauggagaagcuaucaccgucguggucccugggggcgaaagacacggcgaccgcuucgcagggaggcgaguagagcccggcguggcccggggacgggcgcggcgugggcagcagcucgaauuucuuccagauguccucgcugggcgcuggcggcugcggcggcugcugguggugcacguccuccuccucaucgucgcacaugaaguauggcugcaccgagucauaguccaggucgcgguugccguuagcgaggcucacguggaggggcauggucgcggcguugcguuuggaggcgacccggaggggugcagggcugcugcggaaaccuggcgcgcugcgcagcagccccgaaccacuccccuucccagacccucacuuccgacaaucccgacagucccuucaccaggcucggucuccggcugcagcggagggaggaggcgucagc

SEQ ID NO: 696 - RNA, 2390 nt, Mus musculus
ucuugaaccaaaggaggaacuuuauuuggcaaaagucuucauacaugaguuaagaucaguuugaaugucuugguggcuuaaaucucauuggcagaggaggaaaugcagacacagaaggccaugugaagacagaggccuagaguacggagauaugaccacaggccagcaucagaaagaaagaggaugcccaaugcuggccagcaucagaaagaaagaggaugccuaaugcugucuccgcagugccuggaucucaacucucuggggugcaaagcuguaagacaguaaaccucaagaugcauccuuuacugcacauagcauccaggguaguuucccacucuucucagacacacuauaaaaggccccacuacaauccugacucugggaauauaucacacagucuucuacaaagagcuggguguuccuuugcuucagcaggacaacccagugaugagcagaguauaagcuuugagauaugaagcucauggucacucugagauggaccucccccagcuucugacaccacuggcuguugguuacccugcccgguucccaacaccccaggcugcuugucuuguacccaaaccaaaauucacauaccagaaggccuggcugguuccucuauggucuauaaaaagcaaaaaucuggggagacaaggggaugucagauggcuugcucaaccccugucccaguccucagggcauccgugcaaggcacaccaggcugugagcugccuucucugggccuuucugagucagagaagagaaccuuaccuuuuuuugucaugucgaugauauuuugugaguccagcccauauagauugcagauguuuucaaauucucucugaugagucuugucaagcaguauggagcgcccuggggacagauuugggacuuuuuguuggggagcagucccaaggcaccauuccauaauaugucuagggcccauggaagaugcccucccaguggcugggauucccaaacagauagggucggguuaccauagagugccagcacuugggucuuggucccauucuugauguucugcauguagaagaugauauacaugcuguagucggucuccaagagcagcaccuuguuuuuccccucaucugcacagagauauagcuuagcauacccucugccugggcacugguauacccccucacuucugcaaugaaugccaugugacuuauguagcuucuguuaaagcaagcauuggaaggaugugagaguuugaaugcccagugcuagcucaggagacugugguauggaaguguagauagcaggguauuauagccccaucugugcguuugugugcugccuccacaaaccucagcacaguacucuggcugugugauaguuccaagcuaguacuguccagagagagggcuaggcuguggacccuuaaguuguaccuagacuggugggcacggccucagcagaaaagacuccuggcaaucagauuagaaagaacagggccccacucacaggcaacagagaacuccccauuauucuuagucuuuucacagaccauggucacagcuacacauucuccuugcaaccuggaggacagugaggggagaagaucagagcaagcaccaggcccaucccccuaccuuggcuucugugaccacuccaguaggggccuuucagcuuaacucacucagaggagcacagaacacagcaacaggccaggaacccccugaucccaucaugcugaucugcagggaagagcuggugaaguccacacacuggcccaagugugcagaugugugaguguaugaaguuccuguggggcaugggaacauauucuccccuaguuucagcguagggggcaauacacacaugaaauggaagucaaacugcaggcugccguuauuuaagagcuugauguuccggaugaagagccucaggucuccauuuucuucaaugcgagucauguuaucugaggcuauggaaucgagguaccaggucccggaaaucuggaaggaaaggcugagugguggaguccuguaccaccucugggacugcuuggcccucacagucucaauccugggugagucucuaaacauuagcucuaagcugggaccuccuucugccuuuucugcccucccucugcuccauuucucccaaagcuccuucugcacccucugguugccaucauggcuaggaaugugagggacucucauggccuagacacuccuuuuccaggucagcccccuccccaauaaagugagacaggugcuuuucaugaagccuggccuagccuuagaaggcucggcccacccuggccagguuguagucucuccgcacagcaguaugcagguugaacugcgcaguggccaggcucagcaccaggcccaggacuaguaguaguaccauucucucug

SEQ ID NO: 697 - RNA, 56470 nt, Mus musculus
aagguggggcugcggggggcgguaagugcgccugcgugacgcggcggcggcgcguuagcucccacccguuggccgccgccucagcugccgcuucuccugggccgcgcacgcgccuccgccaccgcccccggcccgugcucgcaccgcgcuugccccgcgccugccccgcgccuuccucggccggcgcuugcccgccgccgccugcccggcccgcucggcgccuucucggccucggcucggcgcccgcagcaugcagcagccuggguggcggcggcggccgugaaguaagggccgugcgcccgggcgggcggcgcgggagggcggcggcgucuuuguugcggccgggcugccgcggccuuugucugcagaugguggacgcgggcggucgcugugccgccgaaggcuggaggaggauggaggcgcccccggagggcgccgaccuggugccgcuggaccgcuacgacgcggcgcgggccaagaucgccgccaaccugcaguggaucugugcgaaggccuauggccuaggugggcgggcgcggcgggguccggggucgggggaugggauuacagggagacggacggggaaugaauccgguuccaggaugguacuagaggggagccgacggggaacgcacugguuucggaugcgaccgggaggugucggacggguauaggagccgggguaugggaccagaacuggggucggacuacgacgggggaugggaccagaggggaacgcgacggccgcagaaugggaccagagggagaccgacggaaacgaccagguaugagaccagaggggucagaaaagggacugacaugcugggggaugagagcagagaguuucggacguuggacagacggggcagguugggaccagaggggaucugacgggucuuggggggaugagacgcacgggaggagguuguaaggucuagggacaaggaauggagacagagccaagauugagaaugaggccggugacagggccaaggcgcgccuucgcguggugucaguucaagucuugcuguucuggcggcggcccaggugagcgagcgcugagguagcccagggucgguccaggcaugggacuguguucgcgugucauccaugcucucugagucucgguggguggagggugccuaucaugugcaguguuauucucuggcaauuggacugguccucuaaguccaagaaagacucuuaccuaaauaaccacugcuuagcuguuccuuacugcaucagggugacuagaaggcuggauaguuugagacuuagucucaaacuagaguuccagccaaucugguuuauauauuaugaaauuugguacuuaacagaacagaaguuauuggauacuccaaagauacauuauguguaauacagauuguauagaaaccaucaucuccuuugguuaauuccuguuguaaagagcaagguaaccuuguuuaugaagccuaauaugcuuaguaggauuaggauucucugauuuggugcucugggaacauugcagaccaaauagugcugguaaugaguugguugggaggcucuaguaucagggcaggugucuuguuuuaggcauaaaacuaugauaaaugaagcauaaauuacccuugugcuggcaaaaacauuaccugaagacuuggguuacugagauaacccuuucaggaaaggguuaggugaccacuuuggaaaacuugcuaagcaggugugcucggugacaguggccuccaacuagucauaagaacaaacuguuuugugagucuugggauuaaauaaacugcuuuauuuuaaauuuacuucugugguauaaaacuagcagugaggaagaaauucuuuuauaguuuucaguguuauaauucuuggucacuguuucuauucagugcagggcuuuaccuuacuuaaaaaagugcaauugaagaaguugggugguagcugcccaagcuuuuaauaccaacacccgggaggcaacacagagaaacccugucuugaaccccccuuucucccccaaaaaaagugcaauugagaaaaggugucugcuaccuaccuagagcagcgaaugagugucuggccacuggccauucucuuugcuagcuccacacuuugcccaucucccaccuuauguuucuuauuguuugcuuggcauuacucuaagcuauuagcauucagguuuuuuuuuuuuuuucuuucuuuuuuuuaaugagacaguaucugcuauggaguuuccuauguagaccagucugacuuugaacucccagagauccauuugccucugucuccugagugcuggaauuaaaggcgugugcucauuuuuuauauuucacaauuuuuuauuuuaugugcauuguuuuuuuuuuuuuuuuugacuacauguauuucugugugacagaugucagauccccuggauaaggaguuacagacacuugcaagcugccacaugggugcuuggaauuuaaccuggguccucuggaagagcagccacugcucuuaaccacugggccaucucuccaacccucuaguuguucuuagguucaucuuaacucccagcauuuucuccauugguaguauuucgccaaggcuagcccaccacuugucauggugcauucuugggcauaguuccucuucuuucuacaaguuuucacgccuguguauauguauguuuuaaccugugugcuggggguggaccuccuguguauauguauuguuuuaacccucgugcuggggguggaacucaggauuuugcuaggcaaguacucuugcugagcugccuucuuuuuuuaaggcuggcauguggagauaguuuacuuagauucuguuuccuuaacagggugagcguguugaguuuuguguagccuuagcauucagcuuggggguaagguaucuagagauaaguuuuucucucucaguguuggcaccugacugguuuaguuuuauucuaguaccagauuacuugugagaucugguugccucaucaaauaauggagaaaaugggcuuuaagguuuuagaauuauuaagagugcucauuugaagacuggaagagcaagacugaggcccagcgugggucugagccuaggugaccccaugaccugagggcaugccucugcuagcagcaugcauaugacgugaguguuaggaggucuaguuucuuuccauuugcugggguaaaugagguuucuauacucagcuucagaauuugggaggcccuaauucauaugagcaagcugucuaagcuggaggggugcuugugcuguucguagucuggugugaauuuacuucugccagccuggaguugggucuuccaggaacaugggugaagagggaguuuuggcaagguacacauuuuggcaagguacacagggacaccccgucuaccccaguaaaauucugaugcugguccuggucaugcugcuuucuuugcaucuggaugcuucacugacaacuuaguuugucuggguggccauagggaaagggucuugcauguuuuauguguuaugcacuguuugguuaagucacgaagugaaaccagcuuuucuucuguauaggaguugaaagugugguggaauuguggggcuagccacuggagacuccauugucacuugccccggaagucugugucccugugccaggcugcuaucuguagugaguggcaagcuguggagcucacccuagcaggcuuuggguuuaugguuaugaagaaacauuuucucaagauuuauucugcacucaugccacaaccaagauuuggggcugucuugugcuucuauuuuuagguuccuucucucuuucuggcaacucuuucgugacauuaacagucuuuuuguuguuuuuuaggaguaacuuauuaggcgugcugaaaauuguucacuuaaaugugucugcaaagaggagcaaagucugcuuagcuccaagaguguaugguagcauuugugugagaccugcauaaaauugauagagaacgucaaagugcugcuuaaaggagcauuuauuuuccaggguagugugcuagcccagggcugcaacaguccuggcuuugguuuugggucgauuugcauucuguuugugcucugagcaagcucagagguaucuaucuaggcuuugguuucaggggaaagugggggaauaccaguuuuuaucucucaaggacaguggcacacacagggaccggaugagaaggcucuaaauuguuugcaaggagauugcuuugaggcucagcagaaacugauuuguccuuuugccccagagcugagcuguccugaauccuagguccagucaagaggcucaucuuucuccccuuaccagcaacagaccgggcgcugguggccuggcuguagggguuaggucuacuaaccaagaaugcugcucuucauccucucuucuaccucuccuguucucccacgaucaccagaaugagcacauuauagaguaaggagucacaugaggaucuguggccuaugcaacccuguuccuaggaaauugaacuagagccacugcuggcaacaaagugcuuuuaagcugguuugccuagccaguguuaggagcagagcccuuuccuaacuccaggaguuaacauauugccagagucaugguauuguuugguuuagugauauuuggucaaaaguucuucacuacugggaaucccuuucaguagcuuuggagcuggcuagagcugcucacugagccuugccuuuccuggacugggucagguuucccugggaacagucuacugccugggcccaguucaaaaguguguuaucaaguuguucuagguuauaauuuguucagacuacugguucaugaguuuagauuguggcucuaucuaucuaguuuagauuuuuugaagcaggguuucucucuuuagcccuguccuggaacucacuauagaccaggcuggccucgaacuuaugaagauccaccugccucuguuucaggagugcugauauuagaggcacucaccaccaugcccggcugguuuuauauauuuuauuuuaagugucuggguacguugcauguacuugugcaccauauguauacccagugcccuuggaggcuagaagaggccgucagaucccuuggaauuggaguuaugcauguaugguuguuagcucuuuguagaugguaggaauugaaccucaguccccugaagaacggccagugcucuuaagugcugaguaauuucucgagcucugggcuguuuuuaaauagccuuuugcuauucuuggcaagugaguuggguguuuuugggcgggaggguccagcagccucaaguguuuggcgaacuggagaagccugaugcuguagggccugcugauugugccaugacuccucuacagguuguuuagagaaccuccugucuucggguucuggucucugcaagguugggauuccccucacaugcccaccugcaaaaugcucaggugcuugucgguguaggagaagucauguuuuuagagcuguguuuauauauguccuccuuccuggccugaugccaggaguuaauacuaaucagagaacgaaaaucugucuuuaaucugugagcuaauccuuuggcccucagaagggcuaguugcuacugugguuuagauuguuaacuuuggguauacauuuuuuuuuuuuuuuuuuuuuuugguuuuuaugagacaggguuucucuguauagcccuggcuguccuggagcucacuuuguagaccaggcuggccucaaauuuagaaaucugccuugccucugccucucaagugcugggauuaaaggugugugccaccacaccuggcucagaguuguuuaauagcuuugcuugcuauccauuuucauauugucugaggaugaccaugauggaggcaagauuacuuucauccaguugcuuuugugugcauaauuauuauuucuuuuucagaauaggaaauauaaagggaaaaggcacauagugccaucuauguuguugaucaaaauccucaugagauaacauucauggaggaaaugggaauaauggaagguugaagacgacuacauaggacuggggagauagcuuagauaauuaagugcuuguuaggcauggggcuggggagacggcucauugguaaagugcuuguuacacaagcaugaagaccagaguugaaacccauauuaaaaaggucagauauggagcuggcaagauggcucagcagauaaaagaugcuugcugccaacuuugacaaccugaguuuguaggugccuaggaccuacauaauggaaagagagaacuacugcaaauuuucuucugaccucuacacauguacugcaugugugugugcacacauacacacacaaaugaauaaauauuguuacuauugagacaggguuucucuguguaguuuuggcuguccuggaacucccucuauagaugaggcuggccucaaacucagagaucugccugccucugcccucucuucccugcccgugguggguuuaaaggcaugugucaccacugccuggcaugaaguaaaauuuaaauaugaaaaauuuuaaauacgaaagucagguguguaugcuuguaauuccaugcuggggagguagaagaugcucucugaccagccagccuggucuacuguuagggucuaggucagugagagacgugugucagagaacaaaagugaauggcucugaaggguggucaaggccuggauagcccgugagagcaggagguggggaccuggcugcaccauuguguucuugugcacugaguagauuaacuucggaggcagagguguaagggcugacauagcaggugauuagcuugggaagucuuuagccagguuguucacagugcucguggugucuuuggggauuccuuuggugugugugcguggggucacuuuugaauaggagagguugcugagagccugggaaugugcuuugagcagauguucccugguugcuacagauuuaacuagucaaaacuggucuauccguccaggugaacauuugucuuaugaccugugggaacugaauggagcuuugcaggccacauauguaaagaagaaaagcccuggguggugccuggguagaagaugccacuggaaggucaggugggaaggagagaaugccccauaaagaaguagaaguagguagucaggcaaggacagggaagggggguggagacagguguggguucaguuugcucaagcacaagcccaggcacguggaaauuagaagcugagauuggacaaaaggcugaguuucagauuuuggaauguauuaaaugacauauugguaaacccuaaaacccuagcagaaguuuuguaccuguacuuauggacaguuucuaagaaggaaagaggucugggcuuuuuuuuuuuuuuuuuuuuuuugugguuuuccgagacaggguuucucuguguagcccuggcuguccuggaacucacucuguagaccaggcuggccuugaacuuagaaauccgccugccucugccucccaagugcugggauuaaagcaagugccacggcugccuggcugagaucugggcuuuuuaacagggcacaguugguagugcucauuguuuggaccuuauauugacuuacaguuuagauacucaguaaaacacguguaaguauauagcuagguaaaguuuuggugguacaccgccagaccccuguaagucucauccuggccuucuuauaccuacuuccucucugaaguuuccuaucaucuaagcacaucaagguccugcaccuagcuuccuucauuccacauauuaucuuucagauucauucauguguacagucuuugcuuaguaauauuaucucauuguaugguuagcccauuugucuguugaggaauguuguuggggucauuucuagcuuugggguauuaugaaaaaaacugcuaugugcauucaugugggcagauuaaaaaaaaucuuaacuauguauaggauuagggggucacgaguuaaugcauuuuaauucagaaggaaguaugaaguuuuucaaaguugcugagucauuauuucccaugagcacuguaugagaauuccaguugcucugcuuuuauguccgcacuugguaguguugggcuuuauacucuuagccagucaagugaguggacugugcauggcacugguuuaguacacauuucccugaugacuaaugaagaaaagccuuuaaaaauaugcuuucugcccauuuuaaucucuucccauguaauaauagcuuuuagagucuuagacaauguaagaaaaaaauaaguuauuuauuucaagguuuauuaacauguaguuuuaaggcauuuugcaaagguccuagaugucucuacucaguuucccauuuaacuucuuguaaaucuacuagaaaauuacaaccaaguuuaggaccuucccuccucucagaacuucuuguucuguuuugaugacugugccugccaccuuguguaugcaucggccucugugccuuuccuucucuaguuguuuacuaaacuuaggcugcuucuacaagcaguuaguguggcagcucacguguguugauaguuuauauuuucuuuuguuguuuguguuuauuuuuuguuugcuuguuuugagauaaaggcuuauguucaaaacaggcucagcuaaaguuuccuauguagcuagggccgaccuugagcgccuagauuuuccugccucugccuucccaaagugcugagauuguagguguguggguuauaccacacuuacauuuuugaugucuucuauuuccguguaugaaaaguuuccuuugaugcuugcucuuauuccaucuggauugccauaaagauuccaugaccuagguaacucauaaaugauggagacuuugggguaugaaaguucaaggugaaugcaaacgcagauccuacaugugguaagguuuggguccugguucauacccggcgcccauaaaacuaggugugauggugcaugcauauaauucuaguacuugggaaguagaggcaagaggaucgauaaucuuuuuuuuauuauuccuuuuuuauguuuuguuuuguuuuuauuuuuguuuuucgagacaggguuucucugugcgauccuggcuguccuggaacucacucuguagaccaggcuggccucgaacucagaaaucugccugccucugccucugccucucaagugcugggauuaaaggcgugugccaccacugcccggccugauauucuuguuauauagaaaauugaaggcuaaccagaaccacaugaaaucuugucuuuauccucaucccacauuuaaacauucuaacaauacaaugaucugaaugauacaugcugaggagugaugaugggaaguauuuuucuguguuaagcuguuauguuucuauagaagcagaaaacauuguguguacaguaaaaacacauuucuguuggugacauugaaucugaguggaacuguuugagguuguaugugcuggcuuguguggugugguggcauguacaguaugucugcuguauguuuagaaucagggcugcaguacaguuucuugaugcagcauggguaaacacugccacaaacauuuuggauccaguugguucugguuguuguguguuuuuauuguugcaauuacuuuucuggcucccacauucaguuaagcuggggccuagaauauaguuuauuuuggugaaugugugggcauguaggagagggcauguaagacagcuucuugcucuguugccuuccacuuuucuguuccuuuugguugaguagaagaccuuucuuaaggcguggcugacuagaugcaggagguuccagauccuugugcaguucccauccgggccccauggaucucacuguggcagcaucuuccauuucaaagucuccagccuugugucaucaggaacuggggaguaucgccccucucccacagcuuccugccucugacccuccuuaguuucagucuccagcucugccuguggcucagauuagauggauguguugauuucacuuuaaagucagggauuccauucagucccugucauugcuacccugcuccucagucugcccagugaguuucuaaauaucuguuguucuacuuuucauuucuauauuuagugcuuuaaaaagcuuucuuugcugaacuuuuuuaguuugcuucagaguuucugacucuugcaguuauuugugcuggcuacuuuuaaauguccgagauguuucaacacuugaugcaucuuggugugugucagucaucacacuggaguggagauuucaggagauuccaggaggaagcagccagcucguauccuguuggcuuugccugaagacuggagcuccaguguucgcaguguucugacaggcccugugcccagcccugagcgucugguucagucuacuuuugggggugcucccugcugcugcugcugcuuaagggcgaaaggaacuuucccuccuagguaggugagauucugccuaucagacugcuaguuauggugcuuggcuaucucugccucccaggaaaagauuacacacaguuuuaagaacuuauagaaccaagcugugauuggccagugaugggcagggccacuccuugaccaggacuacuuaauuaaucaugcccuuucuuuaagccuaaaucucaggucagcaccucaaggauggacuuagggguuacuggauccauuuauuuuucuucccaaggugaccacacgaauaaaaugcuuuuuuucugauucucacugucacuugucuuauuacuugauguauugaggauggcagccaaacguagcuuguuggggaugccagggcucagaauuauacuacaaaccucugguaacaugugauucccuuuacuagaauccucgucuguguggggaaagagguucauaaccaccagggagggaggagaguaucuucucugcuaggugcucuuggggagacuuuuauuuguuguguucccugguccaugguggcuuuggccuuaaagaaaguaucuuaggccuguuaaucucaccucuuccaagacccagaaaccagcugccuugccuguuuugccuuucguacagggauuuagcaagcaccaggccugcccuugguggggaugugauucucuacugcuguccugcagugugagugugagguccaagccagcaucagcauccauccuuuucacuuuguaggugcccgugcuuggaguuucaggguaguagcugccuacugccuaaaaaggcaagcagggauggucugcuaccuuggcuugacuaguaacucccucugguauauuaaaaaguguuuugccuuuggauccuguuggugucauuaguguuuuuuggauguggauuuucuuuuuuuuagucuugcugccauuuuuagugguuucauaaauuuguaaagucugcauccuucuaccauauucccucucccuucugggccugcagguccuuucuaugggcugacagccacugucacuuacucucccugcuguuuccacauuguguuacuguugguuguggauacuuauuuucuacucaucuucaucucucaaguguuuccuuuugccuuuucuggacaggguuucucuguguggucuuggcugcccuggaaacagccuauagacaaagcuggcuuugaacucagggauucaccugccucugccuccagagugcuggggcuaaagcuguguaccaccauggcugucaacuaucuuagccugcuuuuucuuuucuuucuuuuuuuuuuuuuuuuuugguuuuuugagacaggguuucucuguguagcccuggcuguccuggaacucacuuuguagaccaggcuggccuggaacucagaaauccaccugccucugccuccagagugcugggauuaaaggcgugcgacaccacacccggcuuuaaucugcuuuuaauaguucauuuuaugacacagguucagugauuguauuuguauauauguaaauauauguaagcauauacuuacauauauuuguuguuguuauucuagaauuucuauuuuguucuuuuccaguuuaucacuuuuucuuuauuaaaaguacuuuuacuuuucugccuuggcugucaauuuggcuuaucacuuccugugacuuagggucaggguaccugagccuggcuuucuuugaguuugcuagguuuccugagcuggccuugaacuuaccaggaucuuccugucucaaccucuagugcauauuaaaagcauaugccauauaucugaugugaccaguggccaaugccauaacacgcagcuguguugaaacuuucacaguuguugcaauucugguuuuaagcaaaugggucucuugagguggccaggacauuauauacaccccugauauaucuucccuucuguuuuggaaucucucccuacuuucucuggucauccuccuggccucugacuagaagcucagcaugcauacuuaaggcuacacuguacagagaggcuguggugugcuugucccugauguauguugguuuggugacucucccugguauguuuggguagaguagguauggccuuacaauuaccaaguuucuccuggccaccacuuagcuccuuugguauucucuuccuugcaugccuagccuggagugaccaccagucuguccugcccagcuuccauucucacuguguccuucugguccccacaugccagccucuucagaaugccccccuuuagccauauguccauaauggagcuccuccuaauaccauggccaucuucugagccacagcuccuaauuuaguaacagauccugugacuggcugguguccaggccugucuucuacucucugugcaggaagcagcagcagacauuauuuccggggccucuuuccauuaucuccuaacucagccuguucuaauuuauccuguucugugcuuucagaguauauaaaccuaaugacagucccaccaaagguacaguacacguagcacauacucaguuaaggaccuguugaaugaauuagugaaucaucauauuuguuuuuccuaugcuguucugaacuguguuauuucuuuaaauugucugaugagagucauugucauguuuuucucuuguuugccuaagcugggcucugugcucacuccagugugaugcuccuugucauggaaguugccuacuguuuuuguguccucuucagagucucagagccuuugcugauggugauggccuuccaccuccuuuugguggccuagcauauucauauauuuccugguucaugcagguacucaauaauugucuauugagugauuuguaaauugcugucuuugucuuuuguagagaaauaugucaccugaaacagauucagaaugcauuuacaaugccuuuguauuguuuguaauauuuuaucaucauccuuaucguuuuaaaauuauguauguauguguguguguguugcaggggcaggggguugugcauauaaauauauuguccauggaggccagaaaggguguuggaacuuuccaggcaaacaguuauaagcugccugacaugggguguggcaaucaaucuuggguccucugugagagcaauacuuguuuuuaaccauugagucauuucuguagcccuuugucucuuuauuaaaagaacaacuacugacugcuaacuauuagaccaauagaugugugcaaacauagcuucugagcugaguauuuauuaucuuggaacagucacucucuugguagacuggaaggaguggugcucucuuacugagcugaggacaguuucuccccugaagggccacaagaagugguucuguugcugagugggcugaagcgcccuaagacuggauuggagggagcucacaggugugguaacccugcugcggcuaggcuuguugucuaccuacauaaguguucugguuuucugucaggacucugaagugcuccagaaugacuauuuguacggggcccaauccagugugccaggaacacgaacuauguuagguuguuugcaaguggcccagggcaacauuccucuuggauguuuggccuggcugcuuuuucugucuugcuagcuuccaaguucaggcugcuuaugucuuuauaacugugucagugagcucccgcaucuucccugggcuucccuguaucugucaaacgccagcucuugguugugcuucugugguguaccaucgucuccuuccuuguaacagugagacucugugcggucccuccugagcugugcucuucuguuagagaggaaccuuacuggaacgcucccauccaggugagaagggagaguagcuuggacagccagucuggcuugagguauuccagacauuacauggaacugcauauagguaguucagagaagguggcuggggcuaguauacauauugggauagguacacauuuauguuuuuucaagucucaagguggauaaagucuccuaggagugaaguaaaauguguucuuggauuucugaacaugcaagaaguuaugggcuggaaguuagguagaggguagcucugcuagacacuuaaagaaagugcaggccuaaggugacuccugucuccuuuuccuagcagcaaaacaaauuuggaacuuggccucccuagcucagauccuugcuugauuuuaccaguucagaaccagauccuacaguuucacagacccuguguucugugccucucagcucuguuccaugggacuucucagucuuaagugugguguggcuccuccccucuuuuugucuuacucacuugucguuauagcucagaaacagucagaagggagcaaaagagaggaugcuggcgcaaggggaaacagccccugaaaagcugaccuuuucucagugugguucuauaccuggcacagacaggaggagcguggaugguauccuaguuaggguugcuauuguuuugaugaagcaccaugaccaaaagcaagaagaagggaaagaagguggggaagaagggagagguugucuuggcuuacacuuccacaccacuguucauuauugaaggaaguuaggauagaaacucaaacagggcaggagccuggaggcaggagccuggaggcaggaaccuggaggcaggagccuggaggcaggagcugaugcagagaggcuauggaggggugcugcuuuacuggcuugcucagccugcuucuaacagaacccaggaccagugggaccgcuuacaauggguuaaucagucacuaagaaaaugggucauacauaaggguacauacccguaauccuagcacucaggaggcaggagcagguagaucucuuauuaguuugaggcaagcacagucuacauaaugagccagcuggucuacauagugaguucaaugacagccagagguacaaagugaggcccugucugguggugggugggggagggggagagggaugaggcaugggggaagaaaaugcccuuagaggcuuuucugcagccugaucuaauggaggcauuuucuuaauugagguucccuccucucauauaacuuuagcuuguguccaguugacauaaaacuagcuagcacaaauguccacggauuguggggugggguagcaucaucuaguauguuccuacauguuuauuugaaugcugggugugguggguuuucuuaagcagcucucuugguaaugccagcuuucuuaacucugcuguuugagaagacugcacucgccauucucuuuaguugggauacagagaugccagagguccucaggcccuggauaaaggaaugagauucuccuucaggauuuugggcuuuucacaaaggauagcuguuguuauccuacaaguugagggcagugccaagagggcacagaaucagugguagcacauauggcucucuggugauguaugaaagaccagauuguaguuggguccugucuucugugacauuggacaugcuacguccuuuuucugugcuucaguuuucuugucuguaauaugggcacauuagucauuauuccugauucacuagaauugugauuaaacaguaugcugccuggaccaaagauaacggaaagcugguugccauguucuguugugguagcagacuuggcguacuuccuaaacaaaagcuguuuggucucugcuugguaccugaccuugacuuuggaaagaagauaagcagagcucccuucucagaaugaaugucauuguaccauagccccuucuuuaauccgauggcaucuugguuuccuuugagcucucuagcaucccaggaaauuugugcuugcgucccaccaucauucagauuaugcuggccuuugcacaaaugccucauugugccucugucgugcuaaugaggcuguuaguugacccuagaucuuuguguguugugugugguaccuuggcugggauuuugcuggacggugcuuuuguguguucucaucuggcuggugaugcuugagacuggacugugcauguccauucacccagugcucucucuccugccauagacaacaucccugaggaccuccgagacccguuuuacaucgaccaguaugagcaggagcacauuaagccacccguuaucaagcuucuccuguccagugagcuguauugccgugucugcagccucauccuaaaaggggaccagguggcuaccuugcaaggacaccagucugucauccaggcccugucccggaagggcaucuaugugauggagagugaugauaccccugugacagaugcugaccucagccaggcaccuauuaagauggugaguguugccgggcgugguggcgcaugccuuuaaucccagcacuugagaggcagaggcagguggauuucugaguucgaggccagccuggucuacaaagugaguuccaggacagccagggcuauagagaaacucugucucgaaaaaccaaaaaaaaaaaaaaaaaaaaaaaaccaaaaaaaaaaaaccccaaaaaacaaaacaagauggugaguugucugacaggcauuccucuguucccuuggcugagcaggcaagacucagugcccuuccauuagggucagauggugagguuugccaauguguauugguggaccuuaaugacagaccugcauuuuaaagaaugucaucauucuggaaagaacagcuugcuuuuggguuuucuucucacugaagagacaguguagcagggcacaccacugcagagccuuccugcuggauaucugcacucagccagaaucgguugcuauguucucagaggcuaugccucugcagauuagcccagcaccuagcaugcuauggcuguuuucacucaguggggugaugugugggugaagagaaagcucugaagagacugaagguagagugugauacaaagagagcccuggugccauuccagagccuuuggggcagaggaagcgggcagccucuucucacagcuuuuuuuccagggcuacaaagcaaauuuauagucugcugguaagagauuaggaccauggaccauuacugcauggcagaacagugccagggauggacaggccucagccagugcuguccuuggcggggaaggcaaggcagaaaguuuucuugcauugggaccugcaagauguuuaggaugcugauugcagccucuguucccagaguggccacauggcgaugguggaugcccugaugauggccuacacuguggagaugaucagcauugagaaggugguggccagugucaagcgcuuuucuacauucagcgccucaaaagaacuuccuuaugaccucgaggaugccaugguauucuggaucaauaaggugagugcuuguuuagcucuuugccugauugagagcugucugcuucuuguucuccauauugggacuugccacuagaguuugucauuuggaacugcaugguacuuuauccagcuagguguccaauagacaguccuuauuccugagcgcugagaguuaagcaaauggguguggguuuguguaugaggauguacauaugugugugguuacaacuaauggguuucauuuuuagcuuaagguacuuauauauaaugcuuguucaugauuuuuugcugauaguuauuggggaggagucaaguuucuugugucuguuuaucaguguguaucuguguguacacauguauucaugugagaguacagauacacacaugacauggcaagccuguggaagaaaaucucagguauuggucuuugucuucuaccuuguuugagagaagguccaccugccauuuuguuguaggagcacugagauugcugcugugcuggguuuacgugcugugcugguugguuuuagggcaucuuggcauaaguuagagucauuuuguaagagggaaucucacuugaaaaaauacccucacuagauuggcugauaaacaagccucuaguacauuuuuucuauugaugacuguucagguagggcucagcucauuguggguggugccacccugggcugguggucuuaggguuauaagaaaguaggcagagcuagccagugguuagcauuccuccaugccucuguuuuaguucuugcauccagguucuuucccugcuggaauuccuguucugaaguucuucagugauguagaagaaauauaagaugaaauaaauccuuccuccccaaguugcuuuugcucaugguguuuaaucacagcagaaauuguaacuagaacacaugguuuaaagcuuugguuccucgugcuugcuuaggacuacuucaugcacccacugagaucccuccccucuuuuugagaaagguagcucaggucggccuugaacucacuauguaguugaggaugaccuugaacucuugguucuuuugccuccuaaguccuggggcaggcauacagacauaugccaucaugucaggcugcauccauguaguacuucaaggaaauacacuguauuuuugucuucugacuugucacucuuagacaaaguuugugcagauuuggguuuguggaaaauaaggugcacuugcucuuguagcuuccaucccugucuuggguuacagacacguuggcacuucacuguuagauuuuaaauuacugugcuuugguaucugcuuauacagccauauuuccauucuagaaccauccuuuguucuucuuguuucaguuuuuacaaaucuuucucuuuuucuuaccuaauauuuguauuuguuauucaugguuuguuauuuccuuagcauuuccacaguaacuuacaguccucuuuuuacuuguuuuuccugguguggcuucucugguguuugcuaguuuguaagcuuuugccugguuggagucaucagaugcaguuagugcuucuggcuaaauguuauccuuacucugcauccagggugaauugcccagcauccagcaagauggagcucuuuugcagccuucacuagauugcauauguucuuaaagguccucuccauaacuucacagggcccucaacaagcauugaaguacuguagaguauugagugucuuuccuuguggcaucccuuugggaccuuguucuucucuagcuuagauaauggucuuuucugucauccuggacuccuuuucuccuccugacuugagaugcagucgaugaagccuuucugcagagcaccaacccugcuaugauugagcauccugucuaguauuggaaggacuagagcugagcaggcaguaucauccugguuguccaugcuggccugacaugaaucaucuuugauggacacuuagguccuccuuaucuccugggugcucugaguuggcccauggcccauuuuucuggggcucuuuuaaauuuuuuggugaguguguuauauacauauauguuuuugugugcauaugcaucuauauauuugugccagccagucauaaguaaaagacgucaaaagucguaaaucucuugccacccaaguuuuuuuuuuuuuuaaauagggguucacacugaacauagagcucucccuaauuaacuggaaugccuggccagcaaguccuaggucauccugugacugucgcaaggacucagaguuugugggugcugaggaucugaacuuaggucuucauguuuacacagcaaguucuucauauacucagucaucuucagaaguuuacugauaaccugugguuuaaaacucccuacugagucaggcgauggugguaugaaccucccagcacucaggaggcagaggcagguggaucucugaguuugagggcagccuggucuacagaggaaguuccaggacagccagggcuacacagaggaacucuguauggaaaaaaaaaaaaaaaaaaggcaaacaaaacaaaaaacaaaaaaaucuucucuguacugaaaguuaaccuagauuccacauguggcgauuccuugcauuuuaagcagugaugauagauacccucuuaacagccacuacagucaaggcagcucuucucucacacucagugcugcuuuggauccuuuugcagucagccccucccccaggcccaggcuuauacuuaccugcuuucuuaaugggauuaguuuuguuucauccagguuuugcuuaaaauguucuugaacuuggcuucuuucgcugaaccaaauguaucuauaaguaguuugguuuuguuuaugccauguagaauuucuuuauaugauugugucaugauuugucugucauuaaccuguugauugauaccuacauauuuuccagcuuuugucuauuuugaauaaagcugcuggggcauuugggugugucuagaugcugcugcucuuucuuuaagugaguacuuggcagaauugcuaugucuaacauaguugcuuaagacaaaggucuuaagcuucuuuuuuugacagggucuuacucuauagaccaggauguccuugaacucaccaagugccucugauaccaagugcugagacuaaagucuuguuccacaucaagcauuuauacuuaaguuucuagaaacaaacugccagaauauuuucuaagggaauauuuaaaauauuuaaaauucagguacagaauaggaaucuuuugguucuaacuuaucauuacuccaucaggucuuugauuuggggccauugguguaguagauucucauguguuuccuugauuuuuuucuuuuugcaaguccuuguuugaaucuuuuacacaacuuuuauuuauuuauuuugaguguguguuugagauagagucuuccuuuguagcugaagcuggcuugggacucugaagccuagguuggcuuuaaacuuuuggucuuucuucuucagacucuugaauguugugauuacaagugaguaauaucguucuuggucuagaccaguuuuaaauuguguucuuugucuuaauauaguugcaagaauauguauguaccuuguuaggaauguaugucgugacuugcuuucuuaguuuugacuuuuuacuauuaguaauugccgccucaaagcagagguuucugggauuuugaagccuaguuuacauuuuuuucccuaagagauuucugcccugccccaagacuugaaggguuuguucccuuucuuccuccuagugguuugguggucuuugcucuucuccugagcuuucugaugcccugguguuuauauacuguguaugaagcagggaagguaugaagugcccugcuuuuuucacagacagagagcaguuagagacuccccagagcagagauuuuuuuuuucucugcacguuacuguagcaguggcucuauugggaccuaggugagacacauuuaagugugucucuagacacacuccauugaccugugugguuaguuccauggugacuugaggugacuguaagcuuauacacaguacucuguaauaaugacuuaaauuuaaacaauacaugucuuugaacugaauuuuuuaaaauuaaagaguuguuuuagcucucguagguugcauguucucaugaauuuuagaaucaacuuguugguuucuacaaaaagcacuuguagggaucuagaucaguggggccauggcuauguuguuacccuguaaggaucacaguucauugccauacuuuuguccacuaauuauccccagggaaauuuaauuucaguguauugaguugugcuguaagugauguuucuuaguuucauuuccaguugcuuguucaauagaaagccaguuaaauuaaagagugcguuucucuucucuuguggaauguggaguagaagugguagaauaagguauauuguuugucccugacccucaggacccacagaacugucugcagcuuuuuuucuucucaugcauuucuuuuucuuguuuugauauuaggaugaugcagacucaaaaagagauaagggauguuuuucuuuuucuguucuguguaguaauuugacuaugauuuguuucauuucauucugaaaccuuagggcuggcuggugaagcuaucugggccuggagauaugugugugugugugugugugugugugugugauguauauguaguugugaaaacuuuuauauacauuaaguuauuuagauuuuuaaauuuugugucaguuuugauaauuuguggcuuuuauagaguucauuuuaaguuguuauuagcauaaaguuuauugauguuuauccuucagguaaauguaucugcagucucuagugacccugucuuuguuuccugauacuuaucaugacuucuuucuaccuuguuuuuuuuucuaguuuaccaacuuuauuaucuucagacauugcacaucugugcuguuuaauguuuauuuuuuccuuuuaccuuuauuuuuuuacuauucuuuucuuguuuucauuucauuuuuagucugucugucugucuaucugugugacugacuaucuauagacagguucuaacuuuuuuuuuuggggggggguuuuuuuuuuuuuuuggggcuuuuggagacaggguuucucuguguagcccuggcuguccuggaacucacuuuguaaaccagacuggccucgaacucagagauccaccugccucugucucccgagugcugggauuaaaggcgugugccaccacgcccggcuagguucuaacucuuuagaccaagcuggccuugaguuccuggcauuuuuccggucuuagccacaguguuuaccucuuauauguuauuggcacauaacaacugagcguauuugugcaguguggugugaucuuccagcaucauguaauggucagauucauauguauagcauagccagcgucucaggcauucauucucagacagaccuuguuucuaggagcugagcaauagcacagugacagagaugcuugucuaguucuguucucaguacuaaacuaaaaccaagcaaaauaaaguguuccagcucgugggagcaucacacacacucucuucacuugucguuaaaguagagagcaaguucauucaaacuugcuuugcuucuuguguaugagguguggugcccacccucugagcagagcuuugcucugucuccuguacuugaguauacugcauuucuuuuaaaauaguaucaaucuuggugauuucuuguuuuaucagugcauuaucugaaaugacuuuguuuuuaaauuuuaguauuuagagggaaaucauuccagauacauuuuuguguuuuggauuuuauuuuguuuuuuucaagucaggguuucucugucuagccuugacuguccuggaacucacuguguaaaccaggcuaacuuggaacucaagagaucugccugcuucugccuccugagugcugggauuaaagguguauaucaucauacacagccuuuuuacuccgcugucuuucuguuuaaguggauccucgagcacacuguaaguuugccauucucauguauuugauaauaucugccucgucauuagaguguuagaccaguuagauugcucugauuguccaugugguugaauucuaccuucuggcuugauggcugcuuaucuuguccuuuuuuuuuuuuuuuuaaaccaaccucccucccucccucccucccucccucccucccucccucccucccucccucccuccagguaccuguaguaguuccauuauuuuacaggguugcuguagguucugcccugcgcuguuguguugccagggguuacugagacuagagugauguauuaacgguaguagaucugcuuuucuccugggacuuugaccuugucacauucguuuggugguaacccuacccaguucuguucuuucuguuuucaguagucauuuauuuguguguuuauuuguuaguuuguacuaguugucaacuguagcuguggaggcuggugcugaccaaugcuuuuugguccuuguguccucucugguugugaaggacuagcagugcacaguggcugugcaguguucacacugcaaaaagauaagagauuuugauguuuuaaggauauacagucuuuuuuuuuuuuuaaaggacauuuguguguguguguaugugugugcgcgugcgcaugauaggggucuuauguguauuguaagugcagguacauacauacccaagaccaggagaagaugucugucuguuucucacugaaccuggaauucaccauuguuuuuuggcuagacuggcuggccagcugauauuuuuuaauuuacuuuucaucuguuugguuuguuugguugagguugaauuuaaacugauuuucuugccucuaccucccaaguguuauacauagguuuauguggugcugugaauugaaccuagggccuugugaauguuauacacucuacccacugaguuguacaacuuccucccuuuuuuuagagacaagauuuuguguuuauuuuaaguuggccugaacuuacuauaucgcucagaucgggccucaagcuuucagcagacucccaaguguugggauaacuuaucuugcccagcuuaguuuugcucuuguacacuuuuuagcaguaucucagacugguaggggcuccugagucccauuugaauaacuggauguacauuucuagcugcauuuuuuccguaccaccuaguaacuguuguagugaauuuuuauagacugguuaugaguucacuaagcuuugacucuccugaaaaagacuguaagaugucuuccccaggugcugcaccuuuguaagagacaauggcuggcagucucuuuuuggaugaagauguugcuucccaguuucagggugcacauaggaggcuaaaauggcaguuccucuccuaguuaauguuuuaaaagucaguacugacugucauggucagcuucacacccccacucagaagauggggguggugucuuggguaacugcccuccacccuuccugucugcuucucaaacccauuccuuauguuaggugguggcaugcucucuccugugcuuucugggccaccugguuucacagcagauacuugguuugguuuaccgugguagaucuugauuuugaaaagaaauugauauuuuacuuuaaaauauuuacuuuaugagaaacuugaaauuaauuuacaucuuagguacaggauuucuccauauagcucuguggcuguccuggaacucacucugaagaccaggcuggccuuuaacucagagauccaccugccucugacuccugagggcuaguauugaagguaugcaccaccuuuguuuuaaaaugggcuuguuuuccuuuuuuaaaaaagggucccauauaucuaagacugauuuugaacugacuguguagcucagaggaccuugccuugaacuucugaucuucgucuguaccucuggagugcugaaauuacaagcgugagccacuucauccaguuuucgauaguggcuuuacuuuccuucaaaaaucugaccauuagauuggugggugacguggcuuaccaaauacgggucguugcugauucugaucccuacccaccugguaaaaggagagaacuaauuccugcaaguuguccucuugacuuccucguauguacuguggcaucgugagcauaaacacacguacucacagagagggugggugggugugugugucugucugucugucugucugugagcugccauauuagugcuugaaaucaaacuuggguuuucugcaagaacaaguacuuuuuaccacugagcugucucucuagcuccuuuaucaugguuuuaaagagauuuucugcccucuugguguuguagguaaagagcucacauacuguauuuuucuuggaugauaagccacugcacguuuucaucugaccauuauugcucuaaccacuccuaaguauuaauguguauuuuuacaaaaccuguuguuauuuuauaaauacagauugagaaauuauauugugagugugcaugauguaugugugugugcaugauaaaugcguguucaugauguaugacguaugugugggugcucauguggcacacuagguguguugcaguuagaggacacuguggagauugcucucuccuuccaucucuauguggguucuagggauugaacuccagugacuagacugcagugacaaguaccuucucggucugcuaaacugucucguuggcucaauagaaauacaaauuugauauuaucuuaauuucaagagagauuacuuaaaucuaugauuuuaaaagggauuuacagcuugguuuuauaaccgagcuuuuauuuuguguugauucauuaguuuuguguagucaguugaggugugauguaaaauuagguagauuguuuuggggugacaucaaacaaccguguaaaguguacauggggucuagccuugauucuacaauggugaggaacguccugcacugaccuuuaaaggcacagugguuuccuugcaagggcaggcugacccugaggggcacauagaauucagguguucugcaucuuuguaauuggccugaugguacguacgccugucuuaagagugaucggcaggugcugugggaucucaugguggugaaguggagauauaggggaugacaugggagagcaguagccuucuuuuuuuuuuuugguuuuucgaagggauucucuguguagccuuggcuguccuggaacucacuuuguagaccaggcuggccucgaacucagaaauccaccugucucugccucccaagugcugggauuaaaggcgugugccaccacacccggcuaaguucuucaagcuauucuuuuuuuuuuuuugguugagcaguagccuucuuaaugcauuuuuuucugccuuagguaaaucuuaaaaugagagagauaacagagaaagaaguuaaauuaaaacagcagccacuggaaagucccgcucaucaaaagguaaaggguaauuuuaauuucuucgaaacacacuaagguaaauguuaguaguuuuaaagaauuaucuuuguuucuacuugcucauucuauauuuuuaucacucugagcaagccggccucuuagauucuccaugcuucaguuaggaguuuccaugggcaaccugucuucuaugcccaaccccaaaaggucugguuuguugaacuagggguauucugggaggacuugggggguguuggggggaggcucaguaaggaagcaauguagccugagcugggagugagcuuuagaaggucagaaauugagcagaaaacucccagcugcacucaugcagauacuugagauggccugugaggugccaugggacagaugggggucuaaacccugugccuggagccagugggaaguguguaccuugggauggguguagauggguacguuugugccacguucuaccuuuggucuugucccuggccauuuucucuuuugccaaggccauguaucacagucagugggauguacccaggaaugccugacuauugacacaguuucacuacugagagcagcauguguucucccuguguaguuuucucucuacacuggucagcucuagucagccaggucaguagaggauuaggcuggagcugagcaccucccuaaucuuuggauggggacaggcucacaugggcauagacaaagggcagaccuguagccugguccccugauuuucucaaguuuggaacuguucuuugcuauugugaaacagaguuguaaaggggacagguuaccuuccaguuaaauugccugguguugugauuagcuaaggucaugcacacuggaaagccuuugcuaucagaggcugucucuaacucuccugugugagcaugugugucauggccacaccuggaccugcagugcugacauuccuuuccaccuuccuuccugcuuccugagcagucucccuccaagugguauuggaaguuaguacccguaagugacccaggccaccauccaccaucugcaaagccaucuuguugccaucaugcgcuuccauuaaaauugcucgcacccaagauugguuuuugucuguuuguuuaaguguccgccugggggcugugcggcuugucuagcaugagcccugcuggccacgcugauggguucuguuauguggcacauugggaugccauguucauuccccuaggcucuuagugaucucuaagugaccaguacagcauagcugacaggacacugucuuuucuagcagaugcuaagaggacuggggguuaccuaguggcuggaaucauuucauggccuuuucuuucugcuguuacuuugccugggggcuggugucucuaaccaccuucccuagaaccuguauucuaggcugucagauugaagaggcauucucccacugaggguacagguggacugcagagagggcugucgaugguguauuuugauguggucuucuuguuucuaccccucaggucauauggaggucagcucagauucuguagucugaguuaggucaguucaaaugcaggguuucugaaauuacguaugaauuuucacacaaaguuuaaaaaacaggauuugauuuaguaauuucagcaguuucuaacugguggcccagaauggaaguagaccaguuuguugcugcccuuauaggaaaugccuugugucaagugguaccuuuuuaugugaacucuuugcagauggcuuuguaagugcccuuugauugcuuggguccuguagcuucauuauuuggcccagauuuuuuuuuuuuuuggguccccacagcugugggcugcaaaaggccaauguaaaccuugaauguacuucuugcuaaguguguuugugagaaggaggaggaaggcaugcuuaaugaauguuugaguacugaauuugaccaaggcaagggcucacacacucagguguccuguagagagguuugguuucagauacaauugauuaaaaaaagagaacuauaacccaaaacaauccgccuuaacuuuguuagagaggcuauggguagccuacagugguaaauagaccaacaagaaaacguguggucaagguugguauguuuugggcuuuaccuaaacaugucccagcuagaaguuugaagaugugggugagcacagcagccaugugagccuucugggccccuguaauucagugucagccuaauuuuuacccaugccauccaucuuuacucaagaaaccauuugcuuuacugcaugucugcucacucccugucugcugucucugaaagccuggccuggagcaugcugugaugcacugcaugcuggaaccuguggacuuugcacgugugguacaguauaaggcggguucccuaugauagugcuuguugugggcucugagaaacaaguuaaaauguguguuggaauauucagucaacacaaaacaagccuuguugcuaaaugugaaggagucaguuccaaguguuuuucuaaugagcaucacuacugcucaugcagaauauuuauggaaguguuagcugaaagucuagauuccaagaugauucuuugaguuggaugacuuaccuguagaacucucagaaaccaauaguucuucuucuaggcaggugcuggcucccuuguuuuuaguuucuauugugugugcuccuggagaaaaauguggacugguagguacccugcccugggcacugauucaggugagagcgguacacugcagcucucaaggagucgugucuacacugagcaaccccuucucugcuaagcuuuuacugacaguagauagaaaaguauggauggacuguaacgcauagaauauugacagguagcuucaauauuggggugugcacauaaaggagccuuggucuggcauuugcuugaugaucuugugaguuuagcacugauguuucacuuauaguucuugguggcugguguaguggugugagaaauuuuuuaaaucugguuucugaaauuucucaaacuaucaauuaaugcuauuuuguacuuuuuaaugaccaguguuaauguugauaauacuuagaacagugccuguagcuugggucuuucaagcaucugaaugcccacuguuuaacuuguuucucauuaguuuguaaugcauuggcucacgguaguauaguuauguguuuugucuccuucccaugugugcccacugccagagucaguuuagaguuagacugacccuggugguguuagcagugaaucucugccauacaguguagccauggaccccaguccuuggaucugacuuguuuguucuggauagaggaugucauccacauagucugaauuuuuccaggcaauaucauguggcucuagacuugauauaaaucuugcucuagcaguaugccuguaagauacacagacugaagcgaucucacacgcagagaccauuuuccuuuuaucaacugcagguccguuaucggcgagagcaccucucugcuaggcagucacccuacuucccguuguuggaggacuugaugagagacggcagugauggcgcugcucucuuagcagugguucacuauuauugcccagagcagaugaaacuggauggugagugcagaacacuuucccugaacagaccugagagggaacagugugcauuuagcaugcaagagaaguagcauggagucccugugucaguugggauacuacuauauaccuagaaauuccaagaaaccagauucuuauuuguaaucuguaucuuaagugauaaagaaauagcccauugaguauuggauacuaugucauuguguuuugugacuuuaccuuuguuugaguaugagugggguuuaaauuccuuccuuauugaaacaucuagaacuuaaaccagacaggguggcacacaccuauaauccugguauguggucggcugaguuaggaccaagacaagccugggaugccuaaaggagaccccuugucagaagccaaaagcaaaacaauucuguagaacuuugugaagacaugcaaaugaaugcuagauucagucuguguccugucgugaccugauggagcacuauucugaugccacagugccucuuucuaggugcugugacugacagcagggaggagggaagugguuggcugugagggccacggcacagaccugccaggggauuaugaagcucguguugucaguagcucuauuuccuaagugccuugugucuggagugggcagguagaaggccagggaccugaccaguucugauuggaauuuuaucucagauuuuuagcacuggacagcuuaggcugguauuaaugccuguucuaggcaugaaagugcagauaauacauuuucuuuuuuacagacacagguggcuagggagacccccagguuucaugaggauaaaaccugcaggugaacaaauggcuuccucacauuuggcuggccuugguccugugacauggggaaguguaucagaaaagcccuagcuuauacgagguggcuucucaaguacccaugucucugaggacuaagaggaagugagugggagggaggccagcuucacaaaauaaaaacaacucuggggaaauaauucaguguggauaauugcuuagcuugacugagaccuugggcucuaucuccagcaucacacaaaaagaaaugauacggccaggcgugguggcgcacgccuuuaaucccagcacucgggaggcagaggcaggcggauuucugaguucgaggccagccuggucuacagagugaguuccaggacagccaggacuacacagagaaacccugucucgaaaaaaaaaacaaaaacaaaaacaaaacaaaaaaaagaaaugauacacaucuggggauacagcucaguaauagaaggcuugccuagcagacaagcaaacggcacuagguuucugcccgagcacugaaaaguaaaacugguuuagugcuagacacucaggccauguaggaacuccagaguucugcuuguggggaacauuucaagaaaccacaauuuccaaggaaacaugcuuccauagaacccucagguuucacagcaggugaaagagaaugcagaaugcuucugaaggaccuuaggaaagaaauagaagcuguacggaggagaguuggugggcacuucaucccagaguuguggggguuucccuuucacugugcuuagacugaccuggggcuauagguguuccacacugcccuugaccguguguccugcugccuuagccucucagaguacuaagcucagagacaugggcaucacugcccgcugugcucugguagcucucugccccgagugcacuuucucaguuuucccucagcuccagagguggccugguuuguuugcauguuuguuccauagucuuggcuguccuggaacucaguauauagaucaggcuggccucagacucagauucucuugcuucuuccucucaagugcugggauuaaaggcauaugccaccaugucugcucuguagccugcuuuuacaucuguccuuugagcaucuuaaggcagacaguaauauuacaaacuugacaggcuacauaguguaccagauauuguaguacacugaauaaaaauaaauggucagggcuaucaagaugggccagggggugaaagugcuuaugccaagcuugauaaccugaguucaauucuagaaccuacagguagaagggcagaacugauuccuguaaguuguuccuuggucuccauguacacaaaccuuugcaaaaaaugaccuuaguguugugguacacaccuuuagugucaugcaccccccuauccccaacacacacacacacacacacacacacacgagacagagauaggugaaacucugauuucaaguauacacugguuuacaaagccaaggccagaccagucagggccacauaguuaagaccaugucauggugggggcagucaauggggacgacaacagcaacaacaaacuuggucaaagccacaagagaaacuacaccagaucccaaaguauguguucccgccaauuuagcacauuacaaaucagucacaaaggcacagcuucuauccacacucuuccuaauaagagaagucagcugguagguaagaucuguaagagugggagcuuuuuauuuguuuucacugauguguuacaaccauuuaaagugauauguaggacagaccaauguggacuagguauugagccagugaacaauagccagaaguggguaggacacagccugaagcgugcuguaagggaggugaaugcuuuacauaugugugucagaaagcagggagcuugggcauuaauuagauucauuucaguaucuuacaaaaaaggacacaaucccagagaaaaguaaagggagaaaaaaaugaaguuuugugacggugucuguagagcaagcgacugaauuguaaguuccaggcucuaacaagcuggcuagccaagaaguaaaacagaggcaaaacaguucaccagcuagaauucuggagcugccacaggaagacagaagaaggcuuuuggccagcaauuaugccuaggugugucuuuguaagucagucucaagaacugugagagccuggauucuuccuuugcuuccaguaauagccuccauguccaaagauagggauauaaacacacuuggggagacuaagccuguaagucauggccucaggcuccgcgugggguggguaggaggaggugaccagaaucaaggcuucugugugcgucucuucauccuguacuuguaagccucaguucugugcuccacaugcaaagcaggcacagagucuucucucuagagacugcucuuaaggauaaaagccacagugacugagguuugacaucagcuggcuucuugccuuggucaccugcagcaaaacccacuucuuaaugccucccucuaacagugaagggguacccaggucccccugaacauuugaggaaauccccuggccauaacaaauacucagacaacagauagaguucagaauacacagcaccaagaggccggggaccuaguugccaagaacggugacuggaaagaggcaucuuaaaaacugucuuccugguauguccacguuagguucuguagagcucugaggaaguaggcauuuugguaucuaaaguguaagaguauacuaaagaguuagaaggcugaguagaaaaaaaaaaaaaggaaucuuccagaaaauagaacagaaagagcaaaagcauggaaguaaaggaaaacuagaaaaaugaaaucaauauaggagaaugaacacagaaaauagagaugguuuaccaaaggaaaguguagacgccucuugggugagcacagccagauuucaggaacccacuggaaguguccaguugaaggacuaugguguauacugagaagacuccaaagcacucuguggggagacaaagcaggucacacagaguagaggacuguaugacagcagcaggucucagcacggcuggcugcuuucuaacagccuugccucugcacuccagcuugcuggagaagaggcuacacagagcacuucagaaucuuugugcaguuuagaagacauuguaucuuguugaaauaaaaaguaaaaaguauauuuaguaggaaaguaauaaaacaguuagacauuuugcagagaaaccauguaaaguuagaagcugguuuuuguuuuuguuuuuguuuugauggauucauuaaacagauacauguuuggaucgaucagacaauaaaagagagcaaaauagagaaugcagaaaacaggcaaggugugguggugacccaugucuuugaucccagcucucaggagauagaagcagucagaucuacuacagagaguaaguccaggacagccagggcuccguuaacacagaaacccugucuagguggggaaaaaaagcagaaaacaaaauggcauaaauggaggucuaguagaaaccaaguaaaaauauggagaguauuuuguguuguuuauuucacuuguuauaugacacagauaguucuguguuggagaaaaaggaaugagagagccggagacccauaaguacaagacagauggacucaggcaucaggaagugcauccuccugggcugacuuccugugggaacuuugugcuggagcauuuaccaaacucucaaagaggaggaccccugguggugcuagcccacuaugcaguacaugagucucauguggaccgcagcuuggggagagccagguaacccagucaguaaaacggggugugagaagaaaaugugaauauauaaaaaguuaaaaacugcaagaaaaaaaguccuaaacaucccuguaguucuuggaagaggcuucacauucucagauguggagucagaaucacuaaaaucaucauuucuuguaaauauauugccaguccaguaaauacuuucgcuuuuaccaagauugauaaggcaauauaagggcaaaauuacaacauuuuacuuugguauaaauuuaauauauaacagcuccaagaauuuguuuuuuaaagucuagccuucccagggcaauccuuucucacuuuugucuuuggaguagcucagggaccaaaggcuuuccuggcagcacugcuauacgcaguguacgcucaggggagguccagggaugucuuuucaccccuacucaccguuuguaguuguuggggcuugcagucucccuaaagccauaguguccaccuagccuuugccauucaugguguuuaggcuauggaguuggucuguugucccuugcuuggugguuaguuggcuuacuguuuccuuaugauuugucugccucaggcuauacugcacaccaguaucugugucuacugugcucuuggucaaaacgcugugugcuggccgcuuaagaccacuugagaaaggugauuuuuacugaugaacugacuccuagggagaccuuuggacuuuggaucuucgguuaucaucugcuuccucaucugauuuucaccacugagugucccuccucguuccuguuuguuguuuccuagcuggcauugugcagggguagcuuuguccucuuccugccagcauguuuguugauugacagacugaacucacauuauaaucuuaucaccugguagcuugugucugguuccaucuaucucagagacuuguacuugguacuuaguucucacagauuuuagcugcauuuauuuguuuguuuguuuauuuauuuauuuauuuagaauagaacauggggcccuuguucuacaaguguaacauuuuguuuagcuuuacacuggcugaaacuguggcauuggcucagggcaaucaauagagcaggaauacacaaaccacggaaaaagagauggucagucagagcugugcauugaggggucacauacccauaccauagagggcaagggaggacugggcagucaggagugguggcaaacagcgcuccauggucagaugacagacacuaccuccugugacaugggcacaccugcuccuggacugaugaccuagacuggaaauagcaauugagaucuuugaaaaauaauccccucaaacccucccccucuuauuuugguacucgagcaugcuagagagauagccugccucccuccuguuuucuuuuugguuuuucgagacaaggauucucuguguaacaagaucuagcuguucuggaacucacucuggagaccagacuggccuugaacucaaagaucuaccagccucuaccucuggagugcugggauuaaauguguacaccacccucuuggcuucucguuuuuaaagguggaacauucagaggcaaagccuuggugcaucugucucaugaucuuacauuugcuguuuacuggcaucuggacaaaccccggaggccccuuuucagggguccuuauuuacugccuguaccacauuuuccaauggagcaucugcccuccugaauuuucuuaccugagagguugggaagagccucaccucucauagaggaggcuuguacuugguguaguuuucucucuuucucucuuucucuuucucuuucucuuucucuuucucuuucucuuucucuuucucuuucucuuucucuuucucuuucucuuucucucucucucucucucuuucucucuuucucucuuucucucucucuuucucucuuucucucuuucucucucucugucucucucucucccuuucucucuuucucuuuuuguuuugggguaguuuuuuuuuuuuuuuuuuuuuuuuuuugguuuuucgaucaguguaguuucuugauuuggaggauuagagacauugcuugacaauuauaauuuugugcauauccuaucuccugccauuugcaaauaugucucugcuuguggaagaaaaugcaaacauuuccauacauuuauuuuaauaguauugugugugcaugcauguuguauguauguggguguagccacagauguggaugugaaagguuaucuuuuuggaaaugguuuucuccuacuuuuuuuuuuuuuuuuuuugagacaggguuuuauaccugacuguccuggaacuugcucaguagacuaggcuggccuggaacuccucagagaucugccugccuuuuccccuugggauuaaaggugugcaccaccgucaccuggcuguuucuucccaccuuuaugugaguccuggagauugaauuuagguuguugagcuugcagggccagagccuuuacccauugagcacugaggacccagaacacugagauuucucauuuugcucaucuuugccugcucuugugccuugcacauguuaggcaagugcuaugcuacuaaauucuaguucagccccucuguucacuuuaggacuucagccuugaacucucaaaugaucuauguugugaauacagaguacuuuacauauuuucuuuuuccuuuuagugucaccuaugaaacuuacugucuuuuaaacucucuucaccuugcuuccuuuaucaccaacccuuuuacauagaauuucaguuuugugugucuacacacaccggugugagcacacuacgcgugccauaacaguuuccugucuguaucuaccagauaucugucugaaggaggugccaucaauggcugacagccucuauaacauccgccuucugagggaguuuuccaacgagcaucugaacaaguguuucuaucucacgcuggaggauaugcuguaugccccccuagugcugaagguaagccugccaccagacagacagacacgcacuuagagccagcuggcuuugagcagguacuuacugugccgggguuguuguguguuuuguuuuagccgaacguuaugguuuuuaucgcugagcucuucuggugguuugagaacgucaaaccagauuuuguucagccccgagauauucaagagcugaaggauggugaguaacaacuggguggucauagccauuuucuugagagcucgaagguugagucagcccaucugucugugaaggccaagguggugugugugucagugcuugggcagaccugaaguccaggcuugccuuuuuugucuguuuucuggucuguauuguuuuuaaauuuuguauuuguaagucagccuagagccucaccuguuaaacuaauuuugagaaguuugguuucaaauaaaaguugaacuguguuuccaugguucuaaaggcuauaggcucucuguuucuugcugacauuauaacuauaaauaauagacauuuauauaaauuugcuauuucuguagcuaaaacaguguuacagcagaagagcagccggccuccugucccuaucuccaaugcaaccaaacgcagcuuccuggguagcccugcugccaugagccccgcugaccagccaccauccacccagccucuugcugaaggcagucaucgguaccaccuccacucggaagaaccugagugucuguaagucugucagucauuccacuuuuguggccaguuuaccaucuucuuuccuuuuacaugauagccugagaauggaaacucucuuaaguaaguaaugcagagaguacccgaguagcuccuguugcucgcugucuguccuccugccuguuccuggagcacucagucuccucuucagaggccaggagucuguaagccuuaguugcaauuaacaaguuucauucuuaauuaauacaucaaauuguagaagagaaaagagauuucucccguaucucuucacagugaauuacagucucacagaugauguaaugaggaggaaacugaagaacaguuggaauuggcugugaaaugucaucugaucgccuuuagggaugaaggcugcucagcuguaagcagugcugcuucauugccuucagugagcaguggaugaugacauagugaauggagcugcuggagaguggguuuugagaauggauuuuuaucauuaucagcuggcuagaucugguugauuggcuacaaccuugucagugggcugagggugagaugaaagagcucuccugggagagagugugagccucugugggaggaggccuguguguguucuccugagagaauauuuuaaaacagaaacauaguuuuagaauguggagauugaguugagauuuaagguuaaaacgauacucagaagugauuuuugaauagcacaugcagcuguauggcuaguuagacacaaguuggaaaggaccucaacuuucucauguugacacuaaagaugcuagagggucgguccaggaggagaguguucaggggcccaaaaaaccugucagguggcccugggaauauuuaagggcugagauccacugacaggaucugguccuuggagcagaguggaaagcuguguguggcucagagcccauggguacagacagacgguggcugaggagugacagcaucacaagggcagagcuauauagccacaugugccuuauguggguaccugggcauucuugcuggcaguccuuacauccagcccuugugcugggucuuuauggucagauccaguacaugcuguguguguguguguguguguguguguguguacauacacgagcaugcucucucucccucccccucucccucucucuagcucauggaacuugguugaggcagcauuggcaucacaugugcucuaacuggcucagugacuuuuucuaccuaauagugacugugaagauuuucucauucaucaaauucuccccugaauagcuuggcacuguugcauuucugacucuauucuguuugaauucucugguccuuggugccgugggugacuauagguuauaaaccacuuucuuuuuccuugccuucugcugggcuucuggauuuccuucuaccccucuguucaguuuugucucccucucuuccuaauguccccucuuccccagagggacugccaccugucuuuauuccuuugggguuaaccuuaguaguugcaguccaggguguugagugccccugugauuccugcccagacuuuauuacuguccauuggucaacuucuuccccaaaguaaaauagcaaaauagcugcccuccagugugagugugcucuuccugaugggaagcuagugccaguccccaugguugggugucaggcuaacguagcugcacugaacagugcucaccuggucugugccuucgccacacccgcuggucucauauaaaguggguguccuuauggccagagccuugaguccucuuacucaagcuguaaucaaagaagucaaaaggugugaauaauuguagauuuuuugguagcuguuuccauauuguucuuuaaaauaugugaguguucucucccagcuuugugggagugcccugcuuauccauuuucaaguuacucucaacauuuucagucaguuugauauagugguaccaucuuuguggccuuuuaaauuuuuuuuauuuuuguguuuuugagacaggguauuacuauauagccucagauggccuagaacuugcuauguagaccaggcuggacuugaacucagagauccaucugcuucugccucccaagugcugggauuaaagguaugcaccacuaccgccugguuuaugagugugacauuuucauacauauauaucaugcauuguucuuacccagcugguccccuuugugguagucacuugggacuuugugccauauacugcaaccagaaguuguaugauuuguguucgaagcuuugggauuugugaguguugguguguuuguacacauguaugcgccuguguguggggguuggggggacagagguugauguuggaugucuuccuugaucauacuccaucuuauauuuugagauaaguaaggucucucauugagcccagagcucacugauuuggcuagucagcagucuuugccaguacaguggcugcagauauguauugauugcucugucuggcuuuuuaaucugggugcuggcaacucaggcccaccuuauauuugcauagcaaacacuuuaccaacugagcucaguuccaauuuggggauuuuuaucucaaauucaaaacuuuauugguuuucuuuugguucaguuuuauggaaagacuuuaacccagagaaaccugcugacugcucucagcuugauacaaguuuuuaauagucucuuucaguuauaugccuuuguuuuauuacuuuuacauugauugacagguuguguguguguguguguguguguguguguguguguguauuuaugguuacuguaccacagugccuauguggaaguuagaagacaacuuucaggaaugagcucucuccuucugccacgugggaccuaugcugucagguuuggcagccaguguucuucucugcugagccgucucacuauccuuugccuuugcuuuugaacuugaaguuuguuaaacucauuauuuuuuucugaauuauuuuuauuuagugggaaaggagcuuccacauuuaguccgucccauccuuuguugccacugagacagaaacagcaaaaagugucacagacagaggaaaucccuggugagaccaugauucuuuucccuuuuuuauuuuuauuuauguuuuacuuuuccuuuucaugguuaguaaaauaauauuccucaaaauuaaaugaccuuauucuaauguacccauuuuaguuaagaagagcaggauaaauuuuaauuuguauugaucuauagcucagaacuugugguguaaaugucauuucaacucagguaaguugugugcugcaugcacagaguggcaggugucgcagacauuccgcacuggcuacuguguguagcacugcucuucacguauugcagcuacuggaaguuacaguacuggaguguaguaguguccugaguuaggauuauuauuacccagagaaauggcuguuacacugaaagaacuuccaacgguacagaguuaguuacuuaacacugaauguuucuuccaaacuacagaucagcggcacaggucgaauucuuuaacucggguugauggucagccacgaggugcaauaggagcauggccagauaaaaaaaacaggugagucacugaacuguuucuguugggugcucauuagacuaagcagcaguucuccagauguguuccagggacccuuaaagauucaccacgcugcuucugggagcuggcagcuagugauaccacagcaauggcagcaugugcuggcacagcgacuguaugauguauggugucccagcaauagagggagcugugagggccucgcaguaggggucuguaguagcaacaggugcuuccugugcuauagacgcuuuuguuuuucauguuuccuguggugauuuuuauucaggguuuaaaaaauaucugagcugucauuuguagugugcuaaauguagauaaucaaggcucaucggggccuugguuacuuuaaaggguguauaaaggagugcuggggcaaaguguuuuugagucauucacuaaauguugccucugcggcucuuuuguccuaaagcguuuguauaaggcuucuuccuguaagacugcugcucucucuccauaucuugagcucuucuucaggcugcugagcagugaguugguuucuccucuuguuucaggccugugucacagccaacaucauuugcucuccaucaugcugcaaguugugauguggaucccaguucuggugacagugucagcuuagcucgcucuaucagcaaagauagcuuggcaucuaacauuauccaccugaccccacagaaccagccccaucccuccgcuggaaagagcaaugggaaaagccuccugagcaaugucaacauugaggaugaggacgaggagcuuguagccaucaucaggacagaugugucuccuccuuccccacagaugcccaggaccucaccucaggccccaggccugguagcaaguaucaggucuccccagagacaggcagacacuuuggagaguaagccugacaguuuuuacuuagaaccccugaugccagcaguacuccggccagccaaagagaagcagauuaccacuaaggaagaugagcguggagaaggaaggccaaggaccaucauggccaagaggccuagugagggcucccagccuaugguacgaaagaaaguaagugguggccauggcagucgugaccugaacagaacuuucaccccaauuccuuguucagaauuugcugcgagcauugaucuugcggagguaggaccacagucagcagaagcuacaggggaaggacagccucuggcccuggguagauuugauacauuaccucaggggcaggcugcugaugguuucuuucuccauguaggcagggcugaggaagaugaggggaggugguacguugguucacaaaguccuagcucccacgacucagaacccuggaccauuuugaggcaagacucggacucugauguaguagacguagaggauacagagcaggauuuuauuggugaggaccacccugugguuauccccagauaugcuggugaggaagagucagccaaacuacaggaggauaugaaagugaaggaacaugaagacaaggaugaugccagcggccgcucaagcccgugucugagcaccacuucucagcucagcagcauguccauggccaguggaaguguaaagaugaccagcuuugcugaaaggaagcuccagcggcucaacagcugugagaccaaguccagcaccagcagcucccagaagaccaccccugaugcaucugaaagcugcccagccccucugacaacguggcgccagaagagggagcagaguccaggcaggcacagcaaggacccugccagccugcuggcuucugagcuggugcagcugcacaugcagcuggaggaaaagcgcagagcuauugaagcccagaagaaaaagauggaggcgcuguccgcacggcagcgucugaagcugggcaaggcagccuuucugcaugugguaaagaaagggaaggcugauggugccccacagccacugagacccgaacacuucacaaaggaauucacacagcacaauggggaggacuuggaugauggcacuuguaaaacugaaggguuccuugucaaagaagagcagagagaucucagugacgcucaggauguggcauuuguccagcuacauaagcccagggacccagcugcucugcaugauggagagaagcacagaaugauuucuacggcccuccucgaggauaguguuggugagguagaugugaacgagugugaccuguccauugagaagcucaaugagaccaucaguacauugcagcaggcuauacugaagaucucccagcagcaagagcagcuucucaugaagucccccacagugccaacaccgggcacuaaaaauaacugccaggaccaaaaaauaaaggccccaguccacuuuguugagccacucucuccaacuggcgugccuggccaccgcaaaccaccacggcuuggccagggccggaauucccgcucaggaaggccggcugaacugaagguuccaaaagacaggcagcaggguuguucucggagcaaaaccccaacacccaguguggagacacucccacagucaaggucuuuaccuccaaguacccauccacggucacccuccgacccaggcggggaacucccugagaagugucucuucgacaguuauaggcuccaugaugagaguaaccaucggacauuuguucuguccucuugcaaagaugcaaacauuguaucagaacaggugaacuuuaaagagggucuagauacaagugugaaagaggcagggcugagcuccucuaccaucacaggcaaagaacauacuccaguggaagagccgcugaggagcaaggccagccucauugagguagaccucucugaccugaaggccccugaugaggauggagaggugguuggccaugagagcucgguggagcuugguggagauagugaccagaagccugggguugguuucuucuucaagguaaguuggaauuguauugaaguguagucauauugccuuaguuguaaggcuaucucacgaacuucuguucuaagcagguuccauaacaagcuggagaagaaacauguuugacuuugugggcuacggaagccuccauuuugaggauauacccaaucagauguagucucaggcagugcauccuagaaccugauacuuuuaaugagccaugaauacuuuauuuuuggauggcuuuuuggucacugaaaaauguaaaaagugcucagaauuugaacguuguacaaagacauccaagccagauauggccuggccuguaugcuucaauuugccaaccccugguauggaaaccuggcagcagagaagcuuugaaaugccuuuguuucucugccaugcagagaugauaagaaguauggccucuaggguuucucuucuugaucauaucuguuuucuccugaccacaugcuauagucucagccuuauaagaugcacguuuuauugacauuuguagagugaguguguguguguguguguguguguguguguguguguguguguguguguguguguguaaaaagccugaggcugacaaugggugucuuacuuuauugcucuccaccuuauguauuagacaagagcggauggguucagggugauguggccauagaccaccuucuauagucuauaggaggcaagguguccuguagaaccuggaguuuaucauuucaauuagccuggcaagcaaguuuguuccacggacucccugucucuacuuuucauauacugggauuacacaaggcugucuuuccuaucuagcuuuuugugaguucuggggaucugaacucggguccuuaugcuuuccaggcagagguuucucugcugagccgccaccucauucccagucauacuuuguaugguaugauuguagucacaugguguuagcugagauguggagaaauguguggcuuuguagggaaacugaauuuguugcaggucaucuaauaggcuguuuugguggcauggacuuuuuuuuucccauuugugucacagcuuauuaauuaaaaagaaucagaacugggcaugguggugcauaccuuuggcaagcagagguaaacauaccucugaaccuaaggccagguuggucugcaaagagaguucuaggauauccagggcgagcuacaaugaagucagauuuucuaaguguauguuaaaguccauacuugaucaggguaagccuagguuggauaguaaggaguuccuuuguacuuccacugacuacaaaguaaugugggcuuuguaggaugaacagaaagcagaagaugagcuugcuaagaagcgggcagccuuccuuuugaaacagcagcgcaaggcugaagaggcucgugcgcgcaagcagcagcuggaggcagaaguggagcucaagcgagaugaagcccgguaaccucuuccucagcagccuucguuugucuguguccaguugggcagccuagauguagagguagacaggaccaggcugguacaucacaggggcuagcaucucacagcucuugacucccuccucguucuugcuguuggacguuggcauucacuagccacaacaguacacauccguguggcucucaugccaggcucacaucagcccuaugcguucacucccugugcgcucacuccccauuguaaugaugaggcugccgcaugcagcacaggggauacgaugucugugguccagagaguuuaccaggugauucaguccuaaccugccccuuaaacucccauaguucccaggaaucuacagaaagaaccacagagagggaucuuagagagugggucugguacguuuguccuuaggaagagaaccucugacccagucucaugaauccauuuuguucuuaggcguaaggcugaagaggaucgacuacggaaggaggaggagaaggcaaggcgagagcucauuaaacaggaauacuuacggaggaagcagcagcaggccuuggaggagcaaggacuuggcaaaccuaaaucaaagccuaaaaagccucggccaaagucaguucaccgggaagagucuuacagcgacucuggcaccaagugcucuucuacccguaagugcccagccccagccccagccccagccgugugccaugcuugcugcucagugcugagugcuuuaucucacugggagagggugcaggggaggggccaucccuuaaacaggcuuaaggggcugagaccaaaugugauguuccaagauggcaagggacagccaggguuugggcagagaauuaauuguuggggguuguagagggaagcuccaucacaguguguuaggauggcagggaugggccugguaaacuucuucacaguuugccaauuucuuguuccuacagcagauaacuugagccaaacucacucuggcuccagccuauccuuggcaucugcagcaacaacagaaccugagaguguuuauucggggggcacaccuucucaccgguaaggaggcuaagaagcuaugaaguaucucagcgcuuguacagagcaggagagccuuccagaucgagagacacuuuauaacuagauccacaacguuuaggagaaaacccagcccaccccuaccagggcuaaguggcuuuuaugacaucgucccucauucuuucuccaugaccucccugucaaaagugugcacuucuuguugcauaggaguaagugggugacacuuagccccauuaccugcauacuucagugaguaacucaguacauugcuugucaaaccgucaucuggcacagccuuaagugugaaugucuuucuugggcuauggggucuggcagggaccaaugcuuucgggcuaccagaucauuuaaagugguauuuuucauuuucuaccagguauuaaaacccccucuuuguguuacaaaguaauuuuacaggugcuguggguaccuguuguggcaucaaugaauucuuaauguagcuuuagcugggagcuccuacaugguguugacuucugguagcuggggcuucauuugaguggcaucuugugaaugcugucuguggagaggagcuuucauuccuccuugaugucuagugggguuuugucuccuggacucuggaagacuccuaggcagccuugaauggugcuucuuuuaguuuuguuuugggaguugguugucuagcuagauucuacuccaucccugacaguucaccgagagagugaccuucuacacaguuuucacaggcuuuggccuugguaguuacuguucaugauccagcaucccugcauguacagccccaaccugcuaggagucagagaguagcugaggcaugcauagguuuuuagauuagccccauuucagccccuccuucccuaggucucaucccuugcuugguggauguuagucuccuguacuugguccucuguaccugagccagcgucagucauucccugcacucauggugacacccucuggcagugguugacaaaggcucaccaaaucuucuaccuucacauaaaggcccugccuguugcagcugugggcaugcaucuugcccugaauguaugguugucauggagaaguaggagaacugcagcuugagcacccugucuuuuucugccugcagaguugaaucacuggaagcuuuaccuauccugagccgcaaccccagucggagcacagaccgagacugggagacugcaucagcagcuuccucuuuggccucuguggcugaguacacagguaacagccacacaacaucuuuaggguauauugcccacagaggcacuuggguauagauagcacucuuuaaaauauaucuuuauuuuggccuaaaauguuuuguuuuauuuuuuuuuaauucaauauauacucagugucagagcuaucucuaacugcuggcuguccacagcagggacacagcagagacccugaucuuaucucuauuugucccgugggcaauaauaacuccuuacucuuuugagagcagagauaaagcaggaucauacauccuggucacuuuccgguuucuggguuuguaauuuguauaguaaagagacucaggucagaaaguagcaacaaguacuuuaauuuuuuuuuuuuuaaauucuucugaguagauuagaagaggucuuuauggucuguuuucagaaaugcauaauuguauuuuguuucugagaaaaguguugcucuuuuguguguauuuguggcuuguuguuaauaauuuugcaauuuuugaucugguuuucuuagguccuaaacucuuuaaggagcccaguagcaaaucaaacaaaccaauuauucacaaugccaucucccacugcugucuggcuggaaaagugaaugagccucacaagaauucaauauuggaggcaagugucaaauuuuauggugguuauacauagaauaaaaauaaauucuguuagccuuugcuguuaaugccagagguauguucucuucuguuauuuuaagcuacccuguuacugaauagccauggagucuuuuucuccuaauuaucaaguagagggguguguguccugaagcaugaacacagaauucucuguaggguuaugggagaccccauagaagaacaggauuuugucagaaagguggauuacuaauucaguuaaugguuucauuugguucagagcuagacauagaagauaagagguauccucuucagccguucaugguagguauggcgugcuggccaugcgagggccaggaccugguccagugggccacauuccuggggggagaggagacuguuucuguggcuauagaugugacuuguuucuguuuuuauuuucuggugcugacaguggaacacagagccuaaugcauauauaguagacaaguaccgugccacccagcaacccacuuuguccccagaguagaguagauauuuuuaaauggcagugcacuugagacagaaaagaggcaggugacucugcuguccugcuagugagugcccauggcugaaggcagaaguuagaagggugggccuuggaggcacuuugggcaccugagucaccaagaacugaaaaguugggucagguggaaaacuacucgucuuuccugugucaguugucacuuccuugaggcuguuugugucugcugguuugcugcuuugugucugcucaugccuauaaugucagcauuuaagagacugaggcaggaggauuccuaugagauugaagcuagcuuggacuauaguauaagacucucaaaaaaagagagagagagagaacaagaaaagaugagagauguuaguagccuuucaaguucaagagucuggagacaguuagaaagugagggucaaaguuaggguuugacaugcucuucacaauugggaacugugaguaugugugcugggagggaggccacauccgcacagugaaugcuuagaguguguguauuggugagcccugugcaguggccuagggaggacugcagccagcauaauaugcugcaucuucagcaguagggucuuaccgucuagugagaguaugcagccaaggacaauggcaggauucuaucuauguuugggggccuuuggccuccuuguaaggaacuauuccaugcuugacacugaggucuguuguuuuaauaacacaggguuuccugggaggaacuuugcagggcaucuccacuccuuuaaaauuccucuuaaaauuuuuuauauuuuaauaaaguuagaaauuaguggguuuccauaagacuuugcuauacauccuuuauauuauuauuauuauuauuguuguuguuuuguuuuguuuuauuucuuuuaaaaauauuuauuuuuauuuuauauguuauggauauuuugccuguuuguaugucugggcaccgugugaccagaagaagguguuggauccucuagaacuggaauuacagauggucgugagcuaccaugaggugccaggaguugaacuccauccucugaaagagcaggaagugcuuuuaagugcugaaccuucucuccagccccuguguguguguguguguguguguguguguguguguguguguuucuuauuuuuuaacucaacuguauucuuucacaugguaccuagucagccauguaaaacuuaauuccaaacucuaaagggaaggcagaguuaaugugauggucagccagcucaguacaaggagccuuccugucagccauugauuuggacacccaggaaguuaaguaccagcuuccuuacagagccacacuccaggaaaugggugagggacccugauacacaacagcugccaugccugcagguggcgcucuucuuccugaccagagcucauucagccauguuuaaacaccguucauauagguuaggucaguauuguauacagacuuaguuuucuuuuucuauuuaauuuuuuacauuuguagguugauaguggcuggagagagaucucaaugguuaagagcacuggcugcacuucuagaagcugggguuugacucuuaggcccaccuggcaggucaccaccgucuguaacucuaauacuaggggcaccacugcccucuucuggcuuucaugugguacacagacaaacauguaggcaaaacauucugggucagugagguggcucagcaaauacugacagcaugaguuugauccucggaacacaugcguagcugaaaggggagaaccaguuuaaaaaguuguccucugaccuacacacguguacccuuuccaucauacacauguacauacuacaaaggauagacaauaauaagcccauuacauuacacuggcaaaaucaaauguuuuggaaauugucucuucugaagcaaagauaagccauuguuuuauauuuuuauaacucuuaaauuuucggcuuuaugggcgagaacugggaccuccuuuuggucuggcacacccugcuuuuuggguggccucagagucucuuuugcacucacuggagaugguaggcugagauuauaacacugcagucugaugccaggaaaguucaggagcccccaccauacucaggaacugcugauaccgagaguuuauguggaggagugcacaauguaggacuguauucucacacacugcauagcaaagccugguagcaacgucaauagguuguuggcugcagguucuuucuugguaauagcuuuauuagagugggaugugguggcacaugccauuggucccagcacucaggaagcagaggcagggagaucucuggguuuaaggcccaccuggucuacagagugaguucuaagacagccagggcuacacagagaacccugucuuggcuggagggggagggguaaaaucuagacuuuaguucacaaaugcuacccuuugaaagccaucacucaguagguuucuguguauuuaguucagucacuggucuacaugcggucugucuccuuggauguccuuauucuugacuuugcauauagaaggaagacucagacauguaaguggccaugguagucaggacuuggagagaguguggucacaggaugucauuugguacagugugaugagccgcagacaguuuucgcaguuuccuugagaacagacuccacguccacuguggagagcagcugacuacaucauuucauaucugcccucauagucuucuuuauuuuagcauucauugugaacuggugcucacuugguuuugauuuacguuucuccacagcauggagcugugaagcaucuuuuuauaugauuccucaguuugucucagcagcauuuuuccuugcuugcucagagucuuuaguaaaaucucauuggccagccauagcuuuuuugaguggggaggcugugcugaaccuguuuugucugucuuaaaagaggauguuuauuggacccuuacugccuuggaacaauaccuacccauuggacaacaaugggaaucuaggguguaagagugacauucaguguuuuccaucucuuccuacuccccaggagcuggagaagugugaugccaaccacuauauuauucuguuccgagaugcgggcugccaguucagggcacuuuacugcuaccaacccgacacugaagaaaucuacaaacucacuggcacggggccaaaaagcaucaccaagaagaugauugacaaacuauauaaauacagcucagaccgaaagcaguuuaaccugaucccagccaagaccaugucagucagcguggaugcacucacgauccauaaccacuuguggcagcccaagcggcccacggugccaaagaagacccagacucguaagugaccauggcaaccaggacucugagagguugugcugacgggaucccuauuuauuauuuucaucuacuugguacgaaguugaugagccauggacaguuuucuacagcgguuccuagagaacagagaagaugcucucuccccugcacacauggaugcugggcaugacauaugcaggagugaguccugugcuuucaugggcauggcugcuguggcccugcugaccacugagauccucagaauaagggacaccauggagugagauccuggccugugggccccucacuugaaguucuucagaauaaguuaaaugugaucugcucucuggccucccuucaccccugugcacauugccugaugccccauguuggccagcuguaaucgugcgugauuauagggccaaggcucauucgggucaggguguuugaaugucuucauaaaaggaguucguaugggaaaucuuuuucauuuuagaaauuguauaauauuuauugacugugucuacugccaaccuuuauauccaguucuaagauucugaaaaaaagaaaagaaaaaaaaaaaccuguuccuugcugcucagaaaaaguuuacugaaaaugucaguucacuaaaagcacugaaaucgguaaaguuugucuucugcuaaaaugacguuuacauauguggagugaguauuucugccacacaguugggggcuguggguacugcuagcugaugcuggccucauuggaagccggcagcuaagccggcuuagccaccacugguuaggucuggggaaugugcuggcauguucacucugauaaaggcagauuuugguauaguagcguacuuuccacccuuggcugccgguuccuuuguggugcugugaaggccuggcuuaccuaccacgguucuugcuucuggaggaacagcgugcucagugcagugugcagucucaggugagguggguaauucugcuuuuugccucuuuuaaaacuuggugguuauuugcgguuauuucagaaugguguagcugcuuugggucucuuccccgcuggccccuguggcagcugccugccucagaacaggcguuccuggggagcagaggugccccagcgauggaucagcuaugugaagacccuggagccacuuguaguuuugcacauuucuuuuugagaguguuacuugaaucugucuuaacugcaggagagacuugaagaucauagagggaacucagacaucuuaguguuagcgcuagcagugucauguagacagaggaaaggagcaugggacagaacgccggaggcgugaggcgaggucuugucuucucuuccuuggugacuguguauccagucagggguggcgcugugcuguaugagcauuaaagucuguggccaccugucacuggaugcccugugugucuucauuucucacugugcacuugauguuaccauauuuauuuuaagagagcacuaaaauauaauaaaguaaugagcuggcuuucuguuaaccaugugugugguugucacaacuccuucugcugacagugucccacaucuucuggcuucagggcagcugcgcaugacuuuuggguuaccuaggaauuuauuuuucaugaagaguuggaagaccugguguagagcaggaaguugcauuucugcucgacuuuuaauacggugacuuggcauguggccuguccugaaggcugucucagaacgcagggucugcaugugaaguacagugccagugucucaaggccgggcuguggaggccauguggcuugauggcucagaagcacucgugccuucuguguuccaugacacagaaguaguuuugauuuuuuuuuuaauuaggaaguuuccgguacaggauuuugugguggugaucuggagccuccaggguguggguacacugucuugaccaacugugcugggaaggcuacucagcuuuucgggcagaaagugccaagaaauugaauacaugacgacucaugcagcucauuccuuaguaacaacagacccccccgaggagcccaggucgguuggcauuaaaaauauuucucagccgggcggugguggcgcacgccuuuaauccaagcacuugggaggcagagacaggcggauuucugaguuugaggccagccugaucuacaaagugaguuccaggacagccaggacuacacagagaaacccugucucgaaaaaauaaaaaaaaaaaaucucagaacuagaugugcaggucuacaugucugugucgaugugggauguaccugugugugcguauaugaguaugugcacacaaacaugugcauauggccuguguacacguguguaugcaugccaaagauagcguuuccagugugaccuuuugaccugguauucucgguguguuccugcaauacaaucuccaaucagacuuuuaaggcccagacugcuucaggcaacauugaaaaguggcauaauacaaaauuuacuucuagauuguuugaaacuaugguuguuacuuggaagaagaaaguguuaaaaguccauuuuucuuguugaaaguuaaucaacuugaguaaaccuuuauagauuggugcugguuuaccuagugaaauggcuuugaucuugguuaccugagccuauuggugauuucauucuaucuguguccaguaccacauguguaaagccaguucuaacuccuguuuugugacuauggccaagucacaagccccaacugggaacgagccaugcccagcauccucuuguuucucacugauuccuuggcaauaaacuuguaccuugcugacucagggucuuccuggugucugaggugcacucuggaggugcuuuugguaucugguaucacugguguucugagcuuuguguugcugugauaaaugaaaaccauaauaaaagccacgaccaaauacaac

SEQ ID NO: 698 - RNA, 3716 nt, Mus musculus
uccaucagcacauuaaaaaaauagguuuaaugcaggugauuccucucauaaagaauuuaacaggcacucaggacacuaggcagcugggugugcacugagugacaaggucccaucauucccucccaccaccagcccugacacacccaccaucacccagcaaaauggggcuucaggccacucugagauacaugagcuaauuaacaaagaacaauguugcuuugggggaagagugggguuuagugcaaacaauucucugcagcaagcgagcagcagcaggguccacugggaaggcaccucaucugcuauccugggaggcagacagacuuccuccaugagcccucuugccagaccaacgacgacagcuggcuacaaguuaaagagcuaggucaauaguccuacaucuuuguuuucccuguuugguuuucuuggcaggguaggguuaaaggggccacucccaugcccaggauguggggugacaauggggggugaagcaugugguagcaggauaugcucaauguccugcacccagaguuacugcucaaaccacuucauuugccaccuaggcccuugucaccagugagagucauauucccaccccugauagaggccaaagguggucagguacuccaucuucuaucucacaaaccaggccuaacaacauguggggaagguguagcuagcacauccaggcugcccacaggacuaguaaaaaccacugaggggggacagucgguuuauucccguuuucuacagaucuggccaagacucugggaggcugcuggagaccccaucccucagagacuguaaaaacuccccagguuaagcacaaguguuuuucuaggcccuuucaguuugcagaguuccagcauggcuugacacacagaccugcccaggguguggaccagcccccugcucuggaguucaagccuuggggccugugcucccuuguaccagggucuagccaaugccauauaugcuguucugcuaaacugcaccuaugcaaaccaaggugacucugaggccugacuugggguucaagacugacacggcuacuugugaacagcagagagugguccaugggcucaaagugggcgcaguuaguggcaguaguaugucugcuuguauagccaggugggucccugaggacagccaggaggagggcacauaaaggggcugugcagcccaaaggcaccccuuugugucccacugggugggccugauguuggugagaaugucacacagaaggucucaagguggaaaaaagacagacaggccacccacuggacaaccugaaaacacacaggcaacccaaggcaagaggcuaacggggacagcacaucugguaacgugcacagcaaggacagcgcagaagccaacagcgagacugugugcuguucccauuacagaguagucucagcccuuuucuccccucaaugggagugugugcuucaggccuuaccuccaggauggggcaaaaaaaaaaaaaaaaaaaaaaaaaaaaaagccccuaccagccccacccuccaagagagaagcuagguauggcacaaucaggagccccauggagggugggcccucacauguccacaaagaccaugaagcaccagcccagccccccaaccagcagcauggucacauggaugccauagauaagcagcucguucaugaggcggaaguccacgcgccugcgccccagcagcagcagcagcacugacagcuugagcuggaagcgcagcaguacgcggacacccagguacuguaggcagaagagcgcggccagcgcgccccaaagggccgcugugaagaggcugcagcugaaguagagcaggaagcguauaaagccauagagccagcgggucuugacauaaacaucgaaguuguuguacuuggugcgagccaggugagagguucucagcgguccgcaggcugcgugcaggcagguggugugcgggccguggaaggagcgcacccgccgcgggaugggcaugaccggcauugggccugggcggcagugcuguuuugcaguggcggugcaguguccggauggccagcauaggugucaucagcgucuaggagcccucagcugagccuugggggaggugcuggccugcagggagaaauacagaaugccaggugagagcucaagggugucccugucaguaacucaguugcaacccaaggaugcacuuuugacucuuuucaugaguccucagccugugcaggccaaugguuaacauucuaccucccagugcugggagaggaaagcaacaguaacuaugccccucagcagccgccggccgggagagggucccuaggacugccagggauaaaacggggacaguagugcucuagcuaagcucacucuuuaguuucuugaagacccacacacccggcuacugguugcccaguacuccccauuacuuccauagugacuuauaacaguccccuucaaggacacuccaugcagagucacaagaggacugggaugaaggggguguccacauagcaagccccuaagguuacuugcugggccugaacuuuggcauuauuuuggcagguuaccaucucaccucccacugaucuugcuccguaaauugaggcaccaagaccucuucccuggggcugccuguacacaacaaaagcauuacuggcuuaucuaggcuggacauagugucagaguucuccaaacugggacacagagaggagaaauggcgugugguuccuuguuucaccaagcaauugucauucgcagcagccuauguuaauuugcauaugggggaaaaaaaacacuaaauuucaaacuaugggacacuagagaccaaaaguugguaacaggacagggcaacaucgccaacaggcuuuugcgacuuccacuccaacggcuucugucaccgccguagguccugagcaaauggccgccagcgcagcugcggccgaggcgcagugggaggaaaccugucccgagccggggaggcuuagcuauguuuuacccagcuagacagggcaauggccucauucaggcgugucacuggacaccgcacaggagggggaugcggucugcagcagguguacucggguggaggugcaugccauggcgcggcccggcgcggggcacgcgucucugagcacgggacccuagagcaggacauccagcucuccaaggcccgcuaacucggcgcguggagauacgacccucacuagccauaggcuacgcgcgaccccggcccucagcccgcguuuucugcgggcgccacuuccggugucggggcgccguugccguggagacggcccuuagguccguggccgguccccgcccguccucggcggcucacccggugcccucuccguggcggugccgguguccggaaccaugcggcgggccgacggugcuggggaccgggccugcggcugagcuugugccccgggggugcgacgccaaggcgggcacaugccgccgaggacggggucgcuucgcgcggcccuucaguugcccccggcuggcucuggcccggaggggagggcgcucccgggccgggcccgaggcguuugucccagcgugggagccguaguguugucccucggcggccaccguagcacggucuucacgcccccuccgcccgcgacgacacggugaagccucgcagcgcccaccgcgggcccgcgcggagcauccaggaauuccucauuauccgaggacgcgcacuagcgugcgcgcg

SEQ ID NO: 699 - RNA, 1000 nt, Mus musculus
uacgcggacacccagguacuguaggcagaagagcgcggccagcgcgccccaaagggccgcugugaagaggcugcagcugaaguagagcaggaagcguauaaagccauagagccagcgggucuugacauaaacaucgaaguuguuguacuuggugcgagccaggugagagguucucagcgguccgcaggcugcgugcaggcagguggugugcgggccguggaaggagcgcacccgccgcgggaugggcaugaccggcauugggccugggcggcagugcuguuuugcaguggcggugcaguguccggauggccagcauaggugucaucagcgucuaggagcccucagcugagccuugggggaggugcuggccugcagggagaaauacagaaugccaggugagagcucaagggugucccugucaguaacucaguugcaacccaaggaugcacuuuugacucuuuucaugaguccucagccugugcaggccaaugguuaacauucuaccucccagugcugggagaggaaagcaacaguaacuaugccccucagcagccgccggccgggagagggucccuaggacugccagggauaaaacggggacaguagugcucuagcuaagcucacucuuuaguuucuugaagacccacacacccggcuacugguugcccaguacuccccauuacuuccauagugacuuauaacaguccccuucaaggacacuccaugcagagucacaagaggacugggaugaaggggguguccacauagcaagccccuaagguuacuugcugggccugaacuuuggcauuauuuuggcagguuaccaucucaccucccacugaucuugcuccguaaauugaggcaccaagaccucuucccuggggcugccuguacacaacaaaagcauuacuggcuuaucuaggcuggacauagugucagaguucuccaaacugggacacagagaggagaaauggcgugugguuccuuguuucaccaagca

SEQ ID NO: 700 - RNA, 3995 nt, Mus musculus
cgaagagggccgcuuccggccgcugcgcccguuaccaaaauggucgacgcagcuucacggggcggugcaagaaaagguggcuaaggauucgcaggcgggauguugcggacagcgcugagccgcaugccgacacuacuucguagugugcggacccgggauuccggaccgcggcggcuuugggauuugggggcucgccuaaagaccgcggagagacuucggggcugggccuggggcugggccucgggcuggcggagcucgagcuccgcgccgggaucagggcgugcggcggcgcuggggcgcguggaagcggaccacuaucaacucgucuacaccugcaaggugggcgcugucggcaacaccuggugcuggcugguuuccuguugguguaggguccuggcagaaacguggaaguauccuucggaccagggaggaggcggagucuuuacaaauggcugggugggaaugaggcacagggccuucuagguuggguuaucaggagacaggcgucuagaaaugacgccgucgccuaggugggaucaucagagaaaggguugaggcugucccucgggauggaguuagaccuugggagagacuuuccuguguaugccuugccugaccaccucucuaacccagcuaggucugugggacucggucauccaagcgcaucucaaaguuggccuaucaccagggcguggucaucgugacuugcccugguugccagaaccaccacaucaucgcagacaaccuaagcugguucucugaccugaaggggaagaggugaggccagcugggagggguaggagacaguaagauuguggcccugugugagccuggauccauugccuggaucucucuaccuggacagcccagcuuccacguggaccuggaagcaguugaauuugaacuucagaugaaccaugaauggccccaaauauggcaaacuaguucuauggcucuaccucugucacugccugaccucugaucucgccaggggccuuaucaaucucuaguggaggcuuuuuguccucugccaacucagggcagauggaaggguaugugucagauuauggacuggggcagccuucagugguguucccacuuuugggagagcaguggggagggccaggagucaguuuggaggcugugccugaugccuucuuaauguucuaugaggagggaucaguggcaggaguaagggcagagccacagaggagauagccugugauaagugugcaggccuugggucucuaggguucgccucuuagaccuggacugcagagaaaucucagcucugauauguagggacaagacugaaaugcagggauggguguuaccuggugagaggcagggccacggcccuuggugguacacuguacgagagagauggcuucugaggacuuguuaacagauacauuuggugaaggugccauuaggugccugcaagguacuggugucacuuggaugcugggacaaguguuccaggcccaagaugaccaugggaugcccuugagggagcccagaguaaggcugaugcugcucuuacugucuugcaggaauauugaagagauccuagcagccagaggagaggagguacgccgagugucuggugacggugcccuggaacugauucuggaggcugcuguacccccugacaccccagaaggggaugaggauccccccaacccuggcaagaugggacagagcugaucugcauacuccuacagcugcagacuccagucuucccaaaagucgcucccuucacuuggagccucacaagccugcugcuguuccuugucaguaaaaagccaucaccuccaggcaccgggccugggcuccuguuuuucucuugugaagucagaacaacucuguggcuguaggagcccagccucaugcccacccaugauagccacagugguggcuucggggguggcuuugucccagugcagucggucuccuucuuaaguagggcuggaucuggucuugaguuaggcucguggccucaggugguuuuuuguuccucagagcucuuuacuucuuccuucuauaugaccugccuccacccccaccccacccccagcccugguggcuucuguuguugagcuaguguccagcccagcccugagguuugguuucuguagcagaacuggcugcucuggguggccgccgaggagcagagcgcugcucagaggcuuaggggagugauccaggcagaggcacaccacacacacacacacacacacacacacacacacacaccacaccacccaugagcugccugcaccucucaauccuccugucuugagguccaagaggagaugcauggaagugaugagggccguaucaugcuugccuugugugugcuucaucuccuaacuugguuugacaugccuuugggauagucuuguguuuaggaagucaagcagaugcacaaacaggcuuuuugugggaguuucugggcccugugaccuucaacaucuggcaggggggauccugggacaggggguggagaaggcaguugacacggacacaaugcuucccuggcuccugggaccccagcuagugauuagcaguucacucugggcccugggaggccgggugcacuugcagucugugccuucccucgauuacccccuguccuucccucagcaaacacccugcuauuauccccacccuagccuccugugccauuuguacaaacugucacauccuggaggaagagccagccuccgacuccagccugcucccuguggaggacaccgaggucagaggagccgauugccuugcuugugggccuucaagucaggaaccaguggagccuggcugggcugccucguccucaggugucugggccagaguugucggaggccuggggcuggcuagaccugacaguacagagcuggaucuagcguaucuccucuagaugggaagcccaugauuuggacuuaccuccugugugugugugccuucugccuguugcugcuccagagccuccuucccagggagggucuccugugcaucaggauuucacuugaagcuucacuuuccacauaguccauucuugcagaguccauaccucaccguguucugcagacucaccacgggccacaguucccaaucauguggccagguuccugacagccuggaauuguucugacuaguuuaguucuccauuccuuccucccuuucaguggagacuaaguaaaguaccaccccaacaucacagcaccucuuggccagaccagcgugacuccugugggguggcuuggcucucucaauacauccccuucccauggcagccaucucuggcagcuggccucccggcaccugagcaauuucagccugcccagaagcguggcugccucuagagcaaccacagugcucuagacgauagagaauucucuaggcuauuuuacuggucuuagcuauguucugcuacccuuggcccaucaggacacuccccaaagggcccaaucaggaucugaguuacauggggugcugcccacuacaugaacauugaagacaaguuccucuguggcuuagauuggcauaauccagcgcuuguaaugggaacugcuaagacauaggaagcucuggggcuggguccaauccagucgggggcggggaggcugcuuggaagggcuaguccugaguguuuaccaauguacugugacaucccuggcuucuguuuccugucucuggaaagucagcauaauggagaacagcagagaaagcagcaguagcggcucuggccccgccucucacugucgcaugcagcagagacaugcugcaugaucucaggggccuuguacacugcacuggguaagccaauaccauguccugggaaggcugacacaaauuccaacagaagccacacucacuuggcagacuuuuauuuuuggguaaaacaaaacaaauguaccucucgggucagaaaggacccaugaacaacauggcaaacacauguaagcaauaaauacgcauguacauucaaguau

SEQ ID NO: 701 - RNA, 17892 nt, Mus musculus
cuuccggugcaagccuacugacuuccgcgacugcuagaagcaugaucugcguguggucgcccgggcgaugaugccagcugugaaguuuggaagggaugccuagaaggugaggauuggcgggcggcagguagcaggcguuguguccaggaggggcagggcagccagcacggggaaaccgaggcguggcguggccgcgacauugcuggaguggagagcccgcguccggagcccagccgagguccccuagcuggugagaugcaggaccggauuugcuccgugcugugcuccgaaccgcugcucuaaccgguugcaugcgcugcagcaccaccggccaccccuggcuuaucgaauccagccacuaagggugcauuggaccccaacugccuugcccgguuaggccuuagaagggacaggcagcaaagugucucugaugucauuaaaggcggaccguggcucccagcucaggacuugaaaacgugacuuuuucuuccuuuaugugggcgaugcugugggaggagauggaauugcugcugccucaaaacacguuacucuuucguugguggccaagcauccaguggcaaugauuauugcuacaucuguagaucccgcuguuucuagccaaguugguugacaaacguucccuguauaaguaauuggaaugucguugaaggggauuuuguuuuguuuuguuguagucaguuaagacugcugucaacaacuuaguaggaagaaaucaaacaggauguuuuucuucauuucuggcucugggugugaaaauguguuugauaauuuuguuugaaacaguaucucacuaaugguuugaaaugcagagauccacuuaguuaugccccccaagugcugggauuuaaauuaugugccaucacacucagcucuuuguuucuuuauuuugguuuuugguuuuuuggguuuuuuuuuuuuuuuuuuuuuuugggcgggggggggggggguggauuuuccgagacaggguuucucuguauagcccugguuguccuggaacucacuuugcagaccaggcgggccucgaacucagaaauccgccugccucugccucccaagugcugggauuaaaggccuuugccaccacgcccggcucuuuauuuuguuuuugaagacaguuucuuuuagagcucuggcugaccuggaacucacucuguagaccaagcuggccucaaacucagagaucccccugccucugccuccugauuccugggauuaaagacgugugucacuauacccgacuucuacacccagcuuuuuacaguuauuauacuuguuuauuuccuuguguguagguagaugugccauagugggggaggucugagggaaagcuggaguagggucucuucaccauugauuacugguccugaauucagguccuuaggccugguagcaagugccuuuguauggugugccaucucacccaccugagcuuguguuuucuagaaucaucuuucacacuucucuuccaaauuuccuuugcccucagacuuugcuuacaguguaccagagaaaaagccuccuuuguacuuuagcagacacuuguucaguaucagacaacaccauaugccagguaguguucugaaaagauaggucauggaguaagcuaagccuuacucugacuuacuagccagucagcacuguguagagcggggcaccucuuuauagguuuggaucacagggggugaaugucuguugcucugcacuuucugcacuuggugaccaacugagcaccuuggggcacagagacaaguguuuuuaccugugcuggugguggccucagggagaguagggucauuucuagguguugagucaagagcagaaguccuggguaugaaaagagugucauaacuugugggacuuuaacccuaagcugauugccaucuggauagucuauugucugcauuugaacaggcucuugccaccuccagcaagugugugucugaaagagaacgagacccaggcacacucaauuucucauguuuucuaacauucugaaggcaggcugaagccauggacauagacgccgaacgagagaaaauaacacaggagauccaggagcuugaaaggauuuuguauccuggauccaccagcguccacuuugaagucucugaauccagucucaguucagacucugaagcaggugugcccaugaaccuggccuagcacggcauggcuggaacggcuguguguacccuuuagcuaaauuaggcuguggacuguuccauggucagacucuguuucuugcccaaacugucuucuacuuucaccucaguaagaaaguuuguuucaguuucuuagucuuagcugucagggcugcugacuauuuguguauaaccaccccugcugccaucuagccugggacccucuaagcaauggugaauccugguggggagaagaggacccagagcucagccuaucaacuugaauagucuccauggcccagauacacagaauuucgucccugagcacuccagugagacccuguuauaaguguucauuuuugucuauagcauacucuugcuccccaugcucccacuccaauagagugugcuuguguuucuuacagauucgcugccugaugaggacuuggaaacugcuggugcccccaucuugguaauuguugcuuaccaggccaggcugcugggucauaccuguuaacuaccuuccaaacuggccuaagaggacuuugcaugccugugggauuuucuacaauuaauguuauuuacugugaaaauaaggcaucacaaaguauuuacuuauuuuuauggugcuagagauggaauccagggucucauucacacuaggcucacacucuaccacuaagcuauaccccuaaacacaaauuauuaucaaaacuaaaguuuauccauagaagugaaguaacucuaacagacuggugacuauagcugcuggcuuuuccugagcucacagucaaaacaucagaugugagaggcagcauaccugggaccugcuucacagcuaacccucugugucucaguuucccguucuagaugguagucaucauggauggcuuaggaaagcaucuggcagagauuagucaugccagcguugcuagccaugcuuuguucguuuugcuuacuuccucaccaaacaagcaaguauggagucccauuaguguuuaaggaccaugugucugcucaauagacuaacacagcucuggagucguuggacauuuggcguucuuggagguuugacccugauugcuauuccgggaauuuccuugcugagaucugacacuugagguguuccggaugggaacacaaacuugcugugaaguucaggcuccaaagagaugucuguuauaaaaauggaagcugccugcuaugguauaccaacucccaaccccagcauacauuuuacaagcagaucucauguugguuuggaaagaugcccacucucuagcuugaggaugaugggcucuguauaacuucucccuccuuccaguaugguuccacacucagugaguguauacuagggcuuccucagcucccucucaugggcuuaggcuugagcuuggcaacaggagagggcugccuguuuccuguucuuccugcuccauuucuggcuccuaacuaggaagaggaagggucgagugagagcagcaaugaugaggaggaccccaaggacaaagcucucccugaagaccccgagaccugucugcagcuaaauauggucuaccaggaggugauccgggaaaagcuagcagagguuagccaguugcuagcccagaaccaggagcagcagguaagaugaccuacucaauaccuguauaaccccucaugacccucagugucccacaggaucaaguucccagagugaaucugcucacccaccuggccuacccucuuucucuaccuggccuacugauggccuugcuuuugucccaggaagagauccuguuugaucugucuggaaccaaaugccccaaggugaaggauggcagaagucugcccucauacauguacauaggccacuuccugaagccauacuucaaggacaagguuacuggaguggugaguaguaaugaacgcucuuagcaguugguugagugucucuucuucaugaguacuugggucuguaggguguguuucccuaaaagaaucacagcguuuaggaagucaguaguauaaaucucaaacugcugaugcccuugugugccugcaucuuccuggagucucaggccgcuuccuuguacugggugggucauguccagaacuuuucaaucaguaguagcuuguaguaguaguaguagucuugggccuggcccuccaucugggcaguacaugaggaggcuggagggaagauucugagucuccguagguacccuggagggugagugugguuggugugucauguuauaacacuguacacucugacaggggccuccugccaacgaagaaacacgggagaaggcuacccagggaaucaaggccuuugaacagcucuuggugaccaaguguaagaguccaggcaggccuuuggaugggcguccuccaaccauggaaaccacagagggcauccccauagccuggccucaucuaggcagaugcuguaauucucgccuauccuuacggcgucauggacuccuucaggacuuuaucacuggggcuguccacuugauacuuucccucuccaguguugaguggguucaggcugagucuagccuuccuucccagcucuagcuauucucagaacaccugacccugaaagaguacccugagcuagcuuuuggguggaagauggguuccugggcuggaagggauucuggcuagccacccuaguggcauccagagacguagccacuaccuuuccggagcagggggcagcagguaggcuagaguuguagagaggauucaguggacauguauguccgugaagcaagcaaaacuuccugacaucacauugcuaucucuuccuccucagggaagcacugggagaaagccuugcucaggaagucuguagugagugaccgccuacaacgucugcuucagcccaaauugcugaaguaagucuggaaacaggccaucagagccuuccccguggugaaaagccaggcagcugugggcugugagguuuauccuagcaugcucuggccuuccccguggugaaaagccaggcagcugugggcugugagguuuauccuagcaugcucuggccuuccccguggugaaaagccaggcagcugugggcugugagguuuauccuagcaugcucugccucucuugcugcucuuucagcacugaugucaguguccauugauggguauauaucacaugaccaaagggcaucauguggugccuaggggaguacacagugaggagcacuguuguuuugauagauugccaccaucaauauugaacacacaagaccaaagguggcuaguagccucaggcccagcccuuagagacauauuagcucuggugcugacaacauuggugcucaauauugauggugggaauggcagaauggcaguuucccugaaguguaagagagccaguucuucccuccaagacaguucuguuuagcugcaaaacuaagucgagauugccugagaugacuguauccuggaagauaagaauuggcaguggguccagacucuuugagauacaagcagcuaccaccugccaguguaaacaacuuggcaacuccugcccugauggugccauucuggugguaagagcaccccagaaguugugccagaucuuccuuggugguaagggaucaaagcaggagagaaagcacauuucugagcaggcuuuccaacacugagcugugaggcuugaacaagagcagcucagagagcggggccucagcuuacacagugcaucucacucacaacucucccccacucuaccugccuugcaggcuggaguacuuacacgaaaaacagagccgagucuccagugaguuggaaaggcaggcccuggagaagcagauuaaggaagcagagaaggagauucaggacaucaaguaagcuggggcugccugcuccugccugggaagagccgcaggccuugcacgauaccagcuccuuguccuuugcuuuagccagcucccagaggaagcauuguuggggaaccggcuagacagccacgacugggagaagauuuccaauauuaacguaagugaggaagaccugggugcccacugcucuaguagugcuuguaagccgaguguggugggaacuagguggggaagccucacugucucuuguaccuuaacccacugugaagucuccaguccaaagaugccugggaguuggagguggcaaaggacuccauuggacucucccuagcugccagggucccacuccugagauaggcagucuucauggccacugaagccacuggcagacagugacaaucaggccaggagcucugucuuggcaucagcagccccucugaaggcuuuguucucauggguguaguuugaaggagcccgcagugcagaggagauccggaaguucuggcagaguucugagcauccaagcaucaguaagcaggaauggagcacagaagaaguagagaggcugaaggccaucgcugccacacauggccaccuggaguggcacuugguugcagaggaacuugggguaaagacuaggaccugggagaccuuagaagggugggaggacaugggcugcugggucagucucaugcucuguaguguggugcacacagcaagcauuacucaugcucuguaguguggugcacacagcaggcauuaggaauuguuugguaaauuugcuuuuaaagaaauuugucucuuucaucuuuuuaacuuuaaauuucauuaugucugugaaaauaucacccuuuaccucaaacucuuggcaccucuccugcuuugggauugggcugggauuaacaccagagcugucuauggccaaguuuucuuucuauaagccauagaguccucucugagcugcuccuguccugggacccaaccauggucuagcaaacuaucaccugguaagagccuggaggaggcaggagaguucugcuguacagagcgcucgcugccuguggcucaggcccaccugucuucuggaagcacuugggucuccuggaagguugugccagguauuucugcacgugcaaggugaagcccaauaaugcccacuuguuucucuauguccuugggaagacaagccgcagugccuuucagugccugcagaaauuccagcaguacaacaaaacccugaaacgcaaggaguggacagaagaggaagaccacaugcucacccagcugguccaagagaugcgaguugggaaccauaucccauaccgcaagaguaagcccaccacauccaauagcaucuuucaguucauugagcugcuccaagcccuaguggccugaggcccuaggugccuggaagcagagacuugcagaagaguuuacaguuauacuagggagaagugggagggggauccuagugacagaguaacucuucucuguagcuucugggaggaccccagucccugcuuauugccucuauaggacagauaaaucccagucuucucuguccccagucgucuacuucauggaagggagagacuccaugcagcugaucuaccguuggaccaagagcuuagaucccagccugaaaaggggauucugggccccagaggaagaugcuguaaguuuggcacccagagaaaacuguucccaggaaguuugacugguucccuggaugcagucauaugcccuccuuagcugagagaccccagggugggaaggguauggcugucccguggagcuucuuucuguuugcuucuuuccugcagaaauugcuucaagcuguugccaaguauggggcgcaggacugguuuaaaauccgggaagaggugccagguaggagcgaugcccaaugcagagaccggugaguugcccgcacuggcugaaggagcgacuugcuugggucacacuucuguaggcaggcuaggugacagugggccaaaguuauaugcccacgggggcuuuucaaaccgggguuggcacuguuaggaagcaggacuuugguauuucuguugcccacaaguugucaaguacuagugaugacucaugcagauguccuuccacauugcuggugggaagguccccagcagagagguucucuccuuuucucccuauuuucuuucagugguuuguucagauguauuuuaguuuaccuacacucagcagcccugcagaaucccauucaaaacaggcagacauuuucaacagacuugucuccagagaugcacaaguaaccagaaggcccauuaaaagaugcucagucacuuauuucaagaaugcaaaucaaaaccacagugaaauauuucgcacauguaggggaauuguuuuaaaacacacacacacacacacacacuaacaaguauuccuggggcacagaucauagccuccagaaaaaccagagcaugggacagcauugugcuggggcaguauagucuguaccugcaaaacucccuugucccaagugucccaggagcuuguauauuagacaagaauguuaauagaacauccuucauugucagaaagaaagugugggguacaaagccggaguguggcauuugcagggaagguccugauaagcgcugugugauacauguggcgccgugggaacauucugaacauuccgucaaauauuuaucaagacaugcucauuucucucaagagcgucuuugggucggugacucuugugcuuggccuuuggaagaacugucaucugugcaaaaugucucuauauugugcucccacaagcagcaugugaggcuuguggcugaagccguccacguguuuguggaauagacuuugacacaguugucucacagcagccccucauggcuaaccguguguacaauugcuuguaccugcuggcuucuuacauguguacaucucuuuggaaaaacaccugucaagucccuuccuagguuuaaauuaccugucuuuggauuacuggcuuuuacauguucaaaaugcaagucccuagucagaugcacuaaucaacggcucuucucucccuucuucacaaggcgccuuacagcagugguucucaccgugugggucucaccgugugggucucaccgugugggucucaccgugugggucucaccaugugguucucaccgugugggccucaccgugugggccucaccgugugggucucaccgugugggucucaagcccuugguagggagguuguugaaugaaccuuucacaggggucgccuaagacacagaaacacagauaauuauauuacaauucauaacaguagcaaaauuaguuaugaaguagcaauaaaaauagcuuuaugguugggagucaucauaucaugaggaacuauauuaaagggucacggcauuaggaagguugagaaccacugccuuaaagcauaaaauucuugaaauguucugggcagugguggcucaugacuaauccuagcauuuaggaagcagaggcaggaggauuucugagaucgaggccagccuggucuacaaagugaguuccaggacagccagggcuacacagagaaaagcugucucgaaccaaaaaaaaaaaaaaaugaugaauuccaucuugucuugguuugcuuugguuuugguuugguuuuugcuuuugcuuuugcuuuugcuuguugugguauuguccuaagaaaucacugagaaggccagagagcagugaagggggucuuagcaccuaaagugucccucuguuuccacacauuuccagcuacaucagaagauuacauuucagcuugaaaaagggacgguggaaugcaaaagaagaacaacagcugauccagcuaauagagaaauaugguguuggugaguugucugucggacaguauuaccugcugcugcugacucugaucauacugcgaauucuugcagcccaucuuccggaucccaggcuguccucaaaucaguuucugccucauucucaaccuucccaguugcaaaugcuguucucuuuuaggggugggcauggggauggaauccaggaccucacuccagcuaggcaagcaugccuccaagccccaaccucaugcucucauuacaaaugaauagauauucacaacagaacauggggaagccagaugaaguggugcagggucuuuaauccuggcacucaggaggcagaugcaagcccacauucgcacgcauaacuguguccgacuuuagucagaccuuuugugacuugcauuugcuguauuucucaacuuuuuacaacaugucaggagagagcuaaguguuuguggccaaaucuugcugauauuggugauaccuccucagaaaaaaaacuaauaugacuucagaacauaagaguguuuuccacccguugucacacugcccuagaacugcaaugugcaugugucccucugcagcacuaggcacaaagaguuggcaaggucucuuuagagccuaagugcaucagaugcacagggccuguagugacuuucccuuccuaccuguaugugccagaccuuccucaggggcuggucagccuugagauucgcaugcuggcaaacacagauccucucaccaagcacaugagggaagccccuccugaugaccuagccucuguccuagaggcugaucuacuguggcuguuuuugcaggucacugggcaagaaucgcuucugaauugccccaucggucaggcucccagugucugagcaaguggaagaucuuggccagggugagacauuuguuugcuuucuguguguaugcuuuccucgagcucagcaaaaaccccauaaccuguaagagugcuugggcgagaugagggauugugggaugggaagggagugcaaagguucuggcccucucguguccuuaucaggaggccaaggacagagggaaagcauaccucagccccagugugcucugucccuggagguguucuuccuuaaggaacuucuccauaggguguccuguuucucuguuaccuauaugccuggguaucugagaccugaggcagccuauuccuccccucagaagaaacagcaucugcagaggaagagagggcagaggccccgucacaguagccaguggagcucuagcggcagcagcagcagcagcagugaagacuacggcagcagcaguggcagcgacggcagcagcggcagugaaaacucagauguggagcuggaggcgucucuggagaagaguagagcacugacuccucaacaguacagagugccagacauugaccuguggguuccuaccaggcugaucaccagccagucacagagagaagggacagggugcuacccacaacacccugcugucuccugcugcacucaggaugccucucaaaaucaccacaaggaagguucuaccaccgucucugcugcugagaaaaaccagcugcaggugcccuaugagacccacagcacuguuccaagaggagaccgguuccuacacuucucggacacccacucagcaaguuugaaggauccggccugcaagguaggcccuagaaugugagcaaggggaauagugugugcucugugcucuuaguggucacuauagcugucacucuggacaguguggcaguuugguuucugaccuggcaaaagccuuguccuuuuauucacuagaauuguugcuuagaacugguuucagaguugugcaguagcaguggccuucauaggagcugcagccuccauuguccccaagucauuugcuuuaaagguuguaagaauuucugcuuaagggcacuuagauaguaggcaguuccccauccucaacugccaugagucguggagguguccuuggguagugucaguccaacuuggcuggcugugcauugaccugucccccucuguccucagugcugggccuggggccagccagauuagcucuggcaguggcuggagcagccuuuuggacuauacaggcugcucugcugcucugcacuggggauugcuggagggacaaugcagucagcucagccaugguacugccugccauugggccagagcaucugucuuagagagggcacuaagacaggcccuacuuuaaggccacauuagccuuaccacagaguauuuucgcaaauagcaagugguguucuuacaagggggcguuaaacgugcacaguggcaggccuguaccagauccucuugauauacagccuguguugaaggugccccuagagaaaaugccgaaguuaaucaggacucguccacccacccagagucacacacugaugaaggaaagaccgaagcagccacuccucccuaguucacgcucagggucugacccuggcaacaauacggcugggccccaucugcggcagcuauggcauggaacuuaccagaauaagcagagacgcaagagacaggcucuacaucgcaggcuccuuaagcacaggcuuuugcuggcugugauacccugggugggugacaucaaccuggccugcacacaagcuccccggagaccugcaaccguucagacuaaagguacugcccagagcacuuuggggaacuuccuggagccagggugggagcaagugccgcuccuugauccauagcagaguauccugaagggguccuugggagggcaggucugugaaggacaggcaggacuaucccugaagaguuugagcacgagcaguugggccacucuaccugccauugugaaacaaagggcagacagauuuggggugauggugagauuuggggucauaccuucugcucuuugagguaguguggagcucuaaggcugcucugccuuccucugucuugggguuccuuuucgggggagcuucaaaacgagccccuuuucccuuguccucuagcugacagcauccggaugcaguuagagugugcccgccuggccagcacuccgguauucacacugcuuauucagguaagcccccgcagagugcugccugcuuugcucagucuucucugacaauaggagaccaguggguucacacaugagagucacuacacuucggcuucccagccuacaguucagcugacgaacgugaaagggaccuuuggcucuucagcauuugccaucuuuugaguuaaacagugacuuagaaaagagauuagcacccagacccaggucuaagaugaggaggcaggcuuggagcuggguaggaaccugugcuggcccucauuggaagaagggacagcaacauggaacccaaguccaggcugugggcucugaaacugucaugaccucccuuuaggaguuuggggcugcuccauuaucagggcuguuuuccaucugcuugacgggccuggcccagugcaggcuggagcagggaagcacuuauucucaggucucucagcuauugcagauugauacugcgggcugcauggaggugguucgagagaggaaaagccagcccccugcacugcuccagccuggcacccggaacacccagccgcaucuccugcagguaacauacacugacaacaagaagugaggacagauugugugugguaguaugugcuuuuaaucccaguacuuggauggcagaaacaggcagaucuccaugaguucaaaaucaaccuagucuacauagcaagcuucaagccagccgaagccacaugagccccuuccucaaaaaagaaguaaaauaaguacugcccaucccuggcccagacuggcucagguucaguaucucaacuuuucccuugggggggccaggggaggcaguucuuagacauuuccauagaaaaguguggcucucccugagaacagcccugccauagcuucucagggagucaucuguguaagcagccccaugggagaccugauuagaaccugaggcaggugcaagguaggcugugugugggcaggugggcuggcuggcacaagcccuggucucugcaagucauuaauaccaucuguucuagaaaacaaacucaugggcuuaguuugggagaggcaucaccuuggaguccugucaccuggggagaccgugaacuaaaauagaacucugguucccauagccccaaccccacacuguuuggugacgaccugauaagcuguggccaggaagcuuuaguggggcuguauacaaagccuagagcagcagcgguccucucccaggaccccugagcuuaggggaggcccccagaguuggguggugagugggaagaagugugagaucuagcagagguucugcagucugacucuucucuuuacaggcauccucuaaugccaagaacaacacagguaccauaugccgcuucugucucucucauggugggacaugccaugcaucugagccacagccuuagcaacacagccagugguccugacaguaggcuagaaaggccugaaccugcuugggcuuucaccuuugggcugccacugggggcuugaggggauuaugcugugucacauuaggguccaggcaugcuagagguuuagaagccagucuuucauagucgggcugcugccucuggcauugcugcccucucugugaacagagugccuuggguugggggcccaugugagcuggagccucacaugugggguugguugcuggugucccugggcacagaaccugaaguucucaucaagcugguugucucuuccuuuaggcugccucccaagcaugacgggggaacaaacugcaaagagagccagccacaaagggcgcccacgacuggggucaugcaggacugaggcuacccccuuccaagucccuguagcagccccacguggccuccggccaaagccuaagacuguuucugagcugcuucgggagaagcggcuccgugagucccaugccaagaaggccacucaggcucuuggucucaacagccagcugcuggucuccucaccugugauccuccagcccccucugcugccagucccccaugguuccccaguaguaggcccugcaacguccaguguagaacucucuguaccuguggcgccggugauggucaguucaaguccuucuggcuccuggccggugggugggaucucagccacagacaagcagccccccaaccuacagaccauuucccuaaauccuccccacaaagggacccagguugcagccccugcugcuuuuaggagccuagccuuagcccccgggcaaguccccacaggcggccaucugaguacucuaggacagaccucuaccacaucccagaagcagagccugcccaagguccugcccauucuucgagcugcucccagccucacucagcugucugugcagccaccaguaaguggacagccccuggcaaccaaguccagccugccugucaacuggguucucacaacucagaaguugcucucuguccaagugccagcuguggugggccucccccagucagugaugaccccugagaccauaggacuacaagcaaaacagcugccuuccccugccaagacuccugcuuuucuggaacagccuccagccaguacagacacagaacccaagggaccucagggccaggaaauaccacccacaccugggcccgaaaaggcagcuuuggaccuaagucuccuuucccaggaaagugaggcagccaucgucacauggcugaaggggugccaaggugcuuuuguacccccgcuggggagcaggaugcccuaucaucccccuucccugugcagcuugcgggcauuguccagccuccuccuccagaaacaggacuuggagcagaaggcuuccucucuggcggccagccaggcagcuggggcccaaccugaucccaaggcuggagcccuacaagcuucccuggagcugguacagaggcaauuccgggacaacccagccuaccuccugcuaaagacgcguuuccuggcuaucuucucccuuccugcauuccuggccacucugccccccaacagcauccccaccacccugucaccagacguggcugugguuucugagagugacagugaagaccucggugacuuggagcucaaggauagggcuagacaguuggacugcauggccugcagagugcaagcaagcccagcagccccagacccuguacagguauggaugcuggacugcagccccacuucccgugacaggcaaaggucccugcagugccugcugggaguggugagaugggcagguggaaguuguacaagggagaaggcuguggguuccugaaggaggaggaagcuuguccaaucugccugguugggaaagggcuucuuagcaaaaguugccucuccugggcuggauauagcaggagagggaggcagccuucuaauaugacguacccccacccuacucacauaccacacaccuaaacucaacguagagaggcuggccugacacauaacccuggggugggcuguagguacaguguaggucuguugcccuuguuccugcucuuguggguauagaguuccucucagacaucucuuguucacagagagcuggccuggcaagccagucuguuucccauaggugcuuagggacaagaugugugggcccauuucucuggcuacuuccaaggaguccuaccaagccgccucccuugcaaagauuagauguguggagccuucccacagcugucacuccuuuccugguagugcugcccuagugccagggugaccugggaaucucuaggauacauucuugucucugccuccauuggccugcacuugagaguaagaggguggcuaucauggaauuacuaaugguuggagaccguaccugaagggcaaaacugcagaaagcuaggaccugguuccuccccugcucuguccuggggaagcauacccuagcagcugccugucccugauguuagggugggggcaguagaggggguuguucugaguccucccuuucccauucccuacccuggcuagagccaccuugucuccccuggucagagagcuccaaguccuggugagguuucugcucccuccccucuggaugcuucugauggccuugaugaccuuaacgugcucaggacucgacgugcucggcauucccggagauagagguugcuuugagcagcaaggugagucccuggggaggcugccaccaugcaaccaggaagaggcagaguucagauaugggcucccuccaucugcucuggaaacaccugagggauguggcaccaagucugaaggcugagccuauagggauacuugaugcuccuuguccucuguccuucccuaccugaaggacauguugcccagugugccucuuggccuuggcccuccuccccuuugccugaguuuuauccccuucuuugcuggggugucagcucucagagcacccucuggcugcuuuccugagguggcacugcugacucagugcaagucuugggguguucaccacuugcagcccaugagcauaauuaccugcaguuccucugaccacaaaucccgggcucuaccuuguugcuuucacuguugggucccugggugcaggucagcaggugaccaaggacauugaugggacugagguggucagggcauucuaguugugaagccaccgccauccgcugagcugucuguccccagugcagugccagcucaguccuugcugcucagcagccccaucuguguggucuguccugacgucuggggccuggugaggggcaggcacugucaagaguauccuguguuucaggacaaggcgucaagggguccagaauccagcucucacuaggcaagaggcagggcccaagccugcccagaagcaguacacaacccucagcaagaagacgggaagccagaaagcugcaggcugaggaccaagcugucgguagcgaucuacaggcuguggugauagcaguggccacgugaucacaggcuaccuguuaacagacuuggggccguguaugugagggaauaaaggaaaugccuaauuuucacuuaaaaagcaaug

SEQ ID NO: 702 - RNA, 49800 nt, Mus musculus
cacgucggcggcggcaccuggagccggaugugccaagauggcugcggcugcugcugggaacgcgcuaguucccccuacugccgccgccgucgccggcuggguuucaguucgcggcgccugagaagccaaccacagcucacagggugagggcugaguguauggagcacgguggaggcccgagggugggcgaggcugcggaggccaagcaggcucagugagcaucgggccuagcccggaguggcgagcgcauuuaaagagacacagucaggccuggggagaacgacaguaccgggccgccuggugcugagacaccggacagguuacgggccgugucgccuugguggguugucuaaggggcucgugguuucccagaccugacgggagacagauaccuggucagggcuucgggaacugguuggccgcuggggaagguguguuaacauggccagacugugacaccuccgaggaagcccgcaacucauuuaaaacgaagaaagugcaggaaauugccaagcuugacuuuugcuggguucugaagauauuugauucucguuggcucgaagacuuccucagaaguugaugaucaugggacacauuuucauuugaaacagggaguagcagcguuuauuuguaaucucuuggccggcggagcaggaugucgcaagggaggucgugauuuguuuuuuaccaagguguagaaaaaugucggcuuggcuguggagcguccuguagauaacucuggcuguugugcuuacacagguuuuuaaauggcauguaggauggucgcgcacugaaggaaagauuuccuuucaaaaguguugacuagaggcguuuuccauucugaguuuggcaguaagaaacagcagacucacagauuacuguuccuucagguccuuuugcaaggugcagcacagugcagcuuccuuacacguuguccacguucccuuccuaggguuucagugcucaugucuugcagauuuugguaucccgucuugcuuuuauaagcaaacaugaauguccauguuuccugugugucuuccucacauaguguauagcuuuuucucuucugcaaaugccuucuucaacauuuaaaggguuccggcucagauuuugacuuagaagggagguguuuaucuugucugucugauaagaguaucacagacagucaccaugggggagauuguuggcgaguggagcucacuaauguucuuggguuccccuguguucuacaguuuacagcuguuaaggcuggcagugaaaggaucaggggauguuuaaaauaccucagucacauagagucauacuuaaaaugucuuguguaaguauguauagagaugugagguaguugagcuacagagcuggguucaugaauaaugcaucugagaucaguaggucucacugaaacaggugcuuuuuugaaaaguagauaacuggcugaacagaauaaaagugucuauaauccugagauaaguaguaggcaguucauuaucuuucuguugguaaguaaagacgauuaaaagaauaauguucaaguugcaagauuauuucaccugaaacaggcauauuguggaaaaggucucuguauaggagcuguaggucuuuguaggggauaguguuagcucauaaaacacccauuaaaguugagaaaauaauuucaaauuucugcaaacaaaauaguuaaguauaaauuuaggcaauuuggauucucguaggcagcauuagggaucgggcccuugaaagaauauauggccaaaaucuuaauagugaauucagaagacacuugagcgugaaaagaucuuguucucucaucuugugaacuagcugcagagagguaguugcccuuagcugcucaauggauacccagccuauugacacuugaugcaucagccguguguuguuuauuauauuuuaguuuaguuuuugcuugauuguuuguuuguuuuuauuugugugauguguuaagaugauggacagccucagcugcuuuuuaugccagccagguuucaggaggaacuuaaaagucuguguuuucgggccagguccagauccauguuauugugucuauggcugcucagcagcuggucagauaaauagggguggcaacucuucuuccacuuuugguucaggugaagugaagcagcaauggucuuuauuauguaaaauggcaaguuagagccuaaugaauuccuggcauugcuucuaauugaaguuccauuguagucuuuagucaggugcuagucaguugauaggauccucuguugacagaggaaggaguauaugugggcaauaauggaacugagcuaauagauuaauagaacuaacauuuagguagggauuagagaccuuuuguaaauugcuuuauuuaaaauacauauaucaauuguuugguuuuaaaucugauuaucaaaaagauauccaagaacaaaguauacaucugugaauuaaacugccuuugcuuuauuucuuuguggauuagccaaacaaauuucuucuugaggguggugccauaaagaaggacugacacaaagaaaagggcuuuuaagguguuacgcuugaauugugucuuguucaaaaauaaaaaacacuggugagaaucuuguccuaucucauaccacccccugaggguuuguugggaucucccuguuggaaaugugagaccaguaaaacugcuguaaauguccuugggauuuuuaguugcagcuguguuacaacuucaguggucagaggcaacuuuguuucgcuguucucagaagacuacccuaaacauuucacuuggugggguaaaugcguuuaguaacuuuauaacuguuuuaggaaguguaaacucuaauagacuuaaaaguaacauuacaaaaagcacauuaugugugcuuuuucuuauuaguggaguuggcucuuucuggaugugguaguugguaguguuggccuaaagaagugucaaggacuauggaacaugguaaucugucagacuggcaacagguuguuccuugucccugaugauguggggcugggauguggagagauggagucuuggguauuuaaaugauuugaaaucacauuuagucuuguucuuuucauaguuguauugauuauagccaggacugugagucuauaguucuuauguucuucuucucuuuucuuuuuuagcacaaauuaaagaaaagcucuacucugcccccuugauaagcagcaucuccuuguggaaaagacuccaacaugcagccaccaccucaggcagucccgucugggguggcuggaccacccccagcugggaauccucggagcauguucugggccaacagcccuuacaggaagccagccaauaaugcaccaguggcucccauaacacgcccauugcagccaguaacggauccguuugcuuuuaauagacagacucuucaaaacacaccaguaggaaguucauccaaaagcagccugcccaauuugccuggcccagcccucucuguuuuuucucaguggccugguuugccugugacucccacaaaugcuggggauagcuccacaggauugcaugagccucugucaggaacucugucacagccuagagcagaugccagucuauuuccuccugcaucuaccccuucuucacucccugggcuggaggugagcaggaaugcugaggcugaucccagcucaggacaugaaguccagaugcugccacauucagcucacuacauuccaggaguggguccugagcagccucucgggggccaaaugaaugacaguggguccgggccugaccaacccaugaauaggcaugccccccaugauggugccgugacccacgcagcaucuccuuuccucccucagccacagaugccaggucagugggggccugcacaaggaggcccucagcccuccuaucagcaucacucacccuaccuggagggaccuguucagaacauggggcuccaggcugccagcuugccccauuuucccccuccaucuagucuacaccagggaccuggccaugagucucaugccccacaaacauuuacuccagcauccuuggccaguggugaagggaaugagauaguucaccagcaaaguaaaaaucacccauugaguagcuuccccccuaaacacacuuuugagcagaauuccagaauugggaauaugugggcaagcccagaguugaagcagaauccgggagugaauaaagagcaucugcuagacccugcccaugucaaucccuucacucagggaaauaguccugaaaaccaggcgcaucaucccccaguggcagcaacuaaccaugcccugcaagaagcagccucuggagcucucucaauguuuuuucaaggggaagagacagagaaugaggaaaaucucucaucugaaaaagcaggccucgauaagagauugaacuuggauagcuuuucuucuaccuccagacugggccauccaccaccaccuggagcuaguggugucuaccaggccuuuccuagaggcccuagcagugaggcugcgcaggaaggagaugcgcaaccuuauuuuucgcagucugugggcguccgucuugacaaacagagcacugugcccccugcuaaugaugcauggggugauguuccggggaccgggacccgcugugccagugggccacagugugagaauguugagaacuuagaauuuguucagaaucaagaaguuuugccccgugagacccugaguguggaucccuucccccugagugaucagauccgauaugggccccuuccugggccagcugccuccaggccugcuacugugggccucaccagagguggggggcuaaaucuugaggccccagacacaccacugcacccuacacgaccugacagugugucauccagcuacagcagccauagccacagaaguccuccugggucagccagaccccaagaauuggugggcacauucauucagcaagaaguugggaaacuugaagaugauacuucagggaguuuuuuuaagcaaauugauucuucuccuguuggaggugaaacagaugaggugacugggagccaaaauugcugcagcagucugucccagccuucaaccccaagcccuccaaaaccuacaggaguauuccaaacaagugcaaacaguucuuuugagccaguaaaaucccacuugguuggagugaaaccaguugaagcagaucgugccaacauggugguugaagugagagggacccaauacuguccgaagaagcgcagggcagcuguugcaccaccugaugcuaccucaggaaaccuggaacagccaccagacaacauggagaccccgugugcaccucaggccugcccuuugccucuuagcaccacuggagaggcugggcaacugguuucaaacacggcagggacaccccuggauacugugcgcccagugccugauaagaggcccucagccagggcccagggaccugugaagugugagagcccagcaacaacucugugggcacaaaaugagcugccagauuuugguggcaauguccuucuagccccugcugccccugcacuuuauguuccuguaaaaccaaaaccuucagagguuguucaucauccagaaaagggaaugucuggacagaaggccuggaaacaagggucugugccaccuuugcagaaccaagacccuccuggugcuucugagaaccuugagaacccucccaagguaggagaagaggaggcccuuccagugcaggcaaguucugguuaugcgaguuugcuuucuucgccacccacugaaucuuugcacaaucaaccuguccugauugcucagccugaucaaagcuauaauuuggcucagccuauuaauuuuucuguguccuuacugaauccuaaugagaagaaucaguccuggggagaugcuguggugggggagagauccauagugagcaacaacugggcucucgguggugauccugaagaacgugcugcucugucuggaguuccagccagugcugucacuggcgcgucuuugccuagcaguaucccccagaauugugccccucaagguucggggucuucugaaaugauugcuagccagucugccaguugguugguucaacagcuauccccucaaaccccucaaaguccgcauccaaaugcagaaaagggcccuuccgaguuuguuaguagcccugcuggcaauacaagugugaugcuaguuccaccugcaagcaguacuuugguuccuaacaguaauaaggcaaagcacucuaguaaccaggaagaagcuguuggcgcccuagacuucacauuaaauagaacuuuggaaaauccugugagaauguacagcccaucuccuucagauggcccagcuucucagcagccucuucccaaucaucccagacaaucugggccugggcugcauaaccaggaucauuucuaccagcagguaacaaaagaugcucaggaccagcauagacuagaaagagcccagccagagcuggugccuccucggccacagaauucuccccaagugccccaagcaucguguccagagccuucaaauccugaaagcccacccacacaaggacagucugaaagcuuggcccagccaccagcaaguccagcuucagucaacacaggccagcugcugccucagccaccacaggcuuccagugcauccguuacaucuaccaacuccagccaggcagcugugcggucagagcagcuguggcuacacccaccaccuccuaauacuuuuggcccagcaccucaagacuuggcauccuacuacuauuacagaccccuguaugaugccuaccagucucaguacccuucaccguacccgucagauccugggacagccucgcuguacuaccagguaagagcacugacauuuaaccaucuuuccucacuuugccccuuuucuccucucaacgcuguuucucucagggaugaccuuucuuuagaccuguguggcccccccugaaaaaaaaucccuguccauuaacaaagcucuucuuucagaggguccuguaguguugaauugcuuguucuaccagagccgguuuuuguguaauccgacaucugacuaacaguguuucccagagcguuuguuagcuugcugcaguuacagugcugggcugacccuuguagggaggagcuuaguagguagauugugugugcugcuguuuguuugugcuuugagacaggucucacugugugggccaaguuagcugugaacuuaaaauccuucugucucaaccuuuaacauguuuuaccgugccucacuuuuguguaugugcugguuuugguuuugacaggcuucauuuagcacuggcuagccccauauguagcuaaggauaaucuugaagucuugaaguccuuacauuccugccuccacauccugaguggugggauuaccaguauaugccaccauauccagcucuuuuauauauucuaaaacauuuauuuauuauacguguguauguguuuauauauuugcauguggauacacacauaccacauuccacacgaagaggucagaagauaacuuucaggaguuaguuuucuccuuucaaucauguggcuuccagggaucaaacuccaaucagccauuucuguuuuaauaacaaaaacaacuuaugaaaccaaugacagggauaacucuaggagucuucuauguccuuccuugagaauaaagucuuugaggaaaaagauuagauugucugugugcagucaugaaaagaggugagggaagauaaacucucggguacauagcagugauccugcagagugggaggccugccgcagagugggaggcuuucugaguucuuuccugccucguucugguguggagcaggcucguaacugcuguuuggguucugcuuaauccugcaguaguuugaaguggacaugcuugaugucuguuagcuuuuccuuaccucuggcucagacucaucauugcucaaguuagguggauuguguuacuggaaggugaaagacccagguccucugguguuugaggccaggugcuguugaauucucaugugccugggaagaguuggcacuggugcuauacaggaagaugugucagaaggagccuuagaaacaggguuguagcagcuaggccagaucuaaagacgaguaaagagauucuagauuuuagaaggaggagcuauagcuauuauuucugcuguguggccugaucuugggcuacacaguggguggagccacagaggacggccugcaggcuccuuugaaaucgcaaggcucacagcucuucugugagugugcauccaugcuucuuuacugccaugguccucaguggccugucagcugauggcagaacugaggcuuuugccuggaucacuucauuucuuuugagaucuccgcaagucccacagagccuuuuuucccagagacagggcagaggccaugguuuugucgcaauggggcugaaauccucagcagaauaagauauauauauauauguauauauguauguauguauauguauauauguauguauguauauauauauauguauguauguauauauauauguauauauguauauauguguguguguauauauauguguguguguguguguguguguguauauauauauauauauauauacauauacauauauauacauauauauauauauuuuuuuuuuuaaagccagguaugguggcuguaauuuuaagacuggggaggcugguaaagguagauucuacaagucugaagcccaugugagcuucguagugaguuuuaggccagcuuaggcuaaauaugaaacugaugcaaaacaacaaaaaacaagacaaaacaaaacaucccccugaauuugaaaauaacgagcagugcaaucuuucuuugugagacuuuuagaaccaguaguuuuaggauugacuuacauggaucccuggucuuguugcucuacugagguagugacugauguauauuuauguuguucagaccauaucaucuccaugcuuaagauugcaggaggaagauugcccuggagggccuuagggagauucugcuggcugcccauugaugcggacuacacuuuaggcuuuguuucaaugagagaauccugccacaauacugcucuuggacagugggcaccugcagcaccuagagcuaguccugucacucaaugucugcucuucauggagucuaacaauaccccaaacuucuuuucacaggauauguauggccuguaugagccucguuacagacccuaugacagcucagcaucugcuuaugccgagaaccaccgcuauucugagccugagcggcccagcucccgugcaagucacuauuccgaccagcuugcucccaggugggagcugcgucugugcagcugcuuuacccucacacucaguuuguguauuguuggcuaugaugguaacuuagugaugauaauaauucuucaucuguagagaauccuacaaacccaugaugucagcaugagcaaaccagaacuaaguacacugccacauguaguccuagcagagcuaucacuuagcauuuguccccaauccuuagccaggucaggcucuauguaaggccauaaagaaguggccucuaugcuaauagauggaugguuguucugucccugagacacccauucugcugcuggcaguuugguuguguggugguuuggguuguaugugacucuuagacugcugcagauguuuuuaaagucuugagaauccugaucacagagauaacacaauccacagauccaucaaaugaucucuaccagggacuaaaagcuguggacugugccuggcuaugcugacuuuggugaaagcuccccucccccgcagccugcauaucuccuauccugacuauccacaacccuggcauugugaccuuugaguaagucuguaagccaggucaaaguuccaucucauucucauuugcccagagccugcuuuucaucuuguguccacucugggccauugacuacauugugaaaaguaguggggcgucagccuuggucacuguacucugcuaccucagcuccucaguguccugcuuagucaggcccaguagucaaggaaagcuuaugguagcugacuuugcucuaaggauguguccuucuuugcuuagaaaccccagcugcugagguuacaugggccuugcuuucagcguuuucucuagguucuucucuaagaaguuauuugguaacuugucuaaagacacacugcucugggugugaaccuugguccauuuagcuagccauaauguccuuugcuccagagguacacacugaaccaugggcagguccguucugggucucuaggaagcagcagugccgaggcuugggugaguucuggaguaccugccugguagauaggaggcucuggauuggcucgcuaauacauacacuucaagcacuugcacacgugugugcuugagcaacagagacagagacagagacagacauacuuaauugugagaaaauguggggaucuuagaggggaaguagcucaauuuuccaauucagaaucuaugagaaggcaagaggcauguggaucuguuugcuggagugcagaagggagaaagcauggggccagagccaggguguaucaguuugccuuccacaugucugccugcagcuucauuuaagaauuaacuuucaagagugacuguaucuaggcugaggcuagaugagguuacuauugugugaucugucacugugacggcagcuuuccuucaucucuucaguucucauuugucacagcuuacaggagccuguccucuugucugugugucuauguguguggacacucaguguugaugauacucaauauuaggugguagcaccacuggaggaccugcuugaggcgggacacauuccccauguuugucuguguccucccugaacuaaauguaaguagguuggugagaacaguugagguaguggcaggcucuugaucuuacucugucacgguguuuuucuggaaucaaugucagaugaaggucuaggguggccagccuaaaugaaaccuuaaggccagguuggugguguuccugggcugggcaucuggcugaacagauacuaugcuagccaaauagccaagcucagcugagcaguuuccuaaaacgguaucagaaaauuuaacaauguuuagugcuuuugacaauucugagagugccaaacccucuuaagugcacuuacaccucuuuuuugaguaaaucucaccuucucuguaaugagucagggccaugguucaguuuauugggcauagaagaggcuaacuccuuauugaucuguuggcccuggcccuggcccaccucauagauccacuccuccaaggccacacgaagcacucauaguuagugaagucauuuucuugugguuuaccucuguaaucccaucacuauggaggugcaggcaggaagguugucaugaguuuaaggcgugccuaagcuacacagugagaccugucucaaaaaaaaaaaaaaaaaaaaggaaaaaaaggaaagaaagaaagaaaaggaaaaaaggaaaaggcaguagaaguugguaugggcuuagugcuuugcugcugcucagcauggcauagaaacuuguuagggugcaguccugaaacacaagaugaguuuacucuugcugagcacaauccaacagucgucuugacgaguuaaauuuuagguagcuacauaauaagaaauuccauagucuugucuuuguuuugauugugaccugguuagaguuuuccauagccgaggugucuucauggaugauaugugcuuucucgggacacuuauaagaagcagauacuguguuuaacagcucuuuccccuccccaggcaaggauauccugaaggauacuauaauuccaagaguggauggagcagucacagugauuacuaugcaaauuauuacucuggccaguaugauuauggagguauguuuagaaguuguaaccauuagcaggggauguccaaccacugccugugcccaugcagccaaguauaagucauggucuggcuggugaaucaaggucacuuuucuuuucacuauguuuuuaaucacaagagccaaaguaauuaagaauucugugggcuggagagauggcucagcaguuagagcccuggcugcuuacucuuccagaggaccugaguucaguucccagcaaccacaugguggcucacagccaucuguaaugagauccaguguccucuucuguugugucugaaggcagcuacaguguacucagauacauaaaauaaauaaaucuuuaaaaaaaaaaaaaagccaggcagugguggugcacaccuuuaaucccugcacuugggaggcagaggcagguggauuucugaguucgaggccagccuggucuacagacuguuccgggacagccaggguuacacaaagaaacccugucucggaaaaaaaaaacaacaacaaacaaaacaaacaaacaaacaaacaaaagaauucugcacaucuggaaauggucauuuugacaacuucauugaaaaaucacauuguacccacagcauagugucucuguuguacccacgugaaguguagugacuacuucugagacuuccugguccacaggugacuucucaaguaugagcuaugaggcaggggugggauacaaggcuggcucccaaucacacugccauacuuaaauccucagaagccacaugaggcugacacuugcuccuuggugacagcuauagccugcuuauuguggcaguugugauuacucucauacaucccuuucacagaaggucuccuaggagaagcugucagcucccuuagaaacccugcugugugcuguuuccccacaaggcucuguagucccuugacggguccacauuuuguuuccuucugccucccagggggcucuuugcccuguaaacguuugcaugaauuuuaaacaggaguauuguacaacuccccuaaaccagugcuucuuguuuguuauaacauuaauauuucuuuuuagaguuggcuuuuggcuuuuuuuguuuuguuuguuuuuuguuuuuuguuuuugagacaggguuucucuguguguaacaguccugguuguccuggaacucacucugcagacuaagcuggccuccaucucagaguucugccugccucuggcuucugagugcugggaucaaaggcgugugccacuacaccaagcuuagaauuugcuuuuuguuuuuguuuuuguuuuucgagacaggguuucucuguguagcccuggcuguccuggaauugacuuuguagaccaggcuggccucuaacucagaaauccgccuaccucugccuccugagugcugggauuaaaggcgugugccaccaccgcccggcuagaauuugcuuuuaaugaaauuauuuucuuaaaauauucugaaacaugagcuggagaaauagcucaaugguuaagagcauugucuguucuuccagagaaugugguaucaauucccagcaccuauauagugggucacaacugucuguagccaguuccagugggugugguucccucacucagacauacaugcaggcaaaacaccaguauauauaaaaaauagauaaaucuuuaaauaaauacacauauacauguguguauauguguguauguauguguguauauguauauaauacauacauacauauauacuuucauacauccucaaucacauuaggaagguaauuaguauaaucuuaguugagauuaacuauuaaaaaguauuauugaggcuggggcuauaacuguagcaucuagguauaaccugccuauuuuugaagccuuagguuugauuccucauauuguaaaacaaaccaaaagaagugaaaaagaauguauauagcacucuuaauacuugcauugggagaccagcagugacugcuccaucaugggcaggaggcagcuggccucucuaggucaggucuuguucucuaguccaggccuguccuuuacuccuacgcugugcuccugccuccggggagcuggguggguucuccguguggcuacuguacucaucccuuuauucuuuacagaccccagccgcugggaucguuacuaugggucucgccuuagggauccucgcaccugggaccggagguacugguaugacucugaacaugacccauacaggaaggaccacuaugcuuacagugacagguuggugaaaugaaggauguuggaggaagcugaggugugcucuugcuuguccuccuccugucuuugggaguaaucagccauaguucuggggcuucugagaagugaucuaguguuugaaagaggaagcacuggccaccccucccugcgcccaccuaggacuggcucaaacguauuucuucccaguagcucugggaggaccugagggcugccuccuguuuucuuuggugucccuucuccauccuacucguaucccaggaaagggacugcccucaaguugcaccugcccuguauucucugcgauuaccugcaucugaaccuaggauuugguuucuugggccaggccugcaagguuagcuguaccuuacauucuucaagaugaagacugucccaggauggagggaaggcagugagcagugagagcgagcugcagccucagaaaguucuugguaguugcguggugucccagggaacuggccuuccaaucuccugccuugauccccugcuuacucuaggccugagaaaugugaugaucacuggagguaugacccucgcuucacugggagcuucgacgaugacgcugagauccacagggaccccuauggagaagaagcagacagacgcagcauccacagugagcacucggcacggagccugcgcagcacucacagucugcccagccgccgcagcagccucagcucccauucacaccaggugugcugggcaggccuggcaggggaagggcagguguuuaugucuugaccuguacuuugucucugccuaggaccaacaguguacccacagucuuucugguguucauggggacucacuuucucugcuugcucucuuucccaagagucagauuuacagaagccaccaugugacuggcgguuccuuugaggccccucaugccccaggcucauuucauggugauuaugccuauggcacauaugccagcaauuucagcggugcccaugguuuuccagaguacagcuacccugcagacaccuccuggccugcuguggagcaagguacgucucagcaguucagcauucagccaccagguuggaucgaacaagcgaguccagucagcuccucuuugcacccugugcucucuguccuggauguuauggcuuauugguacaggccaauauuggcccuuggauugacauuugucucugggucuaagagcuguuugcuugcccaauguguauuguuaauguguaauuuugaguccagucuccuuucuagucaagccuuggguaucucuucucuauauuccgacacuggcuaugugggugaacgcucuuggacccaguucccugagagacucuuguuaugauuugugccagugucccauucugacucuccuaugucuuuaccuccuacaguguagcugagagcucuccuaaguaaagcacuagucagcaugagaaaccauuuuugugugugagcugcucagcucuucugcucuuggguguccugugauagucauucugagcuuaggcaggaggccugagcugggucuagaagcugugagcacaaccagccagcucauuguuucucuuccuauuuauuuauuuaaauucaguuccaucaagaccgaccucuccugagaaguuuacggugccucaugucugugccagguuugguccugguggucagcuccuuaaagugauucccaaccugccuucagaaggacagccugcacugguggagauccacagcuuagagguaaccaugggucuguggugcugucgguaccccauggccuuggaaaacaugcuuccaugaaaagcucagguuuauagggcuuugguuuaaaguuggaaaaucuccauuggaguccaugcucauguaauuguaccaaguaccuucacacucuggguagaggggugggugugguuccagaaaugguuuuugugacucagucugccagagguucggacugcacacaugacccacucugccccucuuguugcagaccuugcugcagcacacaccugagcaggaagagaugcgcuccuucccaggaccucucggcaaguaagguucccuguuguggggucucuugaugucugccauagugguggcugcuggguuuggcucacaguuuuggaaccaccauucacuggguguucauucucuccccagagaugauacccacaaaguagauguuauuaacuuugcacagaacaaagcaacaaaauguuugcagaaugaaaguuuaauugauaaagagucugcaagucuucuuuggaaauucauuauucuguuaugcagacagaaugggguauguucccuuuuacuucuugaauuucucccuguucgccuuuagucucagaaucuguucccuguuccuauccagagcuauagucagugucaagcccaccaugccaugcucucucaggaagagcacccuaccccuugccaugccuccucaggaagagugucauggcagcaaccugggaaaguaggaccaagggaggugugagauuuggggugagcugccaccacagcccuuauaugcuaggaggcugaggaucaguaugucccugcccacaugaagagucaggcuucuuuuuugaguucuaacauguguuaccaauguagaccuggccacgcucugacagccugggaguugucuuauuuaucuggcuggaaaccuuguuucuaauaaagucuuauguugcucuccauccugucuccauugauccuguagacuguugugggaacagacauugcagagcuuuuguuacgggaccauagaacuguauggcuuccugggaagucacccaaugaggcaaaccugauagauuuuaccaaugaggcuguggaacaaguggaagaggaggagucaggggaggcccagcucucauuucucacagacagucagacagugaccaccagcgugcuggagaaggagacugagcgguuccgugagcucuugcuguauggccggaagaagguagguagcucugcagauuuuuuuuaguguccgucgauuggcucagagaagagagaccaaccucuggggaacaacuguagugagugcuguucaggggugauauauggccuuuugcuggacauuucugaagguauccguaguguuucuucugagaaaagcccauaaagaaaucugaccagcucaguuuacagucauuuagagagugugguugcucgucuguguauagaaucagggugaagucuuguuacagacugaagcaucagaccacucuuguguauuuuuguuaaagcggaguucuauagaccugaggcugacagugcacacaggaguaugaaaguaugcauauuagggcagaagauguucugauagugggagauacaucuuacuggcucauagaguucucuauggcagagacagcugaugggcccagaguucucuguccuuuauauuaugaucuauguagaaguucaugguuuuauucugguucggaucuaacaauugaaccggggccaugugcaugauaaggaaauacucucaccuauaccccaacauagaaaaguuuaacuugccaggugguguggcacacgccuuuaaucccagcacuugggagacagaggcaggcagauuucugaguucaaggccagccugggcuacagaguugguuccaggacagaguuaguuccaggacagccaaggcuacacaaacccugucucgaaacccccaccccccccacccccccaaaaaaagaaaauuuuaacuuuaaaauagggucuugcuggguggugguggcgcacacuuuuaaucccagcacucgggaggcagagacaggcggauuucugaguucgagaccagccuggucuacaaagugaguuccaggacagucagggcuauacagagaaacccugucucggaaaaaaaaaauagggucuuuguagcccaguauagccucaaauuuaucauccuccugccccagcuuuuaaaguucugugauuucaagugugugccaccauaccuaacuagaaaacucuuuuuaugaaagucuuucuguguuacccagacaggucuugaacuucugugcucaagugguuuguugaguaggugagacuauagugguguccccauguccagggaaagcucauaugugauccuuggaguuuuaacauggaguuucagagcugggugaaaucauaugacccuauuggcuuuugugaauaauuucuucuauugccaaguuuugccuccuaacggaaagugccaaguuguacuacagacuauucagggugcugggauacuagguugaggauggagaguaucugaggaggcugcaugucaccugagggagcccaugcugccguugcaccccacaggaguacugccacuuguuucuagcugggguggagaaugaaagcagcaugggucuacagguacccacuagagggaaaggacagaaggacaagaccgugcugucgccugugaacugugaacacaugcucauuuguccuuuuaccuccacagucaucuuguucugugugugcaugacuacaugugguaagcacugguuauucacacgagcucugaacugcauugcaggaugcucuggagucugccaugaaaaauggcuuauggggucaugcucuucugcuugcaaguaagauggacagccggacacaugcccgugucaugaccaggugagucaucuuguaccguacccccauucuuuggcacagccugacuuugguacucagguauuuugccucugccaugggaguuucagcuguggacucauggacuuccuuggcucuuucucagguuauacuguugaggaaguuuuaaauuccuuauugccugguguucuuuaauauuucuguaaaaccucagugaacuuuucauucugauggcuggauaaaggacugagaaugggcugugguuucuucuuguugaaccagaggucgaucuccccauucucuguacauguagguuugccaacagucuuccaaucaaugacccccugcagacugucuaccagcucaugucuggacggaugccugcugcauccacggugaguaugcaggcccccgggacacugauggaggcccacaguccagugugauuugugcauacugaagacuuugacuauggagucugucugaaaccuauguuuguuggucuugcuuucucauugggcuugggcuugaucaucaggaaauaagacagucucugaaggauaagaauuuguuuguucuucucauuauaguguuguggcgaugagaaguggggagauuggaggccacaucuugcaaugguuuuguccaaccugaacaacaacauggauguugaaucuaggaccauggcuacgaugggugauacucuagguagguuaggugugagguaggccuuuggcugucaugugauagaucccagagucugacugugugaacaacugugccagaaccauaagagauguggcuuucauaaguccagugucucuuuggcaccuugccugaagaguuuccaaggacugaugagaugugguugcucuguuucucuucagcaucaaaaggccuguuggaugcugcacacuucugcuaccugauggcccagguuggauuugggguuuauacaaagaaaacuacaaaacuugucuugauaggcucaaaucacagguaaggaaucaagucacuauagcagcguccguuuuccucuaagaagcaaaugguccugaccuucaguuaauuuggaaguggccagccuuacgccuuagcugcaugaugggcauacuuggguuuaccugcuuggguuuauggugccaguaauuggccacuuuucacuucuuccacaguuugcccuuuuuaaaguuugccaccaaugaagccauucaaaggacggaggcuuaugaguaugcucagucccuuggggcacauaccuguuccuuaccuaacuuccaggugagcaggggcugugagggguggccagugcucaccagugcuugcuuguuaugguuuugaauucucacagaaguaaugaugagguguuuuguuuuguggaguuuuuuucauuguuuguucgguuaguuugguuugauuuuugacaccuugaauacacaguugaucaaaaugcuauauuaaauaggauuuuuuuauauuuuuguucuuaauauuucagacuaaauuucaagauauauauauacauauauuuauauaugcauguauguauguauaacuuuuaaugagaauugugguaugaucugacccaguugugugcaugcaugucuguguggggguagguggguguguagguuuguauguguauauagguuugcauauauuaguaggaaagguuuauaguuugcccauaggaaagccaguugucuggauuuguggcagcagcuggacaucaaaucuugaacugcuggcguuaucagagguguuaggggagugcaggugucuaccuugacccuacacuaucacagaggcugcugugguguacagcaucuaagaucucaggggugaugggaagcucagagccauggcggugcacuuguguggagccccaagacuauagugaugcacuuguuguuucagguguuuaaauucaucuacuugugccgccuggcugaaaugggacuugccacacaggccuuccacuacugcgaaguaauagccaagaguguccugacacagccuggugcauacucuccaguacugauuagccaguugacucagguaggaucuucuggugccuuccuguuagcaucuugccaacucuggggaagcacaggcuucaucuugcugagcuugggguggugagugguacuuaacaaagagauauccagaaugugcuuuagauaccucagugcucuggggcggcuguuuuggacuuugcaucauuaauagucacuacuuaacaaauucaucuugauccauucaaauccuuuaaaggcccuaucaaagaacuucaucuucccugguuaguugaguacuuggacaggccugcuaauauccauauaagugugaacugcacccuggcgcacucgaugauuuauacaacccacacaugaccuccuucaggcccagggaacacuugggaacaauuuuauuggugccauuuggcaauaacaaggaccucuguucucuggggucuagauggcuucccaguuacgccucuucgauccucaacugaaggagaagccagaagaggaguccuuuguggagccugccugguuggugcagcugcagcacguggagaggcagauccaggugcgccuuuugacagcacaaccuuguccuagaacauggccuggaagcauuugaugagaggguuugugcccguauuguuuccaugcuggagcaucugaugguggcacugugacuucagaagugcacacacugagaguucccuccuuuccaagagagcaccaguguggaucucuugauguggagaguacaugugugcucacauggacugcugagcauggacugcagcuugacccuguuuccuauaggagggcacugugcuguggagccaggauggaacugaaccccagcagugucgcauuacaucgggcucugagguggagcagucagauggcccuggacucaaccagcaggcagggccacaggccgacaacccucuacugaugccaagcacugagccuuugaugcauggcgugcaacugcugcccacagguggggcccacagcauccauguacuugcuuacugaugucuucuuugaaaagagaguauguugcugccagaauugaggccugguguaucaccauggugacuggugaucuuuggacuuccuccuccuuucucuuaggcuuccucauguggugagcauauaaaguggcagaacuucagaugcucuccuggugaugucaugaaugccuuugcccccuggcccuggcccuugacaaacuccagcugcccuuuagcuguuugcuuccuguggugccucauagcucugucagaacaaguacugccacuucucagccugcagcugcuucuccuuaucuuccucaucuugggaaggguuacccaccccuccaggagaugagguccagaccucucacucauuucuugagccucuuugcuggccaggcaagcaucuuuucuguuguccucacucucauucugucauucugccccugcacugcagguguccucaaccgaccugacacaggaggucaucccuauccccugacggccuccggcucucuguuccaaagcuccccacccaccuggcauuccagccacucuugacucggacuggacuucuggugccucucgucccuacugaauacccauuccucacauguuuccuggcaucacccugggauaaacucccucugugccuguuuccuuucuuccugguucauucccugcaucaggauucuuguuuuguauugggagaugggaaucucacacuguugcucaggcuggucuuggacuugugguucacaaauuaucuaagccuccugagcaauagugccuuuguguccaguguugagcuggagagaggacucacuuagacaguugagcuguguagauggcugcgugcauaaauggucuauuugaccuagcgaugagcagaguauacuaccaaagcagcacugaguuaggggucacuuguuguaguuuucagcuccugccccacaucacaucuacugauggucauuggcacacccauucugacucugaguuccuaggacaugaacauucugcuuuuuccuagaccacugaagggugcugcuuuucaacuaccucauuauaaaagaagcaugccuguacagagcagcuuaugugcuuaugaugugcugaucagugcuugccuggugcagucagccacagugaccuuaguuccucuucuccacugugcccuacagcuccucagacauugccugauggccagccugcucaccuuuccagggugccgauguucccagugccaaugucucgugggccccuggagcugaguccugccuauggacccccaggaucugcacuuggcuucccagaauccuccagaucugauccugcagugcugcauccugggcaggcccugccacccacuacacuaagucuccaggaaagugggcuuccaccccaggaggccaaaaguccagacccaggugugucugcugagggauagauguuguccugagagcagagcuaauuggucaugcuguuaaaggaagaggcuguuagaagauauugccuggacuaaaaguucuaguauugcaaacugcuaagagucucaguacaguuugaaacaguaaugcuaguuucuauugugacuugaccuugugcuaucauuugaagccuaacugcccauuugaguguaaaagaaugguccugggguauuugcagggacugucuugguacuguacguccuugggggcugcacaggugaggguggcagauguuucucuggaagccaaauuugauggauucugugccugucugacuaucugagcgaaacaaaacauacaguugcuuuuauagagcaaaguaguuaguugccgcacacuugggaaaaucuuccuuuucccuauuagaaagaaacauuggugacugagccugguaaucacuuuguucucagucuaugcccugccagugcccgcuucccucuugccccauggcagcagcucuaggaccuagucauccucuuuuguuuugacagaaauggugccacggggcucaccugucagacacuccccuccggagcucagucaagaggaguuuggcgagagcuucgcugacccgguacuucccauaccuuguaacugcugucuuucucugaguuuguugaguagauacuuugguuccuuguucuuagccugaaguaggaagguaauaaagggaaggaaauuauucuuaaauugaauucuuacagagaaaguguuauaaaaucauuguggcugaggacagagagaugggucauuuguuaagggugcuugcuaccaaggucauucucacaugggagagggagagaaccaacuccuacaaguuacccucugacuucuacacguauucuaacacacaugcccccaagacacauccagaugauuaauuuuaaaaauuacuuuaacucuucaaaugugaaaguugguaaaaauguugauggagaaagaggcaaaaaagagaaucaaguguuguaaaagcaguuccuuuaagcagaaaggagacccaccucuagugaaguuccagacagaauuuucaaagauggagaaccuuccugaucucuacccucacuguacgguaaaaccugauauuuugguuuccaugaaauugcagucacugcagcacacaagguuugguauagauacucuucugugugcucucaaccaagagggacagauggacaguucuuuacagauacccuauacuaaauggaugucccaucaguagauguuuccucauuucagauagccucuuccugagaaauaacagggaggguuucacugugugcugaucaugccuucacccagggcuggaucacuuuucuuuaaaaacuuuauuuguguguguguguaugcacaugcguaugcaugcauggguucccacagaggccagaggagggcauugaauccccugguacuugaguuacagguauuugggacccacugcaugugagugccgagagcugauugcaagagcagcaagcacuccuaauaagugacccaucucuccacccccuugauuuuauuuuguaacauuacuguggugaggguagugcauguaccacaguucgccugugggaguccgaggaaacuguggaguuugguucucuucuuucacuuucaugugaguucuagagaugaaaaucacauuggcaagccugaauugcaagugccuuaccacugagccaucuguuagcucauggagaggauaguuuaaauugggauguuguccuaacagcaccaugcgcagcucacccucagggcgugcauguacuucuucucuuggaguggugugauacuccgugcuagguguuugcuggcugugcuuggcauuucuuuagcagacugggaaaguuucaaaguguccagccuggccgggcgugguggugcacaccuuuaaucccagcacucaggaggcagaggcagguggauuucugaguuugagggcagccuggucuacagagugaguuccaggaucagccaggacuacacagagaaacccugucucgaaaaaccaaaaaaaaaaaaaaaaguguccagccugccagcaagcaugaaucccucuucucugcucuugucgguucuuugccguaccagggagacacaagucagguguuccuccuuacccacuucacuuccucacaaggagcuccaggagaccugguuuccaucuugcuuugugacagggcucuuccagaacagcacaggacuuggaaaccuccccagugugggaucuuggcagcuccaguuugacacgugcaccaucuuugacaucugauucugaagggaagaaaccugcacaggcugucaaaaaggagcccaaggagcccaagaagguauaacccaguccugcagagagguggggcaaaugcuggagggaggcuccacacccgaagcagcuuuccuugggaguuagagggaggcaaggaagacuguuuauuuuaaaucaaaaauucauaaacuauuuucccaagauguaacauacaugaaauuaagcaugucacagcuagacaagucucucucucucucucucucucucucucucucucucucucuuucucucucucucucucucucucucugcguguguguguguguguguguguguguguguguauguauguguguauauccagauuggugagagcauacccagguuuccuagagauucacucauagccaguccaugucagagaagcccuaguguagccagaguagggcacauguauuuccugauaacagccaagcugagcaccuuugcacaagcuuagcccuuagugcucauuugucuuguauuuguaauauuucucuguuguguuuuuucagugacuugugagaguacuugcaugguggguucagguccucuguugaaugaguaugugggucacagccucucucaaaucugcagaccaccuuuuuguucuuaggaugucuuaacaaaaaauacaguucuuuaauuuaaaaauuauauaaucuaaaaauuauauguauaugugugguggguguacauaugaguacaggugccugcagagacaaagagagguaugagagguuguaagcugcccaaaguuugugcuaagaacuaaaucagguccucuggaagagcaauauaugcucuuaaucacugaaccaucucucucccauaguuuagcauuuuaagaaaguucagcuuaccagauacccuucaugacaauuuuuuaaaauaaacacaaguuuaauuuuuaaaaauguaugaaggcugaggauacagcucagugguacagcacaaggccugggguucagccccuagucacuacagggggaaaaaaaaacaaacgaaaugaaaaagaagcccaagauaguuuuuagggguuagagaggugguucaguaguuaauaguauggacuguaagaacaguccuuguacaguccuuuuauugcuucuuugugaguuucacaucaugucuaccaguccacuuauaccugcuugcugcccuugaaauccccucccccaacauaaaaaccacacaaacaaaauaaacagaacaaaguguagaaagcaucucguugucauagaagcaguauugugucacagugugucccacaguaaaucccuuuguccacauaucuucacuuuugaauguucaucaaaugagucauuggucuggcuucugugacaccaucaauauugacuccucauuggaacuccucccaguuauccuguuguugcucugggucuuggagauccugcaguuuucaguaagcaggacuaacccuuucacugaacccaacaguuguagauuuuggggugggccaacucaaagcccuggaucugggccugagugguagcugagcuagucagcccacuggcucucccuuauccguaccgcuagggcaagcucuccagcucugcuccugcuaggccacccaauaggucagcucucccacucucaugcccuggggggccagcucacccacacccacaccuccagagucagcuccacugugcugcccaguugagguguggagccugcucuccaauagcugcagcuggcaaggagcuaggugagcucuccugcucugacacuaaggacauuuuaaaaaggaggccaugccuggugugugccuuuaauccaagcacucuggaggcagagacaagcugaucucuauauuugagaccaguauguucugcuagaaaguucccagaaagggagggagggagggaauuauaagcuagacuccuguuccauuuauuuuuauuuauuuauuuauuuuuccaguacuggggauccaggacccauauauacuggguaaacacuggaucacugggccauggcagacuuugaggacaggucauuuccgcugaugauucuaggaggaauagaaugugggcucuauaguacagcuucucucuucucuuuuuuaguaaaguugucccaaaugucaaaugauaaauucugaucacacagauucuuucuguagaggaagaggggcuguguguggaggccauccuguccaacuuccuuuuuccccaaagugggaagagccugaugcucaguuugucagagacuggaugugaaauguucuguagguggcauauuaucauccugagcuuguuuguuaaaaauaacacuuaucugccagguaugaugguguauaccuuuaaucccagcacucaggaggcagagaggcaucccugugaguuuccugauagccauaucuauguagugcaacacugucucaaaaaagauauacugggcuggagagaugacucaguggauaaaagcaugggcugcucagaggcccugaguucaaaucccagcaaccacacaguggcucacagccaucuguagugggaucugaugcucucuccuggugugucugaagacagugccaguguacucacauauaugaaguaaauauggccagagagaguggggcugggauauacuuaggguugugggaugucauucaauaguaaagugcuuuccuagcaugugggaggucccaggucucauccccaucccugugacaguguacagaugauugcauauccaaccccuuggacuuguguggucagagcgucucucaugagcucauccucccgguccaggcuaaccucuguccccaugacggcugccuccucagcccuuguccugcacucacuccaucucugggugcagggacugcugugcaaugcuugccuuuuugugcuggcuuccucucucugggaaguguccucaugcuugccuggugauuuuauuuagacugaguccugguucucucguuggcugccuggaaaaaaaaggacagaagcuuaucuaccagaugacaagaacaaaucagugaguauuguccagauguggcagucguagugggguggauggguagguaaugauggccugucacugcuugauaaugcaauguauuaggauucagaacagaccugaaagaguuaacauucucugaaguugugaagugucuaaaucacauucuaauucuuuuuaguuucauuguacugaauuuuuuuuucuuuuaaaaaucuuggcagauuguuugggaugaaaagaaaaaccagugggugaauuugaaugaaccagaggaggagguaagcaguguccuuaggucccuguuugaggggaaggcugccugcuuuauuucuugucaccugggcaaggccucccuuuggagaguccucacuggucuccaaucguguuaaaggcauugcugagcugucucucccucugcagaagaaggcuccacccccaccuccaacaucguuccccaggguuccccagguggcucccacugggccugcaggaccacccacggccuccgugaauguguuuucuagaaaagcagguaauagcuacagcagaaaucagaggugucuguguagaacacuguccuuuggcauccagagcucagucagcugucaugaugcucacguugucugugcauuuuccacccuugagagaaaagcccaguuacccaguacaugaugagaucugaauagauggcccauagaucugaguuuucuguuaguauauaugcagcccgugugacuggguagaauggaaaccaagcccaauagucaauucugcugugcacccucauuaguucuucugauucagugggaaccaaauuuguuggauguuggaggucgaauagcgcucaacugaauuugacucucccucucauugauagguggguccagagcucgcuauguggauguucuaaacccaaguggaacacagcggagugaaccagcucuugcuccugcagauuucuuugcuccucucgccccacugccaauuccuucuaacuuauuuguaccaaacccagguaggcagcccauguauucacccggcuucuugaucaguuuccaucuaugagccuguggcccuagucuuccuuagaagaauaacugggccaaggugcaaaggaccaaaggcuuguauauacuucuuuggcaauuggacuuuccucccugguugaacccuuacauuuggacuguuuggacagauugucccagacauugggcuggggugaugacuucaugcucccucauucacagaugcagaagagccacaaccugcagaugggacuggcuguaggggacaggcaccagcugggacucagucuaaggcagaguccacccuggaacccaagguauauacagugcuguagaaagaaggugaggggcucccuguauccuuuaggauuccuuugcccccugcaaaucagugucaggugugucaggugaugacucuggucacauugucuauauuuguuugguagagacauuagaagguuaaugcaaggccugaggaaggcacucaagguucaauuuggaaagaagaaaaacucuaaagguggaugggguugauggcuguuuuaacaguaucguccagccgggcaugguggcacaugccuuuaaucccagcacuugggaggcggaggcagguggauuucuggguucgaggccagcuuggucuacagagugaguuccaggacagccugggcuauacagagaaacccugucucgaaaaaaaaugaaaacaaaaaauaaaaaaaccaguauaguccauuaauguuucuugcuuugaagugguaugggugguaauucuauguuaaacauauuuuaccaaaguuuuuaaaaucagaaaaaaaguuagaaaacaaagaauuagguagcaguacaaaaaguaaagaaggguaaaaaaagcagcugaauccccacguuccuaggaaagccugcucuugucuggacccauggcccucacggccuccagagagucggagggcaguaauguguggugcacacaggcuugugggcugugcaucaagagccacuccaggcaggacagugggggccuggggagaacaccuucauaucagaacuaccaggcauaucagaguaguguuuaggcugugcuacgggagcaggcaguuuucuucucucuagguguaaaagcuuagacucuuuggauuggagcguuaccacacuucacauuucauauuuccuuauaggugggaaguucuacaguaucagccccuggaccugagcucuuacccuccaaaccagauggcucccaaggaggagagguagggaacccugccaguaugagugcuggguguguguguguuguguguuaccugugcauuuguguauuaugugugugcaggagaggaggugagggcaugcaugugcaugggugugugcauguugcaugucuguguggguguggguguggugggguacuauggccuggaauggugauucagccagcucagugcacuucccuguggugacuuuuuagaagugugcaagugaguaggagaaggaagugcaagauggcagcacaguguguuugauuaacaguaacacuuuaacuuguaugaucacuuuuucucaggugcucugagucagguguggggcugacaucaucacuuucuagccaggucucccucacaguauccuuagaauuucagaacuuugaggugucacaaaguaugagcuaagagcuagacagauuuuuuuccuuuuccagcguaaugaugguugucuuaaccaaaacugggggggggggggcauuugaugcuaccucuggcugucuucauuugagugauauugauucuaauggcaucauaaagcuuuuaaaaccagcugacagcuuggagcaauggagcaugcugaucuucaugucuguaucuuguguguucuugcuguuccauagcucucgcguuguagcucucugagcucgcucucacaggaagugagccggcauuuccaucagguaccuguggcugguggcucccuccacggggcuggcuauguagcucccauaugucccuuagagagucugucauccucuuuacuuugucacuaaccccuugucuuaaccaagcaucaugugggcaaagaugcaguuuuccuuuauuagauggccugggucuagauacgcuggugguggacuugccucacaggguucagagugcucagggagcuuccuaacucugcuccuugugaaguggccugaccccuucccuaccaugaucuccugaguuaagacacuacuuggaaagaaagauuucuucuugcugaugaggcuugaggaagucuguuuguagccaguagaaauguggacaugauaagccaucguguggccaaacuagaggagacaaggaacgcuuuucauccucuguuuuggagccaggccaugucaguagcuuucaguggaaagucugaggggacauuugacuguccauggcuguagagcaggcacacuguccaggccgccuaacuguuugaccagcacuaaugaaaugucaguguccugcacucacugucugcauguuguucaaaugauuuucugcauggugcuuugacuuuggcugucccaugacccauccaguaaugaaaacaaguguuaccagaacugucucucuggagccuauuuggagcguuaaugguucuuucugaguuauggcuugugucugcugcugggacagcaacugcuguguuacacugacuugcugagguccaucucugugcuucacaggcuccuggagaccauuguccuacaggggccccucauggugggucugugcccuuuuacaacccugcucaguuggugcaggugagugacccuugccuuuguuccccacagccccaacuuuucugcucagugagucuccuuuguucccuggcuggcuguacuuuuggggggguuuguuuuguuacuuguuuuuuuuaaagacaggguuucucuguguagcccuggcuguccuagaacucacucuguaggucucuuacuugacuuagucugcauccuaugcuugccugcugcuccucucacuacucugggcucuucagggucagggauuguucuuuuuguuacuugccauggcugaggguuggcucucacuauugccaaccucccauuccugcacaggaugcaugguuuucccagguuagccauagaucacaggcucuaagcccaguccucucccuccugccucccccucuucuccuuaagagcagcucuuccaaggagaccccugguuugggauuuuucauugcuucaauuccucugucugagugacacauuguuuaauugcuugacucuugaagauccuuugggucugcccuaggugcuggguugagaguuugcugggugcaguuuuuagaucaaaaaugguaguaccauuuucuggugcucacuguaagagaguccgggucuucauucucugucucugaaggcuggaauagcaucuuccuugaggaucuguacaccccuucccucagucauggcucuuguguucuucgccuaggagagucuggaaugugcuauauaguuucucuccuccaccaucuuuugaagaaguauagucuggcuucuguggaggggacgagcucuaggcaagcaucuuuauuuugggggacaagggacuuaaaccagguacuuaaacaugcugcacaaguacucuaaaaaaugagaugcaguccuggggaaagcagcaugugugggguuuuuguuguuguguuugguuuuguuuuuaaucaaagggcaagcaagcaaaguuuauuuaaauuuuuauuuuauguguauggguauuuugcugcauauauggcugucuacuauuugcauaccuagugucuacagagaccagaagaagacaucaaguccccugaaacuggaguuacagaugguuaugagucauuaugugggugcugggaauugaacccaggugaucuggaggaggagucauuuuuuuuguuuuguuuuucauauaugucauacaaagucuauugagaaguaaauaaaucuuugcaaccaggaagagcucaaaaugaguuaccugggcagguaucuugacauucugaaugugauguucucagcccacucuaacagggacccugcccgcagcugugcuagacccagccuuggccacucucuguuuaguccucuugaggggccugggcccugugcuaagcccugugcagaugaggcugcugauaucaacauuuuuguccauauuuucaacuccaagaucucauuuuucuuuugagcuugugguugaauaguucugacagauuucuuggauuagaucccaguaaggucuagugagggaggaagaauauaugcaguguucucucguggcaugcagcguccuugugcuuucaggaguagaaaauuauaggccacuggccacccuugcacucagugaacccuuagcugccccccccucccccccccccccccccgcucuguagugcuaacucagcucuuuugaccuugacagaauuggcagaacaaaaacaaaucaugucugcagugcugugggcuaggaaaugcugagcagcaggaacuuggcacauacagaaggucuugcuuacacuugaagcuaacacagagucugcccauuuguuauugaucugugggguuauccuguagcuccaucgcuggacagccucugggcauggacacauguaggucauugcuguuccuuuuguucuaggcuucugucaccucgggaaauucaaggccagggaggauuggccaaagaaaauaugcggcauugaacuaggauugcugcuggauucuuauuuggaacccugagaugauuagauaacuguucuucaccaagaaccaacuagcugccucaggucucguggaucccagauggacauggcaguaacucagagccggucauacugugugucuccuuccuugcagccuauguauaugaaugauugaaaaauugauuucaagguuccuuucaaaugcuggauagaaugaaucuaauucaaagucuuuuauguaaaagaacaauguuucuuuuuuagucacuuuagacaaauuaagguuugagccacuugagaauauccccgcagagaggcuaggcagggauucacuacaggagagcacaguuacuuggacaccaaggccuuucucaccugagaaauggugcaaaccaaccagggauccuuaggcuacugagaaggcugucugcuuaccuggagaggacugacugcugggaugucuggccuaagaggagccucaaacugcacugggcaacugugccuuguccugugaacuggggaguacaugccagcuccucaaagggucaccagauggcagcggcucccaggcuggggaggaagugguuacaagggcaugucucuccaacauuuccagccucacuccauuuucuguggccucauuagugcugggugcguuuuuuuuuugcuccgagcuuuccgucauggcucagucacuggggagagccccagggagcugauauucugaagcugcugaucugauuaaccaggucaaaaacuggcugugugcugcaacguacugcccuccuagccaggagucuguauggagcccucuagcugacucaaugucaccugcagacagcacuuaaagccuuggugguaucuuggaguggcuuacgguguccuagcgcacacucuggaaccuugcaucucuaccccaaagcccaccagggaccuucagcagcgacucacuggcucacccauaucacuucaaggagcugccaccacauaagagucaaagcuuuaaggcuucacugacuguuccuaaaacuauccuuacacucuaaagaggaagggaaagagaguuaaauauuuaaaaaucagcagguagaaaacauaaaugguuuguuugguauuaaauuuagaaauuguagaacauggaauuaguacagcccuucccgguuuucugguuccuugcaucaucuaggaaagacucacagaauggcuuccaggacguuccauagaugaguguacuuggacccuccuguuccugucauuaagaaaggccugucccugugggucaguagcaacuuguguccuugcugggaccaggcaggacccuugccucugguucaacccugcccaggcucuguguugacugccaaccacuuuggauucaagaagcuuccucccugggagcugcuauuuuuccaaaauucacauuguuaaauaaaauauuuugggcucucaaguaacuuaauuuauggcuuccuuuguguuuugaggggcagaccagcgagaucuuuaguguugguagagccuugggcagcuauugggugugacugccugugccugguccugccgcggcuuggcagggcgggagcucgugucgggcguggcuuccaggcaccgggcugugguccuccggccgcgagagggcgcuguggcggcgauagggucuugggccgggcaguucuccggaagacuacagaacggaaccugagccagggugaccacuagacugagcuggggcgaacccugggcgggggcgggggccgaggcacggggccgcagucguuguuccagcugccaccgugacuggccuagguccgccuccgccagcgcugggcccggcugaaucagaccucgggcguccggcggcgggucugcugccgaacggagggcgcaggugagccuaggacgcugagcgcgcugcccuacucugccucggcgggguggagggcuggccgggggugcuggacagacuugugcagcuccgugaagugcagccccgacccccuggcgccuguucucacgaagucgcuuuuaagacuagcgagcugacuucggggagccaagagauuuuucugcguuuccucaggcaucggugagaacucucaagucuccagccaugcagcuacaggcccuccuccaaaaggaccgccccaugccacaaagggagccacucgaguuuucauggcaucgagcuggcgaacucugacgugcauccuugacaacaagaguugcuuguuaaccucccagggaggaucccuuuccuuaggagggccaggcugagggggucagggcuggccaggucuggacuaugccauccaagucagcuugccugcgucacacugaggcaccugggcagcuagaaggcagaaugcuccagggacagccuccgaacacggaaaagaagcucaucccaacaccaggcuucuuaccagccucugacucucaggguucagagacaaaccccaugccuccuuucagcauuccagcaaaaacaagcaaccagaacccacaaacuaaggcaaaucucaucaccccacagccacccauuagacccaaguuggagcgaacccugucccucgaugacaagggcuggagaaggaggcguuuccgggguagucaggaggaucugacuguccagaauggggccagucccugcaggggcuccuugcaagacucaguagcccaguccccugccuacagccguccccugcccugccucagcacauccuugcaggagauaccuaagucccgaagggccacaggcagugagggagggagcccauccuuguggagugacugucuuucuggaaugaucagcaccuccuuggaccuccugcacagagaugcugccucaggugggccccccuccagguuggcaaguuugcaugccucacacacaccaccagcuauggaccucagcauagccuccagcucccugagaacagcaaacaagguugaccccgagcacacggacuacaagcuccgcaugcagaccagacuggucagggcccacagcaaccugggcccuagcagaccccggagccccuuggcuggugacgaucacuccauucacucagccagaucuuucagccuucuggcccccauccgcaccaaggacaucagaagcagguagggcuuucaggggggagggggagggagcucuggggcugucaucagaggcccucaucucaucaggccaagagcaaacugagccaggcaugguggcucuugcuaguaaucccagaucuuaaaagacuugagguuggaucaucacaaguucaaggccagucugggcuaucgugagccaccaucuacauaaauagauauaaaagaacuagcuacccaggggcuaugugaauggauccgaauagagaaugccuaagacuuggaaauggaaaauaagacagaucacccauccucucucagaaaucaugccuuucuccuucugucuauguccuuccagaaccuuuucuuuggggcucagugucauccacagacacuuugaacguguagaaguugcuugucuaccucauucuuuacggaggcaaaugagagcacacccucacacucucacuguacacguaguuuguaucuccauguguccugccgggcagcuaucucagugagugucugaguuggucccuugguuucuuagcguggaggaucacagguuucuucagcuguacuuguuuuuuguuguuuguuuguugguugguugguuuuucgagacaggguuucucuguguagcuuuggcuguccuggaacucuguagaccaguucgagguaggccuguacuuguuuuuaaccacugcucaugaggagcacucagggaugucuggugauuauugauaccugagggagggcugggugcugucccaucaugcuggggccauaggucagcauuuuaccaggacauuuagacaccaguuaacccacuggaccaagacgccaggggccacuugcagggccaaggaaugggcuugacuagcuuacucuaugcccuugggagagcuuccacacuguguccgagaugggcaauugcugauguccacugagaccucuucccugccaugaacauccugagacuauaccgaaccucccugacuccaguaauuaacuuguacggacuuacacggaaaagagccugggagccgcccaccacaaggugaacccuuucuuguuuggcuucccuaugcuggcuccccuuucuuggggccacauccacuaugggggacacagaacccaagcauggccuauccagaucuggagccuccuuucccaagcugguccccuucuguggucuugcucuuggccuguaagguauauccugccucaggccuccuacauccauguugcuggacauuuggugggugggacagugagaguggggagggcucucgugguauuuccaggagccaccuaaacaggugacuaugggcuagaagguuucaugcgagagaccuagagugaugugagagugcuuugcucuaggcaaaggaccucugagagggagguagucucuugaaguacaguuucugccuguaucuccagguagucauuucuaaguuucccagucagugacuccagcccugcuaacugcaggacccucuucuggagauguugggguguucauaucugcacagaccgcuuccaaagagagccacauacugagaggccucugguggacacaucuuuaguggggccaccauucaguuccuuuuaguugcugaagguaggccucacuccuagcacccuaccugugugcagcccucuucacuaagccuggcucuuccacagcaugcucuggugucauuaggucagugggcgccuccagcugugccucacaccucacaacugcagcuuguucuaggucaguagguggcaugaugcagcuuucagcucucucagccuuagccuuagccacucauuugggagagugccugguacuaguguggcaagaaggacagugguauugacggcacuuuacugugggacacagauuugauuuguaugagucauaaaaucguguuauugguuucuuuuuccacaauuagaaaagcaugaaaacucuugcuuaucuggugggcauugaugcucugccugcaugugugucugagaguauuggauccucuggggcuagaguuauggacggguaugaaaugccauguguggaugcugggaacugaacccaggaccuccggaagagcagccagugcuuuuaacugcuaagccaguaucucuccaacucugugaaaacuacuuaguggcuggaucaggccugggucccuacuauuguuucagaagaggcccuagauucuuuuccagggcaucuuguucccagaggccaccagguugcaguagcugaccuacuacuuaagaaaaaacaauugcauuuauuuauguguguaugcaugcacaugcucaugggaaugcauagugagcauguauauuauaaaucaggacaguauaugggaguugguccuuucauaccaugugggauggcuacaucaucuuaccagccaaacccuccauuuuuauucuuucuugugaugaggucucacuauguagccuuggcuagccuguaacuugccguguagacuaggcuggccuggaacucacagauaucugcuuccugggauuaaaggcuuccaugcuccuuuuacucagaagaucuggaguguccuccccuaaauggauugggaagcugugcucccuaaggcugggcacaggaaugagcuuuuaccccgcugcuguccagucauguucuguagccaucuggacaaauugggugacucccuaguuuggaggaagcagggacagcauacaaggaaggguguggggcuuugggcuggugucugaaggacuagucugucuccccugugcucaauggcuccuuccuaaauaacucaggauuuugcucuaccagguuaguguguggacccaacuagcuuauuagugacuuucacucauuggcuuggaagcgaggucaagaagguccccccccuaaggcagcccaggcuaccucuugagggcuuauagagcugcacccuuaggacauucugccccaugaaguucaggaacauguguucuggcuccaacuggcuguuguucuuagagacuugaggaacauugguuuguucaugcauucuuaacagauuuggccaaaaacaguaaggaaggauaggguaagcauguggcacauaccuucacccagcuaccaagagagaacagaagaucuucaguugaagguugaagaucagccuagacacagcaaggccuugucucaggaggagaggagagggagaggggagagggagaggggggagggggagggggagggggagggggaggagaggagaggagaggagaggagaggagaggagaggagaggagaggagaggagaggagaggagaggagaggagaggagggaagaaaaaaaaaaagacaggauauagcucaguguagagggcuuggcuuagcauguaugaagcccuggguucuaccaaaauaucuagcaucaccaaaaauaggagugaggggugggugggugggucagcaguugagagcccuggcuguuuacagagcaccugacuuugguuccuagcaaccacaugguggcucacgaucauaacuccaguucuagggggucaggcaaaacacuuacauuaauaaaauaagucggcuuuuuguuuguuuguuuuuaaaaaagauuuauuuuauuauuauaucuaaguacacuguagcuaucuucagaugcaccagaaaaggacaucagaucucauuacgggugguugugagacaccaugugguugcugggauuugaacucaggaccuucagaagagcagucugugcucuuaaccacugagccaucucuccagcccugguuuuuguuuuuaauuaggccagagacgugaaaagcauucaggguuccuuucagcugguguuagagugaugcugugugucuuugucccuuccugagccuugguaaacgggagguggagguggaguggggaaugauggcugaugggagggaggaggguccugcacuggauuguccccauauuccagcucuccucugucaccaccgggcagcuccauugugucucgucagguagaacugguggcugggugggcaugaggacuagggggaaauuaccuuggaagaaacaggagagguugccggggauucuggaagauagguggcucccauggcgcugcggguggggaugagaaggaugcccugcugaaucagcugugagcucgggacggggcagguggugcuguugcaggcagggacagaaaugcugggaggaaggugacaaauagugagcuuaggcuucccucggucaguuacagcugccuuaacccugaggcggagccagggcauguggguggugaacaaggcaguggaccaagcagagcgcugcccugugagaaagugcagaggacaguacagugacaaggauccagaacagggagccugaagucuuccaccgaaauggcauuuggaggaguggcuucagagaagcauuuagaggaagccagugggacaauggccugaguguacaugcaacaagcucacagggaccuuaaauuucuuucuuuagauucauuuuaugcauaugugaguguuucgugggaucuagcguccucuucuggacuccacacguaccaggcacacacgugaugcucauacauucaggcaaaacucucauacacauaaaauaaaaacagaaucuccuggaacuggaguuagggauauuuugaggcaccaugugagacacuaggaaucaaacuuggguccuggaagagcagcuagugauuucaacuacuaaaccaucucucuagcuccaggacuuccauuucuuaaaggccuggagaauaaugaaaacaaaucuaguauuucucagcauauggaaaaguaugugagauuuggaauucuugauuuauuuguugauauuucauguacacugcuguuuuaccuucauuggugucuguguuaggguaucaaaccacucagaauuauagacaauuaugagcugccaugugggugcugggaguugagcccagguccucuggaaaaguagccugugcuuuuaauugcugagccaucuuuccagcccugagguucagauuccguugucccagaaugcauagcucucugggcaaccaaccauacccaucauuucucccuggaacuuugguguuucuauacuguggugauggagcugagugauaggguagagauguaucacccacagggauguauauguucaguaucucuguacaggccgguugggcagccccuauagcacauggugcacacauguguccuggguaggucagauucaucacacuuaggacuggguuucagcuugaccaauguggccucauuccauugagaucuggagacagacugaauucagagggagaugagggccaucuguguugccaucuguguugguauuguacucuggcuaaggaaaucucaacucuaggggcaauacugauggcugguauggacaggauuguccucaggcccaaauggcuuauagaacugauaccuuuggagaguguggucccaaagguaccuuuccugagugaaggaacuccugggucacucuggcaucacugaagcuggcugcucacuugccucuuuuuuuuuuguaggagcuaucuggagggaagucuucuggccaguggggcccugcuaggagcagaagagcuggccagguacuucccagaccgaaacauggcucucuucguggcuaccuggaacaugcagggccagaaggugagaggggucacagugagguaaggcagaggcagcuggacuccauguccugacugaucacagcauaauggcucugugagucuccgugagggaucgggguugggcaugcacugggaggaugggcauaccccccaggcagccugcgcagauugaagcgccugguaagaaggggcgccugcugggaaguagcaacugagcaguugugccuuaagagggagacuuaaguaucugucaugucaaggucccuggaagaccaaaccuacagcuguguacacuucucuuugaaaagaagcuauuucugggaccauuuccaggugauggugcagggccuugcucuugaaccucugcucccaaccugagggaacccagcggucuugacuguuuuguggucuucaccacaggagcucccagcgagccuggaugaguuucugcuccccaccgaggcugacuacacucaggaccuguaugucauuggaauucaggagggcugcucugacaggugaggcuccacucggccuccacuauugaugggaaccuccagaguccuguauggacagugcacugggacccgagaccuauguggaauugaagcaaugugggccagaugagggaccuccaugccucacuaaaaugagcauaaaagucagcaguuguccaagggagcacagaggcagcuaagaggcucugggcugccucugucugguuacauaucugguggcgcccugauggauaucccuggaaagugguuccacagccgugugcuccucacuguaguuuaugggguuugcuggccugugaggagaacaggagaccucuggggaaaggagccugucccugucagagguggggcccaccccugccagcccauagcucucugauaacucacaugagucugggugggacuggagaucugcacacgccugaagcaaccugaaggcucucacagugcaugaagaugccauuaaccuggucauucucaguacaagaugaggcacaguuguccccgcagaaugcuuccagggguucucugggcaacaugggagaggguggagcugaaaggccccaucuaaccugccuccuuccccacaggcgggagugggagacacgccugcaggagacacugggcccucaguauguacugcugucaucagcagcacaugggguccuguacaugucccuguuuauccguagggaccucaucugguucugcucagguaggcaauaccauggggcuucuccccucacauccucucuccgucucuaugucugugacaugugccugcaccacagagcacauguggagguuagaggacaaccugcaagagucaguucuccuuccaccguauggguccuaggaucaacuguggucuugucuuaagucuuagcaucuugcuggcccuugccagggcucuaggugucuccauauacaggcuuuaauaacauauggacccuguccacauauggguccccucacagcaaccugcauccucucaaugcacuuugugcuugggauccagccuuugagguuccuaugucugaggacacacacaagcacaccuaguguagcugugucuguucaggcccugaacccguuccuugcccugcagaggucgaguacuccacaguaacuacacgcaucgugucucagaucaagaccaagggggcccugggcgucagcuucaccuuuuuuggcaccuccuuccucuucaucacaucucacuucaccuguaaguguuugcaagccuuguauaguccugaaacugguuugugagucucuguccagguggggugccaguugcucugcgcuaguagugguggguagagucugauacucagaacauucacuguugucaaccacagcccugaggcagagccccacagcagacaacuggguaguauuuggggacagucaggguauggggcagcucaagugucuauucugguuuugucccguagcuggagaugggaagguagcagagcggcuacuggacuacagcagaaccauccaagcccuagcccugccccggaaugugccagacacaaaucccuaccgcucuagugcaggugagggcuacagcugcacaagacacucuccagcaaugugacuguuggagggcuuaggagauucauggaguccucaagacugaaauagccacuggguuugcagcagggcagaugggagcucacaagguccaguggcuuggcuuguccucaaguccuccgugccaaccacuuccuggcccuuacugagcugugagaagcugauagauggcuaggccugcucuguguaucgaaguuggccuuugcaccuagacugcagagagcuucccauccgcugcaguuguugaccuuggcugcuccuaucacugucuccugggggggagcugcuacccagcugcgauucugucuggaaggggacgcaaacaagggaggcccuauccuguccuagagcccauccauuugucugcaaaucagagcagaugaggggaggccagcaccaauguauucuuuuaccacgugcccaggggaugucacuacccgguuugaugaggucuucugguuuggggacuucaacuuccgccugagugguggacgaguggcuguggaggccuuccugaagcagaaaccugagguggaugugcuggcucuccuccaacacgaccagcucacccgggagaugaagaaaggugaguggccugaggagcagcaccucaggcauggccggcccucccugacucuccuguguugcaggguccaucuucaggggcuuugaggaggcagagauucacuuucuuccauccuacaaguuugacauugggaaggacaccuacgacagcaccuccaagcaaaggacacccuccuacacagugaguauguaacuucagccugaccucaggacuccugccaaccacagcucaugucaagcauguaggacugacgcucggcacacagcagccagccagguuagccagccuagaacguaucaguccugaggccagugacugcaugcucgcagccuaccggggguggaggauagugcucugaaugcauuacuggccacggugagagucacucuggagcccaucugccuggcacuaggugagaacaaguggcaagcaccugcaggcucaccuggcuuuuccaccagacccugacucucuuggguauugacuggcaccugagggauccuugaacacuugugagagcccagcagcuccuugcucucagagggcuggaagggaacagauggcauccacauaggacuuuaaaugccuaacaauuuucauguucaguagggaggguucccuaacugaaacagcuaggccagggccacagccuacaccacgcugcacaggacacccacagcagaaugacgcacaaucucuguuucaccaucucuuccgaaggaccgaguccuauacaaaagccgucacaagggugacaucugucccaugaaguauuccucuuguccugggaucaagacuucagaccaccguccuguguauggcuuguuccaggugaaagugaggccaggacgagacaaguaagcuuugggggcuccugccaguucuuggauaggguaacuuuugggggauggauggcaggcuuaggcgaggccuaauguuccacgcagccccuaggcuauuaugaaucugcguccaucugagccucagucccagcugcuucuuagggcauaacucccagguuacuaaucuuugugguugcaugaagaaacggcuuguucugugaccugcuucucuaggguugagcaagcuccuggaggcaucagcaucaccuucuuuuggcacaacaggguugugguuggggcuagagcaaccuagaugggacgaagaacccuaaccucugggcaguggcccauuuccuauggggcucagcaggugugcagcugagugaaguugaggccagcucuuuuuuuuuuuuuuuuuuuuuuuuuuuugguuuuucaagacaggguuucucuguguagcccuggcuguccuggaacucacucuguagaccaggcuggccucgaacucaaaaaucgccugccucugccucccgagugcugggauuaaacgccaccacgccuggcaaagccagcucuuauuaaaggucuuuuuuucacagcaucccauuagcugccggcaaguuugaccgagaauuguacuugauaggaauuaaaaggcggauuucaaaggagauucagagacaggaagcacugaagagccagagcuccagugcaguuugcaccguguccugaagauuccagaccaggacuggccacagcaacgggggccaaggucacugcaaaggaugggcuucuucucagcugcuccuguaaugcugggauucuaauccaccacggccaggggcucccugcucucaccacagacccagcccucaggacauuuauaccauguucccacaggcacauggcagggcauguggacaccaagcagcaguuuuguccucaggaguaguccagacuucuugcccuugagcacugcugucucuucaaacuccuuuuauuuauuccuguucucaugcuagagcccagguucuccaucuguauccuccuaguagcuccuucccuccagggaaggaucaggcaaccucugguauccuagaugcucaaugccuagaaccugccaggacuucaauucugggauauucccuacagacauuuugacaggcuuugagguucuacauccuggucccaggcucccaacccccaguugaguagggaccucuccacucuacaggccaagccuagcuauauuaaacucauaguuuuuaggagcuucagaccauuugcuuuugugcugcuagucccggaaaggcaugagaaauuguuaccagacagcaccuugcuggguuucacuccuugaagaaagcuuaggagcaucauugcucucaaucuuaccccaccccuucagacauagccuugaauguacagacaccuaggggcauccacucuagucuucuaaaucauuuauuuuuccauauuuauauuuuuaaauaaauaaggauauauucaauuguaaacucuuucuggccaaagagugaaccuuggaagaagucugcaugcaucuuggggccucaggacaccccaggguuuuaaaaggacauagaagucaaaggccaaacauuuggucucagcugucaccugcuacucagucccaucccaggucuuucugcuagguacugucccugcucacagccagaagcagcaauagcuggaaaaagugacgacuugggacuccagugaaccauaauaaaccaacgaauaaggugaaacucaacagcaucagcuucuccaauauggaaagucaccugcuucaauaaaccacugugaacugcaaauucuacugggaagacagccuuuucucucccagacaggcugcccuggacuucauaauccugccucaacuauuccuggcuugaauaagguuugaugugguaagaguuccagacagguuucucuguagccccggcuguccuggaacucucuguagaccaggcuggccucgaacuuggagaaccaccugcuucugccuccugaaugcugggauuaaaggcgugcacuaccacagcccagcaguuuggugcuucuuuguggacauucucuggcaccuuagaaaagacugagguaauccuggaacuucccaguuuggcccaagaucaagaucauaaagucuuaggggucggggggcaaaguacagccauagcaauuuacauuuagauagccuuuacauuuagagggcauuucaguuggaaaaguuaaacacguaaacuagugcagaugaagugggaaauuaaaacuggacuuguaaauaauugugagauacaacuggcauggugacucuuacuagaaagaccaguaacugaggcaaagacaagcucacugugaggccagccagggcuaauuaguauuuuaucucaaaaaacaaaggagaagauugugaaauaccuuuaggcuuguuaaagaacuuaagcuuuagaaaugaggccaggugugguagcacuugccuauaauuuuagcaccugggaggcagaggcaggagggucucugaguuugagaugaguauaucuuauaucaagucucaagccacucaggguuuuacugugagauccuauuugaaggggaaaaaaaugaguacaauuuaugccagugguucuaccaauggguaggcccugugugcuuucagaguguggcgcuuugucucccuagagucccaagacuuucuaaucuuucccagccuuccuugcuccagaaacaucuaguggccagacagcaccugcuuuggcagauacucaggaaaaauacuuguuagaugaaaaauaagccacuuguguuugaaagacacaaaagugcaguggcaacaguaacuuucauucaaguuuccagaguuucacuguuggcacuguucacacagcuagcuagccuuaugcagugucuacaccaacaguaacaugcacacaagcacucuacagccagcucuaagggacucuaccggaacagccgguaugaucugggcagguguccauuucugcuggacagcgcugccuggaugugcucauagguggguaggucagucaaaucacccagggcagccacagcaggcuugccacggagcaucuuggaagcaacccucuugauaucuucuggcuucacguugcc

SEQ ID NO: 703 - RNA, 11372 nt, Mus musculus
cgagggaggcgggguccgcguccaggacgcggcggggcggagcggggcgcgaugccccccggcagggccaggcccggaggggcgggaacagggcgggacggccgcaccuagcucugggcuuccagccuggcccgcccucuacccucggcgcuccucaaaaggggcgcgggcggcggguggagggcggcggcgccgucggggcuggggugcggccgccauggacccguggccauggcugacggcggcgcugcugcugcuguugcugcuugugcagcugagccgcacagccagguucuacgccaaggucggucucuacugcgugcucugccuguccuucuccgccgcggccucgaucgucugccugcugcgccacggcggccgcaccguggauaacaugaggcaagggggccggacgccgggaugggcgcgcgcuuccgcuuuccuaacuucugagcuccucgcguucuuuccuuccugccccgcccgccccgccguccccacgguccggagccuccgacgacgcggcuucccgucccaggggcgcgugucacgaugugcgccgcuuguagggcucggcccugcggcgcccccugcgcgcagcguggagugucggguuugcgcgcgccgcuagcuuugggagagggagggggccgagcgaaggugggacaggcccaaucccacuuucaccagcagggaaaccgaagccuagccaggcuuccgguccgugcuuccaccucucugccgguuagaagacaccugugcccagguuguagccacagguucuccuugucauuaacuuccucuucuggggggugggggccgaacugucuuuggaccuggcuugcuagcaauaaaggaaggaggcuguggccagaauccuccucugcccaucucccagagcagggaagcuuaguggacaagcaaaagguacagguauggagaucaggcuagguuguccugcaaugggggcugcccgagagaaaaagccucuaguccuuucucccuguccacacucccaggagacuguugcuacauuucuuucugccccauuuggacugcugagaggguggguuuugcaauguccuggccuuggccuugccuggguguuucggaccuugugccccugaagccccuccucccccgcgguaguuacaaggacugugaaugaugguuuccugacucucggcuguaucuggucgucuuugggguuaggaugcuguccugaccagccauauuuugugggucccagcccucauuucucaggugcuuauagugacuauccagugucccagggagcagacaugcagaggagacccuugcacagaagacaagggugcccuagcuaugcacuuuucacggugcauagaacaggguggggaggccugcuccccaccuccccacccugucuuaggguuccugucuuaaauccucauaaggcgaugaguugagauaggaacagcagggcccuuggaguauugcaagcaugacauccuccagggaugaccguagagaggggugaguggaaaagaaagggauugacuagcuaggagguggaggcuugcucaguccacauauggacucauccccaucucgugccucccuggccuaggccagccaagcuuggguugcagaugcuacucugccugggcaacagaugggacugagguucagaaaagcaauuugacagaaagguuugcggacugggagaguuuggaaagaaggaggcaagggaucaagauccccccagccaggacagggugcucugggaaccgaaccccagagggccaguguauaauaaauucuauaauaaauucccuuggugccggcucagcuauagugaugcuuuccaagggugcugcauacagucacucuaaggcagagacuuucaaccuaaugcuguaugacccuuuaaacaguucuucauauuguggugacccccccaaccauaaaauuauuuucaucacuguaauuuugcuacuuuuaugaaucauaacuaucugauaugcaaguuaucugauauucuaccccugugaaagggcauuugacccccaaagaagccgagacccauagguugaugacugcuauacuaagggcuaaucuuauuguucuguuuuuuuguuuguuuuucuagagagaguuuagaaaaacccuguguagcccuggcuguccuagaacucacucuguagaucaggcuggucucaaacucagagauccacuugccucugccucuugagugauguuauuaauuuaaggcacuaaagggcuguaagccagauccugagcuccuggaaggacagcccuggucugcaccugguuucuaaaggaagccuuugucauuugguuuagaguucugagaugcaaggaacagcauuagaaacacagagaccaaguuugacuauucagacguggcuuaggggcuaagaccaaggaagggcuguacauguggagcccuucccuguauacagaccagaguugggugacaggaggcaggggacaggggacuugguuauagcauucgacaaggggauaguaaagcccagggaggcuggauagaauuuugcucagcugcaaaguugggucaccuuaacaagaauaauuuagaccuaaaacacacacacacacacacacacacacacagaaugaguaagugaaugagugagugaguaagugagaccaugaccccaguaaaauaagaacaggccuccuuccuaaccuagagcuccaguguugcagccugugacuacacuguaucucauccaagcaucuguggagagugaggggugggggcaauggauaccuagcaccugcaggaacuagucuuaguuuuuaggcugaacuuuagcuuugagcccuggcuaagccccuucuugcugccuaggcuauaagagucagcaucauccuggaaaguccuggccguuuguagguuagcagaaacagaauuuuguagaacauugcuaacauguuccucuccugauucaaugaugccaucuugaccuguggagaacagugaagccuagcucuggcugccuuuggguaaugggucaguccccacuccuccuccucccccuccuccuccucccccuccuccuccuccuccuccuccuccuccuccucccccuccuccuccuccuccuucucucucucucucucucucuuccccuaccccuccccuuaccccucccccuggcaccuacuaccuucauucucuuugguguuugcccaggcuacaaguccuauccuagccccaaucuccugccccuauguuauucuucacuccuggacacuuaucagaaaacugcucugccaaguggcccuaguaggaucucccauccccuaagccaggcccaucaguggcuccccuaccugccauucuccagcaagguagcccugguuggcccuugaagcucccauuuuuaaucuagcaggucuccacccaucaaacucaaggccagaagucagggcaagagucuagucagggcauugaccuuccaugagggcaaugagucuguggcguaggcccugaccuugaacugcuucucaacugccuugggcagguaugggagggaccugagcaggucaaagggcucuucuccugaaguuacucuuguucuaguucugugucccaaucaauagacuacuguuaguacaggcccgcagaguggaguuacuacaucagccagccucaugcaagguagcucuuugcauccuuccccuugcacaagugguaacagaaacagaggucaggucauagauggaaugcauugauccagacugaauaacagacugucuggugcaaaacgagcucaggaggcguccaggggcacgggggugggcuguggggugggggaagcacugccugacagcuggcagccaugcuuccagagcaacaggcugggcacgcaucauccccaggcucuugggguucugaugguuuugacucugccucuacugagauaacacuaaagaggcagcaagucccgacauggagcggggacuagagcacauggcaucgcauccuaggugcaggauuuggggccuagcuccuugaggggggaacggauaggguguucaggacuagacuagguuggcagcucaggcugucauacuaggaaugacacaucccuucaggggagucacuugcuggguggggccagacugccaagcuaacaaagcaggcaaacaggacaggauggacuacuggaacccaacagauucaguuggcaguauaggaaaccauggucccgccccagggugcccucugaucacacaccucaccucacugcuggaagcaguguuaggagguggacuuggguccacguggcuuccucauuccuggggacaggucacuaaccuugcugaccugaauuugugcagccuuuguagaguggguauaaggaccuaucuagcaucuauguccgagcagcgcucuauuaugggccugaaguccuaggcaugguaccugauggugucucucccguuagaaugaagauuccuauuuagacuucuggugucugucagcuacauaaccucuguagagcuuagcuggcaccuuuggggaaaacucguuuauugauuaauugauggauagaauccagagccuuaugcagucugauccaguuuucuaccacugagccacucucccagccugugauaauaaauguucuguguauuuugucucuaaaaauggagauguugagggauguagcucagugguagagugcuugcuuaguauugcaugaagcccugcgucccauugcccuaacccacccccaguacuggagagacagacagacagaaagaggacauauguacaugccacuagcaguggguacagucuggauguggcuggaaacuucccuuugcagcaagacaugggagugaguccacagugaccacuacagguugacugacuuccuuauccaagauccucacgaggaagauagcucagcugguagauuauuugccuacugcacaugaagucaccauugcauagagccaagauguagugugcauuccuguaagcccagcacuagcacuguagaggcaaaggggcaaaaguucaaggccauccuuggcuacucaggaaaaccaggcuaugugagacccugucuuaaauguuuaaaugugguuuuggcugggcagugcagagaaagcauggaaauaaaauuguuuacauuuuuggaugauuugagguuuggaagaggauuuauacauuucuuuuuucuuuucuuuuuuuuuuuaagauugauugauugauugauugauugauuuauuauauguguguacacuguagcugucuucagacacuccagaagagggcaucagauuuuuuguuacagaugguuucgagccaccaugugguugcuggaauuugaacucagggccuuuggaagagcagucagugcucuuaaccacugagccaucucuccagcccgacugauacauuucuagcaagguauccuggacuugacuuuuuuuuuuuccuuuuaaugugucaagugugcugaguacauacacccagagguaacuaacucccuagagcauuuguugugugccugccucugacuguggugacugugaguucagauguggaacuuuagacuugugacaccauuucgagaaaguuugggaucuuggagcacuucagaugcagccuuguggggaugcucagcuuucaaccugaguuugggggguguggcugccugaagcuuugggucccacccccaacauacacauacucuccaccuucuuuucagugagucaauuauaacccaugugcauuuccucugccucaggguauaggcguuuccaaauuccuugauugaaaucuugauuauccacaucuuugcggccauagagaauuccugggaaucuagcuagcuaccaaccucugcccuccagauacaucuggcucuaaaccagaaggagagagggagcaagggacugugcccuguuaagguuuucuagugugcaucugaguaaagggccaggauccuuuccugcucugccuaugccuaugucaacuggugagaacucuuuugacacauugucacauugacaauguguugacacauugucuucucuaaguuaucuucccugucccuuuggagcuucccagagauccgagcagcugugacuuaaagaugaggaacuggggugggggcgaaucucaagcagugaccacucuuucaugaggguuugggaucugucuaccuguccuugcauaauggggaggucugcucuaaagacaagauggcuggaacuagcugaggcuggcaggccugaggagaggucccagguuucaggccuagggaagccauggcugugucaucauuugauuagcagucuuccucuccaagguuucaguuuccucaccagugagaauugcucuuccacugcuggguucuugauggggcaagcauugcaggaagccacuuguauggggacacagagcagcaagaguuuccugggacugggacagucggagucagggguuauggagacaucguauuaguuuggaaagagaaaguucuguguauagacagaggcuguagcacuccaauauuggugccuucacauccugagugcagacaaaugguuacaauggacuuuuuuuuuuaauggcauguggauuucaccauaauuaaaaaaaaaaaguagcuuugaagaagcaguaugcaucugcugcauuguguagagauagcuauaacccguuagggacccuuucccuuaggacugcagggccccuuuuccuuaggacugccagggccccaggggugggguauaccaauguacauguagaauggaguauguuggaguccaccuccccugcucugucacaguaaagaggacauaggccuccucugccuuauagccaacgcccaugacagucuguuuucaaugacuggggcugaguagagaacaagucggguacccucgauggguagggagcagggcuaauuugcugauuugcccccaggauucugugugcccaaguguccuguccugugccugccugcuguuccuucuccccagcuugcccucccuucucuagggagcucauuuugguuacugauaucucugcccucagcaucaucagcugguucguucgguccuucaaguacguguauggccuucgcuuugaggucagcggacagaagaaacuggagguggauggucccugugucaucaucucuaaucaccagagcauccuggacaugauggguaggcugccaucaaggcuuggccacagagagggcgaucuuucucagccugggcccuggugggcuggggucucuggcugggacuggugcaggacaagacuucccucaagcugggcaaucagaggcccaggacugcaccacuuuggcuauuucccaagagacaagaccaggccagaggcagggaccuugacaggugggccaccagccccuucucccccagggagugccaaacugggcucugaagaucuucuucucucuuguuccccacccaaccucccucuccccaaaccuugccacucucuccauuuuuucuaugacucuccuccuaucucuucuuccauccuucccucugucucugucuuucucugucuucccuucucucucucucucucucucucucucucucucucucucucucucucuuucucucucucucucuccugugucucucaaucuccaucucuggucucugccucuccaccucucccucuuccucuccucuguauccauuccuggguuuuuuucucuucucucucucugaucuuugcuuccucuaucucucccuugccugcuucuccaucugugucugucucucauuaucucugucucccucucuauuucuccuaugcucuaauccucuuucauugucuccuaugucucugucuccuaugucucucucucucuugucuccaucucccacccucucuuccuuccucaaucgcucucucuuccauauaggucucauggaaauacucccuaagcgcugugugcagaucgccaagcgugagcuaauguucacagggccugugggccucaucauguaccuugggggugucuacuucaucaaccgccagcaagccagaacugccaugucugugauggccgaccugggcgaccucauggucaaggagaaugugaguauaggcacaguacaacaggauagccuacugcaaggagccgcacagcuuucuuggggugguuacacaggaugugggcagccuaggcaguuuuuuuccuuucuacuggcagcucaaaguguggaucuacccagaggguacacgcaacgacaauggggaccuguugcccuuuaaaaaaggagccuucuacuuggccauccaggcccagguaggccaggcucugcccuccuggggugggaggcugggacaugggucagggugguuuaacguugaagaugauauccuagcucgacugaggaaugcuggccuucagggaucuccuccaccccauuaggaaagggucuccccaccagcucagucccuaccacuuggacagguuagugaccauuggcagcucuaagagcuucaacaccagccuccucacacccuagcugcccagguagguagcccccuucauuuaggaguucaugaaauguggaagugggcagcccugggguuugaccauagugaggcugaggagcgggcacaggcuagcagcaaacccaguucugaguagcacacaugaccucuguccaggaccuuggacuucccgugccccuuagccuguggcaggggaaggcaguauguaucagaagugucccugagugucucccaugccccuugucccugcugugugggggaaagccaccacugggcggacaggagaaggaauuuuacccugcguuaccaauuguuggcugacaagccucagcccaucaaccccugcggcagggagucuccugggcuccugguacccaggccuacaagguggcagguaccauuucccugaggcuccaggggguugggaaacucaggcuggaacaggaaacugcacugugaccucugaucugucuaguccuugguccugggauugaagucauggucuuccuuggcuuugagguauugguaauccuagggaaagagagaaacuaggggcagaagaauccagaccugucaaucauuuccugccccucgcccagggccucacuggggugcagccugccuaccuucuugcccaggcucccaggguuaauuauuacccagugcuaucugccaccauuggaguugacccuggggccugcccggaauaccaacaggcuccagccccuguccccuaguuuccugggaauagggugggagggcagagaaggguccuccaccuccccagugcugauugaagccccacccuuagacuucuaggcuauuuuaugacccagucagggggguggggcaugacaaauaaguacuagcccaggggacuuccuggaggugguguggggaacaggaugagucugggaaacuccaggccacuuggauggaggugaggcacaaggcuaccuggcaguagcaaagcucccuuguagugcugucccucagcgugcauccucgucuacaggugcccaucauccccgugguguacucgucuuucucuuccuucuacaaugucaagacgaagcucuucaccucaggugagccaucagcacacaggagcucacaagccugccgugcucucucuguuacugaccuugagucuggguuguauggacuccaggcugaacuacagcuccuuauguagcagaggaugaccuugacccuccccgugcuugguugauagguuuguacugccaugccaagguuauguggugcuggguuucaguacucucccuucuaaugcagcaguacuugggccccuacuagcagaguucccacuucuggguggugaaugaaugaaugaaugaaucuggaacaaacauugcaucauuucauugcucuuucuaaaugggguuuuuuucuuucuuucuuucuuuuuuuuuugguuuuuagagacaggguuucucuguguagcccuggcuguccuggaacucacuuuguagaccaggcuggccucgaacucagaaaucugccugccucugccucccaagugcugggauuaaaggcgugcgccacccugcccggcucaggguagcguucuugagagcacuguugauccaggcuguacaacagaaauagggaccuacagugaccucugcuggugaggguaagaauucuagcuguaugggcuccccuacguggggcagcucacaagugcagccucugccgcuucaccuccgaagcacuagcuuccacgcagguacccugagccugcaugugggugaugcaugugguagucaggguagagucagagguuaaagggcugugggacgagccaggcucugucuccagcaagugcccagcuccaaggaggacggaaggaacaaguauaauagaggaugauuaggggucgcugagugcagugccagcagcugcggcagacaugcccugagucauagggaguggcuucgggagaggguagcauugcuaauugccccaauuuccaaugugugcgcugcccgggaguugaggauggccaggcucugguuagaagaggcugggcaacaggaagccugcugaguagaggugacugacagccacugcuuccuccccaggaacaaucaagguacaagugcuggaugcugucccuaccaauggucugacagaugcugaugucaccaagcugguggacacuugcuaccaguccaugagggccaccuuucuacagauuucucagauuccccaagagaacucugccauuaaggagccuggggucuugccagcccaguagcccaggcuacaggggcaggggagcuggggaaagagcagaggcugaaggauggacagaaggccacgcccucccacuuaccaaccaucaccuuauccugcuccccugcuggccuggcucucucguuggggccuggaaacaggaagcccuuucuagcacaggccuuagauccaggacccuauguaacuucccaccucaagccugugccuccagcauccagauguggccauccagcaggugggcuggcccacaagaccacaaggcaccuaggagugcacaacacauuacccaaggcccaccccaucgugcaggacaaauguucagaaaccaagcaguggccuguaucaggccaucaugaagaggagaaacuuggucucccagucucaaggaagccuggcucacacagcaccagagggcagagccugccgcccgcaccguccgacggccucagucacaaaucacugcuguguuugguucuuuuucuauaaaugaacucucagaagugccuggagaccagaggucucuuucagagag

SEQ ID NO: 704 - RNA, 1649 nt, Mus musculus
agagauuuuuccugcaugcauguugaaagguuccugaauaaacugcuuugagaagaacacuguguugucgcucuuuucugcugguuggaaucggaggcaacaaauggugacccguacggggacuuucagaacucaucgcagucagagcugcuagcugguaaguucccagguagugggacaaguuaaguucucugauugagacgauaagguucccgguuuggggacaaguugcaccaagcaccaugggaaauucaaccucaggucaaacagugugccaagcccuuaaggacuugccgaaagugaaaggaaucaggcugaaaaaggagacccuggagaacuuuuuaaagcaguggaucaggucacuccuugguucuccguaucaggacaucuuacagggcccaguugggagaaguuagggaagggcuugaaguuugcagaagaacagggaguucucgcuaaaggggugcugccaguguggaagcuaguacagaauuguaucgaggauaaggaaagauguggagcagaacuccaaaaaggcaaugaggcacugaaucaggugagagaggauugaucccaaaagucagaggcagaaggaaguucuagcgauggggauaugucugaggacaaucuggagagcauagccgacagucuagagaaagugaaaaugaagguagaaccuucggugccagugccagggcugccguggcugccuccguaugccccugacagagcaucggggcguagucugcauccagaaaccuggagggaacugugagcccagagcuuuccuguauuucaggaugcacagggaggucauuaucaugagccacuugauuggaagauuguucaaagauuaguggaagggguucguacuuagugugucagcgcugcuuuuguaagagcucaauuagagaaccugcaccacuacugcaugacuccaagugauuggcagaaucugacucgugccugcuugucaccaggccaauaucuagacuggaaggcauuuuucauugaguuugcugccgagcaagcagcaaucaacgcuggcaauggccagccagccugggaucaagacaugcugcugggacaagggagauuuguagcagcucaaacuaauuaucccauccaaguguaugagcaaauuaauaacauagggacuaaagaaugggcgucucuuccaaauagagaagaggugagugggaaccugaccaagauuguucaggggcccacagagcccuuugcugacuuuguggcucgucuuguagaggcaggaggccauguuuuuggagacccugcuuaccaguuggggcaucuucuggauauaugcccaggagagguauugcuggcugccaugccucuacugaagcagcugauuuuugaacagugcaucaaagaaugcaggcaaucaauuaauccauauaagcauaaaggauuagaggucuggaugaaaauaugcagagaaauaggaggaccucuuucuaauucuggucuggcugccgcugucauacagaugucacaaggaaaaggcggccagcagaauaauaacuguuuuaaauguggacagccaggccacaugaaacgacaauguccacaauugaguggugacagaaaccagcaaccaaaagugcccggguuauguccuagaugca

SEQ ID NO: 705 - RNA, 5416 nt, Mus musculus
gcgugucgggccgcggcugcgcguucguccaggcgggcgggcccuggcaccggaccgcaggcuccgagaggcggcgggaggcgccaggagugaacggaagccgcgggaaggagcgugcgggugcuuuguucccucgccguaagggccugcugccgggcguguguucguggacggagcuguuguaucggaaaucccgguccccagcccucaguacucgguucgggccggaccagacugguucucguccagggcccgccauggcccagcagagagcccuuccccagagcaaggagacgcugcugcagucauacaacaagcggcucaaagacgacaucaaguccaucauggacaacuucaccgagaucaucaagaccgccaaggugugugguagcuguuccgaagccauuggagaaggcugggacugguuuucccuggggccuggguacaggggugaggaaagcagagggaaugugacucaccugaccggugcggguaggagugaagaggcguuaaaaguaaugggacagcagauaaauagaagagccaaauagugacaagcacagagcagagaggagaacucuggcccguuugccagggcucuacguuaguuacugagcacuagccaccugggcugagguuuacccuugccauagauucuugugaugacuggugaguuuaacccuuaaacaccacaacccucauguuguggugaccuccagccauaaaauuauuuuuguugcaacuacagaacuguuguuacccuuugagucguaaaugccaguguuuuccgauggucuuaggcagccccugugaaaggcaauccacagguugagaaaugcuguucuauuuaaauaauuucugagaagccucaagcccacugaggucuguguuaggcuccagcugguccaccuguaagcuuaaacucagagaucagaaaguuugucuuuuuaauccuuuauugaacaucuuuucuuucuuuuuaagauuuauuuauuuaaggacuggagaaauggcucaguuaagaguacugacugcccuucuagagguccugagcucaauucccaacaaccacaugguggcucacaaccaucuguaaugagaucugaugcccucuucuggugugucugaagacagcaacagugaacucauauacauuaaauaagucaaugucuuuuuaaaagauugauuuauuuaauguauaugaggacucuauuugcaucuauaccugcaagacagaagagaacaucagacagaagagggagggcaucagauccuauggcagcugguugugacccaccuugugguugcugggaaucgaacugaauguaccaucucucuagcccuuuauuucuuauaaacugucacaaagacugggcaguguccuuuugacaugaaguaaccuaucgucacccagagaacaagaagggguuggagacauugccaguugucuagacaggaaguaggcucuggaucugcgggaaggccugacaggcuaugguaaagacaugaaggcggguggcggcggcggcggcggcgguggcagcuaagccagguggcugcucccuguguugauucuaggcuuuucuuauuugcccucagauugaggaugagacgcaggugucucgggcuacucagggcgaacaggacaauuaugagaugcacguucgagcagccaacaucgugagugugggauggaagacaccauggagggguuguagguagaguccagaguagcagaggaaaacaagggagcaauggggugggcagagccugucuuggggauugcccucauaggcacugggaggagggccuuguccguucugugguggugaugagagggagggcagcuguuccuguugacaugaagguuucccaaggcugcuugcgaauggaaaaggaaaugguggaaugaguccugugugaaaugugagccucuugaucuugcagagaaagcccaguaggcagugucugugcaguggguaucggcagcgguguggggcacagaugccugcgacugcccaaccugcaguugugccguaucugggaaaggaggagucaggaggaaagucggcaugguuuucuguuggcucugaguggaauacgcaggauguguacauggugugaguggugugguugggaaaggaaaacuccuuuaagugagcaaacuuagcccacuuggucacggaggguacugauuuugccucccuggcugugccucuguccucacagauaccucuguacagggcaguguuuuucuuugcagaacguaaaccagacuuccaggaugcacugcuggcucagcagcacguacacagagcagggccacugugucugccuccuuuuauauuuuacccugauuacgauggugcagguucgagcuggugagucacugaugaagcugguauccgaucucaagcaguuucugauccucaacgacuucccgucugugaaugaagccaucgaccagcguaaccagcagcuucgagcccugcaggaggagugugaccgcaagcucaucacccugcgggacgaggucuccauugaccuauaugagcuggaggaggaguacuacucguccagguacaaauagggcuggacugccaugcaggugcugccugcugccugcccagaccagcuagggccugcaauggccuuguguuuuuccaaguucuccuuggcagcagagccccugacuagcucguuugacggacagacagucauagccagccaccagcaggggcccaggccuucccuucaaugaagagggaugaaaacacaggacuugguugugugucaacggcuguggccagaaaaggguaucccccagggggcgaggaagcccuccagggcaacacagucucugucuuacugcuuuaaaucucuugucugucuagacaguuuagucaaggcuggauuggccccuuguggccuuccaggucucuaacgacguucacuuucugggacagcccugccuacugcuugcucagagauucaguuccaugugaaugucaucagacucacaguggagaggugggaugggggagggguaaggaacucaagcaggguggcuuugacuccugggcccaagauaccuggaugucagcucggccuuauucauggagcuggagucuccuggugucagaccuauguuagucucagaggauagcagcaggcaggaucugucacauagcucucuacagggccacuuagaauguugauaccugaaacuuucugauccagagaggccuugagaaaucaagaguccaguguaaaauaugucgucggaaccgggcuggagaauggaggccuugccccaccccauuagcuugaaguuaagguuccggucagcagcacccugccugacucccccuggugguagguuugcuccugcugcugcugcacagaagcugcagucaacuacagauguccagugcugcaguggacaucuuguucccaucuuagacucagugucacugccaagcuucaguaguucuaaaguucuccagagaguucugggguuaucuuuggucucaguguucaucagcuuagcagaaaagugggaguaucuacuguaccccaaaguggcagagacuuagaccaacccagggugaguuccucacaucuuccugucacuaccuuguaguacuucaaggacacuugagcggaugaguacugggacagugacucaguccuguacaaggguugaggggauaaauugcucagauaggaacccagagugcuggguuuccaaagccucggccccucugcaucacgugcauacguuucugggaugaucuguguccucuuugggcaaucaccucucucauauuccucaugguaaagcagcugccccaugccuaggaauuuccuuaaauggcagaguucuucgguaggugaggcaguagguuuugucugccccuaucagccuccugcccacaccaccaccaguugcccagcuuccccucugcauggcuacucuugccuguauacgaacugcuugcucuuucuggcuuugccuucccuccauucuccuggggaugcuacucccuuugucuuggguaguucugcgagagacugcuggggacaggcaugggagaaagcuagggccuugugcauauuagacagcuguagaaacagaugugguccaaguagccacugcuaugaccacugaggcauugugcuugccuccuccugucucuggcuuucccuguguaauguaaggaaauggaauguguaaagccuggggcuuagagcuguagagcuagaguagugguauauagagaaaugcucagaccuguauugcugacuguuacccaguuaggccaggacccuguagggauggaaacaggucugccaccaggagcucuuuguaaagucucaucacuacccuacugguaagggauggguaacagguagaggcugauaggaacaaggagaguccuaugugucaagaaggacccauggggacaguuugccuaagucacauggccuguugacaccaccuuucuuuggaugcaagaguggccagaaccgcuuagcagaggggccagcacagaggagaagaaggggaggcagucaggugauguucauuucuuaacucugcaucugucuugcuuuccccucccuggcuuuccucugccugcuccugucacuccuggggguuucuugugguggcaaagcucaagucucugcgaagcuaaugaccugccucugugugaagcuuacuggaggcuggaccucgacgcagauucugcugauggccucucagccccucuucuggcguccccggagacuggugcuggucccuuacagucugcagccccuguccacucccauggugguggcccuggcccuacagaacacaccugagccucuugggguaccaucgcaggguagcccucccuagggccuaguuuaucagaaaggaagugcuguggauacccagcacagccuagcuuuuuucaguuuuagcucccuuggggacuuugggaucaggagccacuguagccucaggaaccuguccaggccagggccaguuccccgugaugguuggggaaugcuguccaguuauuuacagcagguggcucccuuccugacugccaguggaaguuugucccauugaagaccuugaauagggagggugguuggugauaggaagacagccucaguuuguuuagaauugugagguauucaguggaccuuagucaaguccaguuacccauccuuagguucagguucuauagagagcccuguccacugccugcugccuggagcauaaaugucucugccacagcugacuguccaagauugugugagaggcagcuagccagggugucuuccuggauucucccaccauuuccuucugcuacuuuugagaugagacuguugaauaaaacauuagcuuuuugugcuguug

SEQ ID NO: 706 - RNA, 3401 nt, Mus musculus
ccaugguuuuuacauagcaagaucuuuauuuuaugguuguugggaacaggcuccuuacuucacaugauggguguccgacguacaaauuuuuggaaccacaaauaugauguggccgcacacaguccguaccugugguugaaagagauuauagccugugcggggugggguggguggaggggguagcaggcagcaggacuaaccagguaaggauguacugcaugugcucauugcgcagagucacucucgucuguccuccgaugggcccgccgggggcugugcugucuguggagacaggagucagcucugucagaccccuaagugcaaccagagaaagucugcugggcuguuuugagacuuuguuaaugcaauuaauauuaauuucuuugccuuagccucaggaagacuucaggcaaaagguagcuacauucuucgccaaaauaccacaaaaacagucuccacaccacauacuaagauucuccucuaaaacgcuauccaauagugcaugcucuccccaaagcaggcugaccacaacauacggaagucugcaucaaugaaaaugggguccgcuccuguuaucuuggccauagcuuccaggucucgauaauaccagugauuccuuucugggcuguucuccggaacaaagggcuuccuguuuucugugagccucacuaugccaacuaggucuacuucucccagaaccuacaagagaaggcaggacugcuuuuuacgggaguccuguauggaggcaaggugacuuaacuauauacauuucucgggcugaagagccauaugccuuaccuggccuuucugucuggucucaggauucacuuucuuccugggaacaaacccucuauuaaccaggauggugacucuagaacaauaauaaaagucacccuuugggugaggaagaguuccaauacagaugucacuagugguuacuucagcauuuaucuacugggcauauaaaugguuuauucuguggauucagacuucacugcuaagccuuagugauucaaacuggcuaagaaaaucgcuuaaugggcuggagagauggcucagcaguuaggagcacugacugcucuuccagagagagguccugaguucaauucccagcaaccacgugguggcccacaaccaucuguaguggaauccgaugcccucuucuggugugucugaagacagcuacaaaguguacucauaaauaaaaucuuuuuaaaaaguugcuuaauguuggagauguuggaaauuaucaggcaguguuggcucucauaaauucccuagggucuuaagguugacugagcacaaugaggcucagccaugcacuacucaccccaagucagagcaauggaaaggaguaacuacaugggccccacuuucaguugaggauagucugccagcaucucgcgccucucggacaggauccaccaugguccgaggcauuauguacaacucuuuagaguggucaaaguggccccugaccuucacuggccuguacuccaaauuuuucaguuccauugggcuauaaggagaaaaggaagggcugugaguaagccaggcuugucaauccuuuaagcagaaaggcucagugaggaucaucagacagguuauguccuccauagcaaccuuugaugccaaauaguaauagaagauggugauaaccagagcccagguuuucaaggaaaguguggguuucuguauggcuacuguauauacauuaacaaaaugugaguccaaacuccacuuguucccaacccugaaggacaaaacuuuaaaauucaagagggcaauacaauaaacuuuaaagaccaccacccaccagggccacaaugaacugucaccacuuuggaggaucccuugagaccugaaaagggaaaucugacaccgaaaauaaaucuuuucuauuuauguucuguguccaauuucauaaaggcagucagcaggcaguuuaucgggaaacaggguucucgccaaaggacagcaaauuacaccaaacagaagcaagggccccacugccgcccuguaaguggaaugaauaaagugggcagccacacucacucugcugguagagggaugggcucagccaugacucgagacucuaauucugcaauaaguuucagcuuccauuuccgacguuggaccuauagaaacagcaugagcuaagcuaagguaucaguggaguccgagccucggagccacccaaauucgacccccaucuucaccugccaaguccccaggccaaaagcaguagcagggauuaaaagcaggaaccacuggagaaaagaaucguccucugcuuuagcggcggcuguuucagcaguagaacugcaacaccugcguggccuacagaccaucccuggaggaaguuuuacaacacuggcauggggucagaagcccuagaacaaacagaacuggauggccaauuccucgagaggcccgauuauaccccagagaauguauggcaaagguggcaauuaacagcacaugugcccaacccucucccaguacaauacacgcaguaaaccacugugggcugaaaagaaaggugcaucaaccgcacccaggucugagcccuucucaccugagcggacagaaaacccaaagacgcuccuccugacagcgcagaacugggccugcggggaccagacaggccgaggggcuaaauccagggaaccccacgccugccaagugcaagcaccugacacgguccaacccagccccacacaacuucgagcuaagucuucuugggcaggguccucccuggcaccgcuccacccagggcuaaguucucuugggcaggguccuccucggccccacuccacuccgggcccggcccuccagaucccucuucuugagcaggauccucucugaacccccgcuuacccgucccgcguaggcccauugcgaccaccgcgucauccgucgcggcagcacagccaaagccaucacagcagccaucuuugagcacuuccgggaccgagaaaucugcuuccuuccgggacggcgcucugucucacgugguggcugcggcgucagaugggcaucuccgaucauggacgaaccacccucugaugugcuugcauucuugcgccagcaccccagcuugagacuacugcccaacacccgcaaggucggaagagaaccgugaccggaagaguagggccaggaaggaacgggaucugggaggagcggaaccucggaggaccgacaguggccagaaaggagggggacccgggaguauugugccuggaaagcgugggaccugggaggacagugcagggaaggggcggagcuggcaagaaccaccuucugaccagaugcucauccgcagguucgcugcucccuaacuggccaugagcugcccugccgucugcccgagcuccaggaauacacccgcggcaaga

SEQ ID NO: 707 - RNA, 3992 nt, Mus musculus
cuuccgggacggcgcucugucucacgugguggcugcggcgucagaugggcaucuccgaucauggacgaaccacccucugaugugcuugcauucuugcgccagcaccccagcuugagacuacugcccaacacccgcaaggucggaagagaaccgugaccggaagaguagggccaggaaggaacgggaucugggaggagcggaaccucggaggaccgacaguggccagaaaggagggggacccgggaguauugugccuggaaagcgugggaccugggaggacagugcagggaaggggcggagcuggcaagaaccaccuucugaccagaugcucauccgcagguucgcugcucccuaacuggccaugagcugcccugccgucugcccgagcuccaggaauacacccgcggcaagaaguaccaacggcugucaaguuccuucucuaacuucgauuacgcagcuuucgagccacacauugugcccagcacaaagaaucgguacguaguuuggccggccagcgccuaggagcagagccugugcccccuguucugagcuuguaggagccucccacugugacacuuaucaggacagugcuuguggcccuugcauguaguucccugaagccaggcugggcagugccaguuucacuguuuggggauccugucuaugguugugugguugauauauccucauauagcacucccugagcugucugaccgccaagcaugcagugugaaacugcaauuucuuggguaacaaucuggguccuugaucccagauacugaguggaauuguuuguaagccuguguagcuggguuggccuggaacucacuauguaggccagacugaccuuaaagccugccucugacucugccccucugccucugccaccugagugcuggaauuaaaguccaccaugccuuuuucaaaauccagacacugagacuaaaugcagagcaucccagcagauggaucauuuguuugcagcaugcagccaugguggagcccacaagacugggcccuuggugugcacugccccuccauacccaccuguuugccuuuuaggcaccaacuguucugcaaacucacccugaggcacaucaauaaguccccagaacacgugcugaggcacacccagggccggagguaucagagagcacuucaucaauguaagucaccccccagaagcucaggccuuuggaugcaugcucccugcccccaaaaagccagaaaggugccuuggccaucacugauccuuuauugaugcacuugccugaucuugcacagugagaaggcaaagccagaaguaggugggaaggagugcgguggaggucugauauuccauagcagggacaauccuaggguagcucccaggcugaggcugcaguauucuaguuauaggacagguccauagucaucugauacugcaggagagccuugaagacuguucucaggagcaggauuggugcaaacaguccugcaggcuccagagggugaggggucuugcagcuaagggguugguggcuugagcaggaaaggggacuugcagacagccuccaguauuguuggguauagccaggggugggaaggcaucccaagucauugagaguagagacuccugggguuagggacagagagaggauggggccagcuugagcaugagggaggugaaaaccucccauccaugcuaccacaggaagaugaggguaagaaagggacugggacuagguaacuuggauggaggaaugaagcagggagaauggaggguugggguucgcagaggcuggggaugagugggaggcuucagggacugcaucgccuguccugcccuaacaggcagacuucagucacagggugggaagguaaggaaucugucaguugucugcuggugcagaguuggcaccugggcugcacugaccgguggcaagcuaagguuuggcuguuguaccuuuguuagcuuugucaucugcuacauuuucacagggagggcuguacaggaauccccaugauuauaaagauguaucaaagagcugagacagagccaaaacacagugaggccgguuaggauggcaggcugguuaccguagcuaauuggccugcugagagcacugggaggagaccacagugguccuagaaauagaugucaaagaugaagcagggaagacuggagauagcagagcaguugguucuaucagaugcccagucccaauuagacuguuacucaugagcaaugagcugguaucccucaccuauggagauggugcuggcccaagaaguucagacuccucaguaccugaggacagcaguggugacccuaguaagugccuucccugaagccucauucccgcgccaaguugaagugaagccaggcaguuuccccugagguccacagccuuuggcugcccaccccuaucugguaggauaaaggaacagaaccauggcacaauacaacccauagcuuagcugugcaccaagaggguaccaguguaaugagcuugcuagucuccuagaugaagagugucagaaacaagguguggaauaugucccugccugccuucuacacaagaggaagaagagagaggaccagacgaacagugaugaacucccaggccagagaacagguuucugggagccagcuuccagugacgaggaagacgccuugagugacgacagcaugacagaccuauacccacguaagcagacccaguccaaucccugccccugucuccugcuagguaccuugugauccugcugugagccacuuuuccuaagaaagggagggaugcuuuuaccugugacacagcucagccaaguguuuguuccuuccagcugagcuguucacaaagagagaacuaggcaagccuaagaacgaugacacuccugaagacuuucugacagaccaacaggaugagaagccggagcauucagaagagaagagcuuuagagagagggaagaggccagagugggccacaagaggggucguaaacugaggaaggugaguggugggcugcagagugcugaggguagggggcuacucagcaaauucugcaagugcacuugucggguagcagccuaaaauauggaagccaaggccacuuuagaaggucugcaggaguaaguccugacugcucaggaacuucacugcuggguacucccucucuaugggacaggacugaguauucugucagagaggagcaagguagacaaagucucuagucaccuguguugcccucucccaggccccacacugacccagcaauagaaguguugagaaggcagacuuaaggcucuuccggcuuagacacacagugccuuucccugugaaccugcagaggcccuggucagcauuuucugcuuucacagaagcagcucaccuccuugaccaagaaguucaagagcuaucaucacaagcccaagaacuucaguuccuuuaagcagcuggggagaugaagccugcaaaaaaagccuuuggauguccuuggaaauggccacugauauccugacauuggcuguuguccagagugggccuggagguucuguucagaagauggcagcgucggggacuugcauggcuuucucugcaguguugagugacucuugcuguagcucacuguagcaucccgaagccuagccaggcucccagcucuggcugcucaccauauaggaccacacuauauaccacaaaugccauuauuuauuuugauguuuccaaagaucaaaacauuuucaaacacaacuaagauauaaaauacagcauaaaaaugagguuuauaccuauucccacauaaagcuaaagcaucuucagaaaacuuuugccaaaccaauauguguaucauuguuuucucccgucccaggcgcaccccacaggaggcugguaaaugggccaaguacccuugggaugaggguucccaucccaggcagaacccacaggaggcuggucaaagggcuaaguaacccugggacgagggcuucugcugcacggcaugcacuugcc

SEQ ID NO: 708 - RNA, 3992 nt, Mus musculus
ggcaagugcaugccgugcagcagaagcccucgucccaggguuacuuagcccuuugaccagccuccuguggguucugccugggaugggaacccucaucccaaggguacuuggcccauuuaccagccuccuguggggugcgccugggacgggagaaaacaaugauacacauauugguuuggcaaaaguuuucugaagaugcuuuagcuuuaugugggaauagguauaaaccucauuuuuaugcuguauuuuauaucuuaguuguguuugaaaauguuuugaucuuuggaaacaucaaaauaaauaauggcauuugugguauauagugugguccuauauggugagcagccagagcugggagccuggcuaggcuucgggaugcuacagugagcuacagcaagagucacucaacacugcagagaaagccaugcaaguccccgacgcugccaucuucugaacagaaccuccaggcccacucuggacaacagccaaugucaggauaucaguggccauuuccaaggacauccaaaggcuuuuuuugcaggcuucaucuccccagcugcuuaaaggaacugaaguucuugggcuugugaugauagcucuugaacuucuuggucaaggaggugagcugcuucugugaaagcagaaaaugcugaccagggccucugcagguucacagggaaaggcacugugugucuaagccggaagagccuuaagucugccuucucaacacuucuauugcugggucaguguggggccugggagagggcaacacaggugacuagagacuuugucuaccuugcuccucucugacagaauacucaguccugucccauagagagggaguacccagcagugaaguuccugagcagucaggacuuacuccugcagaccuucuaaaguggccuuggcuuccauauuuuaggcugcuacccgacaagugcacuugcagaauuugcugaguagcccccuacccucagcacucugcagcccaccacucaccuuccucaguuuacgaccccucuuguggcccacucuggccucuucccucucucuaaagcucuucucuucugaaugcuccggcuucucauccuguuggucugucagaaagucuucaggagugucaucguucuuaggcuugccuaguucucucuuugugaacagcucagcuggaaggaacaaacacuuggcugagcugugucacagguaaaagcaucccucccuuucuuaggaaaaguggcucacagcaggaucacaagguaccuagcaggagacaggggcagggauuggacugggucugcuuacguggguauaggucugucaugcugucgucacucaaggcgucuuccucgucacuggaagcuggcucccagaaaccuguucucuggccugggaguucaucacuguucgucugguccucucucuucuuccucuuguguagaaggcaggcagggacauauuccacaccuuguuucugacacucuucaucuaggagacuagcaagcucauuacacugguacccucuuggugcacagcuaagcuauggguuguauugugccaugguucuguuccuuuauccuaccagauaggggugggcagccaaaggcuguggaccucaggggaaacugccuggcuucacuucaacuuggcgcgggaaugaggcuucagggaaggcacuuacuagggucaccacugcuguccucagguacugaggagucugaacuucuugggccagcaccaucuccauaggugagggauaccagcucauugcucaugaguaacagucuaauugggacugggcaucugauagaaccaacugcucugcuaucuccagucuucccugcuucaucuuugacaucuauuucuaggaccacuguggucuccucccagugcucucagcaggccaauuagcuacgguaaccagccugccauccuaaccggccucacuguguuuuggcucugucucagcucuuugauacaucuuuauaaucauggggauuccuguacagcccucccugugaaaauguagcagaugacaaagcuaacaaagguacaacagccaaaccuuagcuugccaccggucagugcagcccaggugccaacucugcaccagcagacaacugacagauuccuuaccuucccacccugugacugaagucugccuguuagggcaggacaggcgaugcagucccugaagccucccacucauccccagccucugcgaaccccaacccuccauucucccugcuucauuccuccauccaaguuaccuagucccagucccuuucuuacccucaucuuccugugguagcauggaugggagguuuucaccucccucaugcucaagcuggccccauccucucucugucccuaaccccaggagucucuacucucaaugacuugggaugccuucccaccccuggcuauacccaacaauacuggaggcugucugcaaguccccuuuccugcucaagccaccaaccccuuagcugcaagaccccucacccucuggagccugcaggacuguuugcaccaauccugcuccugagaacagucuucaaggcucuccugcaguaucagaugacuauggaccuguccuauaacuagaauacugcagccucagccugggagcuacccuaggauugucccugcuauggaauaucagaccuccaccgcacuccuucccaccuacuucuggcuuugccuucucacugugcaagaucaggcaagugcaucaauaaaggaucagugauggccaaggcaccuuucuggcuuuuugggggcagggagcaugcauccaaaggccugagcuucuggggggugacuuacauugaugaagugcucucugauaccuccggcccugggugugccucagcacguguucuggggacuuauugaugugccucagggugaguuugcagaacaguuggugccuaaaaggcaaacagguggguauggaggggcagugcacaccaagggcccagucuugugggcuccaccauggcugcaugcugcaaacaaaugauccaucugcugggaugcucugcauuuagucucagugucuggauuuugaaaaaggcaugguggacuuuaauuccagcacucagguggcagaggcagaggggcagagucagaggcaggcuuuaaggucagucuggccuacauagugaguuccaggccaacccagcuacacaggcuuacaaacaauuccacucaguaucugggaucaaggacccagauuguuacccaagaaauugcaguuucacacugcaugcuuggcggucagacagcucagggagugcuauaugaggauauaucaaccacacaaccauagacaggauccccaaacagugaaacuggcacugcccagccuggcuucagggaacuacaugcaagggccacaagcacuguccugauaagugucacagugggaggcuccuacaagcucagaacagggggcacaggcucugcuccuaggcgcuggccggccaaacuacguaccgauucuuugugcugggcacaauguguggcucgaaagcugcguaaucgaaguuagagaaggaacuugacagccguugguacuucuugccgcggguguauuccuggagcucgggcagacggcagggcagcucauggccaguuagggagcagcgaaccugcggaugagcaucuggucagaaggugguucuugccagcuccgccccuucccugcacuguccucccaggucccacgcuuuccaggcacaauacucccgggucccccuccuuucuggccacugucgguccuccgagguuccgcuccucccagaucccguuccuuccuggcccuacucuuccggucacgguucucuuccgaccuugcggguguugggcaguagucucaagcuggggugcuggcgcaagaaugcaagcacaucagagggugguucguccaugaucggagaugcccaucugacgccgcagccaccacgugagacagagcgccgucccggaag

SEQ ID NO: 709 - RNA, 15208 nt, Mus musculus
gugaagccaggcaguuuccccugagguccacagccuuuggcugcccaccccuaucugguaggauaaaggaacagaaccauggcacaauacaacccauagcuuagcugugcaccaagaggguaccaguguaaugagcuugcuagucuccuagaugaagagugucagaaacaagguguggaauaugucccugccugccuucuacacaagaggaagaagagagaggaccagacgaacagugaugaacucccaggccagagaacagguuucugggagccagcuuccagugacgaggaagacgccuugagugacgacagcaugacagaccuauacccacguaagcagacccaguccaaucccugccccugucuccugcuagguaccuugugauccugcugugagccacuuuuccuaagaaagggagggaugcuuuuaccugugacacagcucagccaaguguuuguuccuuccagcugagcuguucacaaagagagaacuaggcaagccuaagaacgaugacacuccugaagacuuucugacagaccaacaggaugagaagccggagcauucagaagagaagagcuuuagagagagggaagaggccagagugggccacaagaggggucguaaacugaggaaggugaguggugggcugcagagugcugaggguagggggcuacucagcaaauucugcaagugcacuugucggguagcagccuaaaauauggaagccaaggccacuuuagaaggucugcaggaguaaguccugacugcucaggaacuucacugcuggguacucccucucuaugggacaggacugaguauucugucagagaggagcaagguagacaaagucucuagucaccuguguugcccucucccaggccccacacugacccagcaauagaaguguugagaaggcagacuuaaggcucuuccggcuuagacacacagugccuuucccugugaaccugcagaggcccuggucagcauuuucugcuuucacagaagcagcucaccuccuugaccaagaaguucaagagcuaucaucacaagcccaagaacuucaguuccuuuaagcagcuggggagaugaagccugcaaaaaaagccuuuggauguccuuggaaauggccacugauauccugacauuggcuguuguccagagugggccuggagguucuguucagaagauggcagcgucggggacuugcauggcuuucucugcaguguugagugacucuugcuguagcucacuguagcaucccgaagccuagccaggcucccagcucuggcugcucaccauauaggaccacacuauauaccacaaaugccauuauuuauuuugauguuuccaaagaucaaaacauuuucaaacacaacuaagauauaaaauacagcauaaaaaugagguuuauaccuauucccacauaaagcuaaagcaucuucagaaaacuuuugccaaaccaauauguguaucauuguuuucucccgucccaggcgcaccccacaggaggcugguaaaugggccaaguacccuugggaugaggguucccaucccaggcagaacccacaggaggcuggucaaagggcuaaguaacccugggacgagggcuucugcugcacggcaugcacuugccucccagggucugccccacuccacagacuggaaugucauggggcugccacugcagguggcugugcacugaggcagcucugugguaaagaacuagcauggccugagccagugcuggaacucacuugggaggaauaggcaggccauaaggcugcaggaaaacaugggcuagguguugagaaggugaauucagccugcagagccagcgaggcaagggacugacccaaagugacucagagaacaaaguccugccuacccagcugaugccagaaaggaggaccuccaagacucuguacccaagggugagguaagcugccagcuucccuccagggguucuaagucugucuguucucuccaacagaccugggagagauccaggaggaacccaacuacccucauggcacuaccaugcagaugagcaagaccacagcauuagacaccccaccccucccccaaaaagagaaacacgguguaaggcaauguuagaaaacuuuaaauacaggacugagaucaaauugguaaggcaucacaaauuguaaaaaguaucuuggcugcauacagcagagcaaguugacaaaaaucugagcaagcaacagccucaggggaauggugguaucagggcugucgacggggucggcucagccuggaacagggaguuaagcuggggguuggggaccacaaccuguggaguucaggccuugcucugagaaggucaagugugagguaacuggguugagccugggugucuugaguacugggacuccucacuucugggccccauggcaucgcuguucccaggcugguuccauggugguugugugggccauccugugagcagccugcucuccugcccuuuccaccaccaagcuugagggauagcagcuuucuaagaacuuccugcugcuuaccccaucccaucccugcuuggagccaugaaaacucccaagguaccuuucacccaguaaacagcauccagcuagcuaacaucaaggacuugggacagcaguaacacccaccuuuccaauacuguacuguucucuugacuugguuucucuaacaucuucacugauccuauaaaauacaggggcagaagcaaugcuggggccacugguagaauucugaacuggagguuuaaccguuugguguuuggcuggacuauccuaagucauuuaguaguuugagcuaaggauguaaacucaaaacuaagaagggaaacugcuuugaaugauaaaaauacagcucaguacgacuuccccaaaaggaacucggagacaggaggaaugaggccacagcccagcacgcugucuccuccaagccuuggcuaaggagugaccauccagcucgccagcccuggacagucaagacuccagacuauuuccaaagauuuuaucuccaauuuucaggugucugcaaauaaaguucucaaaacaucugugccuuuaccaagggaggggaagggagaaggacacacaaacgccggcaguuuguugacucugcccugaaccaggccagggcccugugccucagccagggaggggagggaucuguguguuaccacucuuucuucuucucauccauggacacacccccugggccaagagccaccaccaggagcaggccuccaaucacugacauggucuggaagaagucguauuucaggaagucaugcauggguuuauauaccgggauuguccagaaggcguugaaauacacguugauggcaaacagccagacgacgagagucaaagcugccagcuugguuuuaaaaccgauggcuacuaagaucaucagagcugugcccacaauguucuggaugaucugcacagauucaaaaagaaaugacauucagacuaaaggucaaacgcuggacacacuuguaucugagccaggcucacauaaccaggacuuagugagaguccuggaacacacaaacccuaaaacaauacagaauauuggacuuacaaagaguucuguauuaaaggugcuauggccuuacauguacucucccgaaugccauauguuggaaaauccccuaaauccuauagugauguuugccagguaagacuuugaugagugacuagcccauaaaaagaagcuugggauaccgugaguucucuugguaaucuacagaguccuuaccacaagacccacuagaugugaccuugaccuugggagucccugccuccagaagcauaagcugaguaaaguaucauucuguguauuuacccuucugggguguucaguuacagcaacagaacaugaacuaagaaaacugaugucaagaaucaagaaguauggcugcauuggagagauggcuuggugguuaagagcacugacuguucuuucuagaggacccagguucaaauccaagcacccacauggcagcucacaacuguaacuccaagaucugacugacacccucacauauacauacaggcaaaacaacaaugcacauaaaaauaauuuuuaaaagugugucuauugcuaaagaaacaccugacuggaauggaauaauugucagacucugaggcaucuagagaagcauugucaggaguggagcagugaaggccucucugggaagagcugagaaggaaagacagggacagggacuucacuagugguguuuaguggcccuggccaccauccuguuauaguauaaacaguaaacaugagacagggauuuauaaagcagagcaaaggccauucuuguuagaaaacugcaaugaaggcaagccuagcacaugcuuuuaaucucgaacucugaguucaagaccagccuggacuauagacugaguuccaguacagccgaggucuugaaaaagaaaagaaaaaaaaaaaaaaaggaagaaagcugcaguggccucggcaucacugaguccacacccugggaccuugcagaauacagaacauccaucuggcagaagaaacuuagcagcagcaaagcauucagguugacauguagcuacuuuggauucugacuguuaauagugaaacaagggugcaaagacugaauucauaacaagggaaaaugugaaaacagguaaaaaguucucuggccaaaaaaucaaagauggcuucucagggucuauguaacccagacugaccuugaacuuaaaaucuuaccucugccuccugggcacaggucuuugccacaucuggccaaccaacaauaaaaaaaauaaaaaugaguaaauaaguuuguguuugugugggagggcagaggccagaacagaacuggauagccucuaaucagucucaggauaguccuuuuugaaguaggaucucuucugacacuagagcucaucucagguaggauggaagcagcaauccaaauaauccuccugccucugcuccucucaaaggccauuuuacaggcauuugcuggaugccugacaaguuacucucaugcuuaggguugauguaugguccucaugacugcagagaaaucacucuucaccagugagccaccuguauuucaguguaaaagaucuguggaagauuaguaacagcugcagugcuacccugguaggucccuauaccacaacugagcucaguucaucuacacccaccuaccuacucaugcuggguaugccuucccaacaaugccuauuugccagcucugcuucuccgugugauauauaaaaaucaggaugugccgaacggugguggcgcacgccuuuaaucccagcacuugggaggcagaggcagguggauuucugaguuugaagccagccuggucuacaaagugagugccaggacagcuggggcuacacagagaaacccugucucgaaaaacaaaacaaaacaaaacaaaacaaaacaaaacaaaaccagaauguacuggcccacagugugaauugaccucugaagaagaaaagucagaagucugcagagagggcacuggccucucauuuauaagcaugagcucaucuccucaggcugugcugagccacagcuaugccaacagguagcauaugguuuggguacucacagaaaagaagcuggcaucaaagugaaggagggucaugaacaucaggaccagcaggacccuuccuccaagcugcauguacugcuugggggagcucucacgcaugguugggacaccagcaaacaugcucuucccuucugagcgggauucugccaagagcagcagcaaaccuccuccuaaagccagguuccugagaaacagaaacaucagcuacaaucaccagguguccgucaacaaagccagagcaagagagucuggcauggacacaaccaaggcccacccuugccuuucuccaaaacaaaccaccauucaaugggaccagaccaagcugaguacaaaggaccagccucaaguugaaccaacaggaggcuccuuggauguacacggaaccaagcucuggucucugcccacuuccacucagacccucaguccacacacccauguaauacagggcuagaagacaggaccccucgcuaucaagccaagauuccagcugugggggauacucugcugugcccucagaacccugcuccucagaggguagcacuagccaacaggugcacaggagagggccaaggacucuauauucuuaccacccaaaaugcaccuaccucaugagaaacuucaagucccacaaaaugcuauaggcaauugucuaaaggaacagagaaaaaaaugaaucagcauuucacaucaauaucuauagauaucacaacagcaugaggcagacaguucaaacggguaagaacauaagauacacaaaacuauuugagacacagagggcagaucaguaggaccacuuggcucaguaugcggaacagagcacagugugcccacuaggccuguccgacuaucagaguugugcugugauguucuggagcacaacgcaagggcaaggccaccagugcagaucacucuccuccuaacugccaugcugaguaaguagacauucuuauuugucaaaugccaggacucccagcucacacacagccauggccuacgucucugccuaggaaguucagggaaaagggacugauggcucaguaucuauggcuccugcuuggggccaucugcuccuaaacccuacguaggaaagaagaguggccacuucuccaaaaagaaaaauagcucuagacagccagauacacaggaggcugaagggguaagaugcuggacccaauacauagcuccaccaaagcaaagcaaagugagaccuaccccauaccccuuguacccaaagugagaaccacuaaagugacuguauaccugcagugcgaugauuccaaacagcccaaagcaggcauacugcacgaaguuccugcucagcaccaaaacacagccagcuagaaagaggacagaauuaggggcuaccaucuguccaagacaacaaaacaccuuuauuccaaugcugcugagcugcugcaccccaagcaaagcaccuucccagagcuuuaauggcaggggggccugugcccugaagccugcccagcuucugaagaacacuaguccagaccauacuuuggcuccuugugccagugacuacaaguguggagcugacugcuccacuacggagcacauccaacaaugcuugaaaguacaaggccuuucucaccuccuaacaugcaagggcaagaaagcugucaccagguugggcggugguggcgcaugccuuuaaucccagcacuccggaggcagaggcaggugaauuucugaguucgaggcuagccuggucuacaaagugaguuccaggacagccagggcuauacagagaaauccugucucgaaaaacaaaaacaaaaacaaaaaaagaaaaaaaagaaagcaagcaagaaaaccaaugugagcccaaauaugagcccuggucugugcugacugacugaacccuuuuguccuuucuggauaccaucuaacugacuuaacugcccaggcucuagcaucuccucuugcauuuagaagcaaagacuguguccaacuucuuuuuuguucguuuauagacagucucacuauauagacccagcugcccuggaacuuguuuuauuauauaggccaaguuggucuugaacucaaagagaaaaccucuaccugccucuaaaucccaaaugcugucguuaaaggugugagccaccacagcagccuucuguccgaucucuagagcaaguuuaaagaaaugcgugcaagggaacugaguauggaccauccacccaaaagcucagaaccaaaccauggcuggcauauuucaacacccagagcuguaaucucagcugagaagcucuuaaguuugucauaucagccuucagcccaggaagggguacccagaccucaaguucacacauagcuucucaauggccaacaacaaugaauggggaguaucagucaagggaacaggaugcuccagaaguauacuagagaggcuagagagccacuuacucaauugucccagcagguugaggaacacgaaggaugaggccaacagguagccacagcuccagguggugucgauauagucacgcugcucacuccacuggaaccacaugcggaugccauccuccaggaaggugcugaucaggcagaggcgcgccacaugaggcagguacugcuuggugacucgaaggaacuguaagaccacagaacacacuggugagguggcugcaaccucaucaugacaacaggucagaggagacaagccagcucucuggaagacagagaggcccucagcagguccagugccuugccagggcagacugcaggacucaacaccugcuuuagaugcucccaucguaagucuagacacaugaugaucaacacuuagucccagagacaaagacagcgucacacacaucuggcacaggaccauaggcaaugucuaauacuaucuaccagguuuguuccacccuccaaagcuaucaaaggagaaaaaccacaagacacacaguucccaagacaaauguggggcacacuaacaagugggagacacagaaaccaucugaaaggcucucaggauaucuccagucuagaaauucucacaccucagcccccucccauccagagccauccucagcacugguggagagcaucagcagaacaccccuaaccccuaccuuugagaugccacaagcagcauuuccaacuguggcagaaaaauaaaucccucuauuuuucuacccuuucccacaccaucaaaaucucucuggaaaguuuaauguccuaugggguaacugugguacagacaaacagcugugcuaugggcuggaaagaaagcacugagauguucucacagucuguaugaucuaaagcaagguaaaaauaugagagaucaacaaugacugcagugaaacucaagugugccaaucgccagcaaaggacaguucuguacaucuacagcucccuucugucccugugcagauggcaguugaugguuucauuagaccggcacacccuacugaagcuaggugcaaaugacaugcagguggacuccauacuuuucucauaccacccuuaagagcugagcagcaaggugaaagauaucauggaggccuagaagaaagaacaaagagcugcccauggacugacgugucaagaagagucuaaagugcagagucugaccccaccagggcagcggggagaacaugagcugugcaggccuucccaaggcugacuaaaccuccuguuggacuaggugaggauguauguaagggguauacccaaacucucagcauguuacaagcuacuucaaaacccaagccacugcuaaaacuaccaucucagcugcaaagcaccugggcaucccacggagggguguccaggcuuggcuugguuggcaaugcagacaggcucaaucuggggcagggaacaggaagucauaacacugaagcccaaauccucagacacagcccugguguguaucugcaugugcuuacucagcccuacugaagagauggcacaagccacacugacaucaucacagagacuagccagcagcucugaagucagagcacaggcacucaggccacacgucuucacccuguccguccuugucuaaccccagccagcaaugggcucaaggcauggugauccaguuacuuuuaggggugggagagguugcuacccuccaacaaguaaagaccaugcaauuacuggcugcuaagaguccuuccuaacuugcagagucaaaaaaaucuguaauaaaaaaagaaaacaagaaaaaggggcaugaugacacaaugcuugugaugucagcuucuugggaggcugaggcaggaaguucacuugaaccuaauauuucaagacaauguuuagcagcauagagacccaaucucacaauaaacacgaaaggaaaaaagaguccaaauaugcuuauguuuuagggcccugguagaaaauacacauacaacaacauucuguuagcugggggaacaagugacaccacucaccaucccaguuucuacuucaugguccuaauguccuagaaauagccagcagugacguaaucaccaauaaucuaugagaguaaagaacaccaccauggaucucagagcacucccaagaaauggcccucauauugucaaguacccaaacuaagcagugcagaccacaggaggguguggacugucaagcagccacagacacuggagacguucugacuugcuuccaaaugagaacuguucccaacacaauuacacuggggcuucacccacuggaugaacagaccugcccagccuugcugcagucugcuccucccucaagaaccucaccauagaugcucaauugcuacaaacacaacguagcacaauccacuagauguaguuaaaacaucccgacaagucugcuacucuuaauuggagugucugggucaagaggauuaaagaguagaaaacaguaauggagggagagacaagucacaccuaccucccucccuuccacacuagcaaggcugcaagacugaugcagugcaguauaugcugcacuaagcacaucugcugggcucugccuuccaaagacaagaaucuaucaagugggcacagggcaccagucaacagccuuugaucggcaucucaacacaggaaaaaaggcaaguuuaacaacaacgacaaauccuucacaagcaucuuggucacagcuccuggcucacaucacgccacugcaaaggguuccuacagccacauccacucuguacuugcaggccacugcccaugaccuggcucacgcuggccgugaauaccagaaauuccauaaccuugguucucauugcagagccuggaaaaaccagugguggaugcuacugaggaaagcuugugggaaagucagucaagucaagccauugaaaaacaggcuucacagccgggcgugguggcacacaccuuuaaucccagcacucaggaggcagaggcaggcggauuucuaguucgaggccagccuggucuacaaagugaguuccaggacagccagggcuauacagagaaacccugucucgaaaagaaaaaaacaaaaacaaaaaacaaaaaaacaaaacaggcuucucaugauaggcagugaagcaucccgguagcauuaagaaaugagaagaggggcuaaagaaauggcucagcagugaagagcucagaggacccaaguuugguucccaggacccauauuuuagcucacaaucaucuggaacuccaauuccugggaucugaugcccucuucuggcaucucugggcaucagguaugcaagugauacacauacaaacaugugggcagaaugaggaaggcucaaguuuaucucaaaggguuaucaucuccaaggucugaggggauuuaagauauaauccuaucuguccugagauagcacccaugaaacaaguaagggucacacaaggaaugcugcuaccaacaugcagaguagaaaauaccaaccaccucuuuguguucaggacaaaaauggauccaugguagcuuagucuaagaaaauggcagguuagauuuucugacugguggacccuguucaaagaaccacagcucaggaauugagagcagcaacaggcaggcagggucugcucaacacugugguggcuaaucugacucuagaacccucagcaaguauguaucaaacaccuuggauaggucuccaaugcaucauggguguaagaccugcaagacuacccuuccuuuucuaaaacucaaguacugaauagaagccacagucugugaggacuagcccucaucguacagauacuaaccagucuccagugucucuaccucacuuuuccagaagggggcacuguccaaccuccagucaagacuagcaagcagagaagugagucagcuucccaauccuuaagguagagguacaagaugacaaagcacugaagaagggaaggcucagggccccaggacaacaggcccuacccaggccacaucaagcccacucuggcacuacuuccacaaaggccucaucacuccugggucuacuucugccacucuucuuuucucuugguuuuuccaaacaguauuguucuguguggccuggcuguccuggaacguacucuagaccaggcuggccuugaacucagaaauacaccugccucgcaagugcuaagaguaaagccuugcaccaccacugccaguaguucugccaggacagcacaccaaaguaaggcccccugcagccuuccugucacccugguaacagccaucaggcagaauccauuaagcccuaauguuccugguuccugaugugaauucacuuggaagcuacucugcaaucuguuuagcuugaauuaaguagcagccacaggacauaggcaugacuuugaguuccuggcucuuucccacuugguuucugauggcuucgaaggucuacuuccuguauaucagcacuuucuucagagccuggguuccugggagcaaaaggaccucauccuugacugcccaagggcacggagcuugaugccaggucagagauguagcucacuggaaccugccagcaggaucccagcaggauauauccaacagcaccaacauggggggaaugcuggaucugaguaacaagcccaggacugugcagaucaugacaaacuucucuguagcccugggaagauggagccuugauggccagccucacaggaagguagguguccaguuaacagcucaguguucucaucagcaucagaaacacuuuuccaggucucauaugagaagcccgacuuuccaggcaaaucugauuugcaaacucaguucuacuucuguuuucuaaagacauggaucugugauacuaucugacaacaccuuagaguaacacuccacuuuccaacacauuagauccuuucacuuagaacguuggacuaucagcaccuuccucauugacaaauuuguuuucaagggugcagaugaauauccaacacaaaagcucccaggacuggucacacugaggccacuggaaggcucccugaugccugacacuggaucagaagagcaggagucacaucucagaagcuccugugguauccucugcuaacuuccagguggacucugaggcuaaucccuuaagaaggaaccuucauugggaauuuugguuuuaagcagcaggccaucuacaguacgggcaucuuuccacugauguguagcugaaaucuaacuccagaccugagaugcccuggacaccaagcaguaggagacccaggguuuccuccugggugguggacacuggcaaguccaggagcccaagccaguuacuuagugggaguggcuacuguauuccccacaaaagccuguccagucccaagauuuggcuucuuucauuuaaaucaaaacaaaguacauggaggacuucauaaaagaugaacucuuucuccaguugaaaucuaucauuagauaguuggcagcuucuuggagauaauucaucugaucuggguugugaaauccacuugcaaaaugguggguuuuccagcugaagauccugaggugagccgcucacaaacuuggcuaugaagccaucuucuuagagagcugcuacucaggaagauaaaacugggucacugagaauuaugucaacgaaacccaucacaagaggaagaccuugguccauacaauuuuaaaauuauguauuuaaugcaaaaucguggcauuagaaacuuuuccaaaagggguagaaaugccuuuaaaaagaucagcucacaggaaaaugguucaacagaacugaaggugaacauggggaggugacaccccucaaaaggagggguagagaagcucauuugaagauggucacacacacccaaccuucgaguacucuaggccaaaaaaugccuccucguaucaccgacagccacgaacacacuaagugaaccaaaacuggcuggcgggugggccccggcaccauucagccuccagggcuaguucagguuauauuaugacuucgcagaucuaacgggacaauuucagaagucaaagccucacacucacacaacucccaccccauccgucgaacuuaauuguaaaaaguggugccaccugcgccucucuccggcucuaacccugcccagcuagucgcucgggcccagacucaucccaggccuucccugcgguucacaagccaccuguacacuugggaaggcgagccaaggggcaggcuccucuccuucggcagcguggacccagaucgggcaaccggagcagaguccacgcaaagaaggaagggccaggacgguccuggacaagggcggaggggccacgcagcggggcgcacagaguacccccuuccccagagguccccaaggagccgccgcgguucagagggcagagggcacagagcagcaccgcgggccccgggagccucccuggccgccacccccaaccccccgcccagccuccccucggauuucuccguagagcuaggcaggacggcgaggacgggcguccguggggccgugacggccagcgggcuguggggcaggccgcaccuggucggcgaaguccucggccgugcccaucaggucguucugucccauggcggcggcggaaggcucagcuggcagguccugggcgcucgcgccugcugcggccuccacaggaaguacccggcggccggccucgcugagccgcggcugcucuagcggcugccacguaggccaagccuuaaagggaccgcgccucccgccgcgccccgccccgccugccgcgcgcccucacgcuccaggccccgcccgccacgcucgaggagccuggcgccggcgcaccgcccuucacgaacaggccccgccuccgccgcgcgcccuucacagguagaccccgcccccacaccccaggccccgccccuccagccccuacggaccaccccuagcccuucagccucuagaacccgaagcgcugaccacuuuccacccucaccaagcagcaggucccgcccaccgugcugguagacuuccugccaccugugucucccgcccguaguacuugcggccccgccugccgcgucgucagucucugccccgcccuccacccuacccaacacaccggggcccugcccuucguccgaaacacggcucccuauucucuguggcuucuuuaaggggcauaguacgaguaugccauguacgagccaaagugcuaagcaga

SEQ ID NO: 710 - RNA, 10830 nt, Mus musculus
agcaggucgcgaagagaacagcaacccggguucccgcaugcgcaguggagcacgcuugcacccugggaaaugugugcuugcgcgguugcuggagucgcggucucuucccuggugguuccgacugcggagagcggggagaugaagacgaaggccaccgcgccggugccccaaccugggccuaucaggaagcucgcuaggaagaaagccaagaagaaguucaggaagagcaaagcucuggcaggaagugggguuccgggaagccacccggcggcuguggcaggccgaccgccgaaggcccccgagaacuuuucucaaaauuggaaggcguugcaagaggugagaccggcgacaggccaccuucaucccgaacuuucugucagguagccacagacuccgaaggaggaagggauguugcccucugcuucauucaaauucuuuuucucaauuaugaaucacuuaucuagguugccacccuggcaacgucuuaaacuaugucccagaacucuggcccagugguucuggaacuauuguagcucaggguauacccacacuagugguuguccuccuacauuagguagccucccuaguccugagccucuauaccuacccccauucauaaauucuuccauacuaguuagaugcuuuuuuuuguuguuuuuguuuuuucgagacaggguuucucuguguagcccuggccguccuggaacucacucuguagaccaggcuggccucgaacucagaaaucugccugccucugccucccgagugcugggauuaaaggcgugcgccaccacgcccagcuuaguuagaugcuuuuacugcccuuguuucuuagacggggaaauugugacacauaacuuacaggguuugaguugaaaguaggucacauacgguguaaacagcagaacuggggugcugaauaugccuucacugucgacuucuagggagucuugaggaguguaugucauggagccucaguaagaaagacaauaaggaauuucuuggccuccauaacaacacuccaccuuguuccuuaguguggaucuuccaacaggacacccaggagcagccaaacccuguggacagucagggcuguguaugcugguucuuguucuuucucccaagaaaguaaagugugcagggaggacauguuuacuaaaggaaacuuggauuuggcucugguuucuacaagaaucuaaauccuucaggccuuuuaaguauuaggggagugaauaaguagaaacucacugcaacaucucucagcugguugccaucuuguuguggucuuaacuggagauuugaacacaaggaagaaauuggucuccuggaccucuccucuacauggaucagcccuaucugguuucacaggacuucuuucuuuccauugaacucccuuccuccaggucuuccuuagauucugagcuguagccgccuccagagauaacggaagugaucacugugucccacaguguugaccauggaagucacuaagugaaacuccaaauaaagaagugaaaagcaccauuaguggugaugggaagugcauggaugauagaauagauguacacacaaguuucuugaaccugugguaugucaguucaaaauuaaauguggcuuuuaacaaaauaauaaauguggcuuauauuuaauuuugauuccauuagcuacugaaacaaaagucacaggccgcagaaaaaccucuugucucucagauggaugacaaaaugcacccccaaauaauccagcagaacagaaaaaaggccucagauaaaucaaagggagacaagcagaggacagaaaaggccaagagcacuagggguucuguuacaucugcaccuacggacaggaagauacuaguaccucccacagauaccucuggaacagagcagaagaaaggagccaagaagaggacauauagugacaucucuucucaucaaggggcucucaagccuaaguggaaagcuacggaggcagcuguuaucuugaaucagcccacgcccacugaguaaguaucaacucugcuguggugccuggaacauccacagaaacaggugauccacugucuucaccaccaccguucggcccugguacagucuucuacccaacccugugauauuuguuuguucgucccuuguuucuccuagagugugggcugcuaaaggcagacccuauuauacagauaauacugugucuuugggccccaguguagagcuuggcacaagguaagagccaacaaaaacuuuuucauagugugugcuggacccagaaggacuccugugaaacccaguccugccuuuuugccaauugauggcuuucuugcauccuuuuauccucaguguggucaucuguacaguuagggggacugaagugcacuauguguugcuuagugucuuuugccugcuuaaugagcacugugauaacaccuagccuggaugggauaugcuuauaaggcagguuggcuuccugcugccuaggauuuuccugccuucccuuaaaccuaaagaaaaccuuggucugggauuauacaguggagggugcgggcaaaggggaaggagaacauuucuuugggaacugguaugggaaguguguuuaugagaguugugucagaucaagcuaagugagcccaugacaggcuacaagauucagcugcugaaggguaaagggacgugaguuuaacugcuucugcugaguuauauaagcaggcuggauuggagagacuacaaggccccucccuccuaaggcugauauaagcaggaaagacacacaggcauuuuacuuuagcauuuguguguguggcaggaggugucaggguauccuagugaagaaagcaaaugagcaggaagcaugcggcccaucaguugaaccuuuugaguaaagauacugaaugucuggaauucaccagauagccaugaagcacccaguaucaacucucucaugcuuccaaagugugcacaggguacaaggcacaggucccugucuuuuuuuaaauuuuuaaauuuuuuuugguuuucgagacaggguuucucuguguagccuuggcuguccuggaacucacuuuguagaccaggcuggccucgaacucagaaauccgccugccucugccucccuagugcuggaauuaaaggcgugugccuggcucacaggucccuuucugccaugcacuccucugcuuguguuucuugaccaguagcaaaccuauuguguaauuggaaaaugccuggucauuauacugaaguagguuacaugcuucuguuucacauucuguuuuaucuguaguucuccuaagucuuggauaauagauauauuugcaaauuaaaagaacaguagugagggcuggaaagguggcuuagggguuaagagugcuggcugcuccucuagagaccugaguuaagucuccagugccagagauccgaugaugcaugcccucuucuggccaucaggcgccaggcaugcaagugauaaauauaaugcaugggugcaugcaggcaaaacaggauacaaauaauaaaggaaugugugagagcagauucagcuggacugaguguggaguguagagggggagccauccugccagagguccuuucgcgaagcauccaucuguguccugggucuuuucacagccaggcauucucaucuuugucucauagggaagacaucugguuugaugauguggauccagaugauauugaggaugccauaggcccagaggcagccaugcugguacggaagaggcuggggcagaagaagaggaccaucucccuggagaaggaacaagccuuuggcggguaagcugagcucgggccauagcugcuggcaauguuacuccuucuggggcugggaucaugggaggaggagcaagcacugagccaugacugcccagcagucaugggggugcagaaugaggcuuggcucacuggccuagaaucccagcccgugauaucuauuacacuggggccuuugguuccccuagcuugacaaaagccuuggcccuggauugugagaugguaggcgugggucccaaaggggaagagagcaucgcagcccgugugucgaucgugaaccaguaugggaaguguguuuaugacaaguacgucaagccaacugagccagugacugacuacaggacagccgucagugggauccggccugagaaccugaagcaggguaugacugauguccauaagauuugaguguagugguggagaugguagcaggacucguuucucuucaacuuccccuucuguguuccagaacauggcauggcagggguccugacacugcuuagcucuuccccagacuuugcagauacaaaaggaaagauaccuuuccuggcuguugugcuguuuguguccugggcucuuggauuauuuucugucuuguggcaguagggaauaaacuggagcauguuaggaaccaggagggaaaucuugaagagugaguaggcuacaugguaggagcugggaggacagaucacagggucucuuugggaaauuagugcaguaauggcagagaggccuccagcaggauccuuguggucaugacauugaguacaggguaggggucagaagacugguucugaggcaggagcuagguagggagguagcuggaagaaaugagccaacauagcagagggaggcugggucugauuuauaauaggcgagaacaucuaggaugcuugagccugccuccuagggagaccuggagaccacuagggaugcaaccguguuuuuuuuucccccguuccucaccacccacugccuguuugcuucuccugguacccauggcuaacauaguaucucuguuguuccauaaaccguaggcuggccagccucucuuucuuuuuuuuuuuuuuuuuuuuuuuuuuuuaauuuuuuauuagguauuuagcucauuuacauuuccaaugcuauaccaaaagucccccauacccacccacccccacuccccuacccacccacucccccuuuuuggcccuggcguuccccuguacuggggcauauaaauuuugcguguccaaugggccucucuuuccagugauggccaacuaggccaucuuuugauacauaugcagcuagagucaagagcuccgggguacugguuaguucauaauguuguuccaccuauaggguugcagaucccuuuagcuccuuggguacuuucucuagcuccuccauugggagcccugugauccauccauuaggugacugugagcauccacuucuguguuugcuagcagccucucuuucuaucucagaagagagguugguccuuuagcucugaauagagcugggcagugaaguaguuuuggggcccauucuaguagaggugggggcagggugguccucgaaggcugucaacugggaaggagcagcacagcagacccuagggucugugcagccuccuuugcacugucugguucgcaaauccagucugacucuacuuaggaagucauaaguaugagaaugggaagccuguugccaagugucccugagauagucuaaauguuccuggacuucuagguuagcaguaguuugcuaacugguaccaguccacugacugugauuggcuuugaguggaguucuugucuuuuuuccaacugucuccagaagugggagcagagcacaaggcauaguggggugccuccuagcccuuccacuucccuggaaaaauggacacuucuagggaccuaccucccaccacagcuuuguguaucaugaagggccugaccuguuguuaccaguccggccaggaauggaaggaacuucccuuagaaucuuagugaguuauguguuguuaaucauuucuucauuugguuuucaggagaagaguuugaaguugugaagaaggaaguggcagaaauguugaagggcagaauccugguggggcaugcgcuacacaaugauuuaaaggugcugggcucuuccaugugagccacacaagccuuacaucccugucuccaaaagcacuacucuggaggcuuuuucauuuugauuuuuuaucuagacuugggauuucucuaggaauagugucagguaccugaugucuggcuguguucaagagaccacauuagguaguuuuuggagucccgacuacauuggggguuucagugccagaguauugacagcucaaaguaggggaguuuugaaugucaccuaccugacauggcagauggccuggugucuagcugugugcuccagggccagagacaaaucuaugcacccugucagagcccuaggguucuuguuauguguccaguuuauaucugggcauugcugcgaugcuggaagcccaccuaccuggguuuauuaaauggaucacuuuaaguucacaagcaaacugcugccuaauccauuugagggugcagcaggaaaaugggagcauagucgacuuggcaaaagggacaccucuguugucaccuggugugguagacuccagagacaagguuucuuuguagcccugcuguccuagaacucacuaaguagaacaggcuggccuggaaugcaagagauccaccugccuuucugccuccugaguucugagauuaaagauuacuuauuuuucugugcauugcuguuuugccuacccuaugugacagugccagauuuccugggacugguguuguagacaguugugagcucccuuaugaauucaggacauugaacccagauccucuggaagggauccagagcagccggugcucucaacugcuaagccuucucuccagccccagagauucuaaugccagacaucagagccuugccggguacaccaggaguuacacaauguaaacagaucuuguuuaauccuuugaggaauaggcuuuuguggguagcagagcuaaguguuaggggguugggagcagauuccaggggagcaguggauaugcauucagggacuucuccacggcuccucagcaucccaaguuucugaguugaauguugcugccgcuucagcuaucccuauaggaagggaacugaaugggcacgugcuuccucagggugucauuccagcuagucaccuccuuuagaggccagccacagccagccaguuagguaacugagcucagaggacucuaccgagugcuagggcaugugacaguggaccuuguccuuccuggaugugaucuguagugccacuguauucauguguuucaggaaccucuagaugggaguuuaauucucauucaauuauuuggggcuagagauguauguagcucaguggcagaaugcgugcuucguguguaaaggcccaggguuucgucccagcaccaaaaaaagaaaauaacaaauguuccaacaauuaaaaauuaaccaaagucaacugcucacugauaugaugagucaccuuggagaagacugccaccagggccacaccugccuccucuagugggucacuuuuuuggaccguaugagucuagaaguguguuacauugcggggugagcuguuagaucucacgucuugcucccccaugugaacaaccagcucagagaagucagcugcagguugacuuuuucgcaacaucguugaugucaagauuuuguuuauuuuucauuuauuuauuuauuuauuuauuuauuuauuaugauuaaguacacuguagcugucuucagacacaccagaagagggcaucagaucucauuucaugugguuaugagccaccaugugguugcugggauuugaacucaggaccucuggaagagcaggcagugcucuacaccacugagccaucucaccagccccuauuuuucuuuuuugagacagggucucacuguauaguccuggcuugccuugaacucacaagagaucuaccugcaucuaucucuagagugcuaggauuaaaaguaugcagcacaccuguucaagauuuuauuuuuauuaacaugguucugaauauugggcaucgccuuaagucagggaaaugaccuugcgagacugcuucuuccugaguguuagcacccagcggugccagcccugugagacgcauuguuacaaacugaauggagauacuugucauuuucuuguagguuuuguuccuugaccauccaaaaaagaaaaucagggacacucagaaauucaaaccauucaggagucgaguaaagguacggaaugaaugagucuugggccgugaguagccccuggcacugaccccucuggcuaaagggaucuaguuuguuuugguuucucacuuuaaccuuuaagaguacuugucacugaagucuggcaaccugauuuugaucccuggaacucccaugaaggcaggagagguuguccucagauauggcucagugguacucgguacucuugcaaaggaccugaguucaauucucagcacucaacgucagguuacucacaaucccuguaacuccaguaccaggaacucugaccuucucaggcccugcaauuaugugcacaugccaacaugcagccagacauaccuauauauaacuaaaaagaacuuaaaaaaauuaagccagguguaguggaucacaccuuuaaucccagcacuaaggaaguaaagauaggcggaucucuugaguuugaagccagccuggucuacaaggagaaacccuaccuuuaaaaaaacuaaaauaauuaaaagcacucuaccacuuggaauauugccagccccagcucuuccucuacuagcugaugagcaaugucauaagccauagcaggcugaugguugcagccguaagugccacauacuccuggugaaagggagagugcgggucacucgagugugcucaggcgccagcuguguccucugugggcacaaccuguggaagcaacacauucaguggaauucuuuucucuacagaguggacgaccgucucugaaacggcuuucugagaaaauucuggggaucaggguccaacaggccgagcacugcucagugaguaucauuggguuacagccccugacuuuuuaacaccuaugguucauuugaccauagaaacaggaaaggacccuaggcagagcaggcuuacagaauguuguuauaucuuacauauuuacauuucacuugaacucaauacaaagaauaauauagaguaaggauuuggacaaaauucaccagucuaauugaaggcuguuuguauacuuccaguuauugaguaauaauaccugagguggggacuucaugguaaugaggcuuagcugauuggagagaggccaaggaggaaggagaaacaggucacucuuggcagaacugacuggugccauuugaccucccacuagacccagcucugaaaggucccacuccccuucauugccacacuaggcuccugcgugaggguggaaccuuuccaaacccuagcaaaggagcuuuaggacuguaugauuugagguucucgguccuaacagguccuccuggccaggcagugugcuucaggagaacagguuccccugugcuguagccucugacucuuugaacccuucugccugucucagcuguugucugcugugaagcuccagcuuccuccugcuguggggccucccuuucugccccuguaaacagaguggcugaguuugaagcacaggaaguuagauucagauucugcuaaaaguggugcccugaccauuuuguaugguuuucuccuucacugcccuuccauagucacccagggagagagagagaggggugugugugugugugugugugugucugucuuggcuuugcagccucaguaguguggcugucaugaagacucaguaguuguaggguuacuucuguggcuguaguccuguguucucacuagcuggcugguggaacauuacugucugucacccagauccaggaugcccaggcagcaaugaggcuuuacgucauggugaaacgggaaugggagagcaguacugcaaaccggcgugccccagcugccacuccacagcaccgcaucaagaacucuuagcaccauccuacugcugucgccaccacccuguccgucagagacuucucaauccaguggcaguugggaugggguuaugaggccugucaggucuaugcacagcagggacucugucuuuggugagcuuucucagagccauggcugcaggcaugugagcugcgggaacuuccuccugaacuacccagggccuaaucauccagcaccuguguguugagguagacuggucagauacagggcagaagucagggguguagguucgaggaaggagaacaucauuggaauggaggagagugcugcagagucuaugucugcugaccaccugugcuaccacuuaacaaugagcauagcuggucucagccagggcacucagcaccuucccuuaaggagcaagaagcgccuucucugucagguaaggggauaagcucugcuggauccaagggauccaggcuaagggcguucagucugcugcaaaccagucuggccagcacagcaaccgcccauugaggacuuucuuaaagcuacugggcuggagguccuuucccacuccuuuguccuuugcuuggccuaagaugccaaugccccgccauguuuucuccagagaguccuuggggugagccuuggggcacagguacacucagaggucugagagccuaccauguggaacaguguaagcagaaaggccaucuucccacuguccugccagcagcuguucuggguagcagcaauugcagagugaccagugaacuuuauggacuuagcugacaacuccuagaacaugugcacccaugcauaugaugacagaugucugcuuuuaaugcagcuguggacugagguguggcucagaggacacuuguucacuaaguguaagacccugguauccuuuccuagaacugucaaaaauaaauggauggaucaaauggag

SEQ ID NO: 711 - RNA, 1934 nt, Mus musculus
ccuaaguucucuccaagcucccccucccacuccaguccuuccccuuuccuuccccaccgcccucuggacgcuccuccucucccucuaggucuuuggccccgcccacagaaugaucgauguguccgucugcaggcugguccucggugcucggcucgccacgccugcgacgcugccauggagacguagccgcggccuccuggcucugcccgggaccuggaucccuugcgucagcaggcccacgcguguccgcgagcgccgguggcaaagucugcuucgcuggagcauccgggcaagcggugacuuugcuggccgcuggggcguagggcucgcauccuuccuccuuccaguagcucucuacuccauagcugaggaccgcuucucucaccagcggagaggagacccugggaccgccaaccgucuguggguuauuaagggaccugcgauuguccauccgccucauccuuccgcucagcucagcucagcaagcugcauccgugaguaaccucgcuugaacacucuggcccauagaggcugcuccugguggugaggcccaugcugggccuguccccgacuccccuccccuuccgacaguuucuucccuuuguagugucacccuugguaagaguggaagacuggcuagaagaaaggaccugaaccaacgcuuaguccacauccccauuguguuuugagcgggguggacaggccagccccugcugcagacacccuggauacaucucuuugagcucagcaguauugcagcggcaguggacaccugauaagcuucccaggagugguguggagucacugucaacacuagagcacuuugucuggaauggcucucacguggcuccugaauggucagagaugugucuuggauucuccugcccuccugaggaucuugccuauggaaggucuaaguuaccuacuuucacuauuaaguugaacaaggacucccaaacccaacagccaucaagguuguuggccaacuaguuacaaagcacagcagccggcuguuccuggccuaggaggaaagccaggugugcaggacgcugggccugugggaugagugggcgagucccgcuggcagaaaaggcccugucagaauccuaugcccgccuccgguacagggauacguccuugcucauuuggcaacaagagcagcagaaguuggagucuguaccaccuaguacauaccugagcagaagccgcagcaugugguacucccaguauggaaaugaggccaucuuaguucgagacaaaaaccagcuuggggucucuagggacacuggccagucuaaguuuugcucaaucauguaauuccagggagaagacccuugauggccaugaagaucaagccgugguauaaaaacgcaacacccaagaaugucauccaacacuuuauuaggggcacaacagguaccuagaugcuccucucacugcccaagcccaggaaaugcuuccaaacaaaagggaagcaagagagacacacaccccgacccucaccugcugugagcugcugccugauauagaauggaucagguccaggguaaggaggugacucuucuugcagggucccagaucugucagcucacugcaguggcaugugaaaggggggcagugcugguagugacauuacugcguugugauagcauccacacuagccaccagauguggccucuuauauagguguguccuuaagcaaaaugugccccgaagugauuccaagccuaaucgaguguggggaaaguggauucugauggugacgaaucggauccucucuucuaccaggcugcgaaggcacucauuuagaggcuagcacuuccccccccccccauggcuaugcaaauguggggaugcauuuugucaaaacugagcuuucuaaauaaacaucuuaaaaacucuucccuuucucauuuuucuuguguaaaaccuua

SEQ ID NO: 712 - RNA, 1932 nt, Mus musculus
uaaguucucuccaagcucccccucccacuccaguccuuccccuuuccuuccccaccgcccucuggacgcuccuccucucccucuaggucuuuggccccgcccacagaaugaucgauguguccgucugcaggcugguccucggugcucggcucgccacgccugcgacgcugccauggagacguagccgcggccuccuggcucugcccgggaccuggaucccuugcgucagcaggcccacgcguguccgcgagcgccgguggcaaagucugcuucgcuggagcauccgggcaagcggugacuuugcuggccgcuggggcguagggcucgcauccuuccuccuuccaguagcucucuacuccauagcugaggaccgcuucucucaccagcggagaggagacccugggaccgccaaccgucuguggguuauuaagggaccugcgauuguccauccgccucauccuuccgcucagcucagcucagcaagcugcauccgugaguaaccucgcuugaacacucuggcccauagaggcugcuccugguggugaggcccaugcugggccuguccccgacuccccuccccuuccgacaguuucuucccuuuguagugucacccuugguaagaguggaagacuggcuagaagaaaggaccugaaccaacgcuuaguccacauccccauuguguuuugagcgggguggacaggccagccccugcugcagacacccuggauacaucucuuugagcucagcaguauugcagcggcaguggacaccugauaagcuucccaggagugguguggagucacugucaacacuagagcacuuugucuggaauggcucucacguggcuccugaauggucagagaugugucuuggauucuccugcccuccugaggaucuugccuauggaaggucuaaguuaccuacuuucacuauuaaguugaacaaggacucccaaacccaacagccaucaagguuguuggccaacuaguuacaaagcacagcagccggcuguuccuggccuaggaggaaagccaggugugcaggacgcugggccugugggaugagugggcgagucccgcuggcagaaaaggcccugucagaauccuaugcccgccuccgguacagggauacguccuugcucauuuggcaacaagagcagcagaaguuggagucuguaccaccuaguacauaccugagcagaagccgcagcaugugguacucccaguauggaaaugaggccaucuuaguucgagacaaaaaccagcuuggggucucuagggacacuggccagucuaaguuuugcucaaucauguaauuccagggagaagacccuugauggccaugaagaucaagccgugguauaaaaacgcaacacccaagaaugucauccaacacuuuauuaggggcacaacagguaccuagaugcuccucucacugcccaagcccaggaaaugcuuccaaacaaaagggaagcaagagagacacacaccccgacccucaccugcugugagcugcugccugauauagaauggaucagguccaggguaaggaggugacucuucuugcagggucccagaucugucagcucacugcaguggcaugugaaaggggggcagugcugguagugacauuacugcguugugauagcauccacacuagccaccagauguggccucuuauauagguguguccuuaagcaaaaugugccccgaagugauuccaagccuaaucgaguguggggaaaguggauucugauggugacgaaucggauccucucuucuaccaggcugcgaaggcacucauuuagaggcuagcacuuccccccccccccauggcuaugcaaauguggggaugcauuuugucaaaacugagcuuucuaaauaaacaucuuaaaaacucuucccuuucucauuuuucuuguguaaaaccuua

SEQ ID NO: 713 - RNA, 21400 nt, Mus musculus
uggaacaaaauuacaaggcaugaaaaucuuuauuuuuaaaaagagaauguauuuuuacauaaaucuacaacagaguucaacuguagaaaaaauaaacuauacucggggauacugugcucgacauggcaagcaagcucccucccucaggaggaggccgcacaccaggccacagcuggaaggaccuuacuacccuccagaaaccccagcaacaugcccacaacauugaccagaacccagguucaucuauccaacagacgccaggggccccagagcccaugucagugugacaagccacccucuuuaacaauggcuucuucgaugugauagcccauuuacacaccaucucccucaaggaagugacaauguaugggguuucuuuuccaauaccuuuggauucuuauuaugcacgauggagggagaaagggcugucaggaccacagcuggggacaagccuuggcaaaggcagaguagagcagcuacugcccugggugauguggcuucaauacacaucaguguuggccucacagaugguugcugcugcaaccagagcaaacccagaaucuccuuuccacccaugucugugcccagcagccuccgccacccaucuguacucccagaaccucugcagucugcuccacaguaggucacccuggguucagccagcagcaguugugaaaaugcuguguaguccugagcuuggccacuaccucuuuccaguccuggucaccugaggcggugaccuggggcgggggccaaggacauaagagagguuugguggguuuagaggccaaggcaggaagcuguaccugcuggggcaagcaccauauugaacuccucccuccugcacaggugacccugagccucucacagaauaaagagguccagaaccucacuacauggugccuuuccaagacuuccuuccacucuuucucaucugagguucuuccucuccaacacucagcacccacagcagccacugggaagaagaggcacaacaaggauccauccucccagagaccuuuccaacuccugccaggaagggaggagggcuuuauaaagccaggugucaaagagccuggucagaacucagggccacacccaguccauacccaccuuuuauuacaguguguguagcuuacugagugauaccagugagacaaggagacauuucaaccacugagaggucaguguugaccuaugaacuccaaaagaacaaagggacuugacacggauacaacuuacaaccuuucuguguuuccagaaacucauggaagcacgcuggguacuauuacaggcaggaaaauugaacaagcaggccagggcaggaggcagggaaugggaguagggcuguagguccuguuccagugugcacugggcaauacaauaccaaaacaacaaccacagagaaaaacaacccaugaggagcugaacucacucuuguaauaaaaaaauuaaaaauuuguugccucugagcacagaacagaccaggaacuuccccaggcagagacagaauuggcaagaaauaucacaguggcuaucaagacucgguagugugcacuccccugagccgacaucuucagauaggaggugcaccaggccugucaacccagccuggccccaugccucugccccacauguguuucuugccaauccggguggcuuccuuaagucucccauggagccaggacuuagcagucacucuuccacaguuugauuguuuugucguucucuaacgcugcugaggcaaugauguucucugucgggugacaagccguggaaaucacaacaucugaaaggagaguagucagggagccacucuaggacaagcagucccagcacaugccucacugcccucaggagcacagggagcaccgcaggguucaggggagugcucagaaugccagaauaguaacaggcaucuuagccuugcucugcugggcacaaggcacuugguggguacccagcagggucugcacaccugucuacacuggucucaggacugacuaugcccacuugcccccuacuauuccugagguuguucuaccugagcacaagguaaccauacaucugggcagggauacuggcauuacugagauggcaugcaguccacuaacccugcuugcucccuggugcucagguuccacagcaagugugaccaagccacucccagcugaagacaacugcuuuuucagaaaacgagcucuccacuccuuaggguugcaaaggagcacaugauaucccugccaucccuggcccgcuucagaaaguagacagggaagaacuagaaugagguaacuccauagcuggacuaaguuuugcaggggaaacagaaaaccagcaucccugaaagaggcugagccuacaggaaaugugggcuagacacucuccauauucauggaguccuagucucuaaagugaaguaaacaagcuauauuccuaugaggcuugagucugacuuaagacccaaaagccagccauguccaagacccuagauaagagcccuugaugcugccuccaaggcugaucauaggccuucucaggccugcagggcugggauggcagggaaaacagaguagcaacaccugcugugugucccuaaaccccagagacaaccaagcaccuuggggaacugagaggcuccccuggguggcuccacccacccguguggccuaucugcaauaacuacccaccugugugacccugcaacuucugcacaaucuccuuggucugcagauuccagauauacaccagguuaucuucagaaccagacacaauccacugcagcaucgaaagaacaagcaggcagugaggacaggcaagaaagacaucaggugauaugcugaauagguagcacaggcaagcuggcugcgguuacucuaauuaauaccuauuuccccaauuuagggacaugcuaaaugccucccacggcacccucagucacuggaucuauccagucaccaccugcucuuagaucuucaaccauauccaagugcaacacaccacagauucauucaaaacgacaaguguggguuuguuccauaggcuuagggaugcuucauaaagacaaaaagccaccugugauggguggccucuuagagagcuagcaggauaacaacaucucaguggaaacucaccuucccgccugucacggagaaguuggcaaauaugcaguacuucucauucuuguggccaguguaugucuucaggcacugaaaagguaggugugcauuguuagcacccgugguuagcuuucauuccagagcauuccaaauucuggguacauacaccugacugugugaacaugcucucuaaauauucuagacauacacaaggcccagacuuuaacgugcagacuagucauuccuaaaacauaucuuuaaagggaguuguaccauacuugcucaucagaagaagaugcccaagucccuccugcugcaacucauggguuagcuauaccccccucaaccuguuaccugggacuggcaugcaggccagaccggccacaugccugaagcucaccuuccccuugcuguagucccagagcuucagugugcugaaagacagagagugggagugaggggcaggccaucuuuggcacgccuugccuccccugaugccaccguauccuaacaaccgugagucaggaaagaagauccucuaguucaccaagcccagccacuccgugacacacaaaagcaaacacaaggaccuuagugcucagcucagaaacaggcugaagaaacagauugcugguugucuucccaaaacuagcaguuagccagaagcagaauguggaaagccauguuggcuccagaaacacccaguacaggugccacaggaagagacucaugccgaccuuggagaagaguggaagacuaaccagaggaguuacagagacaaaguuuggagcugagauaaaaggauggaccauguagacacuagcauauccggggauccaucccauaaucagcuuccaaaugcugacaccauugcauacacuagcaagauuaugcugaaaggacccugauauagcugucucuugucagaguaugccugggccuagcaaacauagaaguggaugcucacaguuggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacucgaaagagaggcccauuggacacgcaaacuuuauaugccccaguacaggggaacgccagggccauaaaaggggagugaguggguaggggagagggggugggugucuaugggggacuuuugguauagcauugcaaauguaaaugagcgaaauaccuaauaaaaaauggaaaaaaaaaaaaaaaaaaaacuaaccaggauaaugccauucaggcagcucucaagagcuaacuuggccagguuccuuagagacuuuguacagugugugccagauuaagugagcaccuaagaggaggucaucauguauggcagugagauuaugcugcgugaagaugcucagagccugggaacuggcaggaacaacuaggugucaaauccuucucauacuaaaacuagcuagaguggacaguccuuucuucaaccccucaacccacaacccaagaacgaacucuuaaugcagauauaaaagaguucaacuggacaacugggagaagaaacaacacaacagacaggagaggaaccccaccaacgaagaagacugugagcucacuccucagggaacugaagcacucacuuguccaaaguugcagccaggauguauuugccauuuggagagaacuucacgaaggacacuggaggauugucaucaucuacacagaagaaaaacaggcugaucuuuggcagagucgagaugcaagucagcucccaguuacccauguugacuguguggggacccugccaccaucacucuagaaggacaccagagagcuuugacaugccaucaccuucccuggccguucacauucuuaagucuucacccagugcccugccaacaagccuccaccacauaaggaaggaggcccaaagcucuccagcacugcugaagaacugauccccugaagaaagcugccugaccuagggggucuuagagacaaccgcccauucuucagccaagcaaguucuccuuucuugauggccuugccucugccuccugaagaccagguugcugacuuuagccucagcauuuggcaagcggggucaaggcugggguguugcacugcugagcagccaggccuccaacaaauugcccacauaaaagcugcuuuccagagcacaacaaagucauauccuucugcacagugggccaaugcggagagcggggagggcccugccccucgccuggguaaggagaacggauccugaggugggccugcucggccagccaaggaagcauaccaggcccuaaagugugcauacaagaggcugguguacccugacacacacauuaccacaggggguucgcagggggcuccguuucucgugacuggucacaaacacugaaagggacacgagagaguaacugggccacauaaugcuauuaguucggcugacauggagcaacaccugugcgccuuuccaggccaccucugaaacagaugccugcagaaaucaagaccugugccacacccuuaaucccacccagcauuccagggugcaaaggugaggcagaucucauuuugaggcuggcauggacuacagaguaucaagacagacagaaauauaaacaaaaucugucucaacagcaucccauccccugcaaaagaaugucuaaacguuaaugucuaaaccugaagaugagaagagaaauagaccuugggccaaacaggccugccuaccucaauccaggccuuacugcccauugccuacccaaaucuaaauccuggccaugcaccugguugccuuucucagacuagaguuuagccaacaauagauauaaaacaaagcaccugcugggcagugguggcgcacgccuuuaaucccagcacuugggaggcagaggcagaaagauuucugaguucgaggccagccuggucuacagagugaguuccaggacagccaguagugcuauacggagaaacccugucuugaaaaaccuaaaaaaaaaaaaaccuacaaguuucaggcacugcugagauggcucaugcacucgaugcacagaccucacaguacaagagucuaacuccuaaaagcuuucucugaccucuacacaugugcugagcacagggaaaaacauacacaagcacauggacauguguauacugggaaacacacagaccaauuuaaaaaaaaaaaagaaaaugcacagaucacagauuuuguugggcaucaaauuacaaucuuuaaucccagcacucuagaagcugguagaucucugaguccaagacaagccuggccuacaaaaugagcuccagcccagccagggcuacacaggggaaauccugucugucuggaggggaagaaaagggguggggagggcagggcaccacaaaaccaaagaaacagaauuucacuguucccuaggacaacuguuuaacugaagcaaauguaaccaacucuagcauucccucuuggagcugcauguaauggcugcaucuaaacuggauaugugccugcacaucaucccacaguaaccacugccuccuggcacgguacaucuguagacccagugguuuuuuuuuuuuuuuuuuuuuuuuuugguuuuucaagacaggguuucucuguauagcccuggcuguccuggaacucacuuuguagacgaggcuggccuugaacucagaaauccgccugcuucugccucccaagugcugggauuaaaggcgugcaacaccaugccgggcuauacccaguguuuugaaccaccucaagacuuaaacugcaguacaaaguacacaagucaccugcaaacacugcaccaucucacaggaaggaccugagcaucggaggauucugggaucaauggaaagucuuacaacccucucccagauauuacugaggggugacuagacaugcuaugcagcuuucuagcuagcuggcuuuuguaucuaagaugcugcccuguaaaugaaggaugacacaggguagcagauguucacaagcguugauacacaagcacuagggguaugcuggaauagccgcugaguaacauacucagcaccagacaguugccuggaagagaagauuggggaaggggaugguaagacaggacauuacuaccugacaucugugacugcucugaaaaaucaguaaaccccaagaguggacacagagcaagaaaagcuuaaaagccauuaucccagguugugucccgaaacuuaugaagacuauccauucacaacucaaguaagugacaguuuugaagagaacaucacacagaugaugguugagguggggagggguguugaauaugagcaugccauuaagagcugggcacagagaagcacaaggguaugcaugucaucuguaggcagagugauaucagaggucaccauacccaugaccuguucccuggccaccuaagcugccauagaggaugagcuccugauucuuggcauucuauccuagcaaccuggcaggccaagagcacuacacucguuucccuaacagucuaaggagguagcaacuuaccacaaugccuaucuaccccgcaaagccaaacugguaaagaaacaggccaucuaagguucugaacuccagccuagcaaguaacagcuucccucccaacaccucaucagcccacucaccugugagcccagaccuguccugcuccaacacccugcccaccuugcaguacacuauaguagcaaauguguauccccaacuccaggaaggaagagaccacuggcaggcugaggcagaugaacacagguagaggcugcagggccccaaagagcuacagacacuauucaacaauguaaaacaagccaaggaccaaccccacaugagcaugagagaagggggacaaguucugguaaacguucguagucaggaagaaaggugccacaaguccugcagaauaagggagcccaggccagaaggaaagaugacuuucugaaaacaaauacucuagaaggcccaccaggacacggcagccacccaccuccacaaucccuaccagacagagcacucaccaaugagugucuucagacacuggccagaggcggugucccagauucggcugucaagcaagaagauaggguaugagaaagucaauugcuggugagugcagucaucuauacccccugaguucugggagggcauuucucccaauucccauaguauugcacuucacccuucucccacagcuuuaacaguuacucugucucuagagacugagugagaauaucaugugcacacauggguagacuucaccugaggacaccuguccuccagcuaggauuacagagacccugucucuacgcuuuuaagcccagcacuugggaggcagaggcaggcagauuucugaguucgaggccagccugaucuacagagugaguuucaggacagccagggcuacacagaaaaagccugucucgaacaggaaaaaaaaguuagggcuggagagauggcucagugguuaagagcacugacagcuuuaccagagguccugaguucaauuccuagcaaccacaugguagcucagaacuauccauaggaaucugacucccuccaucggugugucugaagaguguacucacauacauaaaauaaagcuuuaaaaaugguaaugguguaccccuuuaaccccagcccucaggagacagaaacagacacagccugguuuagacaggaagaaacgguguguguguguguguguguguguuugggggugggguggggcggcacagcaaacaacaaaaaagcugagcaguaagucgugccacaucaggagguggaucucuguaaauaugaggccagcccuggucuacaaagugaguuucaggacagaaagagcuguuacacagagaaacccugucucaaacaaaaaaaggaugccuguccucucuauacagccagugugcuguuaggaggacaaaauuguuacaaaaugacgacuguaccauuuacuggcacauaaagacaaauuuaaaagaaucaaaaacuaaacaguuauuuauaugguccuuuuccuuuuucccuugcugcauugaauucuugccauccucauuugucacuugggaaauauaggugagcguaaguacagccaguaagcggcaggccagaauagauuccaaaucugcacugcccagccucucuggaacccaggaccugcgcuguccagcaugcgcugaaggguuacacauuugccaggguucaugguggcugcucuuuuuaccuggaauuaaccagguagaugauggggaaagaucucuguuaacagucaagugcuagggauauguaggaaugcuauaauaggagagggcaggagucauggagaccgauacugccugagcacauagccuacagaguucaggauggagucaguaucagucacugagccuguguggagaaugcauuuggauuuuaguuccuuaguguuuugcugaauuuaaaacugaauuuaagaaacugaacuaaaaaaaaaaaaaaaaagaaacaagaaaaaucaaaccgcgggcuggagagauggcucagugguuaagagcacugacugcccuucagagguccugaguucccagcaaccacaugguggcucacaaccaucuguaaugggccucuucuggggugucugaagacacugacaguguacccacauacaugaaaaaacaugaaagaaagaaauaaaauuuaaaaaaaagaaaaaaucuuuaaaaauaaaauaaaauccugggcagugguggcacacaccuuuaaucccagcacucgggaggcagagucaggcagauuucugaguuccaggccagccuggucuacagagugaguuccaggacagccaggacuagagacuauacagaggggacgagggcuauuagagucuuccaguccucugugaacucagggcacccaccucucuacugcuaaucuuggucaucuuuagucuuuuuagcucuaccuuacauaacuguuuccuguuucuucccacuccaccauuuuuuugucuucgaguauacuucuaccuggggucucuugugccgcucugccuaugacaaugagagcacucuaacacacauuggacuagcccaacugaaacaagcuuuaguggacuuuugaaagaauuguccuuuugcuaaaguuugugucacccccaagaagagaaaagaaaauguuuaguucauaucacucaguguucucuguauguggccaggaaacaaauaauguugccaacuggcccggcccugugcagucaaacagcagagcuccagcugagcaacugcaacaaggcucaacuccaucugcagcagcacugaaauaaauaaguucaccuucucuccauucugucuagguuuuccuuucugucuuuugguggcagugcugccuggggcacagaaguuucuaguugcuuugguucacucuagaccacucuucccuguccugaccuccaaucaacucuaaggacuuugcuggacagaugccacuuacccacccugcucaaacacuucguuuagguauauuauauuuagguauauuucaguagccuccaagcuaagacccugagugaggauacauaaccagcccaucaccaccgccacacacaaacagugugcuucacucaccuaccacauuacuuaccuugcucucuaucaacacagagcaucaacacgcacucaguuaugaaggcuccaagcuucaagugcaaguacauagcacuguacucccaagccugccuuuugugaccuacccugucuucugaggaacccuaagcacuuccaccuagcagucaugucuacaaugccauccacugcuaaaaagcucugcaccauaccucuggcuucuuuucuucuguuccacacaaugggaucuggugguucaccugcccagagcucaugggaucugugaacagcaccacugcacuuacaagggcucagaccuuuaacucacuuucuacaacuuugaaaggguacacucaggggcaugcaaggagcucccagcucucacucugcccugggugcccucaccuaucaucuaccuuucccuucauagcuuuucauccccugaacucugcacccaguggggcgcaggccucaggaggaugaggaggcacaggcccccacuuugaugcaccacagagcuggaacaacauagcaggccauaaacaacaggucaccgacuacaugaagacucucacuuaccagaggccaucauagcuacuggaaacaaucaaugauccaucacgguugaaaugaaccuacaaaauagaggaagagaagcugauuucucucucucucucuuuuuuauucuuuuacacuccauauuuuauucuccgcccccaagcugguuucuaauaaguacuacaguaguauguuuaucuaaaucucgagggcaucuugcccacagagcucaccacaauccccuuugagcaccugacaaagcuaauacaacuuggggugggggugggggggcaccuucucuuucucaccagcaaaaaagcaagagcuuaaagucaggagacugguccacagguggccuguguucauucaucagccugaguuucugauaucuagaucacugccacucuagaugcucagugguauauagucccagcaaugagagccaggccaccauaaacugugucucagaggagacgcuuaggcuaauaugcaaauuucagugagucccuggugcccuucagguaacuccaggcccuuauaacuuacuguuuucaguuugucuuacuuuuugagacaggaugcagcuaugguugauuuugaaucuacuaaguagcuauagcuucuaacuccuaaucuuccugccccuuaccaaagugcugggcuuacaagccuguaacaccaugccuguguuuauuguauacaauacuggagauggaauccaaggacuggagcauacuaggcaagcauucuaccuguguaccagauacugggucacaguccaacccugcuuaaaucuuagugccaggaauugaaucuaucuccccaaauuucuauaacuuucacugagucuuugguaggugugacucaagauaaacuuuuuacauaggaacucucagugcaugauauggugacaaacuugagaaauguuccagcuucagcuucuugggcucacuuguaagcagccaucagguuccagggacucugccaucacagaccugaugggccagccuggucuaaagcacuagagccagaggucacuuucuccuguugacaagugcaugucagauccugaacagcuacucagccacaacugucagucacuagaguuccuuccuuaggucaggcaauacaacuaacuacccacauuuaccucuacuuuuaauauacgaaacaaauugucaaacauaaugugguaaggggcaaacaugggcccccgacguuuccaugcagccaaugugcagguagcagcuuggagaaacaagcaagccagcccacaggguaccagucaacaggacucccuacuggggaugagacacagugaacggcugaggggacacugauacaggcaaaggcuauagcuagggagaguauacaaaagggcuucaaggcugggcauuaauugagucaucaacuuggcacagaccuaggcccccccccuuuuuuuuuugguuuuuccagacaggguuucucuguguagcccuggcuguccuggaauucacuuuguagaacaugcuggccucgaacucaguaaaaagcuaccugaguugccaucugcccaacagacgggaauggcuggccaaagguucaagugaccacagcuccaggaaccaaaaugggauaagggcaagcggcugugcaggguguucucagacaguuuuuuuuuuuguuuuuuuuuuuuuuuuugagacaggguuucucuguauaguccugguugguuguccuggaacucacucuguagaccaggcuggccuccaacucagaaauccaucugccucugccucccgagagcugagauuaaaggugugcgccacgacugccuggcaggcacaaaaaggaaaucuugagaacaugccucuguuaagacuggccgguagcgaucuacggggcguuuccuugauuaauuaaugauacagggccucaacaguuagugaugccaccuuuaggcagguaugaaaacuuaaaaugacuaaggcacaaauaagacaguaagcaauguucuucaggaccucugcuccagcuccugccuccagguucuuguccuaacuuccuucaauugugcaacggugaugugaaaaucuacugggcacugccagacagaccccgcagagcuccuggggaccggacugucaaccaaagagcacacauggagagacccauggcucuggccccauauguggcagaggauggccuuguuggacaucagugggaggaacagcccuugggccugaggagguuugaugcccugguguaggggaauaccagggcuggaaagggggggugggggaagcacccucauagaggcagggggagagaggaugggacaggagguuucuggaaggggagaccuggaaagggauaacauuugaaauguuuaaaaaaaaaaaaaaaaaccaccacacacacacagaggggagggaugggcacaccuauauauaauuccagcacucaggaggcagaguauaugaaugaaaauggcccccauaggcucauagggaauggcacuacuaagagguaugaccuuguuggagaaguguguuuaggaggggugacugagguuucaggagcucaacccucccagccccccaaaaaaugccagggugguggcacacaccuuuaaucccagcucucgggaggcagaggcaggcagauuucugaauucgaggccagccuggucuacaaagugagugccaggauagccagggcuauacagagaaacccugucuugaaaaacaaaacaaacagaaaaaaagcucaagccgggcccugugucugucacucucuuccugcuacuugcugauguggauguagaacucucagcucaugaugucugccagcuuccaccaugaugauggccuaaaccacucaaguaucugucagccagccccaauuaaaugguuuccugugaucaugguguuucuucacaacaaugaaaacucuaagacacagaggcagauagaucacugaguucaagaccagacuagucuacauacugaguucuaggauagcaagggcuagagacccugccuuaaaaaaacaacgacaggggcuggugagauggcucaguggguaagagcacccgacuguucuuccgaagguccagaguucaaaucccagcaaccacaugguggcucacaaccauccguaacaagaucugacucccucuucuggugugucugaagacagcuacaguguaguuacauauaauaaauaauaaaauaaaucuuuaaaaaaaaaaaaaaaacaacgacaacgacaaagaccaucuuuucuucuuguacaucacuuugacaacacaggcuagagucauuagagaagaggaagccucaauugagaaaaugccuucguaagauugggcuauaagcaagccugcaggacauuuuuuuuuuuuuuuuuuuuggggguuuucgagauaggguuucucuguagcccuggcuguccuggaacucacuuuguagaccaggcuggccucgaacucagaaauccgucugccucugccucccaagugcugggacuaaaggcgugcacaaccacauccggcaggacauuuucuuaaauuagagacugaugggagggccagcagaaugagcuggugguccugaguucuauaagaaacaggcugaggaagccaugaaaagcaagccaguaagcagcagucacuuuuuucugagacaagguuucucugcguagcccaggcuauccuagaagucauacuguguagaucaggccuaccccugucuucugagugccagcacucacucacucacuucugcacucacucacucacuucuccacagccuuucuaucagucuugcuuccaaguuucagcccugcuugaguuccugcccugacuuccuucagugaugggcuacaauauggaaauguaggaaaaaaaacccuuucuuccuuaacuuguuuuuggucaugguguuucaucauagcaacaauaacacaagcuuaggacacuccaaguugcuuuuggccacuguguuuuaucagaauaauagaaacccuaggaucucaccucacucacuuaaaauucucaugacucccuauuuuccaaacugucagcccauuuugaaaaagcccauucaaggaaggacaccccucuugaaaaaucccugucaucuaccucccagcccacagagugccccaccuaccacccaccacccaccacagcucacaggccucuggucacugggaugcuacacgugagcaaaucaagucggcucauccagaggaacuucugaggacaggccaggaagacuacuuacggcugagacuggguccgaaugggcaggcaaagucuugaggcacuucccugucuucacgucccauauccucacacuuucaucaaacuaaaggugagacaggacauuaaagugauucuacaggaacaggagcagcaacagugugaucucagacccagaaccuguccccacauaaaagccaaacugccuaccccaaccaagcacaauaugacacuguacacaucacccuuggaggagaaaccacgcacuuacagacccugagacgaugagguuggacuggggguugaaguugcagcagaagacguaguuacuguggcccuucagggucuucagacacuuccccuagagcacacauagcauaccaaggucugugacuuccaggggcugaaucuccaaauacaagcuucuuguacauuugaagaccuacccaagaccaaccaucuacacagccaacucaucucaacuaugggcacucccuggaagaccagugucacuuacggaacucacgucccaaaucuucaaaguuuuaucaucagaggcagacacaaggagguuagaaucugaugaccacgcuacaucagauauucccuugggaagggaaaaaaaaaacaguugguuuugagggacaaaaauccaaaugaccaguaaaagaucaacccuacuaaccuauacaccaugcugucaggaaauccagccaguguuagcaccacaaaacaccuggcccagaggaaaaggccaguacuuucagcucuaccaaacuucuuagacucacuccccuguggaggcucaaagugcuugugcuugcacuaaaaauauaagcaagccagguaugguagagcaagcccgauucuuaggcaggaggauugcaguuccagaccaaauuggacuacuugguaaggcccugcacccacuacacuuaaaaacaguccugacaagcccaaguggugguggugcacaccuuuuaaucccugcacuagacaguuggaugcaaaggcagccagaucuccauuuggaucuccaaguugaaggccagccugaguacagcaagggcacccagccacccugcucaacaccuagugcaccuaaugggaaacuuaccaguuugugaccagauauaguuuucucaaacuuuccaucauaugcuccccaaauuuuaaugaguuuaucagcagcugaaaggaaugaaagggagcugaagucagagaaggcuguggcuguacagucacccaaaggaaggaggccugagucacucaaugaacuaaguauggacacacagaaguacacccuucacugcagaggggcaauagcaugugaacaggcaauuacuucaguuccauacaaacaugcugaaugcuaaccaacccagagaccaguaacaacuaacacaguccagccuccucauccuccuuccuccaacaaaguucagacgccucuccaaaggacugaaggauacucacaugaacuugccaaccauuccccauuggggcugaacuucacagaggacacagcuuugguguggccagccagggugaacuucagggcauaguuuggcuuaacuggugugggcuggaggaaacaguacagauuagccagaggcaacuaccaccacccaaucaacccacuugauucccaaaguguaaucaagcacuagcugguuccaaacucauacacaagaacuuacuauaaccuuaucugaugucccccuuuaaacugccagugugagccuagcaccucucuugaaagccccgacuuucccugaaguaccuuagcacaccaagaauuuguaauuuuuuuugguaugguggugcaugucuuuaaucccaggaagggagagggaggcagaggcaguugagucucuaugaguucaauacuagccuagucuacaugucgaguuccucaccagccagggacuauaggggaaacccugccucaaaacaaacuguacuuuuugauaaauacccucaccuccaucuuaggucugggacucccugguguggcaccugacugcucugugugaccacuguugugugcucagaaauacuggcagcauaccucacugggcagagaagccuagauuaauaaaauaaugucccugagaaucucuccagccugugggacauaccuugcucuguguggcugaugaggaaggagugggcugugcucuugcagccucugucucuggcuucuucuccucuguggccauggcucugaagcccacagggcaggacaccgugaagggggagucacaauggaagaggcugucagcugaacucuauaguaaggggccuauaaacaaauccucucuuuaacaaagguuguuggagaaauaguucaguagcuaagcucgccaaaugcaguuccagaagaccuaaguuugauucccacuugugagcuuacaacuaucugugaguccagcucagaggaucuggcauccucuucuggccucuguagggacugcaugcacauggcacacagacuuacaugcagagagggaaaacaaaaguuaaauaaaauuugcccugaugugguggcgcacgccuuuaaucccagcacuugggaggcagaggcaggcagacuucugaguuccaggccagccugaucuacauagugaguuccaggacagucagagcuacacagagaaacacugucucgaaaaaaaaaaacaaaaacaaaauaaauaaauaaacaaacaaacaaacaaugauucuggggcuggagagauggcucaguggauaagagcacugacuguucuaccagagguccugaguucaauucccagcaaccgcaucuguaaugugaucugauguucucuccugguaucugaagacaacuauacuguacuuauaaauguaaaauaaaucuuuaaaacauaaaaauagaaagauucccaagaaaaagaauaaaaaggggggcuggugagauggcucaguggguaagagcaccugacugcucuuccaaagguccgaaguucaaaucccagcaaccauaugguggcucacaaccacccguaaugagaucugauacccucuucuggugcgucugaagacagcuacgguguacuuacauauaauaaauaaauaaauaaauaaauaaauaaaagaauaaaaaggagaaacacgaccaccacauugaacccuccaacaaaucaacugucccaagcuggggauaacugucacccuaucccagggcugacgcuucagacacucugugugauggccuaggcuucccacuguagcagacagguguauacagggaugugaguuugcuucaaagagcccuugacacaguauuuaaaaggcuuucuaacagaaacaacaggccaaguaacaggagguagacuuucugugcacaagucugugaacuuacccaaauucuaaaauacacccaaauaauuugacgaaacacaguggccucaccuccucaguggcucccugugaccucauaaacugcaacaugccuuuaacaauaccuagagcuuacagagcacagggacucagugcacaaaguacuaccgaaagcgcuccaagaauaaaacagaguagucacugcccccaugugaaagaaaccucugggggagcagcacaaacaacagcagauaagcugcaggucugagggaaaguaguuauuccagucagcuggacagacucagccugaacauguaugcaacugcaacaguuuacugcaguuuacaggagggcccaucaccugcacgcauccagaaaagcacaccaccugacugggaaaugagcuaguacuccucuaacggagagcuacugagacauuccucagccaucaauguaaggagcaaucauaauguaaagucuggcuuugagguuaaaccugaaaccucacauggacccccacauaagacuaagaugaaaggacaccaaaagagaacaaugccucaaagucuucaauccuagaggaaagaacaggaacaccaugcaccacacaggugcagccaagcuguuuuaccugcagccaucuccaucaaggucaaauccgcuguagcucaagcccaggugcaaggaucagacuaggguaggucccaggggccucuccacaaacaaagcucuugugcccaggaaauaccagcugcuuggugcuuuuagcuuuuuggagacagggucuugcuaugcacugguauuaaaaaaccagucucaagcuugguaugguugguguaacaggcauaaaucaacuaccaggccugaccuggugcuuauucuuaaugcaacuauggccaugaguucccauagcaaccacuuuuguggaccauacagguagcaacaggagcugagacuuaaguaaugaaaagggcuagaaagucucuuucaaccagcaucucaucucccuacuccagugaaaugaaaggccaacaguguagggcagaucuaucuccagugugggaagucucuaggaacuaagcuucuuuuagcauauaaagagauucaccuaacagcagguggaugaccuugccaacaagcacaccaccacccagcccugcccaucacaucguuaauaagcugggucuuucaggaagacaaauauuaacaucugaagacacuaguuguagcaccacccacuuuaauuccagcucuaaggaugaagagcucuaaggaugugggccccaaacaaccaaccaaaaaacaaaaacaaaaacggggaagaaagaaagaaagaaagaaagaaagaaagaaagaauaucaacauuagccaaucugccucacagcauucaggaggcucaggaauucaaagcaguuaaaugugaggcuagcaucaaccugaaaccggcucaaaggagaccaccacuuuccaauuccacaggguagaguccaagacagagcacucaggaaagcaggacuuggggagggcaggucugggaggaagcuggguuaagcaggauccucagcaggugguuuggagcuggccuccacugcccacaaaggagguagguaaccggcagccgcagccggggcuuuacacuagagugagccugacuauggaagggcagcagccaucagucucccuccagucaaauguagacuccugguuuccacccuaguacacaaguaugggaagacagaaugguucagucacucaggugagugcaguagguaacccaacaaagaacuccaacccauccucucugggcuccuagauaccuagguacuaguagccuuggcuucacaccacugugcgcucaacugcccggcugucccggacaauguucagaaacccuugaccggucagcccuagucagguagaaacuugcgcuaggacacaaaugaggguugugcccgcagcacgagaggcgccaaguggccaaggaaaccugcgcgacgcuggcuggguguccccgaugagacagagaauuccacucccagugacgccagucugaggugugagucucgagaagcucgcaggacuaagggucuaggggcguagcaggggccgcaguggaaguagcgggccguggcggccacaaggggcggcggggucggggcgcggccgcaaaugcggcguccggcccggcccgaggcccucggaacacgugcggcgcuguggagcccggagcccgagggcccucguggccgccgcucgccucgcgcccgcgggaccggguuucucgcuuaccugccggggccgcggcggcggggccgggcgcucuggcgucgcgucggcuagcccuacgcgcgagagcagacgaucugcuggacuaggcggcagcggcgcgggaggcgggagggauugcgcgugcgcgaggggcgg
